United States Patent 10,407,724 (METHODS AND COMPOSITIONS FOR SCREENING AND TREATING DEVELOPMENTAL DISORDERS) - sequence listing, part 47

SEQ ID NO: 951 - DNA, 112231 bp, Homo sapiens
ggctcagtagcgatagcagcggccgtggaggtggcgttggggactgttttctctcggaggccggagcggagccgcgtctgactgaggcgggcagcaagcggccccctcgctccctccctccctcctccgcgccctccccgccgccaccagccgtcaaacgccaaccgccgctcctggggaggagccgcggctcgcggggccggagccaggcctgcgtccggacatcagccggagccggagcgagagccggggcctcggcgtccccgccctctccccgcctcggccagcgtccgccgggcccccgcgcgtcgcgccatggactcggacgagggctacaactacgagttcgacgaggacgaggagtgcagtgaggaggacagcggcgccgaggaggaggaggacgaagacgacgacgagccggacgatgataccctggatctgggcgaggtggagctggtggagcccgggctgggcgtcggcggggagcgggacggactgctgtgcggggagacgggcggtggcggcggcagcgctctggggcccggcggtggcggcggcggcggcggcggcggtggtggtggcgggccggggcatgagcaggaggaggattaccgctacgaggtgctcacggccgagcagattctacaacacatggtggaatgtatccgggaggtcaacgaggtcatccaggtgagggtggccgccgcgccagctggaccgggcccgacgggggagcggattcaggcggcacgcgcggtcccgagggacaggcctgggcctggtgcgcagcctagcccggtgcctcccggccttgtcttctccgctgcctctgctggggatagagggtgtcgaaagcagaggttcgccgattagccgggtgtggggaggtgcgctgggggcggtgcttcccaagtcctgctatggcggaggccttcggtcgcctaagccttctcttgcgggcaatttctgccagtccctgggccgggtgtcctttctctggccgggcgatcgcctactggggcggggcggaggaggtggggtggagaagaggagtcaggaagaattgggccctgacgggacttaccccggccgtagcctcatttgagcacttttggaagggattagagtaggcctaagagcagcttggtgtacagttgccccaagtgggcaccagttaataaagaaatggatcttggcagtctcaagtgcctacttaaaggtgggggaagggaagtatttctcggaagaggtgctgatgggccttcttttcagatggtgaggcttctgcttacatcttttttatgtctttgctgtttgggacctaattgctactttttctagtcgtagcagatgacttgcttgaagctgttggaatagttactgcatattgcatacccttccttgtagctaaaacaacaacaaaacgcagtgttgtctaatattggacaagactctattgtgagttagaaagcagaggttttctgcttgtgaactcctttctctgatattttctattttgtggtaagttaggcttggtgtaagttgataaccacatctcatttaaccatgtgcgtcagattttgcatttttgagctttagaaactcaaaagttttcatttggggaaaaaaaaaacctcagttctcctgaggagtcagggatatggctgaagaataaaaatgaagcttgattcagtgcaatttttagaaaacctggaaggaaacatatatgagcagcaagttactattgcctcttttatcagtattatttcttttttgtttaacttaaattggttggctaaatattcattgacaaattagaagtatgtcactgtcaactcgttgactttctattattaactgatttttatagtattataagtaacagttttaaaaattgaagcatctattcaggcactgtttcaatacagtgttttgcataatagaaaaatctctgatatctagtgccattactaaatagtggaagtcttcatttttaatctagagaacacagtctaagaaggaagttgaggattgtagaagataattttttgtttgtttgagacggagtcttgctttgtcgcccaggctggagtgcaatggcgcaatctctgctcactgcaacctccgcctgccgggttcatgcaattctcctgcctcggcctcccaagtagctggtactacaggcgcgctccaccatgctcagctaattttttgtatttttagtagagacgggtttcaccatgctggccaggctggtttcgaactcctgaccttgtgatccgcctgcctcggcctcccaaagcgctggattacaggcgtcagccaccgtgcccggcctgtagaagatgcacatgtaagaaaaatctgattaggtaagaaaaaataaaaagacaaaacaagcctgccacccagagacgtacaacaaaatgcgaactgtagttatttttctagacctttggatagccattaatatggttccacgttaataacagtggaaccatactgtatgttctgtttgtgttttcagtggaaaaacattacagaaatactctgaacaaccttctgtcaagtaaatttttcgagaacttatatgattatagatctgaactaatttatttaatcaatctgttatttgccttcctttttattttctagtttctggcttttataaatattgaaaatatcctcataggtcagtctttgagtgttcttattttcttgggataaagtgaattgctgagtcaaaagaatttgctcattttcaatgcatttgatacatactaccacattgctttcagaaaagttatgctagttttcccaaccagtgtttgatgggcaaaaaaaacctggtgagattgaatttatgtttattgggcttggtatttcttttttaaattgcccctcgctttttgctcattttattctcttttgcccattgcccctctttgggatatttatctcttactggtttgtaagacttctttctattaatagaggttggaaatagcagttatctaggtttttaatgttggtttgataaacactgaattttacttagtttgcattagagagcttactgttaactcttaaacatttaaattccctgttctcagttctaattttcagtgtgaaatcaggtaagatacatttgcaggtgaaaaagtttgaaatgtaaaaagataaccaaattaatttaatatttccttgggaatttgattactttttctgggagaggagttctgggcaacaacataaatactgttatttgtggatatttgcaggttaggtttggtcttcaaataagtcaacattattttctttcagaaaacttggttttctggctttctataatttcccaattaacatttaaataaaagaccaaattaaacaattaaactttatttaatttggtcttttgtttaaatgctttgtggctacctagcttaccttttcagcttttaaggaaaaaaaaaatcagagttttttattttgttttgtttggagacagcctcactctgtcacccaggctgtagtgcagtcgcgtgatctcagcttactgcaacctctccctcccaggttcaagagattccccttgcctcagcttccccccctaccccagtatctgggattacaggcacctgccaccaggcccagctaattcttgtgttacagggtttccccatgttcatcatgctggtactgaactcctggcctcaagtgatctgcccttctcggcctcccaaagtgctgggattacaggtgtgagccaccatgcctggccagggtgttttttgttatttgtttattttgagacagagtttcattctgctgcccaggttggagtgcagtggcgtgatctcagctcactgcaacctccgcctcttgggttcaagcaattctcctgcctgagcctcccgagtagctgggattacaggtgtgcaccaccacacccagctactttttgtattttttagtagagagggggtttcaccatgttggccaggctggtcttgaactcctgaacccaggtgatccacacagctgggcctcccaaagtgctgggattacagtcttgagccaccgcgcccagcctaaaaagtagttttctaatgtaactatataagtagctaggtaatttattaaaagaaccctgttcaattctgcagttgggagtatttaaacttgccattttgtttttccacaacagtgttcagcaaatgttgattgtgctttctaagtatgccaggcattatgttaagcagaggatatgctccttgcctaaggagcatatagggatagggaatatggaggtccttgaactccacttccagagattcttactcattaatgaagtctgaggtgaaaccttagcatctctgtattttagccttctagtgataaccaaaccactggaatagtgatagttaatccactgtcacgattttgactcaggcagggtgagtagagtgagaagagcagcagctcttaggggcacagattgggtatacctaatcaaaaaatcagaaatgctctgaaatcactttgtgttgttgcccagactgaagtgcaatggcaagatcatagctcactgcaacctcaacttcctgagctaaagtgattctcccgcctcagcctcctgagtagctaggactataggtgtgtggcaccactcctagctaattttttttcttttttgtagagacacagggtcttgctctgttgcccaggccagtctcaaactcctggcctcaagcgctccttgaacctcagcctctcaaaatggtaggcctggaaatccaaaactttttgagcaccgttgtgatgctcaaaggaaatgctcactgcagcattttggatttcggattttcagattagggatgttgattgtaagtataattaaatattccaaatctgaaaaacttctggtctcaagtattttggataaggaatactcaacctgtaccatatttagagtgtgtgccgagaggaatatggacctgggactattgaatgtgagtggtcagaggaggtataaaaaacagtggataggtatcttgcttttataagatctgttatgctaaataactttttttttttttggagacggagtcttgctctgttgccaggctggagagcagtggtggcgtgatcttggctcagtgcaacctctgcctcctgggttcaagcgattctcctgcctcagcctcctgagaagctgggactacaggtgcgcgccaccacacccaactaatttttgtatttttagtagagactgggtttcaccatgttggtcagatggtctcaacctcttgacctcgtgatccgcctgccttggcctcccaaagtgctgggattacaggcgtgagccaccgtgcccagccaaataactcattttaaagaaaaaaatatctaagccttactgaagaaattttctgttggctgttggttcgaaagctgtatttcacttatttaattaagagatttaattaaagaacctcaagttgaggttgcaagcctaaactaaggaagacagtgtactattctttttttttttttcgtttgagacggagtctcgctttgttgcccaggctggagtgcggtggtgcgatctcggctcaccgcaagctccgcctcctgggttcacgccattcttctgcctcagcctcccgagtagctgggactacaggcagccgctaccatgcctggctaatttttttgtattttttagtagagatggggtttcaccatgttagccaggatgatctggatctcctgacctcgtgatccgcccacctcggcctgccaaagtgctgggattacaggcatgagccaccgtgcccggtcaacagtgtactattctagcatattgtttactgattggggagtcagttatagccctggtttttactctgtctagttaatatctcagaaccttcaaattttttttttttttttttatacatgtctcactgtgtcacccaggctggagtgcagtggcctgatcttggctcactgcaacctccacttccagggttcaagcgattctcctgcttcagcctctcaagtaactgggattacaggcacgcgccaccacacccagctattttttgtattttattagagatgaggtttcaccatgttggccaggctggtctcgaactcctgacctcaaatgatcgacctaccttggcctcccagagtgttgggattataggcatgagccacggtgcccagccacactttttgttgttgttgttgagatggagtttctctcttgttgcccaggctggagtgcaatgacgcgatctcagctcactgcaacctctgcctcccaggttcaagcgattctcctgcctcagcctcctgagtagctaggattacaggcgtatgccaccacgcctggctaattttgtatttttagtagagatgggggtttctccatgttggtcaggctggtctcaaactcccgacctcaggtgatctgcccgcctcggcctcccaaagttctgggatcacagtgagccaccttgcccggccttgttttgtttttaatctgggactgaaaatgagggagttgaaatactaggttggtccttttttacattaagtgttttattcgtttaacatcattttaaaaacctcagttaattggagatgttcattttttccaagaaattgaattcaggtgtgcatattgtggttatgttcattaattgggagaggaggaagagggtgtacaagcctgtgcatgatgtgtgcaggcacatgtgttttgaagttattaaagtgtttgatatagtttagatttatttcttttggacttttatattttcccagctgatctccttgagctgtaagtttaaattacactgacttgttgaattgctatggcagtagtcctatgaatcaaactctggggatggggtctggctgtctgttttaacaagccttctaggtgatggtgatgcaagctaaagtttgagaactgctgatgtagttgaaatttaatagcagtgtttctctatgtgttacgtgtagtgatagattactacagaggtgggttaatgagggaagataaattgtttaagaaactaataataggggaccagtcacggtggctcacacctgtaatcccagcactttggggactgtgccaggcagatcacttgaggtcaggagtttgagaccagcctggccaatatggtgaaacactagctgggcgtggtggcctgtgcctgtaatcccagctacttgggagacttgaggcaggagaattgcttgaacctgggaattggaggttgcagtgagctgagatagtgtcactgcactctagcctgggtgacagagggagactctacttcaaaaaaaaggtaataatgggaaaatttccagaacctaggcaacgtttactaggctaatcatagggttggaagatgtttgtcatcgtagatgctatccttcatgctatgctatccttcagctaaggtggtctttactcagtattttcttttcttttcttttcttttttggagacagagtcttttctctcttgcccaggctggggtgcagtggcgccatctcggctcactgcaaccttcgcctgctgggttcaagcgattctcctccttcagcctcccgagtagctgggattacaggcgcccaccactacgcccggctaattttgtatttttggtagagacggggtttcaccatgttggccaggctgatctcgaactcctgacctcaggtgatccacccgacttggcctcccaaagtgctgggattacaggcatgagccactgcacccggccagtattttcaaatagacaaactaaactagtgacatctgacattctagattggagttcttgatttcccttccagtcctagatttttttaatatagaatgttgagttttctaatttattagtatgctggaagagatataaagtcctggatagatataaagtcctgtttaaaggaatatgagaagacttattcttaaggagttgagaatctcttagagttaaagctgttaggttagtgagtaatttaaataagtggatagtaatagatactcatggaagagacctctgtaggtgttgtcaaagatggctaggatttgggtggataaaaaagaggaagtcattctaaggaactgaatgaggtgagaatgaggagagtttttgggtaatggtgaaatcagctaaagtagaatggagcttataaatgctggataataatgtagaacctgggagattaaatactgtgatgaaaggtaagcagaagtcatcacattagattcttttggggttgacctgtggtaactatgtagattggttatcttttgccttatgttaccccaaaacttagtggcttaaaaaaacaaggatctgttatatcatagtttctgtgagtcacaattctggatgcagcttacctgggggcctctggcttatggtctcttacaaggctgcaaccaaggtgacggcttggtagcagttctctctctctcttttttttttttttttttaaagacagaggcttgctgtggtgcccaggctggagtgcaatggcataatctcggctcattgcaaccctcacctcttgagtccaagtgatcctcttacctcagcctcctgagtagttgggactatagatgtgcaccaccacaccccagcttatttttttgtttttgtgggttttttggtagagaccagtatttttttgttttgccatgttgcctaggctgctcttgaacaccttaattcaagggatctgcccgccttagcctcctaaagtgctgggattacaggcatgagccaccgtgtctggcctgggtagcagtcctcaaggcttgactggggaagcttccccttccgagctcactcatttggctgtgaccaggccagattttcactggctggttgttgcccagagatatcagttccttgccatgtgggcctctccataaagtggctgacaacacagtagcttgtttcctccagagtgagggatcttagagaaaaggcccatacgatggaagccacaaagtttttataacttaatttcagaagtaacgtcgcatcactttgcaatattctatttgttgtaagtgaataaccaaatccagcccatactcaatcggaggggattatacaaagatgtgaagaccaggaggcaggggtctttgggggctatcttagaggccggctgtttgtctctgtctctctctgttaagaggtaaattacagctattgtataatgcctttctatccaatctttttgtatgctattgggagaacatagtgttttggattttttattttggattaaccgtaaattaattacttttggctttgcaaaacattatacctgtaaatgataaacattcctaataacctttcagtggcttaagtttaaaatagcttgtagtctcagaattggtaggaatttgagattctccagtttactgattttttttttttttaactctagctacgtaatggaatcacctggggatttttttcattactgtttttaaaatagaaaattgtagattcacagccgggcatggtggctcacgcctgtaatcccagcactttgggaggccgaggcaggcggatcacctgaagtcaggagttcgagaccagcctggccaaatggcgaaaccccgtctctactaaaaaaatacaaaaattagccgggcatggtggtgggcgcctgtaatcccagctactcgggaggctgaggcaggagaatcacttgaacccaggagacagaggttgcagtgagccaagattatgccattgcactccagcctgggcaacaagagtgaaactccatcaaaaaaaaaaaaaaaaaagaagaaaagaaaagaaaattgtagattcacatgcagttacaagaaataatgcaaaaatcccacatattcttttttccaaaaaattttatttccctaggttattggggaagaggtggtatttggttacataagtaaattctttagtggtgatttgtgagattttggtgcacccatcatctgagcaatatacactgaacccagtttgtagtgttttatctctcacccccttctcacctttttcccccgagtccccagagttcattatatcaatcttaggcttttgcatgctgatagcttagctcccacttatgagtgagaacatataatgtttggttttctgttcttgatttacttctcttagaataataagtctccaatcccatccaggttgatgcaaatgccattaactcattcccttttatggctgagtagtattccatcatatatatatatatatgtgtatatatatatgtgtgtgtatacatatatatacgtatatgtatgcgtgtgtatacgtatatacgtatatgtatgtgtgtgtatatatgtatatatatatgtgtgcatacatatatatgtgtatatatatacatatatatacacacacacacacacaccacagtttctttatccacttgttgattgatgggcatttgggctggttccccatttttgcagttgcgaattgtactgctacaaatggcgtgtgcaagtatctttttcgtataatgacttttcctctgggtggatacccagtagtgtgattgctgaatcaaatagtagttctacttttagttctttaaggaatctccacactgttttctatagtggttgtactagtttacattcccaccagcagcgtagaagtgttcccttctcaccacatccatgacaacatctattattttttaattttttgattatagccattcttggcgtgactgaagttgtatagcattgaatcccacgtactctaccgattttttctacagtggtaacatcttataaaaacagtatcttgcaaaacatcttgcacagtatcaccatgagggtaatgacattgatgtgatcttactcagattttcttacctggggattttaaaaaatacaggcaggcaggccctaccccataccaagtaagtgggtctctggggggtttggaccaggcattgccgttaaacaagaatctttcctggattattttaatgcacatccaggatcgagagctcctgcttttgtaagaaatctttctaaaacactgccgtctctgcttaactacaaataaataacagtgagctatttttgtgatgcatctcaatacagtgtttgcctattgatttttttttttaatggaaagaaaatctacttccgtattagctttcactcattgttcttagtacctgtagcaccctgaatggttttgttttttatataactatcattttggaatcctgaaggaaaaatttttcttcctgaggttaatcaacccccctttcctcagtcattcctgccttctaggtaattgctgtctttcttataataggcatagtatcataggccataactttgctaaattattgactgtatatacacaactcatcgtttgatcttgacactatattactatgtaactttgtataaatagcttaattattttcattaaatgatgggataaatagaagaatgagaatttatttaggttgacattattggatgagatagtaatcaggctgtttctaacctggagtgactggatcctttggggcccatggagatagtagtggtggtccttgcattattttcagtgttttaaaaagcctcatgtatatttttttaaaaagctgtcaagccacttttataaagtcagtagatttctataatcacttatgatttaagtttctttctaaatttttaatttttttttccctaaattgtcattcacctagtgataggaggtcatctggcttgaccatacaatggtttccccttatctacagtttcagtttccaaggtttcagttacctgaggtgtgcagcagtctgaaaatattaaatagaaaatttcagaaaaaaacaatttgtaagttttaaattgtacaccattctgagtagtgtgatgaaatctctcaccatcccacccaggacgtgaatcatccctttatccagtatatagcagtatatagactacctacctgctactggcctcggctggtcacttcactgttaccagattgaaaaaacatagcatgtataagttcggtattacctacactttcaagcttccactgagggtcttgggacatgttccctgaggatgaaggggactgctgtaatgtctcatttgatacagcttggggtatagttgatgcccagttagtgtttaagtgatggatagtatgctatctcagaaggtggcttaaaaaattcttaatgctctctaacatctgctctggcaaatcagctttccagagccctactttttttttttttcatttttaaaaatgactttttttttttttttttttttgagacagagtctctgtggcccaggctggagtgcagtggcatgatcttggctcactgcaacctctacctcctgggttcaagtgattatcgtgcctcagcctcccaattagctgagattacaggcatgcatcaccacacctggctaatttttgtattttttggtagagacagggtttcaccatgttggccaggctggtctcgaactcctgtcttcaggtgatccgccctcctcagcctcccaaagtgctgagatacaggcatgaaccactgtgcccagcctgacaattttggttttaaggccaaaagtttgaagatttaaatgaaaaatgccaaatattcaggaattttctcctattattattattatttttttttgtatgtaaatattgttgtgtagtattgttctttccttttttgctctgttccatttaaaagtgtcagaagtgccctgacaatacattttggcaaaaaacagagcaggtaatgaagtattaggtaacattttcttgttactgagacatttgcttagacaatgctaagaatagctatcatcctagacacttctccccaggcttgctttgccattgcctttgaaactgtcatacttataactcagatattaactggctctaattacctggtaatatgtcctctctcctaatcacaattgtacagtgtttttagggataaagtgtaaactagaaaccgagaagtattacctgattcttagcaagtatttataagtgaaagcctctaatgtggacatttatcttggaatttgtgacatttggacagatatttatctgaaacttacttgaaactcaaatttaataccttctctctttgaggcttttcccccttttattggcttatctgagaaccattcttgggatttgagtcatccttttttttttccttcattttccacatccagttatccctgatcaagttacctctgaaatttgtttcatgttgttgctatcctttttactaactaatcctagtttaggacctttttattttgcctccttgtctctgggcttccagtgtatcattctgttaccaaacacaaatttaatagtcatcctcctgctaaaaagagactttctgtcaaaagtctatcccagactccttactatggcattcatggcttccccatcttaacatagctaatttttttcaatctcatctgcagttgttcctcatcccttatcacccccagttgcactgtttgtaattctttactgtgtaacacatatttgtgttttcatgcttttgttcatacttgtccctcttcttttgataccttttcttttctttctgtctctcttttttcttgagacagggtttttgctctgttgctcaggctggagtgcagtggcacgatcacggctcactacagccttgaactcctgggctcaagcgatcctcccacctcagcctcctgagtagctgggactacagttgcatgccactacacctggctaattttttgtattattatttttatttatttattttttgtttgtttgttttgtttttggtagagacaattttttgccatgttgcctagactggtctcgacctcctggactcaaacgatcttcccacctcagcctcccaaagtgttgggattacaggcatgagccaccgtgcccagctctctttctcttcttaactgcctgatatattcctattgagaatctgccaggctggctgcggtggctcatctcctttcaggttcttctctacctttcctgtgcttccttatctatgtttgaatagtgcttcatatggatatttggtatagcctataagaggttatgatatagctatccctatatccaagcctctagctatatatgagggttttgaaggtgagaactaaaactccttcatctttgtgttcatagcagagtttcttctctgacagaagaaactcagtaaatatttgttgaagtttgtccttgcctagtaaatgcttgctttctcagtttccttgtggtaaaccaaagggatccagacaagattttcttctggcactaacaaattattttatgatttctagataatgccaaagtggtagtgtaagaagatggcaaggaagaaatgtttgaattccaagaggacaagcttcttaaggtccctgaatattcaaccttttaggtgaagctttattatttgcgtatagttccctggcgctgggtgtgaactgacacagtgatgatgttaaagacagtggaatcacccaggtgcagtggctcacgcctgcaatcccacaactttgggaggttgaggccagaggattacttgagtccaggagtttgagaccagcctgggctacatagactttttctctacaaaaaaaataaataaaattagctgggcttggtggcatgtgcctgtagtcagttacttgggaggctgaagtgggagaagaggattgctgagctcaggaggtcaatcaaggctgtagtaagccgagattgtgctactgcactccagcctaggcaacagggtgagaccatgtctcaaaaaaaaaaaaaaaaaaaaaagacagttgaatcagtttaatacagtacttctcaaagtatggtccataagaacaaaactatttaataataacagaaagacactatttgcctcttaaaatgttctggcatttgtgctgatgttgcagggcaatgaggaggtaaaaccactggcaccttagtacagaaggtatcagtggcaccaaagtatgctagtagtcattgtgttcttcactatcacacactcagagtaaaaaaatacgtttcacttaatcctaaatgaataagtaaaaattactagttttctaagtctttattccttaaggacacatcttaattgcttgtgtgacaaaatgggaggtatgcctaaagcacttctgcatactgaagtatggtggtcgtcccaaaatgaaaacatttgtgtgtgcttttgacttgtgagcttgtttctgtttctggacctaccctgggcaggtttccacagttgagaatcttagcgtattgctgttacctcaaatttccacacactaccagtttgtcttttgaaatgttatttttataagatgtcaaccctggtatggttcacttttgttatatgttggcacctctgtgggttacggaaagctttgccctccaaagcaaccagttggtttttaggaaagggaaatattgatctttgtggataagtagagtcttgttaaaagctattagaaggctctctttggaaaaaaatcagaaaaatcaaaagaactgtgaaaaggatgataataatggaaaagaggcctttgtagccttgtgaatgtaatacgtatagtcaccacagatttttcagggaggccagtcacggtggttcaagcgtgtaatcccagcactttgggaggctgaggcaggaggattgatagaaccaaggagtttgagaccagcctgggcaacatagtgagaccccatctctagcaaaaaaaatgtttttcagggaatgctgaaatgtctccttctcaaaaaaaaaaaaaaagtctccttctcttacaagttagtcaccttactcagtttattacagcaggagttcccaatcctcaggctgtggcctgttgtgaactgggcagcacagcaggaggcgagcagccagggagcgttaccacctgagctctgcctcgtgtcagattggcagcggcattagattctcataggagtgcaaaccctattgtaaattgtgcattcaagggatctaggttggcactccttatgagaatctaatgcctgataatctgaggtggaatattcattgttattgtctgactccactcccctcccgctcctttcatggaaaaattgtcttccatgaaaccagtccctagtgccaaaaagttggggaccactgtactgtagtttcaaaaatgttcatatttggcctaaatctatagtctgaggaagcatatcacatctttatcattcatgacaagcagggatgggagaggaagcagggataggagtggttatgtgggcagccaatagcataggaaacttaaaaggaacctacttagccaaacatgttttgagcctttgagtcccagtgactaaacaatgcagattaggataaaagatttgctcacacctgtaatccctgcactttgggaggccgaggtgggcagatcatgaggtcaggagttcgagaccagcctggccaacatggtgaaaccccgtgtctactaaaaatataaaaattagcccggtgtggtggtgtgctcctgtaatcccagctactcgggaggctgaggcaggagaattgcttgaacctgggaggcagaggttgcagtgagccgagatcgtgccactgcactccaggctggatgacagagtaagactcttgtctcgaaaaaaataaaaataaaaaataaaagatttattagcatgataaatcaggcttttcataatgtgcccctatctaccttagctgccatttctttatgcttattcgtattatagcataataatcacattccctgtggaaattttctgtatgcctttgtaaggtttttttcctatgcttcaaatgcttccccccacccccccataaacccattcatacttcatgacccactgtaaatattgtttcttccttgaatctttccctgtgagcctcagaattttgtatatacttttataataaaaagctcttatctcattatttccttactagatagactctgaaattcttggttgtttgatcagtgtattaattttggtattcacgttgtacccacaaagttcctggaacatagctgttagacattgagtgaaaagtcagatatgaatgaattttctaattgattttattattgataaaaataagtcttggtactatccccatttttttcctttgtgaattgttcacatttctcttctaccaaattcactgaattaacccttccctcattctctaacatactactttttgctcttaaccagttatcttacggaactttagttatcacaactgttatgtgaaataggtgacatttttactgttttgtggttaaggaattagaggcatagaggaattaaataaccagcttttcatagctggagttggaactcagtattttatatcattaaatatacacaaacgtgtgaatgttattgttgtgtgtgctgggtattttctgtttgcctctgcggaactcttctacctttttccatcctgctgtgctccagaagactgacttatacaggctgagtcaatgggctctgacttgtgacttcattgctgtggcctctgaatccaaataaatgactaagagtggaatagagtcagaagtctactacataccccatttaagactttacagcttacatatgtaccatcctcaagaaaatatcaagccaaaattgctgttatatttactgttttctactctaagcatttaaaaacacaaagtttaataaaaaataattctcgaccaaagtaatagaatacatatatattatataaaatttgttcgttatttatgtatgaagttacaaacttagactagtggtccaaaaagcccagcattcttctgaaagaagcaccaagagattctggaagaatagcaccgtgaaactgttatggaggcactagataacaaatgcttgctttaaagggagaagagccagtttattttgctcggtaatgagaaaatagttctttagtaaagttctcaggtgagcttattactaatgccgtttaacttcaaatgtgagaaaatatgtttactttttaacctgttcaccacttcacctcttatgaaggggaaaacttagggagtgggcctcaaattacttgtcatttaatttggaaatgttcctttgaaatttggaaacgtatgtacataattttagtcactgatttgttacagaatttttaaatgtagtaattacatttcattggccctaaaaatgttgtctgtttttaataatcatctctaattgtattgcattaatataatagctgggtccttaggatatatgataatgtatgaagcttgattataatgttgcattccacccagctataaagccaaagtggtgaaaataggacttttaaatatacagaagtattctagtcacccttaggaatgaaagtataacattaagcaatatttgaagatttaaggatggcagtaagcttgcctaatctttgattcataccactgtcaacacagtttttgattcatgtagagtcaaattaacaaggttggaaggatcctaatggttatcctagccaaccacatatcaagtactacctccctggtaagtggtcctgtagactattcttaaatgtctactctggctaaaccttcacagccacttccagaagacctctgatttagagttctttcatactctgattttgtcttcctgtagctttttacctgaacctacctggttctaacccttctcatgatagcgattctataattttaaagacttatttaacatattggagactagcagtgcaataacctaatccagactaacactttttggggggggaggtcagaacccagaataaagctgctgcttattctgggtttacttcttatggattgttgattagaaagattattctgcactggtattttggattgaggcctgtgcatgtctgttcaggcaaagtttacataaggtagaacactacagcagcacatgtgcaccctgctcaattaaataaatatcaggcagatctgtttgttcataccctcattgcagatactgaagggttggtgggttttgcagtaacgaatgaataattcatcttgatattactatattaatagttttgggttctgtatatttcctccgactcagaatttacaaaaataaaagcactttctagacagttaactagttagctctgagtagaatgttttctactacctttttaaagattctagatcattttgagcaaagaatattgaaattgcattgcaaacttatctttgtgaatcaggtttttcttcattctatgtacaaaacaaaatatagaaataagatgtatactgagcttttctccataacctcagattttttttaaaaagttaaaacagtcttagtatgctaagagtgactgtttataaacttttttaaaggattttaaattttttattgtttgtgcatacatatattttcttggttcaaattcaaaaagcacaaaagatttaaaaaaaacatatatatctgcctttatacctcaactacgtggttccctccctcacagtattattgatgtcttagtacttttctcataaatgcagaacccttccctaacctgatttttatatttcttataagatcctaaataatcgtgttatagtttatgaatttctgaggttagtgggtccctaaatataatgcttcagtttaattgggaaccatttgtaaattgagtacttgatttatttttatcagctgagatttctttagctgccacactgctgggggaatacagataatggacaactctttaagaaataatgtataaataaattataatgcgacgctttgtttcatagtagaagcataaggtcgagaaggaatatttaatgctcttctctgggaggaccgacttgctggtaggaatggaagctgaattttgaaaaatgaatggtagcttactaggcagatggggttagaggtggcattccagacaaaggaggaagaggaatggaagaagttgtggtatgttgaatgaacaataaggaattgaatattgctgaaattactgggaagtagagtggtaggagctggggctagacaggcagtgtgatcagattatgaaagcttttagcgtagtgctgttgagatggacttaattcactaggactacgtgaaacaactttaaacttttaaattaataaggaattagagtttaaaaggccactctgttggtactataggaaataaatgagaacaggacgggattaggaaactgggagagtagtgagtaatccattagaataacctgtgaaagaaatgggttagcaaggctggaatggaggagggaaggcattcaagataccgtgagaaatgatgaattattaggaaaaaaaaaaaaaacttagtgattaagtctttggtgtcatttagaaccacattcagttccagctttgccttttaccagctctgtgacttcgtatgtaaatttgattttaataaattctgtttcatcatctgtgagtattgtaattgtgtagttgaagctttaagcaactttcatttaactaacttggtgaatagttaatagttgctctccattccctcagtaaaagagacctagggcagtgttcatgacaggctctcagcttgtcggcctaagtggcaaaattaaccagtcacgatagcccttatactgtgtggtatcatttatacaaaatgtcctgaattggcaaatctatagagatagaaagtagatcagtggttgtcagaggctgagtgggggaaatggggcgtgactgctaatgagtatagggtttctttttagggtgatgaaatgttctaaaattaatggttgacacaactgtcacaattctgtgaatataatcaaaaccactgaactacttttgagagttaatttcatggtatatctcaagttgtcacagaaaaaaagtctaattcagtattccccatttgtccaatacgtcttttatagcttttcttcttttggtcaaggatcatggattgcatttggttatcatgtctctttatttgtccatgttcttgatgggttaaaataataaagaatatacaaatggttagatctcctataaacaaaagaatatacaaatggttagatctcctataaacaaaagtttcctgaaacttccttaaacatgtagcatggatctagtttattttagttgcatgcaaaataaaacaattgattaaattaaaattgttctttcatggctgtaagctcttggtgaagacaggtcagacaggtatttgggttaatgtcaggcaaaaatttctgtatcaaaacacaatatttatactggcttgagctagaatgttgagacattgttttaaggtttgtttttttaaaatagcttttagaagcttattgaggtgtaactatatatgctatataaactatgatatacaaatatatatactatacaaaaatatatcttacaatttttttcctcaagagatactgtttttctgtcacccaagctggagtgcagtggtgtaatcacagctcaccgcagccttcaactcctgggctcgagcaatccttccgcctcagcctcctgagcagctgggactacaggcacacaccaccacacctaattaaaaaaaatttttttttggagatggggtctgttgcccaggctagtctcaaactcctggcttcaggcagtcctcccacttcagcctaccaaagtgttgggattacaagcttgagccactgtgcctggccatagttttgtatataaatgtcttactattatagtttggtaatcgacctaaataatactgttacatattgttttaagcccccaaagttgtcttacctagatgtggtgctagcaaacgtttttataaaggcaggaatgtagaatggcaaaatgctgaaatacaaacatactctaagcacacagaccttagtgtcacagtagaaacttcctgcttgcaataattgccattttaattttggtgcagaaagccttctatggatgtgatagtttatgtaccaaagagcaatctctatttgaagaaactgtgtggcctggttacaaaagtgcctgctgtatctgtaactgtcagtggtattaaaaatactgatttattttgcctgttgtgataatcaagaatagcttatttggatatatgcatgggatggttgcaaataccaagttcaggtattttactatggaatatagataggggtgttttcttctggttttccccacccctttatatataccttgattttaatttttatcaagtgtgtctctttggcctttgccgctgtggcccattgatctgtccatctgtctgttacagtgcatattgggtacttccagaagtatgaattcagtgatgcaaaggacaggcgggctgcagcagcaaaggtaggacagaatcattccaaagacaagtcattaaaagaccattaaacacacatacttacacacagacattggcaaccagtacctcattatttaagggcacatcatttatcctataaatctttgtgggaaagtttgttttgacatgacaaatgtgatgtacttgtaaagggcacaattttattattatgttttaaaccagaagcctacttggcacttaggcaacaaagtaaatggcatttgccactgtctttaagatgccgaataatagaagagataattaaatggaggatattaatggtattaattgattcatggagctggctgattttcagaaactatgataaaggatcctattttgtaaactgggaggagaaacagagaagatagattgagctatgtgtgtatatttatgtgttaatgtttatttatattcctgactctggaatattttgatgaaaataatctaaatcttcctgttatttcgctgacatcactatgaggaagattaagaaattctatttaaatgtttgtaccatttacttaagtatttgtatcagtttacttgctaaatgatagcagttataatagcaatttctggcttaaaaaaaaaacagggttaggatggaagggcaatagcatttttatactgaatcctaaaacatcagttataggcaagttttaaaacttaatcatacgttgcaaacacttgaagatgaaatggaaggcttataaggttaagtgttaggttttatgtgtcattctagtattggctgaaaagtgagtgctatagggatggtggaatgatgcagatatttgcatcattttctatgctgttatgcttctaaaaagaagaggctatgttttcctaaataggttagtagagtgcttctcaaggcttcccaaatgaaaagtcagacaaaaatatgtatttgttcttcagtgaagattgttgggttttcaaaccagcaatcttagctgtaaaacctaagatcttaccacagcctaaattgtgactcaaatgctgatgttagttaatacttttataaactccatatactatattgaggagatctagtttcttgaatgtggaagtgaagcttcataatataccatagtagggatgtttcgaatcaatagtgttaaaatgttttgggttttttaaagattttttttcagctggtcttggaaaccttttcagttatctgtttttgattctaccaaaggtattaggtatttaatgctccactaaatagatcacaaaaggggagtcttaaggaggtgaagatgtgaacttcttgactagatgtaaatcactgctcagaaagatttgacttttttaaatgatgcattcttatgtcaatagactttaatctgcaaccaaaatgttttttttttaaataaaaatgaggcacatttgtgctttctcacttctgctccaattctaccttattctgcaagttgctattttttcctttagcagtacactatagatttaaaaattgtatggtattttctaatataaccatatcaatttatcagttttcctattgttggacatctaattcactcatatttgtgtcttcttcctttcccttacagagtttttgtaaagaaggctgagtgttttcaaaagttatgtttatatttacatgtgtgtgaactaccattttctgtatacccttgctgataactattaagaatcttggtctggcgtggtggctcacgcctgtgatcccagcacttagggaggctgaggcggtggatcacccgaggtcaggaattggagaccagcctgaccaacatggcgaaaccccgtctctactaaaaatacattagctgggtgtggtggtgcatgcctgtaatcccagctacctgggaggctgaggcaggagaatggcttgaacccaggaggcggaggttgcagggagccaagatcgtgccactgcattccagcctgggcaacaagagtgaaacactccatctcaaaaataaaaaaaaaaaagaactcttcaaatttttattaatctggtaaagaaaatactagttgttttaatttacatttttctgaattgcctttttatgtcgtttgcaccttttcataaatttttttttttttttttttttttttttttttttttttgagacaaagtcttgctctgtcacccaggctggagtgcagtagtgtgatctcggctcactgcgacctctgcctcccgggttcaagccattctcccgcctcatcctcctgagtagctgggaggcgcacgccaccacacttggctaatttttgtatttttagtagagacggggtttcaccatgttggtcaggctggcctcgaacttctgatctcaaatgatccacctgccttggcctcccaaagtgttggcgtgagccactgagcccagccagtaatggtatttaatgtataattattgtagctctttctccagtttgttatttgtaagaaaaaaaaaaagcaatacatgcatgtggtaacaaatgtaaatgttatatcttacaatgattacatttatagctttaatatgtctcttccttttgacattatctctttcctttttcttcctccatccttgagaaccccactttatgccagctatagttatatgttatcaaaatatttttgtcttgtgattataaccaaatgttattagttcgcttatagcttgatttttgaagtgacatcattgaatgtttgtttttatggtttataaatatcaatgacattctaagtagtgtattatgattactgttgctttttgtttttaacaggtctaatttcaaatgctgtgaaccttcctaagaacagtactctggtagcaagatggtttgggtttatttatactccttggagcccttcattctgctcttgtaatcaggatggctttccctgtaagcctcttacatatagctctcaaccatggactttgcatcattctcctgtgttggagcctctgattcttagatacatgtctttttcttgactgaatctcattgtgctggactgcatccttaatttaactctcacaacacttttttcccccctgcaacactcttaggctgttacttattgtggctctgataatgtgcttaattttccttcaaacttgattgctagattggctaggttggaaactctagattagaatatttgtgcaagacattgccttctgcattcactgttggtgataagactgatagtagtctggttgtcatttctctcttttttttttttgagttggagtcttgctctgttgccaggctggagtgtagtggcacaatctcgtctcactgcaacctccacctcctgtgttcaagcgatttctcctgcctcagcctcccgagtagctgggactacaggcgcacaccaccacgcccagctaatttttgtatttttaatagagacggggtttcactgtgttggccaggatgatgtcgatctcttgacctcgtgatctgcccgcctcggcctcccaaagtgctgggattacaggtgtgagccactttatgactttatttatttatttattttttaagtttcagccttttctctgaagagatatgtaagtgtgaatcttctaatccattgtgctggatcttcagtggaccctttcaactggaagacttgtgtccttataaagctttggggaattaacttctgttactgctttgctaatttcattccctctcttcttcttttggaattcctatcagttgaatgtgaaaaacaatggatataacttaaaataatgataagttatggaagaaagattgagaggtgcatgtagcgtgccagatcctcatctttcacattaggaaggtgacagataatatctaaaatagaaaaataataactccttgagcataagcatattatttagcataaaagtaaatactagaagacacagaagagtttaaaatggttacctcagaggattagaaatcagtagtgactgaagtatggcaaagaacactgttaaatcttgcagtaccattaacttctaaaactatgtatgtatattaaataaaataacttaaaagtgatttaatgtaatccttaaggtctacatttaatgataccttcattctttaaaatatcgtcaggaagtttatgtagacgtgttcttagaccaaatatacactatcagccttcatgggaggaggtacacactatgtattcctttgtcatgattcgtaattattgagctgtgtattttgagaataattgatagagaatgtactggagatttacatggcctgttattgcttggttttaaaacttaaaggatacaggggtatatttttgtctaattcaagatcatttggatttatgacttttattagctttaaagaagcctacaatggcttttttcaaaaatagaatttttcttagaaaacagtttttaagagacaaatttatttaaatgcccactcttttaaaataaagttagatgtatggttttcaaataatcttatgtttgttattgaacaaaatcttatttactgtatatacaaatatatagtatggatgagtaagaagcagtgaattgctaatcagaatcccaccacttatcagtaagtgttttgagttgcacggtttgagaaagtactggttcaaatgctgttaaaaatcaaatttttgtatgctgtctctagatggtttgttgatgacctagtggttgtgttaaagaagtggagttacattgaagtcacgcgaatgttttgcttgtgtgtttggtggaacatttttagtatatgccacagcagatacgtggaatgctgatacttagggcttaacagttggaacccagaagtgagtatgtgaacaaataactgaaaggttacaaaataactttaatcatctcacaattctaatcaccacaaaaataataaagtagcatgaggtggtctatatttatggtttacattagccccactgtgccagggcagtttggaatttaagttacctggttcttggctctacctttagtttgtaccctttttatcaatagggcttttttgcccctataaggaatagccagttaagagactgcaacccaagaaaatcttgcctgaatggagtttcaggtaacgataaaagtttaaaaactagggtgttatatatattagaagtgacttgtctcttgatgcaaagtcatagactgctattttaagtcttgagtatttttttttgatataacattgaaggataccttacctattgtttctattgttcatgtaaatatacccttccattatctctccccactttggtttgccgctgaatttttatggaagaaatcaaatgattatacatagtgataacatccttctacttacagaaacattgtattaaaacactgattaaactcttgatgttttctagaggtgaaatctttatatttgggatgacatagaaggaagtaatttccctcataaaataaatgtgcaaagaacagcaaagcccagatgtgtcattggctaggcacatttattaacaagtttggatgcatcaggattacatatttaaatcaaatgcatatctcagcaaaatttcaaattgttatgtatttataggattgccaacagttaattgaaacttgtcattgttaaattttgctttaaataatctccaagagtaatgagtggctgggcactcactcatggctgtaatcccagcactttgggaggctaagacaggctgattgcttcagcccaagagtttcagaccagccagggcaacatggcgaaaccctgtctctacaaaaaaataaaaaaattagcctggcatcgtggcacgtgcctgtagtcccagttacttgggaagctgaggtgagaggattgcctgagcctgggaggcagaagttgcagtgagccaagatctcgccactgtactccagcctgagcgacagagccagaccctgtcttaaataaaataaaattaaaaaaaagagtgatgaaggtatgacattcctgcctgctgaagtaatctgagaagcctctttaagggggagttctctcaagaatattatcctcaacatttttaccttttaccttccttctcctgtggtagcttagaagtaaatattcataactgggaagtttgatgatcagtgtttagttgtaaattcttttaaaatgcacatacttttaagccatctagagattgtgtggattgtctcccttagccccactaggtgcttctctgtcctaagtagtctagaaggccaaaaactatttctcagactattttgcatttagggttctagatataaaatagttgtgacaattataatatatatgtgggagatttgaagggagtttatgttttcttcgtttttgtggtctgggtcatgaagaagtgagattttgccaacagtagcagaaatgcagcatagcattatttattctccagcatcttgagttatcaagaggcttttgtggttaaggcagcagctagactgttttattgtgtacatcccctagctgggtatttagaggcagttgtgacagtggcaacttcctgattcaagctttccaatccttggatcacagttatctgccatgtgttcttggatttagtggtcccattggtagcttcttatgatttcagttctgtagtgttctggtagtcactcctggagacatattcctatagccccattcctccattctttcccgtaactaagcatctaattcctttttaactcccctttgctcagaatatctagtggtttctattccctccaccaaatactgattgatcaaagtcaagagcatcctttggtgacaaaatgctactcttacatttagtagatggtactgtatgtgatgcaggatttttcttgaccccttctttggacttgtgatggaggtgccccatttactctgcttgcagccctcaaccccttgcaggagggagcacgtgagcaagtgaatgcgggatctggctggctgctttgggtgctggcaggagcaagtttcatgtgggccctgcgatggcacccaggttggggtgcctgcaacccctgaagccctagagggcatgttacaatgctgtcttagctccaccgtctgtggacagcggtgtgttaccagctcagtaggctccttgccttgttgcgtggggcagccgccctccactagtgagggcaaagggccagtgtgatagcctttatttatttatttattttttagatggagtttcgcccttgtcgcccaggctggagtgcagtggcacgatcttggctcactgcaacctctgcctcctgggttcaagcgattctcctgcctcagtctcttgaatagctgggattacaggtacccgccaccatgccccactaatttttgtatttttagtagagatggcgttttgccatgttggccaggctggactcgagcttctgacctcaggttaatctgccgtctcagcctcccagagtactgggattacagtgtgagccaccgcacccagccagacagccttttttgggtacctgcacttggtgggtcccaagttcttgtctggtgtccaagaaaaatgaggtcctgccagacgcttgaaggatggtggaggcggataattttctttagtgatgaaaatggctcttagcagagaggggagctagagaagagacaggttgggcaggtaatctttcctgaagtcaagctgcccctctgaagtccagggacctctctccagtcaagccgcttctctcgttcgtctttatctgcacaggatgaggggtgggttggccatcagtagttttggaaaaagcaacattcgattggtaaaaagacattattcggaaagaaccaactgggagagaatcggcagacggaagttctcattttgggccacaggtttcaggctttttggtttgaagttggggtttcactgggaacccacccctgtctgcctagaatgtctctgcttcctgcctctatcattgaacttcagatatataaagaagttattctatgatatgtcattgactaagcattaattatgttgacccttttagtgactctaaataaagagctctcaacaaacctatacctttaaagggaagaaaaactatacctgaattacacatgataatttcttagaaggcattaagtatttaatcatatctgaggagaatttggaaatgaaaccatttacagttgcaatttaaccagctctcaagagcattacttcctgtagcttatatcagtgctcctcaaactttaacatgcatacagatcacctcaggaacacttgagggtctgttcaaagtgaagattcagtagatggctgttgggacctgggattctacatttctcacaaactcaggtgattgtaattttgtgaaccacactttaagtagcaaagcctatagtatttacagttataaataaaggtaatattttacatttctatttatttgaaatttctttttgaatattaccatatcatagaaatttacttttttaacacaaaaatggaatattgtgcactactcagtagcttgttttttttcgctcagtggtatctcatgaataaccttccatatttttttaatggctgcataatatttcaagtatgaatatagcataatttataggcagtctcctcttgaaaaaatgtataaatgggaaaatgctttcccaaataatgtggatgtgaaaattcttatacttctatacttggtatttctgttgagcaggttcctataatgggtatttctaggtcctagttcatgtgcattttaaattttgatcacttctgccaaactaccctcagaaaaggtttgaccaaagttgccatctcattaacaaattatgacctgtttctcttgccgttgtcactggatagtgtcttttttttctccctgagacggggtcttgctttgttgcccagaggtggagtgcagtggtgcgatcttggttcactgcaccctctgcctcccgagttcaagcagttctccttcttcagcctcccgaggagctgggattacaggctcgtgccaccatagcgggtaattttttgtgtttttagtagagatggggtttcaccatgttggccaggctggtcttgaactcctgacctcatgatccaccctccttggccttccaaagtactgggattacaggtgtgagccactgtgcccagccaatagtatcagcttttaaaaacttagtcattgtgggccaggcgcgtggctcacgcctataataccagcacttggggaggccgaggcgggcggatcatgaggtcaggagatcgagaccatcctggctaacacggtgaaactctttctctactaaaaaatacaaaaatattagccaggcgtggtggtgggcacctgtaatcccagctactcaggaggctgaggcaggggaatggcgtgcacccgggaggtggagcttgcaatgaggcgagattgcgccactgcactccagcctgggcgacagagcaagactccgtctcacaaaaaaaaaaaaaagaaaaaaaaaaagaacttagtcattgtggaagatttaaagcattcattgtattaaggagattggatattttcgtgtgtttttcagccaattgtaatatgggaattgatgaactgtccatttttgttggattattttcttttttgagtgggtatgcttgctcatttttgttgtagcatttataaatattccttagaatacagatgtttttatactttgtgacttttgagtttctaatattgtttaaaaagtattaaaaaattctctttaaattttggacccataagcagctcatttgaggagcttgtagattttatgcaaacatgagcccatgcttctgtaggaaaatcttaaaactgaggtttaaggtggtgcctctaacctgtttaattctcgttcagatcaaattctgaaataataaaaaggtgggttttggaggttttctgtgtatgtaaactggaataaaaaagtggtttttttttgttttttttgtttgtttttttacttagctttatcctaaaataagaaagttgtctcttgagatttttgaaaaagtagttgcctcccactctgctaaatataggaatgtcattcagcaatttggttgtgattatttttatgtatgtatgtatgtatgtatgtatgtatgtatgtatgtatttatttatttattttttgaaacgcagtcgtgccctgtcgcccaggctggagtgcagtggcatgatctcagctcaccgcaacctctgcctcctgggttcaagtgtttctcttgcctcagcctcccaagtagctaggactataggcgcacaccaccgtgcccggctaatatttgtatatttttggtagagacggggtttcaccatgttggccaggctggtctcgaactctgacctcaagtgatccgcctgccttggcctcccaaagtgctgggattacaggcgtgagccaccatgcctggctttggttgtgattctacctggagagtttgtcatactcttgaatatgggcctgtctgcacacatgtgtgcatccagattatgattctccactgtgactgcttattggaatctcttgggagtttttgaaaatggtaatgcccaggtgtccccctcagtcctcttcctcactccccccatattctgatatatttggcctggggtttgtggcttgtttaaaagcttcctagatggctgtgcacagtggctcattcctataatccctgtgttttgggaggctgaagctggaggattgcatgagcccaggaatttgagaccagcctgggcaacatagcaagatcctgtctttaaataaaaataaataaataaataacagtcaattaagagcttatgtgctactaaaattgagaactacttgatcaaaggataggggatgatggtgcaattgatgttaaagcttcagctaggacagttgacataatcagacttactaatcaactttttcaaaatgcaaaactttaaagtaaatacagctgctctgagcctggaatgttattttctttagattactaaaatactatactgccacattcatgggagttctacagatgtactttttcggagcctgtgtagtgggaaattgtttagagcagtagttcccagttctgtctgcatgttaggatcatctggggaccttcagataaaaatgttggatgaaaatatatatattcatattctacccttgacagttgaatcagaattgctgggggcaaagcccaattaatggtattttttaagttcctcaggagattcttatatgtagccagaatggacaggggtgggtggtactgatttagagttataactagacaagatgtaaggttttaggttgttctattgtcctaaaagttaaatgtactgctgctagtattagtactagttttctgattatagtgattttactcaaactgtttttgtttggtttgtttatatcctttaaaaaggatgaagagctctttatttcagccaagagcttgaattggcttttcactgaactatcagttttggtggcacaccgaagtgaatttctctcctttgacaagtccttgtagggagtggtgctataatcataaattaaaaaataatttctccatgtattcaaatcctactagcctattttatcctggaccaagacacttaacctctgtaacctcatctgtaaaatgtaaatcatatctaacttgcataaaatattgatgtgagtattaaatgaaataatgtatataaagtatctagcattgtgcccggcactaaataatttcaaatctatgttctccttttcagcattcccttttactctcattgttctttctttcttttttttttttttttgagacggagtctctctctatcacccaggctggagtgtagtggtgcagtctcggctcactgcaacctccacgtcccgggttcaagcaattctcctgtctcagactcccgagtagctgggactacaggcatacgccaccatgcccggctaatttttgtatttttagtagagatgaggtttcaccatattggtcaggctggtctcaaactcctgactttaggtgatctacccgccttagcttcccaaagtgctgggattacaggtgtgagccactgtgcctggccctttttttttttttttgagactgagtcttgctctgttgcccaggctgggtgcagtggcctgatctcagctcactgcaacctccgcttcctgggttcaggtgattctcatgcctcagccacccaagtagctgggactacaggcgtgcatcaccactcccagctaatgtttatatttttagtagagacaaggtttcatcatgttggtcagcctggccttgaagtcctgaccttaagtgatcacctgcctcggtctcccaaagtggtgggattacaggtgtgagccaccacacctggcccacattgttctttttaaaagaacttcactacaggtgctccagtgcaggctagattacgtttatagttgaatactttaagtttcatacaataaaatttacactggagcatacagttctctgagttttgataaatgcctagagttgtgtaaaccaccaccatagttaatttacagaacagtttcccctcaccatcacccctcaaatttctttctaccccattgtttagtcaaaccctcccccacctttaatatttggcagctctggatttgtaccctatccttacttatttatttctatttattttcactcattcatttaagacagggtcttactctttcgcccaggctggaatgcagtgatgcgatcataggtcactacagccttgtgctactggactcaagggatcctactcacctcagtctctagagtagctgggactacaggcatgtgtgtcatcatgcctggctaattttttaaaaatttttagtagaggtcttgctttgttgcccaggctagtctgaaactcttgggctcaagcagtcctcccgccttggcccctcaaagtgttgggattacaggtgtgacaccaatcgcccactccagccccacctttttttttttttttccccaaagagagatggggcctcactgtgttgtccaggctagagtgcagtgactgttcacagatgggatcctagcacactacatctttgaactccttagctcaagtgatcctcctgcctcagcctcctgagtacctgggactacagggatctcccacctcttctggcctgagccctgtaattttgccttttccactgtgtcatttaaatagaattgtaaatcaatttttaaaatgggcttttattttcttgttaggtttttagatttttaaaaaattattctaggtacaaattcttcatcagaaatgtaatttgcaggtatcttctcctagtctgtggtatatcttgtattttcttaacagtatcttttactttcgatggatttcagtgtatccgttttctctaatggattgtgcttttgatgtatgtacgaactatttgtgtaactcaaggtcacaaacattttctttaagttttacagtctgatttacatttgggtctgatccattattaattttgtattaaatgtgagctaaagtacattttaaaaatatgtacatcttaattattccagtactacccagcactttgggaggccgaggcgggtggatcacgaggtcaggagatcgagaccatcctggctaacatggtgaaagcccatctctactaaaaaaattaggcgggcttggtggtgggcgcctgtattcccagctactggggaggctgaggcagcagaatgatgtgaatccgggaggcggagcttgcagtgagccgagatcacgccactgcactccagcctgggcaacagagcaagactctgactcaaaaaaaaaaaaaaaaaaaaaaaaaaaaaaaaaagactttttccccgttgaattgttttatcacttttgtaaaagatcacttttgctgtatttatgtgggtctatttctggtctccattccattcttttgatctgtatatctttttgccagtactgtaacttcatagttatgttttgaaatcaggtgttctgttttaaaatttttcaaaatttggccactctagtttccttggtattccatataaaatttagaatcactttgatgtttatccaaaaaatatttggagtttgattggcattgagtggaatctataggtcagtttgggaagaattaacattttaattatgttgttttccaatccatgaagatggcatctctctccattatttaggtcttattaaaatttctttcatcaatattttgcagttttccgtgtacacgttcttcacatattaaatttatacctatgtatttcacgttttggtgctattgtaagtggcactttaaatttttttgatcttcagttattcattactagtatgtaaaaatatagctgatcttttctttctttctttcttttttgagatggagttttgctcttgttgtccaggctggagtgcagtggcgccatcttggctcacttgtaacctccgcttcccgggttcaagtgattgtcctgcctcagtctcctgagtagctgagattacaggcgtctgccaccatgccctgctaattttttgtatttttagtagaaatggggtttcatcatgttggccaggctggtcttgaactcctcacctcaggtgatccacacaccttggcctctcaaagtgctaggattacaggcatgaaccaccgtgcctggcccagctgatctttttatattggccttggacttcgctaaactcatttcttctaggaattttttgtagattaatgggattttctgcatagccacatacatagtcatctgattagaaacagcttttttcctttccaatttcttttatttctttttcttgccatattgtatttgtaagactccgtccagtacagagttgactgagagtgactgggcagctggcctagaagtgcctcttctaggcacttctttttcgtttcctagtttgctgagagatttttatagtagtggatgttgaattttgtcaaatgctttatttatatcctatcctgtgacttttcttcattaggcttttagtgtggtaattaaattgaattttgaatatttaaaactatccgtgcaatcccaggacgaaccccacttgattgtggtgtaattatcctttttatatattgctagattgtatttcctaatatttcattgaggatttttgcatctttgttcatgtagtaattttcttgaaatgtctttgtcggattttgatatcagtgtgatcttatggaaattgggaagtggtccctcctattctagtttttggaagagtggtgtagaatttttttttttcttccttgaatgattagtagaattttccagtgacaccatttttggtccatgagttttctttgtgcaagagagttaattacatactcagtttgcttaatagatataggatcattcgtgttgtgtcttctttagtgaggtttagtaatttgtgtctttaagaagttggcctgttttattgagttgatgaatttaatgggcaaagagtttgtagtatttgcttatcatcctaggtagagttttattagtttcattgatctttagcactagcttttggttttgtttctcggtttttttctttttttttttcctttttaatttcattgacttctgctgtttattattccctttcttctgcttgctttgggtttttctttttcttttttttcctgaagtgtttgagatctttctgattttcttacataagcatttaatatgataaattttcctgtaaacactgttatgtcccacaactttgatatgttgtattttcatttttgtctagttcaagatatttctaattttctttgagatttcctctttcaagcttggatttagcaaaagatggtttaatttggaagtaggctgtctacatattcagtggattactgagagaggagtgttgaaatctcttaagtataattgtggaatcatctatttgatttctatcagttttttctttattttgaagttactgctgctaatttttcttgttctggagtttgctttgtctgatagaaatatggccactgtagccttcatgtgattagtgtttgcgtgatatatcttttcccatctttttacttttaatctgtatatatcaatcattacattgaaaactgagctgttatggacagcatagagttttgccctttttaaaaaaaagatctgagcggttgccctgccttttaaatggtttgttttgaacatttacacttgatgtaattatttacgtggttagatttaggtcttttaaaattacttttctctttgttcctcctttttctgccttttggattacttgaaatttttaaaatattctacttgatatatttattggctttttaaaagcttttctcttggtcttactattttagtggttgctctagggagtataatctaactcttgacattctagttaaggtaaatattttaccttctcaaagtaaaacaggtttttttcctagcctctttatattacagttgtcgtatgtgttatgtctagaaacatttaactcttcctaccaagcatgatgttacagttttttatttcaacagttttataagttttcaagaatttaagtggagaaaaatagtgtataatatttacccaggtatttaccatttctgtcgcttttccttctttcctgtagttccaagtttacccccatatcatttcccttccacccaaagaatttcttatagcttttcttttagagcaggtttcaatctctctctctccctctccctccctccccctctccctccctccctccccctgtccctccttccctccctccccctccctccctccccctctccctccctccctccccctctccctccctccccctctccctccttccctccctccccctctccctccccctctccctccctccctctctgtctctctccctccttccctctaccccccgccccgcctccgccaaagacagagtcttgtctgaggctggaaggctggagtgcagtggtgtgatcacagctcattgcaacctcagcctcctcagctactgggactaatacgccaccacgcccagctaattttttgtagtttttgtagagatggggtctcaccatgttgctcagactggtctcgaactcctgggctcaagtgatcctcctgccttagcctcccaaagcactgaaattagaggcatgagccactgcacctagcctgttttttgcttttttgtctgataatgtgtttgtcttcatttctgaactatacttttagtgaatacagaattctagcttgataccttttgatatcctataggggcctgagagattgtttgtttttaaaaaatatttcttctctcttttgttaagattggataatttgtgttgccatatcttcaagttcactgactcttctgtcatcttctttctgatagtgagccggtccagtgagtgagttctaaaattttcatttttttaaaaaatagtaaactctttcttttttgagaatttcagaccgggctctgtaatcccagcactttgggaggtcaaggtgggaggatcatttgagtctgggagttcgagaccagcttgggcggtatacaaaaccctgtcgctactgaaaatacaaaatattagctgggcacggtggtgcatgcctgtagttcagctgctcaggaggctgaggtgggagaatcacctgaaccaagaggttgaggctgcagcaagctgagattgcaccactgcactccatcctggacgacaaagcaagaccttgtcttaaaaaaaaaaagaggattttggccaggcgcagtggctcatgcctgtaatcccagcactttgggaggccaaggtgggtggatcatttgaggtcaggagtttgagaccagtagagggggtttcaccctctctactaaaaataaagaaaattagctgagtgtggtggcatgcccctgtaatcccagccactcaggagaattgcttgaatccaggaggcagagggtgcagtgagcctagatcacgccactgcactccagcctgaatgacagaacaagactccatcaaaaaaacaacaaaaaagataatttcacatttcatttgttttaaggtgttctttttttacctaatggatcatggttgtaataactgctggcctgtaatccgagcactttgggaggccgaggtgggcagatcacctgaggtcgggagttcgagacctgcctgaccaacatggagaaaccctgtctctactaaaaatacaaaaaattagacgggcatggtggcgcatgcctgtaatcccagctacttgggaggctgaggcaggagaattgcttgaacccgggaggtggaggttgtgggagccgagatcgtgccattgcactccagcctggtcagcaagagtggaactacgtctcgaaaaataaaaaataaaaataaaaaaatataaaataactgctttaaaagtctttgataattgtaatatctgggtcatctaggagtcagcatctgttgattatcttctgctttaagaattggtcagttttttgttttttgtatttgctgtgtttggtagtttagattctatcgcggacattttgaatattgtattgtgagattctgagtcctgttgaagtgctgtagagaaagtttaagatttgttttagtagacaaattgacctatttagtttatacctgcaaattctttctcatcttacataggcagtggttccattatctcttcagttttcaaagtctttgccatgttgtttgcatttgcccctcccattcccactttggttgatctagcacttgagcagtgatttatatcctaattttattgtgaaagcctcccttacacttctttggatctgttccatatatatatagatagcttgcagctgggcccacagacttagggatctacttttctgtctcttaatcatcagtgatttcacctatattcttcagctcccaggggccttctttattcccctagccagaagcatggaattatagtttgagtctcctacctgtcatgcctcacatggcagtgagcacatttagggagcccttgccctaaccatattaaataaaaacatggtggtggaaactaggaatctgttttaacaaaacttaccatagttacttttgataaaccaataacagatttgggaacttgtggctagaaacaatatttggcactagcaacatcaagttatactccctcccctctgttttttccctttttgcaagttgaggctcttaacaattcctgaaatagtttaccccaagcaccctatccagtggtagaaaatacagtgtactggatgccacaaagttatagtcatgcaattttagttaataacaggagacttaagtctcttgattgatggagagacttaagatttagcttattttacatatagctaaatctaaattagtgactttatttcagttgtaggcaaatcctcttgttaaaacttgtttttaatttctgagttcttttaaaaaaaaagttttacatcacatttctaagagctggagatgacagtgtctctgttttctgttttctctacaaataaacgtataacttaggatcagttaaaatatttcttttcacatcttaactcttatagatgggtggtgtctatcagcagtgctctgttaaagacagattcttaggggagtgtgggtccagagaagtaaggagtacctagattagcaaaatgtactaaggtgagtaagtgagtgtctgtatctttggcttttggaggggagtatgcatgtgtgtaaatttttctgtaacaaatggtactgtcgaaaacaattgacatacatttctttcatgacactatttttatacaagattactttaaatctgtagctaactacggtctgcttgtggtgaagtaaagtggttttagtccacagagatcttttttggaaggttatttgatgtagtaaaattatatatgagataaaaataagcagacacatgtttgagttccacttctgctattgtaactagctcttgtatctttgaatgagtcaggccttgctgacttcttaggccccgttgcattttgagttaaaattttgtgcacaaatagtgagctcactagtttcatgggaaatggagatatttgtgacagcattgaatgataaggcagtaaactttggttttatttcatagtggtaacttttctttcttgaaatagcagcctaaaagtatgccctgtaaactactatgtggtacagtattttttcattttggttaaatatctctgaagtatccttctaacttaaaagtgatttgaactcatttgaactattcagtgtataaggtattaaattatttttttaaaagagactgggtctaactatgttgtccaggcttcactcgaactctggggcctgagatcctcctgcctcaacctcctgagtggttaggactataggcacatgcgatcgtgcctgagtgttggaaattttccttttttaaaacaaatttttttttttttgagtcagagtcttgccctgttgcccaggctggagtgcagtggtgggatcttggctcactgcaacctccatctcccaggttcaggtgattctcgtgcctcagcctcccaagtagctgggactacaggtgtgtaccactacacctggctaatttttgtatttttattagggacgggttttgccttgttgcccaggctggtcacaaactcctgagctcaagcagtcagcctgccttggcctctctaagtgctgggattacaggtgtgagcaccctgcctggctgaaattttgattacatttagtgtgctgatgtggcagtctgctgaaattattttttttttgcaattaagacagcgccggatttactatagtaacttactttctgtttaatttctttttggcttatttttaatcctaaagaaacctgacatagtagtgtggcagactatgtttaaatagtcttgatcttatcattcaaatatatttccttagaggaataaagaaataactctagggatggaaatttgggtggagtattgtggaaatttaacttcaacctaggagttcactaaatgtccatgaagtgctattaccttaaaatgactttttttcccctccttctttagaatccagcaactatcacaagaatactccttagccacttcaattgggataaagagaagctaatggaaaggtaaggaactatattgtcagctttgtacttagaagtaacacagaaagcctattgaaccgaatttacaagaatcaagtaagggaattgatgaatataccagtatgtggacaacccagtgtgcaactagtgactgctttaatttcttgtattccccttttgtaaattttgcagtaaatttaatgttagggagttcagtcttagtgtttctttttatttgggagtatgtgtgtttgggggtgtgcttcagtatcttctacatatatcctcttgggtaccaagaactgaaagcaggtagagaaaaaaagcacctgataacattcttggagtacatgagtaagatcctcctttaattacttaaaaagatttcttgctcatccgggcatggtggctcacgcctgtgatcccagcactttgggaggctgaggcaggtggaacacgaggtcaggagattgagaccaccctggccaacatgctgaagccccgtctctactaaaaatacaaaaattagctgggtgtggtggcgtatgcctgtagttccagctactcaggaggctgaggcaggagaatcactttaacctgggaggcggaggttgcagtgagcagagatggcgctactacactccagcctggcaacagagcgagactctatctcaaaaaaaaaaaaaaaaaaaattcttgctcacaaacctttaacctgttattagtagcatttattcagtagaaacaaaattgagaagttgcttaggcttttctggccaccagaccaggtgcttggactggttctctggtttcagggcaggattctattccattgggtttttaaaaatattttctttctgaaaatctttatagttttaaaagagaagaaattagtgggactggagaatgacagtattaatgtcattcttaatcttgttctgctctttggtttggaaatttgtttgaatggaaatttgggacacttgttaatggtgaggttgacaacttatgtttatttcattatcaattctaaatttaataaaaaattaaacctagttgttgggaactgacaacccatatattatagaaataaatggaaagtatttcccatttgattttaaaattcagagagtactttataaaacataaataataccgagaatatcaccccatttcatacaccttgtatctattaaattacattgtaaataatatctattgttactattaaattacaatttaatagtaacaactatctcaaaacaaacacatactgtataaagctttcccatggttcatgaaggataacatgttcaactagtttgatttttctttttatgcattctgaccatgttttttttgtttttttttttttttttttttttttgagacggagtttcgctcttgttgcccaggctggagtgcaatggcgtgacctcggctcactgcaacctccacctcctgggttcaagcgattctcctgtctcagcctcccaagtaactgggattacaggcgccctccaccatgcctggctaatttttgtatttttattagaaatgaggtttctcagtgttggtcaggctggtctcgaactcccaacctcaggtgatctgcccgcctcagcctcccaaagtgctgggattacagttgtgagccactgtgcccagccctgaccgtattttttgacatcagtggtgtttcttaattttggtaacatttactttcaggtttttttatttgatgacacctctactaggagaaagagtttttatcgtttacttgtgaaactctaatgaattaacactgatttactcagagtttctctcatattaatgtatttctccaagacattctgaattttatcctataacactgctgaaaatatttttccattaaatattgtacttaatatttgtgtactattggatttaatgttgtactaaattttgtactttatatgggaactgtagcttctgctcagtttttctgggaaccttaaactgtctaaaaaaataggtggtaagtgtgaatttaaattaaaaggaggtttctgggaaacttctgagtatgtgaacgtttcagtttctccttgtagtttctgtagagaagctattggatacctaaaagatttataattcagtctttaaatagtgtctttaaaatcaatatgcaatatctttttgtctcatttaatgattttcacattatattttatgttgtctgctattagcactgccacactttttttttttttaaagcatttgactgatgtatcttttccattttttaaatattcaacctttctgggttttaggagtgtcttttgtaaataccatgtaggtgccgtttaaaaaaatctgaatgaaaaaactattatcttttaatatcagagattaacatattcatgttttataattaatgtttagattaaattactgtcattttaagttgtgctttatatttgttatgttttctgttcgcttattctgttggcctcatcagattttcctttttctcgaataatttcaaatttatatatgtattctatttcagtttttctagtcacttttacaatttgtacatgcctacttacaactatataaaagtttctaacaatatttacttgaagttttaatccatcctctgtacaagacaaaaactgtagcataaatttttttctttgtcctttccttgtccctatcagcttgataagttgatgtttgaatttttttttttcttttctttttgaaacagggtctcactctgtcacccaggctggagtgcagtggtgagatcatggctcactatagccttgacctcctggactcaagcaatccttccatttcagcacccccagtagctgggaccacaggcacgcatcaccatacctagttagtttttatatttttttgtagagatggggtttcaccatgttgcccaggctggtctcaaactcctggacccaagcaaccctttcaccttgaactcccaaaatgctggaattacagacatgagccactgtgcccagtcgatatttgaattttttatttgattgtaagcatttttactatgtatgtatttaatgccccccccccccccttttctggctaattcgctttttgcataccactattttttttctaaatacactgtttttcttagaatatatcctgtaatataaattgtttcacatgtgacaaactttaagtcctataatagaaactcttaatatactgaaacttactgtaatatttctggatgtgagttttgaaaacataaactgttgggccctttaagtctgacaattcatatttttggttttggaaattctcagctgttatttgttcagcataccttttctccattctcttgatgctttctggaattcctggatccatgttgaaacttggggatctctttccatgtcttctaacttttttttttttaagatggagtcttgcctctgtcagccaggctggagggagtgcaagtggtgccatctcggctcactgcaacctccgccttgtgagttcaagggatcctcctgccttagcctcctgagtagctggggttacaggcacccaccaccatgcctggctaatttttgtatttttagtagagagagggtttcaccatgttggccaggctggtctcaaactcctgacttcaggtgatcttcccctctctacctcccaaagtgctggggttacaggcatgagtcattgcatccagcatgtcttctaactttctaaaaaatacttcttctgtattcatctccccacccccagcacttgggcaagtgccagtgactgtactcatctttgtttttgactttgttctgtgaaaattcctcagtttatcttgcttttcttcctgcatccattctgctttatagtcgtattgaattgtttattcaacagtatccatcttattccttttaataactttgttcttgttttgtgggtacaatttttgctttatctctcggtttattcttacattaaaataattagaattaaataatgagaatacaaagatgagatgtggctgaaaaggtccagggcaatttacagtcttaagggtttttattagaaaaagaaaatgaggtaaaaaactgggctgcgcaccatggctcacacctgtaatcccagcacattgtgaggccagggaaggcagctcacatgaggccaggagtttgagaccagcctggcctacatggtgaaaccccatctttactaaaaacacaaaagttagccaggcgtggtgatggacacctgttattccagctatgcaggacgtggaagctgaggcacgaaaatggcttgaacccgggaggctgaggttgtggtgagctgagattgtgccattgcactacagcctgggcaacagagtgagactctgtctcgaaaaaaagaaaaataaaaacaagagaatgaggtaaaaaaaaggaccaagcctttgaaacaggaagttagaaaaataaaataaacccaaagaaagtagaaaaggtatttaagataaaattagatattaatgaactagagagcaacaacaacaacaaaaaagataaagatctttgacatgaattttctggaagataagctacagactgagaagatatttgcaaaagacacatgtaacaaaggactcttgtccgaaatatacaaagaactcttaaaactcaacagtaagaaaacagtctgattaaaaaatgggccaaagagcttaacagacacctcaccaaagaagttatacagatggcaaataaatgaaaagatgctccatgtcctatgccatcagggaaatgcaaattaaaacaacattgagataccagtacatacctattagaatggccaaaatcaaaatactgactaccaaatgtggaccaggatgtggagcggtaggaactctcatcatttctcgtgggaacgcaaaatggtacagccacaaaatggaagacagcgtggcagattcttaaaatacaaaatgtactcttactatgtaactcagcaatcaaaacttctttaaaattacccaaatgagttgaaaactgtgtccatacaaaaacctgcacatggatgttcatagcagctttattcataattgccaaaacttggaagcaaccaagatgtctttcagtagatgaaaggatgagtaaactgtggtacatccagaagtgggatattattccgtgctaaagaaatcagctatcaaaccatgaaaaaccgtggagggactttaaatgcatattattaaatgaaataagccaatctgcaatggctgtatactgtacgattccacctatgtgacactctggaaaaggcaaaactatgaagacaatgaaaagatcagtggttgctaggggttagtgaagagggagggatgaatagtcaacagcacagttttttttttttttgggtgggtgggggcctaaactattttgtatgatactgtaatggtggatatgtatcattatgcatttgtcctgacccatagagtgtataacatcaaataagaacccttatgtaaactacagactttgggtaacaacggtgtgtcaatgtaggttcattgaatgtaccactctgtgttgttgatagggaggctatgggtatgtattaggacagggttatatgggagctgtagcttctgcatatgtttgctgtgagccttaaactgctctaaaaaataataagttttttttttcttttaaagggggaaataaaccgttggcaaatgtgttgggggagggggagaagacacaacattgagaataataaggcataattagaggtaggaaaaataccgtgtgctacttttacatctttttttttttttttttttttttttgagatggagtctcgctcttttgcccaggctggagtgcagtggcgcaatctcggctcactgtaagctccgcctcccgggctcacgccattctcctgcctcagcctcctgagtagctgggactacaggcgcctgccaccatgcctggcgaatttttttgtatttttagtagagacggggtttcaccatattagctaagatggtctcgatctcctgacctcgtgatccgcccacctcggcctcccaaagtgctgggattacaggtgtgagccactgtgcccggccttttttttttttttgagatggatggagtcttgctcggttgcccaggctggagtgcaatggtgcaatgtccactcattgcaacctctgcctcccggttcaagcgattacaggcgtgcgccaccatgcctagctaatgtttgtattttttggtagagatggggttttgccatgttggccaggctggtctggaactctgacctcaagtgatccgcccaccttggcctcccaaagtgctgtgtgagccactgcgccagcccaagctggtccacttttacatacatttgaaagcttagaaatggaaattacctaaattgtccctcaagaagaagtagaaaaatagagtaaacccataaccagaaaaatatggtgaatatagtaaaagattccactccttccccaaaaagtactggatgattttatgggtaagttctgtctcataaacgttcaaggaactgccagttcctgtagaaaattatctccaaacattgaaaatggtaggacatcattaattcatgttagccagatcagaataacccagttccaaaatttgacagacagtaggagaaaatgatacttataaatatagctgttgaatttataaataaaataatgattgaatcaacgactcttagtaggatttctctttttttccttttgagacagggtctcactctgtcacccaggctggagtgcagtggtgcaatcttggctcactgcaacctccgcctcccaggttcaaatgattctcccgccttagcctctcccaagtatctggaactacaggtgcgtgccaccatctctggctagtttttttctttatttttagtagagatggggtttcatcatgttggccaggctggtctcgaactcctgaactcaagtgatctgcccgcctcagcctcccagagtgctgggattataggcatgagccactgtgcctggccaatttagtaggatttctcctaagaatgcaagaatagatcatcatcgggggaaaattttttcgtttataacatttacaacattaacagatttatgaagataaagaataatcataataaatgtcagttatgcattttaataaaattgtgtattaactcgtgatttagtgaaaactagattcttagcaaactgagaaagtgatttctcagattgattaaaggtatcaactaaaatctacaataaaattatagttaatgttgaagcatcagaaacatgcccattgtaatcaaacaaggattatggctgtcaccaccatttgaatgtattggaagttctgataaataacgtaatacatggaaaattaaataagtggcataaagactagaaaggaagataaattatatgtaaagtatataatctaggaaacccagaagaatcgactgattaactattaaagtgattgcccattaaaatcacctgagaagtgaaaaaaacccacagtgcccagtccctttccattacttcttccttcagttctcttggaaaatgaaaagaaacatggaatgtaagtagttgtagcttcggtgacccctgtgttcctccacattcttttttttttttctcaatttttttgtagaagcagggtcttgctatgttgtccaggctggtctcaaactcctagacacaagcgatcctctcacctcagccccacaaagtgctgggattgcaagcgtgagccaccacgttcaatctccacattttttgcatataaaaattgaggttacccatatggtaatcctgtaggtatttagtatcctaggaattgttaagaaaaggtaagcaatatacctacctttagtctacatatagcccataaggtttgtaacatcgtattttttaaaaatcgtgcttcctaatgggtaacactgaatgtattaaagtgtcatttctccttatttcgatatatttaaagataaatcttatcctagttaaaattgtgaaatattttaaaactttcttttcctttgtcatttccatataccaggcatattagtatttctttttattttattcattagtaagccatagtccctgccctggagggaggtgcccatggtcccctgagggcaatagaggtataaatagatccttgccagttattcctcttgtttgccccatgcctcttagtctgtagtttaaacaaatttatactgaccctaaaaatgaatgtgattttttctttttaaaaatatattttgaggcaggtacagtggttcaaccctgcaattctagtgactcaggaggcttaggttggagggtcacttgaagccaggagttccagaccagcctgggcaacacagtgagactccgcctttaaaaagaagtaggaaacttagctgggcatgatagtgtgtgcctgcagtgctgcctaccagagaggccgaggtgggtgtctcacttcagtgcagagactgcagtgaaccctgatcttgcactccaacctgggcgacagaggaagaccctgactcttaaaaaattaaataagatataaattttgggcaaaggtcggagctggtggagaaaggacacctttaactttatggtcttttcttttatccattatagcagttttccagaccactgtcattttctttcttttactgtctaatgcttttttttttttttttaaatctctgcagattaatttctcttctgttttacaaactaaatagaattttctataattactaatttctttccatgcctctccagatgaagcaaagcaaagcataaaatcagaaatacagcaacaactgttatctgtcaagtcttccatctgggttttgatactatcatgatttttgtgggatattgcctccattatttcatctgtcatatcttgaaccttttcctcctttcttggtatatcagtcaggatttttcattataaacaaactttaagaagttaaaagtgaaatagacattaaagattgagaatcttaggtgtgaaggttgtgcagtcaggaaaatgccaaaatcagaatgtcaaactattttagtggaggcactgttgctgctgccattgggcacaggtatcactgctgataacatcaatattgggcatatgacaccacaactaatacctctgcaacgtctgaaagctggatatctccttactcctttgatagattacctcattgaaccttctttgagtagtgagtttttgataaactgtctccctgctcctgcctgggaggaattctctcacctggagggatgggaaagtgaattgtgtcctctgtttaccttgctagctttttttttttatctccgtatccttatgtctgttctcatattacactttagtagtacaaaacttttgtgacagtcaccaaattcatttttctgctgcctcagctttgcaattgtgttttgacccagggcttctgtttactgtgcagctctagggagcatctttggaattgtactgtcattggcccaggcctgacttgcctttcttactgtcttttttcctaattttccttcaaaactcaagttaaccttttcttctgagacagcttttcttatctctcaagatctacttgctttgcactgtattgtttatttgatttagtattttaccacttctatttgaggttctttgtgcagaaactatcctacttttcttgtattcctacacataacgcagttcctaatatatagccattgtttactaagtattttaattaaatccagccatttataggttttcttttctgtaatagaattttattgaagttatgacatgaatgtaaatcagatttcattttgggagcttttagaaacagcatcaacaatggagctacttttaagttgataacaagtaaaaaaaaaagtgtctttcttgcagctcagatttcttgtaggttattaaattataataacatttaaaaactcatttcagttgatagtatggtagtatatagggtaaatgctaatgaattaattggtgtgtttgaggtgggatgaaatacaggtggttgaaaacttaaccacctataaaacttaattatacttggacaggtataattaaagaatcctgaagaaggatttcagtctttcctggactctgttacaaatagcttttcacttttcattctgaagcattaatacccatttaatgggtaggtactagtgttaatacttggatgtgattatgataacatggaactttttgtagccacattattaataatatataatttcataattagcctcagggatggtgaaagtaaatttggtttttcagaaaccttgcctttttgatgacatttatcactattctacaatacagtgaaatttttcctgtttaaacaatccacggccgggcacagtggctcatgcctgtgatcccagaactttagctgactgtggcaggaagatcgcttgagcgtaggagtttgagactagcctggacaacatagggagacccccatctctacaaaaaaataaaaaattagctaggtgtggtgatgcacacctatagtcccagctactcagaaggctgaggcaggaggattgctggagcccaggagggtggagctgtgatctgtgatcatgtcactgtactctagcctgagtgaccaagtgagaccctgtctcagacaaaaaacaaaaaacaattcacgtattattgaggagagtagtgaagggcaagaggcaaatgtacggctgggtgtggtggctcatgcctgtaatcccagcactttgggaggccaaggtgggcggatcatgaggtcaggagatcgagaccatcctggctaacacagtgaaaccccatctctactaaaaatacaaaaaattagccgcgtgtggtgatgggctcacgtagtcccagctactcaggaggctgaagcaggagaatggtgtgaacccaggaggcggagcttgcagtgagccgagatccaccactgcactccagcctgggcgacagagcgagactccgtctcaaaaaaaaaaagcaaatgtactatctcattatagtacagtgattaagaacacagaattcttgctccccctatctcactatctcacctagactggagtgcagtggcgtgatcacagctgactgcatccttgaactccggggctcaaactgattctctcgcctcagcctccctagtgggtaggactgtgcaccacaacacctagcaaattttttgtagagatgggaccttactttgttgaccacactggtctggaactcctggactcaagcagtcctcctctcttggcctgagccactgcaccctgccaggaattttttaaatatcagctatgtttaagacattgagcaggagcttggtgatgaggagttacacacaacagtgtatcatacaatagaccaccatggtacgtagagataagtttttatggctccatggtacttagagataaatttttatttttgacctaggtgggaaaggatttagtaatgaggtgtggcatttgattggacaaggaagggcagaagtgatatgggaacctgggtatttaaggctcagaaaacaaaactaagtggggcacaaagtttaaggaatatatgttgaacaattatgagattgaatgtctggagtatgcgaagaatagaggggaaatggttggaaatgtttaatgcacgttataagggccttgaattttaagtaagtgaatttggaatttttctgtctttattgggaagcccttgaacgttgttttatggagaaatagtgatggaaaagcattatttcagaaaaaaatctagtaataaatgagctgttttaactatccaggtaaaaggaaaatattgtcctgacttacaatagtgacagctaaattgatagcagagggtagatggaaagagaagtaaaattagttttaactgagacaaaatataggagactctgggaaacttctggtaattttgaccgttcctttcactaaatacactagaagaggctaggtgaaatactgaaacatgtttgaaaagtaagattatcaaataattagtaagataggaaatagaggttcaaggttgagagtttgggaatcaagggaaatttagagaaacaagcttccagtccttgttgctctagcagtgtatgttgatccagaagaggtagctaagagacttagctgtgagttttgtttgccctttgttagtagagggggaagttggaatattaggtctactaagagcgaaaattgaatacactagctccttaaagactgaagatgatcttcatgtcttttgggtagtccagaaaaccttaaaccttgaacttgggttaagatagcccccgtatataacagaaacaaacgtaaatcttctctagggaaataacattatttaagaccttaaactattttctcaaattatttttctaattaaaacataacaacctggaacttaagatactggaattgtcagacctagaccaaaatgagtatgctatcaccagggagctgtcattcagatttggaaaaaaatcagaatttttataactaaacaaaataagcaaaattaactttgtgacatagtttaacagcagactggacaaagctgaagagagtttagtgtatttgaaaatcaaacaatgatccagaattaagtatatccattaaaagatggaaaatacagaagagattaagaaatacagaggatataatgagaaggtctcattgagttttagaaagagaggagagaatgtggcagaggcagtattttaagataaaaatgactgagaattttgcagattggtaaaagacccaaatgtcatagattgaagaaacataacagttcccatgtgtgatagctacttgtttcactgatcctaagatacacagtttttcacattttaacatctgaaatctggatgcatctttcaattattgacaccttacagtccaaaaagattgaaattttgactcgtgaaaaattttccatgtcaacttctgttaagatcatgaaatttcagcacgaaagcattttagattttatgaaatatggtaaaaagaaatccacatttttatttatttatttatttatttatttattgaaacacagtttcattctgttgtccaggctggagtgcagtggcacagtctcagctcagtgcagcttgcacctcccgggttcaaggcattctagggcctcagctttctgagtacctggaattacaggcacgagccactaggcctggttaactttagtatttttagtagagatggggtttcgccacgttggccaggctggtctcgaactcctgacctcaggtgatgtgcctgcctcagcctcccaaagtgctggtattataggggtgagccactgggcctgaccagaaatccacatttaaaaacatcttagtaaaactacaaaatcagcaaaaataaaaaatctaaatcaatgagatacaagaaaggctgctttcaaaagagtgaaagtataggtataataatattctagagcacagctcaacagcaacagtgaaagtgatagtaagatgatacctcagtcttttgaaagaaaataaaccttacctagaatactatgttcatggaaaatatattcataaacagtatgttttaattaatataaatggttttatgttgtacctagcttttgtatctttttaaagccaaccaacattttgttctgccagtgttgattgaagtttcaaatactcataattgttatttaagcaactatttgtctgttaaagggaaaaatcttgcagaatgttgtactttggaatttataaccttaaatgcataatgagctaagcattcatcttaaaagtctcaagtaataagcttagaggtctcaagttaggaaaagaacaacaaaataaatatagggaaaatacaaggaaagaaataaagaacagaatataataaaatagaaaacatgcagtagaagggatcaagaagccgtaagatttttttttttttttaagactgataacgttgacactttgatgaggttaggaaaaagagagatcctaaataaccagtattaggaatgaaaacagagtatcactaggatcttgtggatggtttaaaaaaaaactcttaaaattatggacaactattcaaacttgatagacgaaatgggtagattcctagaaataggcaatttcccaaaactgacataagaaatagtaaacctgtatccttattaagtataaagaaatgaaatccataatttaaaatgttcttataaagaaaagttgaaattcaaatggttatactggaaagttctaccataacatttaatatgacagtaacttcaaccttattctaaagaacagaaaaataggatcttctgccttcataaagatatcataacctttataccaaaacccaaggaaagatgatacaccagtttgtcttatgtacatagatacaaaaaaaccatacatacacacacgcacgcacacaaaacaaaaactggaacaacagaaacacctcagaatattagcaaattgaattcagcaatacatatataaaaaggagggtaacccagcatggccacctgaggtgaatcctgggaatgctaggttggtttaacctgaaacaattcagcatgattggtcacttgaacaaattgatgagaaaaacatttcagagatgccaaggagcctttgcttcatgattttaaaaagaagctattagcaatctagaactttgttaaccttataaatcttacagaaacatttgtaggagatatcatagtttatccactgaaatgttaaaaaagatttcccttttagatgggagttcaagatgtggatatcgtatctccagttcaattcagcattatactagaaatgattctagccagtagaacatcaaaaaatgaaaacaaaatacagtgttgtaagagaaatgcctgtgtttttgggggttttcttttttttgagatggggtcttgctctgtctcccaggctggggtgcagtggtgagatcatggctcactgcagccccctacctgccaggttcaagcaattctcctgtctcagcctcccaagtagctgggactacaggaccatgcccccaagcacagctgatttttgtatttttagtagagatggggtttcaccatgttggccaggctggtcttgaactcctgagctcaaggaatccacctgtcttcagaagtgctgggattataggcgtgagcccgtgggcccggcccctggctgttaatattcactgacaatgtgattgtgtattcacaaacaatgtgattgtacatgtggaaaaatcagaatctggaggtaaattgttagaataaatgtctttagaaagaaatatgaaaaatttcttttttctttgacccaataattccgctctcaggtatatatccaatagaaagaaatacgtgcacatctacattgaaagtcatatataaaactggtggtggctcatgcctgtggactcagcaacatgggagaatcgcttgaggccaggagttacagatcagcttgggcaacatagtgagaccccgtatttacagaaaattaaacaattagctatgcatggtggcatctgcttgtagtcccagctactcaggaggctgaggtgggaggattgctggagcctaggaggtcaaggctgctgtgagccatttttatgccactgcactacaacctgggcgacagagtgagaccctgtctcaaaaaaagaaaaagtcatatataagcatgttcctagcagtatttattcatacttcaacctataaacaacccagatgtttatcactattacactagatagataattatggtatattgacatagtaactattcagcagtgcaaaataaatgagcaaaagctacaagccacagcatagataaatcttaaaaacatagtgaaaagaaaaggaccccaagtaatacctatctactatatggttctacttacataaaatataaaaacagttgaaactaagtttatattgtttaaggatgtgtgtttaggtggtgtagctatttaaaaagggcagtgattaaaacagttgaaactaagtttacattgtttaaggatgcatatttaggtgtaattattaaaaaaaaaaacagggtagtgatcatacgtttaggggggcttgtagagtactagcagtcttctgtttcttgtcctgggtggtatttatatactggtgtttgttttataacagtttgtaagctgcatgtttatgtacttctctaggattgtgttattgcaaaataaaaatcattttaaaacacatatacacagacataggaaaaggatcagtcttaaagggaaggtccatcttttttcctggacatgtaggattaatagttcctttgtacctacaagtaaacttacattttgccaagacagcttttctcactgctctcctaggctctagtatattaaatctatcctaaatttaacttagattgtgttaacttacttgagcaacctctgctacccttgtggtttctgccacatcaaagccatactccccggatttggggtttgaaaaccttgtgtacattcactccattctgtatgtctttgcttataactgtatattccttgggatgccctctgctattcaggcctcaatcttaagagctgtagctttgtacagaatcagagcgtatcaagaatacttcattctggggttgtgctcatagccatcacgtacaattctgtgcatcacaaatcgatgcctcctatgtcttcttattgtctgtattctttttttttttgagacggagtctcgctgtcgcccaggctggagtgcagtggcgcaatctcggctcactgcaggctccgccccctggggttcatgccattctcctgcctcagcctcccgagtagctgggactacaggcgcccgccacctcgcccggctaattttttgtatttttagtagagacggggtttcaccgtgttagccaggatggtctcgaactcctgacctcgtgatccacccgcctcggcctcccaaagtgctgggattacaggcgtgagccaccgcgcccggccttattgtctgtattcttaccacatttaccaacttgtttcaacatcttgaagttagttttctgtacttctctaggattcttctcccattcttgcatgctaagtagcatgtcatactacaaacaggtattcatctctttccttccaaacaattgacattacaactaactagcataattcctacatatagttgctgaataggtgagggaactgtgttaaatggaacttaattatattactaccttgtgttttgatggataatttgttttaacatagctgaattttaaacatacttgtttgattcataggctttcaacttttacagcctgaggacttgcattagatatattgaaaaatcgttatcaaaacaataaaaagacaatttctttttatatacttgaagaaacgatatttctcttcagttggaatgagatccactgttgcatgaatcacaagtagtagtgtgttttattttctagataaaaatgtatagcaggagcaaaagaccattaagcagagggtgtagatttcctttaatgcacgtatttggaaagaggtggacaaaaaaagccactgtcttggttttctttgaagtaaaaatagttttttaaaaataatggttcttgtcgttttggggactgtagtctcttttgaaaaagtaatacaatcttgaaccttctcctgggagtgcgggggtggggcgggggcagagaacatttgtaaataagttataacatttggattctgcccaattgttgaaatgccagggacctccaattacaaatttatgtgtttgatgatcttggtaaaactgaaatagtcataagccagaagtcgtagacaaccaccagtaaagatgacacatgtgtttgtagtgtggctggaacaccctgtgaaaaccagcatctgtgtcttctaaagcctgtattgtacagatgttctccattctgtgttagaaaaagaatagtcattaacttcttttgtaaatgtcctccatacttttatttttatcttttaaattttatttctaatagagatagggtcttgctatattgttcaggctggttccgaactctgggcttgagcgatcctcccagcttgtcctcccacagtgctgggatacaggctcactagctactgcacatagccttttttttcttttgaaattttatttacctgcatagttttacatctacctttaaaactcatgagaaacaataaaattttattatgtaaaaaagctttttgattagcaaaattttttatcgtaaaagctgaatgggggggatgtaagaggtcaatttactgttcacttggcttttgggtatttaggtttttctgtagtaaatgggtattggatccctttggaagatggcatagtttattgtaattctgttatggttttgcgaattcgagcctagaaagagttatcttaacatctgtttcactgtggttagttccttaatccacctgccttcatcctggctcagaactaaaaaggttaaagtatgcagtaagatttttgtgctgccacttggaagtagtattaattagtagctgctctatcaagcattcttttgcttagcagtaagcaaacttaggagattttattacaatgctgtttttttaggttttattttattataatgcctttttaaaaaaaattaggctaataagaaaaatcttatggcctcaaaaagtattctactttttctgaaaaatatatgagcagtatgtatatttagctataaaaactacatagaatacccatttttttttagagattagcttaagaaacctaagtcttttatagcaagctgttacagatttgtgtgagttctcatttttgttgttgttgttgttgttgttgttgtttgtaacatgagggctaaaagctttccttaggataaaaaggttttctatccttaactcctttagatggtttttgttctttggaattctgaacttacctagtagaggtatgtagttatgccagtcatcttacattcttttgaaagaataactttaaaaaccacaaaggatgcagtaatatcttttaatttgtttgaaaacttacattctgcctcaggaacccttttttaaatttaattttttatcaaagtaacacaatcatgattttttaaaagtccaatagtttcccaagagttataaatgaaaaatagtgctccaaaccctcagttccaatcccattccccagaagagaaagaactatttattttagtattttttatgacttattattccgtattgctgttttaagacagtcatcttcatacctcatgttacttttgctttttataaatgtgacggcagttcttattcattcgtatgatttaaatgaatttaagatattcctttgctcctttgacattttcccttaaatgtacattttctaaaagtagaaaaaaattacatcattaacaggttaatgtggctggggggagttgaaatggcagttcttggaagggttttggcaccctggatttttgttctttgtcagaactataaggtatagaataattgtgacttttgtagtattttgaaattgcaatccgatacccataaactgccatatgtgagtgttaaaacagaaatgttttggtcatttagaagtaaacgttatgtgtatatacattttcatacatggatacatataacctataatgtgttttttaatacattttcatatgtgtgcttatttttactccctctcaggcttatagcaatagctagttgacttgcaaatgtataatggaagcattaaaagactggataggaggattgagctctgatagtttaagaataagcatagaggctgggcgtggtagctcacacctgtaatcccagcactttgggaggctgaggtgggcagatcacttgagcccaggagtttgagaccagcctggccaacatggcgaaaccccatctctactaaaatcacaaaaaaattagccaggagtggtggcacacatccgtaatccgctactccagaggctgaggcacaagaaatgtttgaacccgggaggtggaagttgcagtgagctgagatgaagccagcctgggtgacagagagagactttgtctccctctcccccgcaaataaataagtaaataaaggaatacagcgtacaaaagcctactttatatctttaaattggttttacattttgcttttctgattctattgtgagaattagtacttctccaatagttgttggtctttatgaagtatgaagacttagtagctttgaagataaaattaaatattcgaatggcagtgatgccacagtcactcaggattcaagaagaagcattagccagtggtgatccctaccagccccgtttcctctctcctcaaccagacataagagctcttaggctgtaactttcctgccttgaaatttaattcatattatttggtatgtttctctatagcaggcaagtaaaatgaaaaattaagattcaaatattctggaaagttgtctgagtaccaggttgctcagctgtatttctgtaaatatactcaatgtgcagaaataatcctggagagaagagaatttacaatctactgagaaactgcttaaatccaatattttttaaattgacagattattgtctatatgaaaatcttaatgtagagaaatataggccataggaatgggtgttaacctgcttgtgccctttcttcactaaggaaaggctgaaggagaaaccatactgctgcttgtttttttactttgatcaatatgatttcctgaaaaggataggcagggttacagggaaggagagaagcacagtcctaggataagctttgcagctctttcaagtcaatgaagcagagagaagtatttggttaactcattaaagatgcctcaactacagtgctttacattgagtcagttcctttttattttggtctgattttcagaagcaatgatttacatagaagccagcaaactgaaggaacttccagatagtgcccaggtaaacagtgtggatagttaagaatccagcctattcttctatgcctggactactatccaggcacagtagtcttaaataaaacaatcataattagaagaaatcagctttgtcttaggaaattaaacataagactcttgagatgagggatcagaggtaaactgataaaacaacagaaggtgaaaagggaactgacagaacagaaaaaaaaaagaaaggataaataatgattttgtagaacttcaaaccatgttgatagcagaaagaaatagagcaggcattacagaaaataggtctggaagacaggaaaaggacaaagaagtaagtagcaactggtaaacatggaggacaaattaagagactggatgcaaaccaaacatattcttaacaactaaaggatcttgaggtaattaatatccaaatgacatttcaaaagagaaagttaagtgcttagaataaagcctagtggaactgctaaagttcaagaataaagaaagaagaaaatgagaaaattattttggccagacttcctcagtaacaacaggtaacaagaaaatagaacactatctctatatgaatattgaggagggaagggattttggccaaagtgagcagttgaacacatttaaacattagaattatgtctaagtagttggaggtgatcaagtttatgagacaaaaaacagttatcattcttgaaagaaaggctacatgatataaaaacaatgggccgggcacggtggctcatgcctataatcccagcactttgggaggctgaggcgggcagattacaaggtcaggagttcgagaccagcctaaacaatatggtgaaactctgtctccactaaaaatacaaaaattagctgggcgtggtggcaggcgcctgtagtcccaggtacttgggaggctgaggcaggagaatcggttgaacctgggaggcggaggttgcagtgagccgagattgcaccattgtactccagcctgggtgacaagagcgagactttgtctcaaaaaaaaaaaaaaaaaaaaaaaattagtgaaaaaattatataaaactgtaatcaactgggaagagctttaggaagttctgaccaaaaccaaagggatgatcaatgtattatttaagttttataaattaagaaatgtatttaagtattaattacataggccactcctagtaaaactaaattagattttagtaatttccaaataaacattgtggagtcaggggtgaatggaccatataataaatacagatcagaacaaatacatgaaactttggtaaaagaaaaagatttctgggcctactacccccaagaatatgagtggatttttagcttcccactcatatttcatttaaaatacttagcagtatttgaaagttcctttggtggcttctagaatggatcaaaaagctataaactccaagccacatgtagtggtgtgcacgtatagtcccacctatactcaagaaggtgaggcgagaggatctcttgaggccaagagttcaaggctgtatgctattattgcatatgtgaaaaactgctgtgcaccagcctgggcaacatagtgagaccctaactcattttttttaaaaaaggtattaactccaatatacgctatttttaaaaatgctgcaaactccagtacatgctatctaaagcacaggaattcagattgatagtaaaagtgttgatgtgatcggacccaacaccaggctgtgggggcgacaaagtccagcggagtcaaaggaatgagaaaagacaagagacaaagtgggaccagggggccaacgctagtatggaggctgcgaaggcctggagctctgggagcccacgctatttattggtgatcaaacaaagaaacaggtggtgaggatgtgggggttaaaaggaagcggtgtatcaagcgaatgagctacagctgtgagggtttagcattttctttgaaacatatggctagttgagataatgggagtgctagaagtaaggagccagcagtctagcaggcatgcaagccctgcctcagcttctctcccgacactcagcttttctcccaacaaaaagaacttgaaatacctgagaataaagttactggaagatgtgcaggatccacatagtgaaaaaaagttataaaactattgagagactgaataggaattggaattaagtaaattaaaagatactttgttcttggctaggaagacaatattatagagtcaattctttcagtcagtttactcttgatataattgtagtaaaagttccaagaggatttgaaaaaaaaattaatgattgtacttaacttgaaaaaacaaatatggaagaacagagaaaattctgtgagaagaatgataaagggatctttgtcaaatattgagaatttatcgactacaagagcagacaaattagtggaatagaatggagagtccaggaataaacttgtctaaataggaaatttgggtatatagtgaacagatcagtggggagagttagattagtcagttactctttaagaagaaactaagtgcttgtaacatgcctgtagacattaagggctccaggaataataaagtagtcctcatggggtttacattctagcagagcaaacataaagagtgattacagttagtaatgttgtaagtgctgcaaaggactgcagagtaacaatgggatgtaattcaagggaaccttatctaatgggggtggaagtgaggagctgtcagagatcagttatttgaggaagctgggtgtaagctggaacctaaaggtgggaaaaagtgtttccaatagatgaaacaacccttcaataagtgattagatttttggattgaaatgaaatggaatcctggctttactccttattacgcaaaaataaatcaacagttttaatggaaacaatttaaaggtgagatctaaatcattaatgaatttccattaaaaaatctttgggtatagaggtcttttaaagtgtgatatgaactgcagaaatcacagtggagtagcacgataaatgtgcctacataaaaattttaaagtggtaattaaacactattaaagaaggttgaaagacaagaaagaaatgaaagaaagcaacccatgaaacaaagatttactcttcctctttgcatactgaacttaatagggaataagatcaccacagaaaaatgtgttcaccttcactaataaataaataaatacaagttaagtctaggtatttttccctatctgatgggctaagattttaatctaggattatttatatgtggcacatttaaatgtccttcagaataacattggttggatatattatagtaaataactacagtggaatattgtgcaaaaatgaaaaatgtagacatttaaagacaaaggtgtctgttagatattgtctagtgaaaaaagcaggttataaatctggactagggtgttacttatatgaaattagggacacatgtctgtgtggctgtatactcatagaatgctgtctagaatgttaaccaaagtatgagagtcattagttccctgttgtcaaattttggatgacagaagtttgtcttgtcttgggagcatgaatatttttataaaacaaggtgtttagctggtttatgaattgatatttagtgttaatctcttatgctttcagtttttcaggtaaaacttggtattttatattatctttttttttttttttaaatttgagacagtctcgctctgtcacccaggctagagtgcagtgcagtggcaccatcttggctcactgcaaccttgcctcctggattcaagcggttctcatgcctcaccctcctgagtagctgggattagaggcacctgccaccgcgcccagctaatttttttgtatttttagtagagatggggtttcaccatgttggccaggctggttttgaactactgacctcaagtgatccacccacctcagcatcccaaagtgctgggattgcaggtgtgagccaccgcggcgcctgtaatcccagctactcgggaggctgaggcagtagaatcgcttgaacctgggcggcaaaggttgcagggagccgagatggcgccactgcactccagtctgggcgacagagtgagactgtctcaaaattgtaggaaagcatttgattttctgctttaaatatattctgattatctgaatcatcagagacattaattttctatttgtatgagttcctgacaacttttaactttctgataatcctcctttttataatgtgttggcatttcgattgataatatgattatttcattgaactatgctgtagtcaaagtatttataaaaaagatatttatttattagtcttaggagaagtgatatggtttgttctcatttgaatgatttttctggaggtacagtaagatatagtagcctttgacacaaagcctaaacaagaccttaattaaaaatattggaaatttcttttgagtattgattacttttaaaattgaaaatctcctgtttgtatataaagagcattatagttactgtaatctgggctttacaacccaaaaagtaattgaccagattgcacattaatatttttgctggttatattggttttacagattgaaaagtttttttttttttaatatctattgcttttcccttttgaatagtaagctgtttcaggaggccagggaacatgtctcatctgaattaattggaaacattgtgctaagtatttactgttatcttaaccacctcaacccaccttaaggtctgctctactatcttctgtccagaggtttgctatttagttaaaactctaggtagtacttggcatatatatactcttgatgtcttagatatggaactactctatatttagatacatattttatgaaaagctaatatgtaatttattttatataaaatgtttgaagatacacttctttgttttattcctcctcctttctcagtaaattaaaaatatttcaaaataatgtttagaaagcaagtctattatgtaaaatgagacacgtaataattatatttttaagatgatttgtgcagtaagataaatgctttactgaagctaatatgtttaaattgctttaactaaaattattaataaaatgaattcatttgtataaaatacagcctacccatgtaaaatattactcttcataggtaccccagcaacagcacaactttaatccttaagttttagttgcagtactgttaaaatactaatagcttaatttcccaagattcagttatttaaaaccaaagtttagggggaaaaaggcagcaaaactcagtctactagtttacatacatacacacacacacacacacactcatatatatgagagtagactgaatttttgctgtttgcaatatatatatatatgcacatgtatacacacacctttatttgctataatttgtaccatgtagcttttatttcctctgaataaaaaggttgttatcttgttttattttaattcaacttcttgcttttccctatagaaagtcaggtttttggagagctctaacagtgtgcaagttgctgggctcttatcctttctgtttaaataatgcaggtactttgatggaaacctggagaagctctttgctgagtgtcatgtaattaatccaagtaaaaagtctcgaacacgccagatgaatacaaggtcatcagcacaggatatgccttgtcagatctgctacttgaactaccctaactcggtgagtatctggtagtttaaggctagtgctgactttgtatttcagagggtaaatcaacttccattatttaaacaaaggaaaatttgtgggtctgggagtagtaacctctaagccataacctatcaatgtattcagtgtgaggaaaggaagaaaaagagtaaaagcttggttcctcttacctccaacccccatttgttttttaaagcagcaacaacttgtccaagttgtcatttatagacctaaatctttctggagtttattctatcaccatgggagaattgtgtaatagtaggcagtaagtagaattctttctcatccaaattaaaatagatttaaactttaagtgttttttaaatatccagaaacactcataaaataccgttaatactatttgctagggaactctcagaattcttcagaagataagattttcacttaatcaaatccattcaaatggagattgttaaatatggtatgtggggacagagttggagcagaaccagtgatatagcaagagaaccaaagaactgatgttaatcccttaagtacaaataaccttcctaaaaatttattgaactgaagctggactcagtggctcatgcctataatcccagcacttggggaagccaaggtgggcagatcacttgaggccaggagtttgaggccagcctggccaacatggcggaaacctgtctcaactaaaaatacaaaaaaattatcctggcatgatggtgcatgtctataatcccagctacttgggaggctgaggcatgagaattgcttgagcctggaaggcagaggttacagtgagctgacatcatgccactgtattccagcctgggcgacagagtgagactccgtctcaaaatataaaatagaatttactgaactgagatgatttacttacttgatttacttgagtgtttactaaggaagtttagtcttaagatgtctaagataacttaattctatgataattacaactgtcttgttcatattctctgctttaatagttaagcatctctttctaataattactatataacaagtctttgacactgttattttaacaattatttggttgatgggggtctcactatgctacccaggctggagtgttatggctattcacaggcacagtcagtgtactacagccttcatcagactcttgggctcaagtgatccttttccctcagcctcccaagtagctggaactacagacgtgcaccatcaagcctggctaatattatatttatattgaaggatttttattgtttatcttagagttgtatatgtgtatctctaatggggtccatttgtggggagttaacttgttcacatgtacaagtgatgagaaaagttttaaaagaaaataaagtactcttagagaaatagaatgatcagtgagttatttagtaggtaaagtggtgaactgaattttcaaattctcaagttctgatcgtaactctaacgtgaaatttttggctttagcgggaggtaagccatttaatgtcactgggtttttcttttttctttctttcttttgagacggccttgctctgttgtctaggctggagtgcagtgatgtgatcactgcagcctcaaactcctgggctcaagcgatcctcccacctcagcctcccaagtagctgggaccacaggcgcatgccaccatgtctggctgatttttctgtgtgtgtgtgtgtgtgttttgtttgttttgttttgtttgtttgttttttttgtagagacggggtttcacctgtgtgtgtgtgttttgtttgtttgtttgttttggtttttttgtagagacggggtttcaccatgttgcccaggctggtctggaacttgtctgagctcaagcagtctgcccacctggcctctgaaagtgctggcattataggtgtgagccaccacgctcctccagttttggtttcttctccttttcttttcttttctttttttttggaggggggggggtgggacggagtcttgctctgtcgcccaggctggagtgcagtggtgcgatctcggctcactgcaagctccgcctcccaggttcatgccattcgcctgcctcagcctcccgagtagctgggactacaggcgtctgccatcacgcctggctgattttttgtgtttttagtagagacggggtttcaccatgttagccaggatggtctcgatctcctgacctcatgatctgcccgcctcagcatgccaaagtgctgggattacaggcgtgagccaccgcgcctggcctctttccttttctcttttttttttgacacgagttttgctcttgttgcccagactggagtgcaatggcacagtcttggctcactgcagcctgcgcctcctgggttcaagtgattctcctgcctcagcctcccgagtagctgggactacaagcgccggccaccacacccggctaatttttgtatttttagtagagacggggtttcaccatattggccaggctggtcttgaactcctgacctcaggtgatccacccaccttggcctcccatagtgctgggattacaggtgtgcaccaccgcacccaacagtttcttttttctttctgatgagttgaataagatactctttcaattttcttccaacctgagtattgtatcatttctcttaccttaaatcacaattctaatttgaatattttttaaaaagtactactgttacaatatattaatattttgactattttattgtctttaacagattctccttgccagttgacatttatatagtgcttacagttaaatgtttctgtgaggtaatactaagacccaggttttacaaggtttccttacttcttggcgtttttcctcctgccctatcatagacagttccttcttaacttaaatcttaactctgatttgagtactgaagcttggctgcttccaaatatccactataactttctcgctgttcttaatatggtctaacaatctcaacaaactagaattcaaaatcatgacttgagatttacagtgtaaatttttgttttgtacttgtaactgatgatggagaaacctattcattgaacacactaggcactattctaagaaacaatggagaataaatacataattcctaaccagataatttgcaggttagttgggtagataagtagtaaggtgacatattcagaaagagtggtaagtgctttggtagggcaaatataagatacgatactgtgggaacgtgttggagggatacctaacccagtttttgatcaggcaggacttaccacagaaatctgaactaacatctgaaggcatggtagttaggctaaggaggaaaatgtagcaagtccaaggaagagagaatgtactttcaagaactgggggatggtaaatagtactaaaagattcagagaaaagatttaaaaagttaatttgaaatgaaatgaaggagtgaggtaggatgggaaaccagacttcatgggctaaagagtcactgacttgaaggtgggaaaggaaatggaagcaataaatgtaatgaaattactcttttacaagaaatttcactatgcaagtgataggataagatagcaaaaggaacaacatgggttggcaagtaaggtaaggcattatggaaactgctaagtgttccgaaaagtatcatgacaaaactaggatgtcctttcctcataatttttagactcatatagaaggataattttaacctcttcagttttggaagtaaatgtcacctgaaactcttcataaagttttattattggatgagtgagttcttcacttacattgtataactcccacattttactactctccaagcatttgtacttttttattatatatatcttcagtatctttatccttccagaaagcaatttttgctttatgcagtgtcacatgcacattttaaaataagtgcttttgatagcttagtttacaaccctttggagttaactgtcctgagtggctgcttctttcaaaacaatgtcctgagacattggagcactttgtaaattcatagattccaacttaatgttttaggttaaagtagttaagataatagctgtactggcccaccactgtgctaggaaatgtagcttcgactacagcgtctctctctctctttttttttttttttttgaggcagagccttgctctgtcgcccaggctggagtgcagtggcatgttctcggctcactgcaacctccaccccgcagtttcaagcgattctcctgcctcagcctcccgagtagctgggattacagccgcccaccaccacacctgtctaatttttgtatttttagtagacatggggttccaccatgttgtccaggctggtctccaactcctgacttaaggtgatccacccaccttgacctcccaaagtgctgggattacaggagtgagccgccacggccagccagtgtctcatttttatgaagtaaataatttgtattttctaagaataagatatgtgaagtaggtaaaggcagagttgaaattgtgaggaagggtggtccaccatcccgtcccccattcctgaagcccctctgtggaatcttggtgctgctggaaactgcttgaaaatacctacgtcccaccctattttccttttaacacattacattttacacacaagggaaccgattcccaggtcatttgttcaatttttataaacaaaggggtttcaattttagaggttatatggacaacttattatggaagaaagattcttaattttcttactgctatttgacattagttgctgtgtatgtaaagtgatgcagataaatgaaacctttaagagtgtattcttaagtttctttaagtccattaatttcttttgtagataatatttcatgtatttttcgtgtactctcttgatcggatgtatttgtgatataaacagggataagtttagtgaatagataatatgatcccctgggacaggggaaagcccagggagccatgtaggtgaacctagctcaaggttatgaggaaacgaatatatcagaggagggagagggaaagggaagtaagacagacaggaagatatctgcgataataatatgttcctcgaaagcacaatgaatatgtatctttagactacagatttgtgtcttggtttttggtgtttttatttttttgctctatctttagacatccatgtatgatttatttttctaacttgtttaatcttgttatctgattagagaagttatttaaaaagaataaaaagcttttatctgtgtgctgaagttgtaacaaggttgagagaggtgcatctcacacgagtgtgattacatttatgaactatctttttatcttaaaatgagctctagactagaagtcaaaaaaggttgagacttaaagtgatcacttagtaaccattgtgaccgttgatctctgttaaggattcctacttgaaaaaagaatgaagcacatataagcatgtgtatatgtttttaagttttgaataaaacattttagagttgctgatatatttactgtatttgtgtcttttacagaataccccttcctttaacagccttaaaaatcaaagactccattagtgatgtggtaacaagttagtgccaaatctccttctctgatggggagtaatgataatagattccctttaagcttgatatttattttacatgtcattctttcagtaaacctaattgcaggactgatacacttcatatatatatatattttaatgagatgaagtctcactctgttgcccaggctggagtgcagtggtgtgatctcggcttactgcaacctccgcctcccgggttcaagtgattcttctgcctcagcttcccgagtagctgggattataggtgtgtgccaccatgcccagctaacttttgtagttttagtagagacagggtttcaccatgttggccaggttggtcttgaactcccgacctcaggtgatccgcctgcctcagcctcccaaagtgctcggattacaggcacgagccactgtacccagccctctcatagatttcttttcatgtccttgtctttgtatttaaaaaatatagttgatgtgctgtatatagaatttctgtcctaacgagatatttgtatctaatatcataagtaacatcagaaattttataagtacatgtcacataatggctaaatagaaaatctaagggaattttaaaataccctttataagagccacgaaaggaaagaataaaagagctaggaataaacttgataagaaatgtgaaagattgctatgaagaaaacttcaaatactaagataaaagaatgacttgaatatttgagatagaagaaataggaaaatattgaaaaagaagattaaattgacaggggagagctgagtgaggactagtcctgctagatacaagagtagacagagcggtggaacaggatagagtcaaatatgcatgaggagaatttagtgtattacagaggaggcatttcaaataaggtgtattatttgatacatggtagcagtggaacaggatacagtcaaatatgcataaggagaatttagtgtattatagaggaggcatttcaaataaggtggattatttgatacatggtgttagagcaacttggtagccatatggaatagaaacttaagattcctacctagcttcataaataaaagttaatgaattcacaagcggtaaatttaaacggtgataagtttcactgtgagtgaagagcttctgtatggcaacaaaatatgaacactaagaattaaagtgggggaaaagatttcccctacttataaatggccaatttcctacataagtaaaaagcctccgtaaataagtgaaaaacccacaggcaaagttggcaaaatatatcaagagagtatacagaaaaagaaatatacagtgtaaaaccttttttgaaatattataatttcatttataataaaaattcaaatcaaaactaaagaagttagtgtgtttttcacctattagattggcaaagatcaaggagttggatcatatactacattgtcatgggcatgagaaatcaagtactcttgcacggcataaatgacgacaatctctttgcaggggagcctgatgatagctattagattgtaaatgtatatatttattataatgtcacctctacagatttgtcctaagatacattcataagatcacaaagatgtatatatagtcaatgcagtagtatagtaggaaaaaaaaaggcagtgtaaaggttcattaatagtagactataaataaaattgtggtacctttctataaagaggcaaacccacaccagtgtggtaccatatgagaaatccattggatttatttttgtttttttaagacggagtcttgccctgtcatcaggctggagtgcaaaggtgcgatcttggctcactgcaacctctgcctcccgggttgaagggattcttctgcctcagtctcctgagtagctgggattacaggcatacactaccacacctggctagtttttttgtatttttgatagacacagggtttcgccatgttggcctggctggtctcaaactcctgacctcaaatgatctgcccgccttggcctcccaaagtgctgggcttacaggcgtgagccaccgtgcccagccctattggatttttttaaacaacaacaacaaaaaaaaacaaggtgcagaagagaatttgtggtactgttacagtgtgtgtgtaagtgtgtacgttagaacacctctggaagaatatgtaaaaaactggaaatagcagttgcttctgggtagaggaaacaaacaacagggatgggaatgagggaggcctgtttttttttttttttgagacagagtctcgctttgtcacccaagctggagtgcggtggtgcgatcttggcttactgcaacctccatctcctaggttcaagcgattctcctgcctcagcctgccaagtagctgggactacaggtgcctgccaccacacctgcctaatttttgtatttatagtagaggcaggattttgccattttggccaggctggtcttaaactcctgactgtaagtgatccgcccacctctgcctccagtagtgctgggattacaggtgtgagccaccgcacccggcctagggaggcttatttttcaacataaactctgaacttgtactgttaaagtaattgtttttagtaatgtctatttaacttactcaattaaaaataatttagaggtaaattatggcaaaatgttctttaaaataaggtaaccattatttgaatctttttaaaagacataatcctccagatcatctaatattatttaaagtatttacttaatgtcccattacaggatactgcttcatttaacgatcccttaactcttaagattttagaacaaagtgttagttactattatccttagctattctgaataaatcttttcataacaggtttattgagatataatttatatactatccagttcacccatttaaagtggttttagtatatgctacagagttgtgtgccatcgccataattttaaaaacattttataaccccccaggagataactttttaaattcaccccctaattcctcccaagtcccccagcccctaggcaactgctcatctgttttctttgtcaatggatatacctattctggacatttcatatgaaagaatcaaacaaggttttggtacggtggctcacgcctgtaatctcagcgctttgggaggccgaggtgggtggatcacgaggtcaggagttggaggccagcctggcaatatggtgaaaccctgtttctactaaaaatacaaaaattagctgggcgtggtggtgcgtttctgtagtcccagctatttgggagactgaggcagaagaatcacttgaacctgggaggcgaaggttgcagtgagccgagatggtgccattgcactccagcctaggtgacagagtgagactctgtctcaaaacaaaaagaatcaatatgtgatcttttatgactggcttattttcattcttttacaagaaatttcactgtgcaagtgataggagaacaaccttggaaacaaggttcatctatattgtggcatttatcagtactttatttccttttatggctgaataatattttatttatggaaatatggaaaaatatttttttcttcagttgatggacatctggattgttttcattttttggctgttacgaataatgctataatgaacacttgtgtacaagtttttgtatggatgtatgttttcatttcttttgagtatatacccaggattagaattgctgggtcctatggtaactctatgtttaatattttgaggaactgcctgattgtttccaaagttgctgtaccattttacatttccatcaacagtgtacgaaggctccaatttttctacatcctcaccaacacttgttattaatattggctttttttttccaaatagagtctcactttgttgcctggtgtggagtgcagtggcatgatgacagctcactgtagccttgacctctcaggttcaagtgatcttcccacctcagctcccctgagtagctgggattacaggcatgtgctaccacacctggctaatttcttaattttttgtggagacagagtctcactatgttgcccaggctggtcttgaactccttgcctcaagtaatcctccgctctcagccacacaaagtgctgggattacagatatgagccagtgtgctctgctttatctgtctttttattatagctgttctagtgagggtgaagtggtgtcttactgtggtgttgctttgttttgttttgttttgtttgagacagggtctcactcctttgcccaggctggagtgcagtggtgtgatctcagctcactacaacctccgcctcccaggctcaggcagtccttccacctcagcctcccaagtagctgggactacaggcgtgcgtcatgatggctgactcattttgtattttttgtagagacagggttttgccatgttgccccgccttcatggtggttttgatttgcatttccatgatgctgaatgatactgagtattctttcatatgctcatttgtctttttatatttaatacaaacattgttgcccgcctttcctaagatgtatgtgtgttcggtgtatctgcatgtctagattcaccatgaaaagttcattttaggagcccatctattgtcaaattggacattttagccacgtaagaaatgtgaccttacagagccctgttgagtcactgtttatagtgagttttctgataatacctttgttaagttcatgttttgtttttcttacagtatttcactggccttgaatgtggacataagttttgtatgcagtgctggagtgaatatttaactaccaaaataatggaagaaggcatgggtcaggtaaagatatcaagttgtttttcagtttttgttgaatttcctatagtgttaagacccttgcacaaatttgcacaaataaaaacaggtgaagctttatgtgtcatgattctagattcaaacaactaaagataataggctttttcctaaagtaatgtggcattccagttaaagagccactccaggtaacgttttctcagccggcatcaatattggtatatgttaacttaaacttgttgcacgattttgtcagattatctcgcttttgcctttaaaattgtgtgtttaaaaaccaattagtcaggttagcaagtctagttactttatggtgataaacatactctcacacacatttcctttaaggagaaagggaaggattgagatcctgtaaacattaaggtattcccagaacctagcaaagtgcctggcgatggtaagcattcattaaatatttgttgaatgaagacagtttaaatttcaatctttttcagactatttcgtgtcctgctcatggttgtgatatcttagtggatgacaacacagttatgtaagtatttttgatagattctgcatgtgaatattggttagttggttaaaccaaattaatttttacttagtacctcaaaggaagtgaaactttttaaagtctgaagaaactttttaatctgcgttccttagtagtagtacaaaagcccatttgtaacttggttaaatgcctgatcactattcttacaaacttagaaatgcatggtagctagattttgataaaccttgggattggagattagaatgtgtgtatgtgttagttgaggtgttcttggaagcagatcccaagatagaataaaaggtgaaactgacttattgtggaatagcatctgtgcaaggtaaacagcaggagcagatagacattgatataggcctgacatctgttaaaagacaaagaaggaagattcaataggaagagactttatatgatacagctatgagagtctttggcagccctgatgggggaacttcagtgcatagattgcccatagaggaatacctcaataagtagaaagagctgggcccagtacacttgatatgctcagttgttggctgggactacccagggagtcatggtctttgctgaaacactgctgctgatttcagatacactacagctggatgctttcagctaacagctcttcttgtgaaaggttctttcttttttttcttttaacttttaggttcaggtatacatgtgcaggtttgttacatgggtaaattccttgtccgtgaggtttggtgtacaaatgatcccatcacccaggtagtgagaacaatacctgatagtttttcaactcttgccgtcccaccctacccactctagtagtccccagtctaaatagtcttttattctcatcttcatgtgtactcactatttagctctcacttataaatgagaacatgtggtattgagtatttctgtgttaattcatttaggatgatgacctctagctgcatttgtattgctgcaaaggacatgattgtgctcacttttttttatgactgcatagtgtttcatggtgtccatgtgccacattttgtttatccagtccactgttgatgggcatctaggttgatttcgtgtgtttgctattgtgaataatgccacagtgaacatactagtgaatgtgtctttttggtagaatgatttattttccctgtgatctcaccaacatctgttatttttttactttttaaaattattttttgtttaatttttttttactttttaataatattccttatgactggtgtgagatgatgtggtacatcattacggttttgatttgcatttctctagtgattagtggtgttgagcatttttttgtacctgttggctgcgtatatgtcttcttgagaaatgtcttttcatgtactttgccctttttctttcttttttttaagtgaaagcaagtttattagagaagtaaagaaacaaaagaatggctacttcgttgacaaagcagcctgctcatttttaaatggggttatttgttttttgcttgtttgattaagttccttatagattctggatatgaggcttttgttgggtgtataatttttaaatattttctctcattctgtaggttgtctgtttactctgttaatagtttcttcagctgtacagaagctcattagtttaattaagtcccacttgtcaatttttgcttttgttgcagttgcgtttggggacttagtcataaattctttgccaaggctgatgtctagaatggtatttcctggattttcttttaagatttttatagattgagctcttacattaaagtatttaatcctttagttaatttttgtatatggtgaaagatataggggtcaagtttcattcttctgcatgtggctagctagttatcccaacaaccatttatgtgtgtgtggctattatcgataggattgcattattaatttggcgcttaccttgaatgttattggtatatattaaatgctactgaattttgtacattgattttgtatcctgaaattttactgactttgtcagctctaggagccttttggcagagtctttagggttatttctaggtatagaatcatcatcagtgaagattgatagtttgacttcttttcttatttagatacattttatttctttctcttgcctgattgctctggccaggacttccagtactatgttgaataggagtggtgagtgtgggcatccttttcctaagtggaatgcttccagcctttgcctgttcagtatgatgttggctatgggtttgtcatatcatagatggctcttaatgttttgaggtatgttccttcaaagcctagtttgttgatagtttttatcatgaagagatgttggactttattgaaagctttttctgtgtcatttgagatgatcgtatggtttttaattctgtttatgtggtgaattacatttattggtttgcccaggctggagtacaagtggcaccatatcggctcactgcaacctctgcctcccgggttcaagcaattctcctgcctcagcctcctgagtagctgagattacaggtgtacaccatcacgtccggataagttttgtatttttagtagagacagagtttcgtcatgttggccaggctgttctcgaactcctgacctcaggcgatctgcccgccttggccttccaaagtgctaggattacaggcgtgagccaccaagcctggccaataactattttcaatttgtgatggtaacaaatctttgtcaagagaattgtcttattaatgaccagagtgacacttgctgccaccttcttgagaatgcctattcttgaagatggatgctcactttcttttacttccttatcaatatcagataaactaagggtggaaccttgtcctaataactgttggctgatgtttgctctcacgtcctggtggtccatgccaggtttagatagctttttaggctaaggccagctatcagaaatcattagggtttgtcataccagaaaagcattatgggtaatacatgtgtaaataagatgtgtgtgtttggcaatcaaggcatctgacttttggcctgatacattccttattattatttattgatataaaatctgtaatataaaactcattttaattacagttatccttagtatactggggattggttctaggacccacgtcctccaccctgaatataccaaaatctgcgcatgctcatgtcagcccagcagaacccatgtatacaaaaatttgaccgtccatatatgcaggtttcacatcccacaaataactatttttgatccctgtttggttgaaaaatattcataaataagtggacccatgcagttcaaacctgtgttgtttaagaagcaatggggttttttttgttttttgtttttttaagatggaatctctctctgttgcccagagtggagtgcagtagtggcatgatctcggctcactgcaacctctacctcctaggttcaagtgattctcctgcctcagcctcctgagtagctgggattacaggtgcctgccaccatgctcggctaatttttttgtatttttagtagagacgaggtttcaccatgttggccaggctggttttgaactcctgaccccaagtgatcacccacctctgcctcccaaagtgctaagattacgggcgtgagcaaccgcacatggccagcaactgtatttttaagtatattatccagtggcttttagtatatacataatattattctacaaacatcacctaattgcagactattttaatcaccttatatccgttaagcagtcattcgctattcctttctccccctagaccctagcaaccactcatctgctttctgtctttgtggattagcctattctagacatttcatataaagggaatcatgtaatatgttgccttttgtgattggcttctttaatgttttcaagattcatccatgttgtatcatgaatcatcactttactccttttcattgctgaataatggttccattatatggacatttccattttttacggaaatgtcttatgtgaacatatgaacatttgtgtacaagtttttcattgaacatctgtttttaattctcttaagtatatatatttcaaaggagaattcctgggtcttgtggtaatgctatgtttaactttttgaggaaccatcaaatacacaaattatttttagaccgcaggttccacttctgtgaaatatggagatttactcatttaaaaaatattaattgaacactttctacaggcgtactggacacctggggatcctttcatggggttgggaggagaaagacagatattaaacaaatgattatacagataactgtctaattaaaattatgataatttctataaagtagatgtttaaggtgccatgagaactgagagggtatctatatccaaacgagtgtggaaactcaggaaaggcttccttgagtaatactttattgtaactgagtgaagtaatacagtaatagcgtctaatatttattgagtgcttactatctgccaggcactattctagtctcacaaccatgtttctgatatctattttacagattagtaactgagaaatggagagttcaaagaatttaccttcaattcatagctagtgagttgtgaggctggcattcaaacctaggctgtcccaccttagagctccattacaatattcttgtctttccaagggaggcagccttatgcacagcctctgaggaagggtggtacttactgttttgaggaaatacaagaatacgaatgtgataggagtgcactgaaagtgccacaggacagggtgggatcttgtggaaggagagaggcctatgaagctcaagagtcaaatgaggccagattggttcatttaaaagattttaatggggttgaactacatgcatgttcttcatgtctttctcagtgggaatacactcagaggagtatttaccatagaactaatgaaacttaaacttcaggattcctcactacgtgggatcctgtgaattctggaaattcttgtgagttatagtgttcagaagaggccaggatgcagtcagtgagcatttctggttaatttctaagagctctcagaagaagaaggctcttaaaattgtatcagctttaggtatcacaaaacctggatccatttcttaacatttctggcaacaatatctgtctcatttcgcatactgatttgggtggggtgtctgaaggaaggtggctgagaattgctgtcttaaggcatgatatgatatcagagtcaaaagaccctgaaatgcgcttatacttggcactagttggtaagtcattaggctgtaataaaaactgggtaaaagtagactatttaaaaaataagaaccatggaaaaaaagtctatgaaaataaaactatacaaactttgaaattattgttctgatcagtacagttatatttgttgatagcctatgtgcatttcagtatttacagcttagggcataaacatgtagccgtagcataaacagcttttgaaactatgttttataaatgtggaaaatactcttgactggaaactttctaatctatttttattcttggtttcaggcgcctgatcacagattcaaaagttaaattaaagtatcagcatttaataacaaatagctttgtagaggtaagtgatttgttttccttcttgtaagaaggaattctgtttattaatagaaatactattttaaaaattataatttattgacagtaaaaaacatctttaacatatttatgaagcatgccaaaatacctttattctcaaaagagtatgacaggccaggtgtggtggctcatgcctgtaatcccagcactaagggaggccgaggcgggtggatcacctgagatcaggagttcaagaccaacatggcgaaaccctgtctcttctaaaaatacaaaaattagctgggcacagtggcacaagcctgtaatccgagctactcgggaggctgaggcaggagaatcgcttgaaccctggaggcagaggttgcagtgagccgagatggcgccactgcactccagcctgggtgacagagcgagactccctcttaataaaaaataaaataaaataaaataaaagagtatgagaaaccagtaagtacatctctccatagatcttgaccttggataataaaattatttttactgtattcttcctttacttttctttatccctagctgagaattgtagtagattactaatcgtgtcatgtttaatcatgtttgagattctaaccctgctatttctctgctcgttttaggtttcattaccagtaaatcttgttaataaagaatgctatcctttattggaccatgcctttgcccatttgttctatgactccttttgtgctacagtggcagagttgagtagttgctacagagactgttctggcctgcaaaaccaaaattctttaccctcttggcttgttacagaggagtttttcagcccctgtatgacaacatcagtaacttggtcttttaattctagaaagtaattatttctgttagagattaaacctggaaacagcctattttagaaatagtgtattatttgaaatggtcaatggacttctgaattctggtgcagagtgtttttttttcataatactataaaagttatatttccttttgaggaactaaaatgcaatctttgcctgtggtttaggaactgggttttttgtttgtttttttttttccttcttacaagagctttttatgggagaagttgtatgtatatcctttagcctatcttgaactattctgtagcttctaaacaccttccttgataaagagtatatctgattttcttgtgtcttttgaaaattgttctgaaatagaactgtaaataaattagtggtttttaatggtcacatacatgatatttaattaaagttattcagtgggattttgaagatagaacaagaggtgattcatgtattttataaaaccaggtcttcagggatcagtcatctttaaaaaaaaaaaaaaaaggcacatctgaagtgttgctatagaagaccacagcaagttttcataagcttgtgtaattatcccccatttgccccttgtaccagagaagcaatataaatagcttgatgtactaggaaatcttgcatcatgacctaatttaatttgctgtctttttttgaggcagggcctcattctaacacccaggctggagtgcagcagatgatcacagctctctgcagcctctacttcctgggctcaagtgatcctcttgcctcagcctcctgtgtagtcgggactacaggcacataccaccatgcctggctaaattcttttttcttttttttaaggtagagacaaggtcttgctatgttgcccgggctggtctggagtgcttgacctcaaacagtcctcccgccttggcctccctaagttctgggattataggtgtgagccactgtgcccagccagctgtcattttttattttctaacttgtatttcagtgcaatcgactgttaaagtggtgtcctgccccagattgccaccatgttgttaaagtccaatatcctgatgctaaacctgttcgctgcaaatgtgggcgccaattttggtaagcaagtgatttcctaaattgaaatagtgcacaaagcgtttccatttctcctgtttattcttggtagtaaaatagcagaaaaaaagtgtttaccttaggcagggagatgtttgatactggtttaaaatagtatatatctctttcagaattgaatgaaaaggtcacatcttaaaaaaatttttcctctttccttgatgttctaacttttttgaatttttttttatggagaaaatatacaactctaatcatatcttcctgtatgctccactgtaacttaatgggagcaaacttgtagatctgggactatacgtttttctttactctgccaaattttaaccttacttatgcaaaggaaatgtgcaggtaaattctgctgatggtctcctttttaactaagagttttcctgtggctcctctcgcccagctttcttggtaacttgggcttttggagttctatagtatactcttcagcctctgaattctagatttgaactgccaggaagtttccagtgccacatattaggggatgtcttaatcagttcaggctcctttataggtgttctagttttttccaaagtggataggctgaaaatttttcaaatttttgacttcttatttccttttgatgaacagtttatctctaggtcattcatctcttcttgcattttctataaacattcaagagaagctaagctgcgtcttcaacactttgcttagtaatttcctcaaccagatattcagtttcatttctctaccttccacaaaacaattcagccaacttctttgccactttatagcaaggatggcctttcctctagtttctaacagcatgttcctcattttcatctgagacctcatcataatggcctttactgtccatatttctaacaacattctgttcatggccatttatttaggttttctctatgattgaggcattccctgcacttctgtctttctgaatcctcaccagaattacccttaacaattcagttcattcacagtgatctaggctttttctagcttgcacttccaagctcttccagcctctacttactacctagtttcaaatcggctttcacatttttggttttgttagaacagcaccctcacttcttggtaccattttctgtcttaatgttcaggcttttataacaaaagaccataaactgggcggcttctaaacaacataaatttatttcttacagttcttaagggtgagaagtccaagatcaaggtgccaaaagatttgttgtctggcgagggcctgcttttctggttcatagatggtgcctacttgctgggtcctcatatggtggaaaggacaaggcagctctctgggccccttttttttttaaaaaggatgccaattccattcacctcctaaaggctccacatcctaatactgtcacattggttattaagttttaacatacacattttagggggacacaaacatttatatcctgctagaagttaagatgattttctgttcctttgagggtcttgaggagtaagaagccaatcaagtcaaggggctctagacccagcaaatagattttttgttttgttttgttttgagagagggtctcactccatcacccaggctggagtgcagtggcacgatctcgcactgtaacctttgcttctcaggttcaagtgattcttgtgcctcttgagtagctgggattacaggcgtgtgccaccacgcctggctaatttttatttatttatttatttgtttatttatttatgtatttatttttaatagagacagcatttcaccttgttggccaggctggtcttgaactcctggcctcaagtaatccacctgcctcggccctccctaagtgctgggattacaggtgagaagcaccatggccagccagattttcttttttgctgcggggtggtttggagggggaaatattttattggtattccatacctttctttttttcctccaaacatctatagaattacacttaacacatcattaataataaatatttccaaaaagagcaggtaagctcacagagattaagtatgtgtaaaatacatactgtttcgataaagattaattatgtattgttattttagagaaaaggtggataatacctactttccaatgtatttttagcgtgacacatttcaaacataaaagtatagagaatacagcagtgaatacctatatagctacaatccagttaaatcaaaattagtattttgtttttcttcattaagagataaaacatgacacatatatttgaagctccttggttccctgctccttcccattccccatctttcttttcagaaataaccatttatcttaacctgatttaaatcaatagtagtttgtttctgtctttagcaaaggactttttgccattcgtaaattacttaattagctaattaatctgtcattttattatttttttcttaagcatttgtgtttgttaattatacttcttttacaagtgtatatgtcatgaacttagaaaacaaaagtgaattactgattaacacatgtttagtgagtatttagtctttttgttttataccttgcccagtaccatttccctctacagggcggaggttcatttgtttaaataatgcaaagatgtgacctatttgcttcccatatattgtttactgtgtattagtactaaattatataagtaacctacaaagtcagccttttattcttcatttagggtgttaagtaaaagattaaaaatgcactgatgaagcatgggttgaaacttctcaatatagtctgaggcaccttagcaacaattattatgaaattgtcatcaaagcgtgtcttcatgcttatagtcattcttcacacatattgagtacccactatgtgctagttctactactaaattctaggtaattaactgtaaagcagacatgggttctctccttgtatttgccagtcactagaaactagtgacaatactgtggaactataaggcatgaaatgattggcttatttacttgcttacagtaggtaggccttaattctattaactctttgtgtcacttaacagctttaactgtggagaaaattggcatgatcctgttaaatgtaaggtgagtttgtctgacatttcaatttttaaataatggcacacttctaagacttagtgactaaaaatcatagctgatgattttgttatctatctattgatagatttttttttatccttttaatttcagatgatcattacatgtattcagaggtaattccttaggataagccaagtcagctcctgattgttattaggataaccatggctaaggcacctctttgtcaggctttgtaattaggggaatacacaccttgcagttgggcttctcttcaagctctaggttccccactcagcttctgccaaagaaaatcctgctttggttgattttatatatactggacattgtagctatgggatttccctggcttaagaggatgtgagcctagtgataatcttattcattggcttttacatttaagcttgactatagttaagtgctaaagtaatttgctatttttaaaagtcttttgttgtatcctaaccgttgttattttcaaacagtggttaaagaaatggattaaaaagtgtgatgatgacagtgaaacctccaattggattgcagccaacacaaaggttggtgttttccttcagtaactcttggtaataaaaatgataaggattggtactttggcattagcaaaagcaatgaggtgacctacttacaggctttgtttcatctttttctccattgagtctttttttttttttcccagaatgtttgcctgttatttcctttttctctttgagtttattttagagtattgagtactgtagtacagcatccacagttctctgccttaggtttcttctactggaaaaaaaattagtgttctgtagaggaaaaagctgataatttttcaagtgtgggatttgtgcttggctgccatttagtatacaaatgcattggagtttactccgcctagcttggttctgttaggctaatttacatttttgtttctaattttttgttttgaagtacattgctcttgatactagtttcaaaattcaatttcaaaattcactttcttaaccccagacaaatgtcttagaagtgtttaaatcttgagtacccttctcctcgatcactaatctaatgagcaagcatttgaatgccaaccgtgtacccagctagtcttttaatacaaagtcgtattatccatcctttatgtaattcagtcctatcctatccccatagtgagtgacttgggtaatgaatggtaggttggttcatgggctattcatttttagtattattttgtacatgtaaagatgatgctttaaagaatgctgagttgtttgacccatagtatataaagctatctttgaactgttgcctcagtcatcacaggacaatgagattaagaagtgtgtaaacaatgaaggccgacgcaggttgtctgtgtgtgtttaaatatacatcttacatacttatatataaaacatgaatttatatttctgtctcccagaaagtagtgaaacagtgaatcttgccacataaaacaaatgcccaagtctttaaggaatatatggtagaaattaatattttttgttccctccaaaaccatcacgataagcataactcacgtcaatcaaagaaaaccttactataaatatactgtaatgtcagaaagtggttacttgttttgttattaaaaaaaaattcttagccaagcattctttttttgaaaattgaagattttcccacaagaaatgttccttaagtcccagaattctttaatatgctctgaaaaactaatatttagaataaggcaattatattttcactaaattgtttaattaaatggtagccttttttctacatctagagaaattcctacttgtaagccccaaagatgtttaaaatagggagtacaggcttgaatatgtttggcttagtttagattgtagattaccaaggaagaatggcaatttgtaaaacaaatttagctgctcagtatttttgagagaaaactgaagagtttttctcttgaggttttagaagcttttaagattattagctccctaaacagatatgcatattgtcagtgatatcctaacattttggaggtttaatactattaggttaattataaccaagaaatgtagaatgtagaatgacgcatattttatgcctgaaatttgcttgtttggaaaaaatgtaaaatttcttatgtgggtgatttcaaaaatttgatttgaaatatataattaaaaagttgctatattggcctattttaaattgctatcattgatgggcagcatagtcaatttcacaaagaaggccaaattgtgcaaatactaatatagtgggtgatccctccttgggagagttacaaacctcaatcacaaatgcaaaaacaaaaaatccataggcctacagagcagtaattttggcttactagcaaccaagaatatgatatgaggccaggtgcagtggctcacacctgtaatcctaacactttgggaggccgaggtaggcagattgcttgagcttgagagattgagaccaacctgggcaacatggtgaaaccccacctcaacaaaaaattcaaaaattagccgagcatggtggcatgcacctgtagtcccactacttgggagactgaggcaggaggatgacttgaacccttgaggtcaaagctgcagtgagccatgattgcactgctgcactccagcctggtcgacggtgagaccctgtctcaaaaagaaaaagaaaatgatttggacttggaaaaaaacaatctaacacgatctctgtagcatacttgttaaggagtacaatgaaaagaatttaaaacatggttatttggtaggagaaagttggaaaatccagtagccacaaaatgaatttaccaatcaaggtctgatttcctagttacctgacactgaagtcagattgcttggatttggatcctgacttgacttatgtgaccttggactagcttctttataatttttctctcccttagtttattcatctgacaaatggaaataggaatagcaccactataagaattatgagttgatgcatataaaacactgagaacggtacatgggatatgggaagtactcaattatttctagatgacactagagagtatagtatatttatatgaatagaatgcttttatctcctatagtactgttattactatatatatgactaaaagtacttaaaatgatttgtctctcagccctacttaaaaagaaatcctaggaaggctgaagtggaaagatcacttgactccagaagtttaaggctttagtgacctatgattgggcctctgaatagccactgcactacagcctaggcaatgtagtgagactctgtttctaagtttaaaaaaacaagtccttaaattgttgtatgtcttaaaagccagtggtaataatggtaacagctcattttaaatagtgcttaagtgttcaacactgttctaagtgctttatatgtattaaccacaataaataaaatgtttaaaaacaaaccaaatctagaactggcttttccttaatgttagtaatgcaacctagtgtagcattgacaccaactttatagtttctcttcataggaatgtcccaaatgccatgtcacaattgagaaggatggtggttgtaatcacatggtctgtcgtaaccagaattgtaaagcagagttttgctgggtgtgtcttggcccatgggaaccacatggatctgcctggtaggttggggaaattaagggaagaatgtgtttacataagtatgtgccatgtattatgaataacatttctacctcatagatatcaccatctaacttgcaagctaaataaatacatagtgtgtgattaatgttataagtctatgcaagacatagagggattagttagatatatttcataaaggaggtaacaatttagatgaactttaaggggaccaagagttcattagttataaaagtagtaggaaaaacatttagggcaaaagttgcaacatgagcaaaggtagaatgttgtgaaaatacatgactttttcagagaataactgtattatcaaatgtgcctctctaggccaaaattgaaaactcagatgctgttggcaaaacccaacctgcaggtggttttactctgcatatcattagacattgtggaatgctttaaagccttgctaaaaggctttgtcatattttttctttaaataagcatatatatgttgctttccttgttttattgatgacttacttgaactaatataagaatcttgggccaggcacggtggctcacacctgtaatcccggcaatttgggaggccgaggtgggtggatcacctgaggtcgggagttcaagaccagccctgaccaacatggagaaaccccgtctctactaaaaatacaaaattagccaggcgtggtggcgcatgcctgtaatcccagctactcgggaggctgaggcaggagaatcacttgaactcgggaggtggaggttgcactgaaccaagatcgccccattgcactccagcctgggcaacaagagtgaaactgtgtctcaaaaaaaaaaaaaaaaaaaaaaaaaaaaagaatcttacacagcatatgaagcagttttctcactggttaagggcataagcctccactgggtgacaggcaaaagtttaagctctgaaactctgtagttatgtgaccttaagtatgtttcccatcctctgtaaattttattcttcatcttctcaatgaagaaaataatgcatatttcataaaatgtttaagggattaaatgtgttagtacatttaaagtcattagccaagtgcatggtatatagtaagcactcatgaaatagctgctcccataatgtaggctcccataactgatgtatagtaaccactccaggggaagtgcaagtcttactcatctatgctctgagctgacctctctgggtatgttttccccttcccaccattctgtatatcatgcagttttaaatgactctgaaaaactgtaatagcaaagcacatagcacagcatctgttacatggtaggctgtcaactgttggttctctgtggtttataaaagagcagataaggtgaataatcctggaaaattagaaatatttggcttaagtaacagatggcctaagagataagattatctctttctcaaaaagttgagttaggaattcagacagtcaataaaggttctagaaggacagtgttttctaataatgataggtgagctgatttgaaatggactgcctcaggaggtggggaatttcctatcactggatagagaactaatttattatagagagaattcaaacactagatagggttagaacagttcctttcagcctgctaattctgtcattatagcagtagaaccctgggtgttttaacatctcaatttctctgttataaaagataacgttggtgttagataatctgtaaatccaggttaaaattctgattttttttttttccttttcattgattttttttttctttatggaatcctctttatttacttgaaggtacaactgtaaccgctataatgaggatgatgcaaaggcagcaagagatgcacaggaggtaagtatatgtataacaggacaatagttgactaagaatgcacgttgtatattcatattcattagagaataattttttttttttttttttgagacagtgtctcgctttgtcgcccaggctggagtatagtggcatgatctcagctcactgcaacctccacctcctgggttcaagtgattctcctgcctcagcctcctgagtagctgggattacaggtgcgcgccaccacaccctgctaatttttgtatttttagtagtcagtctagtctcgaactcctgacctcgtgatccactggcctcggcctcccaaagtgctgggattacaggcgtgagccaccacgcccagcccagggaataattgagtagaacttttcaattctgaaggatttgtgaaagacattccagtaaatattggatatctatttacatttagaaagggaatcttatccaaaatatttatcaagaacattcttatagtaagtttattttcttttcattaatgtagttacatagcacattttagcttttggtagagtcttgctttcaagatccctcctaccccaagaagaacagtagtgaacagcatttgttaaatggccctggtgctatttataggcaatatcttacttacttaaattttttttaaacctttttgttcatcaagaagcgctgatgattataggtgagctgatttggtatggagtgtctcaggaactgagaaattccctattgctaggtagggaaatgacccactgttatagaagggatccaaacactaggtgtggattagattctaaagcacttttcattcctttcagtctggtgattttattgtaattgtggaaccctggaatttaatagttcctacattcacccattccatattgaaattccccagttgtcccagaaatattcttttcaaatgattttcctagccagggtacaatctaaaatatggtttgcatctgtttcttatttacttgttaacatatcttcaaaatgtatttctaataaaaatatcatatatagaaatgagtatatatgtaacctagtctgtcatattgctagaagtgaaagttttgtctttccctttttaaaaagactgggaaatacggccgggcttggtggctcacacctgtaatccctgcactttgggaggccgaggcaggcggatcacctgaggtcgggagttccagaccagcctggccactatggtgaaacactgtctctactaaaaatacaaaaattagctgggcatggtggcttgcacttgtaatcccagctactcgggaggctgaggcaagagaatcgcttgaacccaggaggtggaggttgcagtgagccaagatttcaccactgtactccagagtgagactctgtcgctaaataaataaataaataaataataaaatgactgggaaattatattttgtaactataaatgatgtttcacagaccttcacaatgtttgggtccatttaaggggaaaaaatccctacaaattccaatattgatttaaattatatttattataatattatttaaatatgtataaacaaaaaccagctataaattcttgtgctcttgcacaattctacagccaaaccaagagagccacaaaatcagtgaaactcaagtaaatgttaatttggtagatactgttgttggggttttaaaaatgtattattactgtactgttaaatatcatgagataacttgttctcccaccaattttcttttctttcttaaatgatgtcccttaagtcatatcccactaactttctatatatttctatatttccaacattaatttttatgatgcattacttgatttgcccagaatgtattatggatatatgttcttatcacctttttttctccattaacctgatgtatttatttagccagatatgctgtttatcaacaaagaaaatatatgtggtttatccttgacctcacctggtctttatttggatgccggtagaatccctttctgagatctatagggagggtgggttatgtgcatagcttttgagccagagtctaatgtttagattctagatactaaaatagattatttttctgtttcacatctgttggactaaactagaatcttctataactgtgggagtacaaagaaagatttcctatcactccattggttgtttggttgattgactaattgattgggagccacgcctccctgaaaggatcacaccattgcatgcctatctggcctcctcatctttccccactcccaagctcttggcctagcatttactgggagttgtagtctgaaaaattactagaaggttgacacatattcaaaagatccttgatggtaccttgactgccctgcaaaagatgtacctgtgttatagaaaattgttgactcattatattgtaccacagtgccgacagttgtggatatttgaatcttcttgtcctctagactagggtcagcaaactttttctgtgaagaatcagatggtgtatatttttagctttgcgtactacataatctctgttgtgacggctcaactctgcctctgcccttataatgcaaaagcagccatagacttaaatgagtaggtataactgttccaagtaaattttatttactggctgggcatgatggctcaaacctgtaatgttagtgctttgggaggccaaggccaaggatcacttgaggccaggagttcaagaccagcctgagcaacatagtaagacccccccgccgcccccgcccatctctacaaaaaaaaaacaaagaaggtttttaaattagccatgcatgttggtgtgtgcctatagtctcagctatttgggagctgaggtgggaggattgcttgagctcaggagttccaggctgcagtgagccatgatgacgccacccctctttagcctggatggcagagaccctatctcagaacaaaaaaacaacaaagaaagcaaaacagttttatttacaaagacaggtggcagctggatttgtcatgcaggccagagtttgtatacccctgttctaagcagtcaagtttgttgtcttttccacgctccccaaactgctttcaggtcgctgattacatttctcattccagattctggcatttgattggagaatttgtcttgatcaggctcagtggctcacgcctgcaatcctagcactttgggatgctgaggcgagaggattgagtgcgggagtttgagatcagactgggcaacaactgagaccctgtctctacaaaaaatttattaaaaattagccaggtatggtagtgcacgctggctgaggtgggaggatcacttgagcctgggaagacttcagtgagccatggttgtgccactgcactctagctcaagcaacagagcaagaccctgtctccaaaaaaaaaaaaaaaaaaaaaaaaagtcttattagcagtgatggtatgggtgttcttttttcatgttgaattttagtgagaagcagtttcagaattcttagattaagtcaagtcccataacatcatacatgtcaatatggtaagggagggttttcatttcatttggggaacttgacaggcttggaaatattagtactttaggggaagataaaatgccaagcagattttccacatattttcagattggcataattttcctgttcataagcattggtttgatacttacctgactcttgaaataacatggctgtggttttgttgttttttcattgagatgagggtctcgcagtggcatgatcatagctcactgtagccttgaactcctgggcccaagtggtcctcctgcctcaacctctgcattagctggaactagaggcagcttgaggtgtgcaccaccgcgcccaacttgtgttggttttttgaagtgtttcgttgtataatgctggatcatgtggttagctaattatgtggctcagaattagtatttctaagcaagggaccaaccatagggccaagtagtatctgttatgtaggctttaaaacatggggagagaaagaggaggtaaggataaaggaaaagaacatacgtgtgttaggaacccctttgataggggccgggcgcggtggctcatgcctgtaatcccagcactttgggaggccgaggcgggcggatcacaaggtcaggagatggagaccatcctggctaacacagtgaaaccccatctctactaaaaatacaaaaaaattagctgggcgtggtggcgggcacctgtagtcccacctactccagaggctgaggcaggagaatggcatgaacccgggaggtggagcttgtggtgagccgagattgtgccactgcactccagcctgggtgacagagcaagactctgtctcaaaaaaaaaaaaaaaaaaaaaaaaaccctttgatagtggttgcatttagtaagcatttattaatggttttctgcaaatcaggtattggaaatactttatctttttaaaagtccattccctctagagatttatggtataatggtagaggcctcatatgaataattatatattataatgtaataatacaaaacaaatctaaactagatacattgttgctttgataacaatatactttacatatctctaaagacagactctctttacataactgtaataccattacagttgactcttgaacaattcaggggttagggacactaacccgccctacctccgcaatggaaaatccacataccacttttgattttcccaaaacttacctgttttaatagcctactgatgaccagaagccttaccgataacatagtcaattaacacatattttgtatgttacatgttttattatactgtgtgcttttttttttttctttttttgagacggagtttgctcttgttactcaggctggagtgccagtggcaggtctcagctccctgcaacctccacctcccgaattcaagcgattctcctgcctcagcctcccaagtagttgggattacagacatgcgccaccatgcctggctaatttttttgtatttttagtagagacgggatttcatcatgttggtcaggctggtcttgaactcctgacctcaggtgatccacccacctcagcctcccataatgctgggattacaggcgtgagccactcactgtgcctggcatatactgtgttcttaacaatgaagtatgctaggaaaaaagttattttaaaaaattgtgaagaagagaaaatgtgtttactttttattaagtagaagtggatcagccgggcccagtggctcacgcctgtaatctcagcactttgggaagctgaggtgggcagattgcctgaggttgggagtttgagaccagcctggccaacatggtgaaaccctatctctactaaaaatacaaaaattagctgggcgtggtagcaggcgcctgtaatccgagctacttgggaagataaggcaggagaatcacttgaaccctggaggtggaggtcgtggagagccgagatcgcaccattgcactctagcctgtgcgacagagtgagactccatctcaaaacaaaaaacaaacaaacaaaaaaacggatcatcataaaggtcttcaagttgagtaggctgaggaggaaagaaaatacaggagggcttggttttgctatatctcaggtggcagaggtagaggaagtcgaatgggattcaggagatgcaggcacacttggtgtaactttacaggaaaaccttacgaaccgttttgcattttcatttctctaaaaatgtttctgtatagtaacaatcctctttccatttgctttagtttcagtgctggtataatagaagggtccattcataaaggaagtccaaagcagtcttaagtaatcagaacccttctgccaaattgtctaatgtcaatttattttctggcactgcttctttagtgtcttcttcctcatcatctggcactggtttggaagcagctcatctccatcaagtggtcttttaattcctctggtgtggtgtctgttagctaacccttcaccttccacgttttctttgccatatccacagtctctttcgtgatttccttgatgggctctgttgtagatactgcgaagtcacgcgcaacatctggacacagttttctctaccaggagtttattgtttcagtcttgatgatgccatggttttttctataacaacgatgacatcttcagtggtgctctccttccagacttccatgatgttctgtgggggttctcttcgatagcattgacagtcccttccagagtaccgtgtgcatctttacgtttgtttacatttctctcaatgtgaatggtaccatatacggtctgtaagagtttgtgtgcataagttttgataaatctcaactttttattaatagatttatgtatattttatcgtagtaaatcataagataggctacatatgtcttatgcattcatgacaactctttttcttaattttggtttgtccgcaagtgttttcaaattgttggcaaacctccaaaaaatatttcaatatatttattgaaaaaaatccacatataaagtagacttacagtttaatcctgtgttgttcaagggtcaactgtatatgttttaaagcaatactctgttggtatcaactatctattgttcaaatatccccaattatcttaaattttgcttttttttgttttttggtgttttgtttttttttttcagaggtagagtctcgttctctccccaaggctggagtgcagtggtgcaactcggcaattctcctgcctcagcctcccaagtagatgggattacaggcacatgccaccacgcccagctaattttttgtattttagtagatacagggtttcactgtgttgcccaggctggctcaaactcctgagctcaggcaatccacccgcctcagcctcccaaagtgctaggattacaggcatgagccaccacacccagcctatcttaaattttcttttatagttggttcaaattgggatccacataggtccacaaattggatttaattgatatctcttgagtctcctctacctgttgttccttctcttcccccctccttgcttttttttctttgttgaagaaactagatcgtgttgtcctgtagagtttcccacattatggattttgctggttgcaactgcatggtgtcatttaataggttcttctatccctgcattttctgcactggtgattaattcaagaaacttgatcaaattcagattcagtggttggggggggagcccagaatacttaattgattatactttctattgtattatatcaggagttacatggtatgtagttgccactgtagttttctacttaaaaatatctctgctttttgcttgttttacatcttgtggcatactgtagaacagtgccatccagtagaacatttttgtaatgatgtaaatgttctttatcaccagtgtctaatttggtagtcactaagcacatgtgactattgagcgatgaggaactgaatttttagtttcttaaattgaattttaagtagtcaggtgtggcttgtggctactgtattggaaagtacaattaataggacatttttcaagagtattaaataacaaaagtagcagtagatgtctattcctgattttagcctagatcacagtactgtttcatcagtaaatcagctttttaaattattaatatttttaatggacaaatcataattatacacatttatggagtacagtggaatgttttgaaatatgtaaacaatgcaatgattaaatcaaactaattgttgtattgccttgccttaacatttttatggtgagacatttgaaatgatacttattttgaaatatatattattattgactatattcaccctgttgtgcaataaatctcaaaacttactcatccagtctatctgaaactttgtactctttggtcaccaactccccattccctcccttcctacccctctatccccgcaagcctctggtaaccgtcattatactctgtatgtctgtgagttcaacttttttagtttctacatataagcgagatcatgtagtatttcttttctgtgcctggcttatttcacttagtgtaatgtcctccaggttcatccatgttgtcacaacagaattccttttttgaggctgagtactcgtgtgtgtgtgtacatacatgacgttttctttctgtgttcatccattgatggacactttacatggattccatgtcttggctattgtgaataatgctgtagtgaatgtgagagtacagagatacctttgacatactgatttcaattccttttcatatatacacagtagtgggattgctggattctgtggtggttttgttttcagttttttaaggaacctccccataccattttccataatggctatactaatttacattcccatcaacagtgtatcaagagtctccttctttctttatctttgccaagacttatctttcatctttttgataaaaaccattctaacaggtgtgaagtgagacttcattatggttttaatttgataatcagcttttatgtacagtttatgtgttataattatatcacccaatttttcttaatgggacagcgatctagggcagccctgcagaggtacctgttctactgtaatcgctatatgaaccacatgcagagcctgcgctttgagcacaaactatatgctcaggtgaaacagaaaatggaggagatgcagcagcacaacatgtcctggattgaggtgcagttcctgaagaaggcagttgatgtcctctgccagtgtcgtgccacactcatgtacacttatgtcttcgctttctacctcaaaaagaataaccagtccattatctttgaggtaggagtagttctgggtgaggaaaaagcccaccttgtatcataggtctacctgatctttcatatataagatacagagttttcagggttcttgtttgttcagaacatgtaggtagacgaatgtatttattacaaagatacaagaaatttctatttcttgtcctaaattatattcagatcgatgtggtttagccagctagtgattaggtatgcaggttctggagtcagccctagattttaatctttacttcattatgttttagctctgttgatttggagcaaattccttaacctcttatttgtccattttaaagtgaggatagtacctttctaggttgttatgaggtttaagtgagacaatttgtgttttatgtgagacaatttgtgttaattgctatacggcacctggaacatcataagttctcaataaaagcctttattcaggctaaactaaccctgcaatattagaagttaatgtggtggttatctttagtggagaaataatgactaaaaagccagcttttagcagtaaaggttttctcaagtaaagatgttcatttaaaattgatgcataaaacattgatatctgtatatgactagacaataagactgactagcagatgggacttcagttgggtaacaggtacaaaactagccatagtggtaaaggatgatacaatttgaatcttccatacagtgttttcttataagaaataagtatagccagatgtaagcaataataggtttctattttttctcatttacctttgagttttcagcaaagagcagctctcagaacgagaagattccaaaagacattttaaatcctttcaaatggtcttcagtattcttccaaaagtaatgggtgaaatctttcgttcttttaacatttaaaaaattgttctggaaaagaacaaacaagttattagagatgaaagcccatagagctttacaggtgcagttaaaccacctatgaaagttacagaatgagtgttgagagcagtctgtagtcaacaaaacagtgaaaatggtttatcttttagctttattttgaagccaaaatttactttcattcttcttacagaataaccaagcagatctagagaatgccacagaggtgctctcgggctaccttgaacgagatatttcccaagattctctgcaggatataaagcagaaagtacaagacaagtacaggtaatttttttttaagctgttgaataaaactttctgccagtgatgatccttactggtaaagttcagtgatagtgaaactgggtttagcatatccagcaactgagcttttgccatgtttctcacagattgcttctgtccgttgggcactaaattgcaggtaatagtattggtgaagcatacatagagaaggaattcagccatttattctattggctaattccacttctgttcagttatttagttgctaccttgcaaggaagaaagaatccaaaaaggccaagtggcctttaggatgagagtgagaattgaatgttggtcttagcctgagaatcctatgtatgggtcatggctattcacaaatgagctatggaaacttactttttagagtttttattacatatatatatatatatttttttaatctaaggagatacttgtcctaggagtcgatttttcaagatgtgccgcctcttaagctagagatgcaaaatgttttatttctcaacatgaagctctttctcccaaagtgacaaatgctagtgtcttttgaaagttgtaggaaacttggggagtttggaagacttggagatttagtcctaaccaatatcttcccttcccttagccaattttagctaccatattttgtttacagtacttttacagttgacagagattttaaggacgtgaataaagaacccatgaaattatttctgaacctgtttatctgcagaactgtgggattgaattatgatttctaaggtccatcagaacttgtaacactttattgctttaaaattaattcccatggaatcatggctttcagaaaataccattttaatattagaagcagtttgatgtgtctgtacatctagacctgaacatgtgcctattaaaataaaaaataggtgcttggttccgagtctggataaactatagggatgccttaaaaataagtaaatgcctctttttttattattagaggctgacaacaagtttttttttttttctctttgattacagatactgtgagagtcgacgaagggttttgttacagcatgtgcatgaaggctatgaaaaagatctgtgggagtacattgaggactgagaatggccctgcataaaatgaactctgaaaactttaccatctagagtgctcatgcaattaaaacaaaacaaacacaaacaaggaggcactaagcctattctgacaccactggtctgtagtaccagaattgttttgttaatggaaagtttaagtaaattatattgtaataaaaaggtagataaaccattgtacaacagtattctaggccaccaacaaaagtgtgacagacacactaaaagccctccaactttaacttgtaacgtagcttcattctcaaagctgactccttttttttctttttccttttcctgagtgtagtacagttaaaatttcaaacagctccttgacactgcttttcatgttcaaaccagccattttgttgtactttggtaaaggacctcttccccttcctcccctacacatacagatacacccacacacagactgactctctttctctcataccccaaggtcatgagtgaatgatgcttagttccttgtaaagaaaatcttgggatggggaaaggggtaggcagcaagaggattcaacaaacgaaaaacataaaaactttgtatatgacttttaaaacaagaggacaacacagtatttttcaaaattgtatatagcgcatatgcatggacaaagcaagcgtggcacgtgtttgcataatgtttaattacaaaaaaatatttattctttaaaaatcttcaagattatgtctatttgctgtgcattttctttcagtttgcttatctttcccgggttggggttgggataaaggtgtgtcggtttagcacctctggaagacctatctagagctctttcactttcctgaggttattttgccctttctggtgttggtatgtctgttgccggccatgggcctcatgccttgaattcctgctcttgatcagggacaagggaggtcaagctctgactaatgccatgacctgattaaggggtacagcagggagttttgttgctacagctcatgaattaacctgtcccaacctaatccccctccatggcatcatgcctctacccaagcctttgtgtgcccatgttatgcacacagctgtaggcattcttaagtcccctgtcgcatccagtggaagcattttaaaatttcttttactttttggttttcccttaattgctgcttttcagattttagttatggctcgtctgctcaccccttctctacattagggtgtcaaagagaatgttttgctttaaatataaatagccattcatttagtctcagattgtgaatttaaaatggtggataccgaaattgcttgtgtgtgttgctgtgggtttggtttgaaggcaaacacccctagaacatgatattcccatctagtgcatttaaatagaaatcactgagtttgctgcttttttattgtcagcagataggagaattaataatgcattttagctgtgatgtccatttttatgaaattcctactaagagctatgttaaaagtaaaggatggtggtggttgtattaactatatacctgtttaggccattctggctgtggtatttttcaataggtcagcatctgtaaatctgtcagttttatacaggagtgcagagtgaactaggcaactagattaagaggtctaaatatgaaataccagttgaggctgaggacctcttcgtcttcctttaaatgtcttttgcctagggagtgtttaccatttgtgaggcagctttgtctgctcttacactgtacatcctattactccattgggaagtaggttcactttcctctggccttttgcctaagttaggctttgctgaatcaaccctacttttccttttagaaaaggttgttacaggagatttactggcaactgttcttttcccatcaaaaatcagtgaatgtttgctgagtataaatgctgcttccttaaaccacttgtcgctttaggatcaactttacctgtaccttttctcctttcctcccttgccacctcaggtgcaaatctgaactcagtgtctgcttcttccattttctcgtctctctcccctcttcccccattatccatatgacattattttacttcaaatgacagcatcaatcttaaaaagatatacattaaaactaaggagtttttttaaagaaagcctgaataagttcctttccctggtaactttgaaaagcagtcagagttgctatatagatatatgtggctcctttaaaatgctttgtgtatgtgtggtgtttaaaaaaaaaaaatcttaccagttaactttgcagtgtctaggtttgagtgtcataaatccacgtgttcctgttgcaacaaatacccaaaaattgtgtgtgcacttcctaataccagtcttcacccatggaggaacagtgctttttagagatgctttctatttcaatgttggcatactgcctgagggtattgcagttgtgggtgcattccctaatttgtatgatcaagatgaactggcccttttctacttccaagcttttaacagataccaccatatttgacagaattcccagagtgaattgcttgtgttattagtagattcagtgcccccagctgggataggcaagccatgacagcttccctgtttcacctacagaagtcttatctgagggatctattcacagtaagcaccaaggtctccatgtcttgaggtcagtttcattgtcttttgaaaagtgcatgcttcatttgaacaattcattcagcagcagatggactttcagtgatttaaaataaaattttgatccaaagctcaggacacaaaccacagtggtaaaattgagtagcatataatatcagactaaattatctgtaattttccacaacccagattgtatgtgttttatgtgtgtttaaataaatatgttagatacacgtgtatacatacacccatatacaacagatccaagactggctgacttcatttgaaatggttgaatctgctgtgtaataaagtggttcaaccatgattaggaactgaaatttagtagaagagggaaaaggagttaatgtaacaaattattttagctacaaaccccggtaatagagcacttgggggatgggatggggtgggttggtgagacaatcagaatggtaaattgattaaatgctcctaaccctgtaattttgtgcatagagcaccctatgctgtggaaataactgttcttagatttcattgtaactggactgttcaggttgcccagagggaaagaacattcctaattctaataaaataaacttttattttgtta

SEQ ID NO: 952 - DNA, 52299 bp, Homo sapiens; identical to SEQ ID NO: 946

SEQ ID NO: 953 - DNA, 52299 bp, Homo sapiens; identical to SEQ ID NO: 946

SEQ ID NO: 954 - DNA, 73411 bp, Homo sapiens
gtattatccaaacaccttttatcaatgttttatttttaaaaacaggtgaatccacttttttatacatcattgcacttcaataattacacaaaacacacaagtacatgcatctacaattacgcaccgcatgagaaccgttaggttataaaatctatcatcaaccagtaaatcaatgtgaaaaaatacagtgtcaaaccaaaaagtataactatagttgcatagaatattaccatgctataacatttcaaggtcattggaaacaaaagaaaaattataaaagtttgccttgattgaatgaatgtacaagaataaggttcaacacatcagtgcaaaaggatttatgaatttacatgacttaacagaagaaaagataatcacttaaaaagcaatcatacgtatatactgcaattcattatacccattcagtggactgttccagcttattaaagtcacaggttaagcccttaaaattatagatttcagtttatattactcatctttatgtaccagaactgcacaatttcctcatctgacaacatacaataaggaatgaatatcagcagcttaaaaatgaaacaagcatttactttattttggatttctcccacccccaaaaatataaatatatatatatatatatttatatactgtatatatctgtaggttttgctgtactttacaaaagtgtatcactagatggcagcagtgcattttagagctttgccaatttaacagctgcattaagtaaaaaatggcgcatgcatgatctgatcctcagaggaccttttcacttctatttaaatattttaacaaaggaaaaaaaaaagcaacattcacagcacatcaagcccaaaatagtttacaccttctacactgaagcattgtttaaaatgtacctggctagatcacccttacaggagaggctaaataaggcatgctttagacagtcattgtggtgttgctcacttgaaaggggagagaaccaaagaggtccaagcagaaaattttagcaggtcatgttgccaccagtttcaggaacctaaagatctgtaaagaaatatgtatttggaaattataaagggattatgcactgtcactcacaactacaccgtgtgccacacaaaactttggttcaaacagcacgctcagggatgtggtgtgaaattctgatctccatatgcctaacaagatgacattctggccctgctgctacctggccattcttgtcttgcccccagacgtgaggtaagactagtaggcctctgggaataagccacctaagaaggtgacaattttcacctctttgtaaagatataatagtagtgaaaagtgttgattttaaaatatgtcttctgaaatggcatttatataaacatgtgacacaatgcacctgatggcggggcacactggctcatgcctgtaatcccagcacttctgggaggctgaggcaggcggatcacttgaggtcaggagttcaagaccaccctggccaacatgatgaaaccccgtctctactaaaaatacaaaatttagctgggcatggtggtgggcagctgtaatcccagctacttaggaggctggggcaggagaattgcttgaacccgggaggcggaggttgcagtgagccgagatcacaccactgcactccagcttgggcaatagagtgagactccatcttaaaaaatccaaacaacaacaaaaaacaacgcagctgaaaaatgttcctttccagtccctaaactgggcagacagaactggcttcatcagtatcagctgctctgaaatgaactaaaatatcttataacaccaattactgaagaatttgtaacaaggtcaatagaggcacattcatttgaatataatttttaagactgctacagaaggccatacttacattgtaagcagtacttaatttgtgtttctctggcgcaagtttttatctttgtgattgttggtagagttggttttcctttggaggaaaaattgcattacatgagttaaactcagtcaataacttttcaaagtataacacatggaaatacagggactctttcacttactgccatccctggtgtagtgagaaattttgtggcacaatatgagtgcataaaaaaacattccttaagtagctacaggttaagtatccctcatctgaaatgcttgggatcagaaatgtttcagattttgaatttttttagattttggaatatctgcattatacttaccagttcagcatccctaatctgaaaatccaaaattcaaaatgctccaatgagcatttcctttgagcctcatgtgagcacacaaaaaaaacttcagattttggagcatttcagattatggattttggtagtaggtagactcaacctgtatatacctcattttatcctccttttgacccccaaggcagacgagtactttcccttcgaatccggaactataattacgatacaggtgagaatatgtaaaacttttctccactgaacacaacaccactgtcccttcttgataaaaggtaatcataagctggcagtgctgggccctctggtacttaacaaatttgggtgctgtttgtctgcttctcactctttagtccaactctaggagattctgccgatcttagattgattccatacctgcagtaccctctctcttggatacgagcaattgttaatggggctagacagtttatccaggctatagttcagcctcaaattgcattacatgagttaaactcggtcagtaacaacttttgaaagtataacacatggaaatacagggacccttttactaccatccctggtgtagtgagaaattttgtggcacaatatgagtgcataaaaaaacattccttaagtagctacaggttgagtattcctcatctgaaatgcttgggatcagaaacgttttaacattgacaaaaccgggagcctcagatatactggccatttcccccacattttaagtatatcaaatacacaaaatttgaaaaaaaaaaaagttttttgcatggtattccactttgtatggccactggaaaacaagactgcataacctatcctgagaatcaagtggtttttagtcagatctgtgtcaagctaagaaatctacactgcaaccttcatttccactcactgtcttcccctccaatcttagctactccatttgattaaactgcaaacacaacatcattcaatcagatactgttgaatcaatgtccaataaagtacttacattggtccagctggttcatcatctacatggtgttcagttttttaaaaatccatgagagataagagaagaaaggagaaaactgttagattctgcataaggattaacagaatagcaaactgcaagtggcaatcatggctactcacagcatttattaaaggccattccatctggaggtgcaaaacactcatggagttattatttctagattcaagtttaaatggcaggtatgttgtttcaatggttttagttaacactttgaatgcttgtcatgaaaaactgcaactgtagcggacagataggctgcaacattgttatactcatcttgtccccaagttccagtggttcactcttaaatagatgagaagacaaaccaacatttcagttgtaaaatcctgctgtttgttttcttgtggtgaatgcatgcagttttggctcaatcctgcaatgtgaatggatgtgtaccatctgtacatttagccacacatcctcacttccccaaagggcactctgtttttcttgctgttttgtaatctttagaagagtctttagtctggagaatgagattgagaagaggcaatcacaatagttcaacctaaattgggtcagccatgctgggctatgccagcaacaagtgtatgtataccagaggatgttctgtgacacaccgaggaaagctgaacagtggtgacatccctctagaaaagacttcagaaagacaggctcactcctgtgccctggccaaaaccagaagccaaacccaggggagccatgagataacttttttaaaatcaaaaagctgacattatatgagtttaagccttcttaaattgatactttatgattctgatttataagtctttcgtgtttcaactaagtgcaacttgatcccctttaagcagagatacacattcacagagagagaatgttttaaaaagacccacaaggggaagggaacaagtaagtgctcttagtttgtttttattatacaaaagtcaggtaaactaaatgattcagaacagtttgatttcactgaaggcttctagaaaaattctcagcaggattccacaagggggcttggtgcacatgaagcagttatggagattacagtctcagtgtaggcatctgcaggagcacatgtcgggagtaatgtctgtcagagggagacattgctccacctgttccttcgaggcaacggagaggcaaagccaccgccagcacacacagtgactggagcaaaaaaggatttcaaaaaaaagaactaaccacaaaccaatgactcatcagccaaaacaataggctagcgacacactagtgtccacaggagtccactactaacaacagtatacactatcaaacgggtacagagaacaaactaagacttaaggacacccaagacatctgtgtgctgtgtatgcagtggagagatacaaagacataccaggtactaagacacaaaagcccagcctaaattctcccctcacaacatcctaatgctcagcatcccggccaagccagctcagctacatgctaggaactaagcactttggggatttaaatgaaaagacataggagcaaacttggaatacttttagtgctctggctgtgcactcgaaaatacaaaattctaatgcaagagagccgaatcaagaatacaccaatctactcccaaatttaaaataaaaagcaggggagggagaatcgcaatagccaggctaatcttttcaaagcatgacactgtaggcaccaacccaagcacctcacaccacgggctgtttttccttttggagtgtgggtattccctggtgtctgattagtaatgtcactttccagcccaacaagctggtaacatgcaaagggttgcatggaggtgttttagcgacagtgcctccggcatagctgccatgcctgcaagtgggagcagttgagattcacaagggggcaaaatcccaggagccctcttcatctgtctccccaaatccactttcacactgacaaacaaaagagcctcatgtctccccactctcctggactgaatcactatctgcagcaccactctcccctacaggtcagacaaaaaaacgacttgacccctaacagggaagtcaggggagagggaaagaacagaattacagaaaaaagatacagaaaccaaagtaaatgaggattaaacagcaaactgaaatccaaattagttgtgaaagtgaatgaagtaaacttgaagaaaagtgttaacattatgaactgtgcatcgtatagactgaagcggagattaaacaaactccaaaagcatgcatatcgctcacttaccaccatgttttaagggtttgatgcaattgaggggggaaaaaaaagaagtcatagtaaccgacaaatatcaacataccccaaaccctcaggccaaaagatagccagcttaaacaatgactgttctctccacctcagtattacagccactggctagatgagaggaagaggactggggggataatggaaacaagatgcttctggaatccaccttatgagagtgaagttaccggtggaactgtagcacacactgatttatctgcgtgttccatcttcccaaccgaatggaccacagccctcactccccctatatccgcctcatcatctagaaggggtgctctgcaatgtctagtaaataacggattgcctaatacaatatcacctccaaaaagatggctttaaagtccgaataatgaagagttgactctctggtcaaaggtcctttgtcactgcattcatctcactagaaggttttatggtttctaaatccacttaaattttgcctgaccttagcaggttagcattaaacccaagagagactgagttacttcctatttccttccttgtttggtcctattgcattttctccatgaggtaacttgttattgacccagatggcccctagttaacagaccagacaccgaatgcatgttttaggtgtcattttaaaagtcacatttcttttccaatatccctagtctgtataaagcttcatatgctaccaaatgttttgaccaacgaatagattttggaacattagaacagctcttcattctaaagtgtctaaaagagcttggatatatcagagccactaaaaatggccccccaaaaaacctcaaatatcttctccatcagtaacttaaagagagtccctttgacttgcttataaaaaattatcccaaggtaaaaacagaaagttcttttttggtaccagcacttcttttcttaaatcagctcctgttttaatttgctgtctgtgaggtcactaaaatatccagaagaactgcaggcctcagcaactaagtgggttcactccccattcctccagggcctggggaggggagactcaggagcacaggctgactgctcctggagtgcagtccgcaggacaccaacacagaaggtgcacccaagcaggtgcccagctgtgacatggatggaagcctagaggctgctagcttgacctggtctttttagagaactatcatttaacattttcagggaatacagtcaagtggtgagtcaagtgaacaaaacaaagctcttatttgactccatgattcacttgttcctgaaaatactgaaggtaaaggtgatctgtagattagtccacctacaagacaacctagtgggcactgatcctcaaagagaccatacaggggactaaaggaatgcaggtgggtgttttcatgtaggaaatggtctgagaatactccagtaggtaaagaaaaaagacatggggctttttttttttttttttttttaaaggaagcagctaaacctcaatcctaagcattttcaatgtgagaaatctaaatatttgattttctagtgaaacatacttaaactaaactatgtaagttcaaatttgtgcttttatacttttgtattgttcacttagtgcttttgtagtaaggggatgagttaccaagaactcacagactgcccaaaatatgacgactgtgcattcatataaaaaaagttcagtgagtctgaaatgagccatgggtgtatcttgataataaagtgctatttggcaaagtagaagtatggcaggcctataaaaaaattcccattttcctaatggtataaaaaaaatccaacacagagccacagatggttatctgataggtaaacacttatgacctcttaacactcccaagtttgtgtcaaatataatgtacctcttcgtttattccaaaaggagtgtacgtatatatctatatgaaaatttggggagaagcacatgggaaggaagcagacaggtaagtttgtccttcctatggagtgcacaggggttgaggggaactggctaaagaaggaaaaggcagagaagaaggaaactcaccaaagaacattcaactttttcttttgtttaatgattacttccaggaaaggagaagaaaagcgggcaggggtggaagcaggatggagtttgagagaaagacagaaagagacagaggagaaaaacagaatggaaatactggagcaagggcagggtgtgaagatggagagtggagcctggcccacactggctgtcaggaagggaaggagagaaggcaaacattgccatcattccagcatctcagatttttcaccccaatgcaacaacaacgaagtaaacgctgctttcattacaatactctcccaagagactagagcaaggaggttttactttgcacttaccctgccgtcatctcttttaagggtaggattcattcactgtctataataacttagtttaaaagaggtactttccctctaggaagctgttcagatttgctggccacagatgtctcctataacaaactggtcccccatttgatttcagtaaccaagaaaactcttacaaaaaaagagctgcttccctgggcaggtgtctgcacttatccaacagaacaatcctaaccatttctcaaatctaacctaccacatgcactgtgatagcaacctcataagcgcggtgacttcttagggcaaagactagacctctgctgggaacacgctaggctgctgcatcactctcaccagtggcagccagccttgccttaaaatttaaaaatcaggttctgaagtccatctctgccttctcttacctgactttttagcttctcaacctttccaaaaggcaggctgaggaaggtggtattggcaaagcaaaagcattctggggggataaaaaggcccttttcaggaatgaggcataactgatcccacagagccaaagctgaaaacacacgaaagacaggcaactctttccctttactcccaggtctaaataaaggtgcactcttgccttgggagtcctaatatgtagcaggaaagaaatacctggagagaaaaagcattaggagtacatgaaatcccaaagaaagcaggttcacttcataaagtaggaaagtaaaactcatggggacactcccaggttgcaggaaactagagattcatttgcagaggccgtctgctcccagccaacgtccttcccacgcctctgcccagctcactgctgagtgcacatctggagggagtcaccagatattgtcagtgtcatcaacaaacctcctcaccagccactcactctacttactgcaggcagagagatttataactgctgagaagaaaggaaaagatggggaaggggctgttgctctcaaacatgtcctcccagagagtctaaagccactggcatgcctctggggccacattctttctgagggagcaccagatgtcactttgtattctccactggacagccagctctgtggggcaggatacagcaccacaggtgcacaaacacaggccccagaacagctggactacagctggcaaccccaccatcaccccgggtaggctaccactgagcccaggggcacacccatctgtctagtctagccagggacagactagtggtggtaacagtcggccaattaatttctgtacgccggtcatgttatagggtggggatggggagccagctgggaacctgaagtactgcagatacaagtctccatcagcagcttcccccttcacaggaaaaatcgatcaccaaaaatttcccaaggcttttctgactctaggcatatccaataacctaagatttcagctcttgctctttccagtgctcagtggtgtgctgtggttctgctgctaccatctcctcccttctctgaccctaggccagcttgagggcacagcctcggggcatggactccatttgttccgcctttgctatctctgtcttacactagatgggtggatacatcagactctcctttgtctgtgagacacagatggaaagccacccagcagagagcgctggaaacctatcaaagggaccaaccaaggaaccaaaagctggcttgttccaatggcttttctgagaacagtctgactgggctggggcagttacctacaggggctacaccaggcaaccatgtgacaaccagttagataccttaaatctgcctgaaaggccaggtggcctgccatcttggggtggcttctaggcttgacttggattctcctcaagctcaatctgcctgatgatctgtattgaaggaggacagagctgaacaaagagactgacagctgcccattcaccacatggggcctgaaaggcagatgggactagggtttggaaaacacccaaacagagggagagagctaaggacagctctagatggctaatgcaaaaaaaataaaaataaaataaaaataaaaaataaaaataaaaaactcttacgggtagggggttaggaactggtataagaattttccttctttcctttagggattgaatcccaacatccctatagtcctctttgggtacttggaaaccacccgaaggaaccaaccccagcagtacagctattttgtagggatgctcttaccgtcaggaacctcatctggcctcttcctcttctcatacacaacaatgatcaccacaaggatgataatttcagccagaattcccaagaaaggccagagtggggccaggtggctccgcaccctgaggacagtgacaacagaggcggagccaatggcgttggtggcattacattcatactcgccagggtcttccgtgatctgcaggttcacaatgttcaactcagtgtaattttccttgttgatgatgaagaagcggccagaggtattgacaatgtcctgcaaaaaagtgagaatacacaaaggtgagagtgagtaactgagctaatgttcaagagagggtgacactgctctccgttctttttaggcaccagccagaatgaggaagcagtgtctaggaacatttcattaatgatttcccttcagtatcaacaacaacaaatcaacttctgacagagccaggcaagcctcccttaccatcggtcctccagacttccccgacttccacgaagtgagtgcaggtcctactgcctggagactcagaaaagtccaacaacctagtaaatgctgcctccaacaccaggtaagaaaccacagcagaaagaggacggcagaaggaggggtacaacccctacagtcaggcatgcctcggggacctcaggcctctctgatgacctcagagtcagcacactgacttcacacttggtgagttctgaggaagtctccttaaacttcctccacaaacaatgctaagaactcactcctagtcagactgggggaaattcataactttcctttcatttaaggactagaggttagaggaaaggttattcaatcaatcaacaaatatttgtggctgggcacagaggctcatgcctgtaatctcagcactttaggaagctaaggtgggaggatcgcttgagcccaggagttcaagactggccttggcaacaaactgagaccccatctctacaaaaaatcaaaaataaaattagctgagcatagtggtgtacacctgtggtcccagctacacagaaggctgaggcaggaggatcacatgagcccaggaggttgctgcactccagcctggtagacagatcaagaccctgtcttaacacaaaacaaaacaaacaaataaaagagaacaaatatttactaaaatatgctgcatgctttatatcctactaagggcaggtgggagtgagaaggtgagatagggagaagacagacctagaaatgaataaggagcttggcctcaaaagggaaccagacatccaaaaagggatgactgatttcaggaatgtgttaagaagccccaacagagcgtgtgtatagagtgctgtagggcacagtgagtggccactgctggaaagagtcagggaaagcttcacacatgagctaacatttgcactagactgtggaggaggacagctgatcaaacagggaggagcagtgcaggcagggattcgcatgggtgtgaaggcagaggtgcaagagtgcacaggcagaggtcgggactcagcgggatggctcactgcactcagctcatgagatcccggcagggaaaaaacagactcatgtgtctttaccctgcaacaactaaagcacaatcagaaataggagagaaaaaggggaatattatcctggaaatgattctagatatggcatacaatcttgtcagcatttgagtgcaggtacatctgaaatggggaactcgtaagcttttaaaacagctagtctgtgatgcctcaagcttcatctttcagattaaaacacatactgcgttaattccaacctgctttggcaaaagctcaagggcactccttcccagtgaccagcagagagaagtggacatttcctctccagtgccttagaaagttcagtgtcttgtaaaaaagactcagcatcttcacctcggcaatcctcatcctgctcctcgttaacgggtctctgaaatcatcgctgatgttggagtcattatcacaactcaacattttattatcaagatgtcatgaagtaggaagaataatggacttgaaatttaaaaaaactagatacaactcttggttttgccactaatttatcttggctactatggaacccttccaaagaagatggattaatgatctttaaggtccttttggattctgaagactgataatcaaagaggatccatgggatcagaggaacgcttgacacgctctctgacagaaaaggtaatgggtcaacaatcataatgagagagaaagtgaggttctaaagctctgactctccaaacaacatcatgaatcatcccactgatcggaaaagatgttctctttgacattttctggggcaaataccgtcaggttcccaatgtctaaggctgccaaggctgcccttgggcctcctcaggttgccccgattccttatcagtatgttctgtgttgcaggaatgtactagtaattgccctcagtaccttgggcctcctcaggttgccccaattccttatcagtatgttctgtgttgcaggaatgtactaataattgccctcagtaccttgtttcctactaaaaaaacaaggcaggttctctaagaccacttcaaaaacagtattttcttcaggataaatggacgagaattaggctcggttctttcagtgtcctatcctgaaggcaagtgatatggtttggattttgtcttcaccccaatttcatggtgaattataatccccagtgttggaggaggggccttgtgggaggtgacaggatcatgggggcggatatcccctttgctgttctcctgacagtgaattctcatgagacccggttgtttaaaagtgtgtagcatctccctccttcactctcttcctcctctccagccacctaggacctgcctgcttccccttcaccttccaccatgattctaagtttctctacttacagggatcacttaagaagaaataaacagcaactgcagtctaaaaaataggtaagtttcaaggatcaaagaagcctgagggggaggctaattctttggatttagctttatcttaactatattacctgtcaatgcctcaccttcagttacagtaatctgaaagcaataaaactcaaagcaggccagatgtcactctgttgtctaagataggaaagatcatctttcctgtgtttcctgaggcctccccggcaatgcttcctgtaaagcctgtggaatcatgagccaattaaaccttttttctttataaattacccagtctctggaagttctttagagcaaagtgagaatggactaatacagtgagcaatctaatctcttaccagagggacagctttaacaaatcacgtacagggatttttgtgctggaagagactgtcaatgacctcttgattcatgctgtaaaccgtgactctagaaagggtgaccctcgccatgcacacatccgaggatacagctactacagtaactgacccacgtgtctggacctctgcagggaaaactccagcaaccagagacccgggcctgcctcctactcaccatgggcatcccgttctccttcttgcgccatatccagtctgggtgggggtagccaactgacttgcaatacatagtggcatcctgcccttcattcttgttctcactccgtttatggccagtgatgtcaggagcggctgtgagaaagcgttagacgcagttaccacggaagtctactccaaacaggatacaaaggccccaccttctggctcagagccctgcttgtaatgtagtcagtctttatgcttactgtcatactcagctttgatgaagagcatttcaggtcagaatagggtaaagggaccaaacccatcctctaccccccacccgctaaagatgcccaggcagataccagggttactaatatatgaggctctactaatgtaggtgattctccaacctactggaaaaggatgcaggtccaactgccctcaattaagcctacctttaaagaaaatgcaaacaaacactattatctcttctatcggcccaagttttttcttaaaacacctgcatgaacaacagttatgcatcctgtcaaatatcacacattcccttaaggaaatgagattctgagataaaacaactacaatcaagtcctattacaaggtatgtaaaaacaatgaatgcttggagaagctactcaataagtaacaatgaccaaggctctcccaggaaagagggaatccagaaactggtcttcacaaggaggaagaaaggaatgaacaggaaattcaaccagtgtcccaagagattttttttttaattgaatgactgattgagatggggtcttattctatcgtccaggctggagcatagtggcatgatcgctgctcactgtagcctcaagctcctgggcttaagtgatcctcagctcccgagtaactagaactacaggcacatgccactacacctggttaatttttaaatttcttgtatagacggggtcttactatattgcccaggctggtcctgaactcctgacctcaagtgatcctctcaccttggcctcccaaagtgctgggattacaggtgtttgcatctgcacctggccctaagaccttttattaacaacttaagaatctgccttggacacctgatttgcaacagtttcctagactgaacccaatatagaaggaatttcaagacatgctagaggccgttggtcttctctatttatagggatcacttaggaagaaataaacaacaactgtagtctaaaaattaagtaagtttcaaggatcaaagaagcctgagataaaagcgaattctttggatttagctttattttatcataactatattacccgccaatgcttcaccagttacagtaatttttttggagacagagtttcgctcttgtcgcctaggctggagtgcaatggtgtgatcttggctcactgcaacctccaactcctggtttcaagcgattctcctgcctcagcctcctgagtagctgggattacaggcatgtgccaccatgcccagctaattttgtatttttaggagagatggggtttcatcatgttggtcaggctggtcttgaactcctgacctcaggtgttctgcccgcgttggcctcccaaagtgttgggattacaggcgtgagccatcacgcccggctaattttgtatttttaggagagatggggtttcaccatgttggtcaggccggtctcgaactgctaacctcagatgatctgcccgcctcagcctcccaaagtgttgggattacaggcgtgagccaccacgcccagccgggttacagtaatctgagagcaataaaagtcaaagcaggctggatgtcactctgttatccaagataggaaagagaatcgatatgccttggtcccaattccagttttgttggttctttcgttattctgggctttgctgctacagccattatcaaatggagacacctcgtgtccttgtctacctcccagtgttcttgggtagatgaacaggatgtcaaaacattcatcttgagactgtagaagcctgtactattgcattggggctaatctcatgttccacctttgactggcttggtttttcttggcttaaaaacaatgcaaagtcctactagtcacagaatgtgcttcccaggcacaaactggttttagactcaccctccagaggcacctggatgggcatgcactgggcaaggccccaagctgtctctgtaaccagtccctgccaaactgaggcctgctgagtaacactcagtgtgaagtgttttctagatagtacgtttcaaaggaaatatctttttttttccaggcaaagtttcttactacagaaggaagtggtcaacctggctctatctcattcccacaaagccgaacttttcccacagctactcagtcacttcttaggctgactgttcaacctggtcaccctttctcagagcttacttcagtccataaattccaagcactccaaggagcaggctccatagccacacaggacccagcatgcccgaagggttaccatgtgctgctccagccagccatgcttcattcatctggcaaacacctgctgagcacccactacacaccagatatgtcagactggttgggtaaggcttttgtgatgagatgaactttagcatggtcgtgaagaaaataagggagtatatacaaggttcctgacctgtggtaagtaaagaatgtattttttcttttttgagatgcagtctctctctgttggccaggctggaatgcagtggtgtgatcttggttcactgcaacctccaccttccgggttcaagtgattcttctgccttggcctcccaagtagctaggattataggcatctgccaccatacctggctaatttttgtatttttagtagagatggggtttcaccatgttggccaggctggtctcaaactactgacctgaagtgatccacccgcctcagcctcccaaagtgctgggtttacaggtgtgagccactgcgcctggctaagaatgtcactttctaacaggccaggaaccccaagttatcttgggacctcaagaggagaggaatttgcccaactcgtaagtatttgagggtacaaacccatggctgggctcgactttttaacagtcttatctgagattcttcatggaacagagttctgtcaaagccaatttaaaaagcctaagtgaaaaataactactcttgctgcactttatgcaaataatcaggccaagtacagtaagaataagtttattttataaataaatcagttctatcatgatttgtttttaataaaaatggggactggagagagaaaaattacgcttcaaaagaaaaactatagtatactgttgttagctgttcttgaggtttttttctgcagtttagatgaaattctaaattctttgtgggttggaagtccccaaactaatgctttcaaatctttgcttttaaaattgggaattgtactcctcatcctaggactcgttatttaccttacagtaggctgttcacttaaacactgtagtaaaactatagatgagagtagtaatgtttttcccacacaagccttggaatcctagccaggcctgcatgagtacactcagacagttacaaggtggttccactcttctcaccttggggttcactcccattcccacaatgtcccctatcagcaggaagaagccagagtgatctacggccttttgccatcttcagagcctacaccttaagattaaggtgttataaaacccaaagggagagactgaaaccgtctttgcaaaattatgactgagacagggaaagagatcgaacttaactgcttcatcttacttctaacctccaagctgtccttgttcactcctgggcgcaggctgaactaactttgggagaaacttatagtttaaacaaagatggtaacaaccctttcccaaaacagactcccttcttgcctggggactagattgcctttgtagaactaacattagacacaagattagaaattatggtttaggagtcatgcagctggaagctacaagattctgaccctccctaaactgctcctaagatcagtgcttgagatattttgcagaccttgcacttgatggatcagctggccccacccagatcaataaactggctcatctgatcctgtgacccccacccaggaactgactgagcacaagaagtcagctctgactccctgtgatttcagctctaaccaatcagcactcctggctcactggcttcccccaaccaccaagttatccttagaaactctgctccctgaatgctaggggagactgatttgaatagtaataaaactctggtctcccagcaaaaaagaaaagaagggagtaggtcacacatatctgtaggaagaacactctaggtcgagggaaatgcaaaggtcttgaggtaggattgtgcttgttatgtacaaggaacagcaaagaggatttgattggaacatagtaagcaaggagaagagagcaggaaataaaagaaatcagagagactggggacccagattagacaggactttgtaggccaccataatgactttggcagttacagtgagtcagccgggaagccactggtgaatactatgtgcaggtataaaatgatgggtgtgttttaacaggctccccgtggctactatgtgaacaagaactgcagagacagcagtggaagcaagaccaagcaggaggctattacagtaacccaggcaagggagaggctggtttccatgggggcagtaacagtggaaataaggagaaatggtgagattccaggtatattttggaggttgagttaacatatttgctaatagattgaatgtggactgtgagaagaaaaggagtcaaggatgacaccaaggttttggcctgtgtaactgtgagaatggagttgacagttactaagatgaggaaaattgcaaaagaataagagtgttttttgtttgcttaatcttagtttgttttgttaaaagactgagaaacagtggtggtaaaaaccagaaggtcaaggtctagaacatggtaagtttaagatacttatttaacatatggctaggtgtggtggctggctaggtgcagtggctcacacctgtaatcccagcactttgggaggccgaggtgggcggatcacctaaggtcaggagtttgagaccagcctggccaacctggtgaaaccttgtctctacaaaaatacaaaaattagccaggcataatggcaggtgcctgtaatcccagctacttgggaggctgaggcgagagaatcgcttgaacctgggaggtggaggctgcagtaagccaagatcatgccattgcactccagcctgggcgacagagtaagattctgtctcaaaaaaaaaaaaaaaaaaaagatacttatttaacatccaagtattgggaaggctgaggcaggcggatcacgaggtcaggagatcaagaccatcctggctaacacggtgaaaccccgtctctactaaaaatacaaaaattagccaggcacggtggcgggagcctgttgtcccagctactcgggaggctgaggcaggagaatggcacgaacccaagaggtggagcttgcagtaagctgagatcgcgccactgcactccagcctgggcgacagaggggactccgtctcaaaaaaaaaaaaaaaaatccaagtaaaaatatcaagtaggcagtaaaagagcaagtctggagttcagggaaatgttctatgttagggatataaatttcaggtatcagcttatatgtggtacattttcccattttcattctcctttgacccaaagaagacacccactttgggccagttattggcaatagtactatgaattcagtactatcagcttttgctttggggactcatttccaagactgtacattagaaccatctagaatgctaaaagttgagtcggcagctgcactgcctctgaaaagtcactattctgaaaggacccagacttaaaggtcaagattgggaagggggctaggaacagtcttcactcctgccttggtgtgtgggaggaggagaacaccacttcccctctttatttgacactctgggaaagggtggccgccatactgggggacactcaaccaaccaatggagaggggcacactgaggaactgagggccactgccaagagccatgtgagtgagctgtacacatggagtggatcctccagctctggtcaagctttcagatgactgcagctccagccaacagcttgaccaaaatctcaggaaagaccccaagccagaacaccccactaagctgctccctaattactgactcaggaaaactgtgaggtggtaagtgcttagcattttatgccactaagttttggggtaatttattatgcatttttgtatgtatagatacaaatataccaattgatgaagcagacattaccccactttttaaaattggaaaactcaagtttggaaaagtaatttaatgtttaaatggtaaagccagaatccaagttcagggttgtgtgaatccagagactatgctttttgtactttaacatactgaggggaaaataaactagaatagagtccacaaaaataaaaatatacaacatgcgaggagggagaccattaggacaaacacctaatgcatgtggggcttaaaacctagatgatgggttgataggtgcagcaaatcaccatggcacaagtatacctatgtaacaaacctgcacgttctgtacatatatctcagaacttaaagtaaaactttaaaatatatatattatatatataatatatatataatatatatataatatatataatatatatgtatatatacaaaatatatttatatatacataaatatatatatacataaatatatatattatatataatatagttatatatgtatatatttgttatatatgtatatatgtatatacatgttatatatgtatatacatgttatatatgtatatatgtatatacatgttatatatgtatatatgtatatacatgttatatatgtatatatttgttaccatgtattactggtaactgcagagcaaagagcccaaaagttatctttccttgtagatgtgctaaaacaccttagacccaaagcagaaccaatttaccttagacccaaagcagaacctatttacctgtcagactttactctgtattagtgtagcgtaaagagcagagcttcagacctgaaaacatggaaatctggacttgatctcgactctattactcaccaactgagtaacccagggcagatcacgtcaaatactctgagttttagtattgtaaaataagagtaatactcacatgtttcagaggtcttgtgaggattaaattacatctccatactaatctagaacatggttggaactcagggccaagcatttaaacatcagtcagggaaaggaaaggctaaggcttcgactctgtcattagttctaagaaatcaaagatactgattactatgtgctctccccatttgctgatacaaacaggacttttgtttgtagctctaaaaataaggtttaatcatgtcagatactgataaattatctgattaatggcctattttagtgcctcaccttctatggtcttgccttttaataagggactgcttaaccagattttgttggtctaaaagcaggtctgagcgtctaactaagccttcatatcctgaaggagacagagacaatactctgtgcttctctttaccctcttaggggggcacagactaagtggcaagagcaaggggtaggagcaacaaagtaacaaaaagacccttagaagagagttctgatccactcaggaattcattcattctctggccttgttagtcacatattctagtcacactggttaatggctatccctccagtatcctaataaatagcaacacaggggtcccaaaagagtctctgttacccaacagcacctgaaccaatttcattatctgggcagtctgggactctggctgaggacgaatgcatgttccttagtaccctctgctacccaacctgatgcacttagagcaaagggtcagcttctaggccaggctggatgctgtagaaactgtcaactcaggccatggaggcacgtttcagatgatattaaataaagttaacagaacagacttaagaaagtgatcaagatataaggcctctttacagacactgcttatatggtgctctttttttttttctttttagacagagtttcgctctgtcgcccaggctggagtgcagcagcgcgatctcagctcactgcaacctccgcctcccgggttcaagcgattcttctgcctcggcctcctgagtagctgggaccacaggcgtgcaccgccacactcggctaatttttgtattttttagtagagacggggtttcaccaccttggtcaggctggtctggtcttgaactcccgaccttgtgatctgcccgtcttggcctcccaaagtgctgggattacaggctcaagacactgcgcctggccttggtgctcactttttaaagcatgttcataacccagcaacttatcttcaaagaaaatctatccttaaaggtgttgtcaatgactagcctgtttccaagtaaacacagagattctgcatttacggtctatttgcttccttcatgcaacctatcaaatcccaaaaacacctatctttgtggtggacaaaatgaacacttggctgacggcagtgggagagtgaagatttactgcttgccaagagctatgcccaagaaggaatatgagatcagtcaagacagaagcaagaaggatgcaggcttttggctcaacaagcattctccacccacagcagatttatcattggttgtgaacactagagcagtctaggacaggtgcctccttctgcaggtgaaaccactgtgtaagaggtgtagaagtttccttgaagacagtgaccctcaaccctggctgtacaccataatcacctgatgtgccttaatctgatgcccgagccacagttcatatgaattaaatcaaaattgagaaccactgttctatcacctttcctggcaccagtactagaggtcagataccccccacaagacagggagatgagtgggtagaggtgtgggagtcattcaggtgacttttccaagctgagaaactgacaaattgaaattttccaataacactaggaaaatgggcttggaaatcacttcctgcaataaccaacctctcccagcctacatccttctcccgtgctggatgcttcctgccctcaaacatcggactccaagttcttcagttttgagactcggactggctctccttgctcctcaagcgtgcaggcagcctattgtgggaccttgtgaccatgtaagttaatacttaacaaacccccatatatgtatctcctgtaagttctgtccctctaggaaacactaatacacaacctctcatctctgtccacataagggaacctagaccgtcaagagccacacagagcaaaggaaccttaaagatgagctatctcattctacttcatcatgcacttgaggaagctgagacccagagaagggaagtgactggtcagagtcactgtgtttaatggcaggaccacgattagaacacatttctcctaactcttagtcaaggccttttaaatgttacatgctcaacagggcaccatggcttggtgcttaggagcacaggatctagtgctagggtgcctgagtgagaaccctagcttcaccagttaactctgtgacactgggccagttattccctcaagcctcaattttctcaactggaaagtagagataataattgcacttatcccatagagttgtggagactaaaggagagaaaaggaacaaataatgcacctagcacagtgcctgacccacagtaagtgtgcaataatgttagctattcttattcttattaaggaaggtcagggtggcaccctgaagagaggaaaagaaagtgcaggtgtggtttttgggctgaagttaatgttcaaaatgccctagcagcttcatgatattattatgccttcaaagacttctcaagtcacagcaattctgagtcagaagcaggttgctttgacatcagttctcacctaaaggatgtcacaacctctacgcatcctcacctatcacactagctgcctttcctgactgtcagtgaagaaaggacggtggagatgctgtgcatgctgaaagtgccgtgtgaatgtggtctgggtatcactgttcttcacagtgatcttcatccccaccacactgccttagccagtctggattaatatgtcacttgtaatgcaccatgacagaataggaaataggaaggcagggcaaggccacttatagaaatcctaacctttattcttaatagtcaaatatagagaaagctaaggagtagggaggagaaaaacaagatcaatcctggctctctcagcagccaaaagactgaaactcatttgaaatgtccaataaggagggtgagatgaacctagtaagacaacaggctcaacccccttctgggctgggaagtgcctctcacaagaggcagtgacatatttgttgcaaaggattggatgaccaacaaaatcctcttccaaaaacagcaataaaattcaaactccttctttcttgtactaatcaaaatggttaagggataaggatactgcttgggagtcatgagagcaatttttttctttttactttgtaaatgataccgggatttttaatttgcttttttgtgagcactttttaaaaaaaaattttagaaaaggaaggaaggagaagagggaaggagtaaggggcaaaaggttgaaaaattataggggtagaaaatttcaacatctattcattcatgtattctctgtaaggtgtgcactctggtaccacagcctctgaagagtcacaagctgaggacagagatgccctcctcagtattagctgagtggatcccagggaggtggggctttgggctccataaggcctcatcactgctgtcttccctctcctgaccggccctgctccatcttccttctctccatctgtgcagatcacctgccgaatacctgagaaacgtaaccctcaacagtatcttcctgtttatactatgccacattgtgtcctttaaaaaaaaaaaaaaaaaaaagggagagaatttaaaaacctgctccagatacaaggcctcccccactacatgtagatactcctatcctccaaattcctttcttgacggtgatctacaggctttggttaaaaaacatgatcatcttggctctgttcccaggccactgtccctctgtctggttccttcagccttcttttcttttgtagaccacagataactcaagatttggtaatctgacagataatgcccagtccctggctaggctaaatgcttcacttcccacagtgctgagcccaaacaacaccccagaaatgttctgaaagacaggaaaaggcagatgggaaagaaacggctgagagcagaatagatgatgaagaaatatatatgcatggtctgaattacatgccctgttgtgctgattcagttaaagccacacaggaagattctcagagactcctttcagccaagaggccactgatgttctcggaacctctctgttctcaagtacaaccacctcttaactctctattactcagcagatttttcagatcactacagctataaaaagataactgtctcttatccccaccccggagacactaagggaataaaatgagagtttctattaaaatgttttgggaacatacacacatgtactactctaaatgcaaggcagtttttctaccccaaccacaattggaggttagcttagaatatgatcctgggcctatggcaaaccttttaaaacttatacagaaaaagcgaagtgttcatagtctttaccatactcaactatccataactgggaagacaagacattaaacattgaactcttttctatccaggtgttggggggagaaggaaagacagactagaattcttttacaaattttcttgagagataaacacacagtatatctatccaaggtggtccagaatatggtttaagatatttataaaacagaattccctcaaggtctacttctgtaaaaccaagatactaccacctgcctcaccttccacacagggctatttgtacagtgagaatccaacagtgcacagtaagcaccttgaatataacacgtaagttgtaacttgctctgaaaatactcctggcctacagcgtcctattctctgaccctggcaactgctgcttcctacctgctgaagagactatgaagaaagatgcctctagggccactaaaccccaccttcgtaagcagccaaacaaatggaaaaaccattttgatttccactcttgaaagtgctttttagaaatcattaactcaaagtcactaacgattacagttagttaggactaattatctcttaggcttggggagcacaatgaactagacaccccactctttccttccctcacccaccctgcctctctgcacttggactttgtgctgaaggctcagccaggaatgctgcacggcctcaagtctcacagagaggtctcaccacaaatttggctcacctaggctggggaaagccctcactggcttagagaaaatgttttcccacatccttcattttcatgttgaatacatgtggcattcttctaaaatgggtagaaaccaaggtttctccaagaaaagccactaaaaaaatcaaatgctaagttctctggcccagtgtgacctgtaactgtaactcctttaggcattcagaattaaactggcagctggaggaggcagtggccatccctacatcaactcacaagttcagggctgtgtcaccaagacattactttcttttgataacaccatataatggaaactttgaatgtgtctaagcctttcttgaatctgcatttttaaccttccaaatattttaggaagacctgaatacctattatacgggcccttccttctcctaaatttgtccttctagcttccagggataactctatggatttaaagaacaagtctgtgtccttactaagcaaaatgagaaagactgaaaataaaaaatctgacctcaaacagtagccctgccttctcatgataattttgtgagagtagaaaaaacattggattgggggtcaagacctgtgttctagactagctctgccacaaactcactgtgtgacagacagctagaggtttcacttttctgggtctcagatgcttctttgaaataacttaggaaagctgaaatttatgatgttgggtagctccaacttttatagttctgtttgcccatcttggaactttctgctactgcctcatctttcaaaggtttctattaaaattctaatgaattatccacaaacagctgatgtccactctgcacactgtactttcccctcaatcctgctggcccacagaagacctatgtaatcatacttgtaaggcactgatctaagagctttacaaagccttgggccataggagctgccagcattcaaacatttttgacatataaaaacagcaattttatgcagttcaatctattaacttatttaatcctcctaaataacccatgatgtaagtactgctgatatcctcattttaaaaatgaggaaaaggaagcaaagagaagttagtaaaccaccaaggccacacagctagtagatgatggggtttgaatttaaacccaggcagccacgatcctgagcctgtggcctaaccacaacattatattgtgtctcgacatggaaagaagaggagcttgaagactgggactccagaccaaggtactgtcttggaaggagagtgagaggctcacaccacagcctctgctgggttgtacctttcacttcaatggtggcgtttgctttaggagcgctgacaaagtgatatacgcagtggtattcgcctgaatcctcagctctcggcttattgatcctgcagagatgagaagaaaaaccaagtgaggaaactgggaacggtcaaaatataaaacagaaggagaatcaaaggggcaatcagggatcctgctctccgaacccttaatgcaactcacctccttctaactaaaagcaaaaattcctctctgtgcatcctaaaacattaatgtcttgctcttttccaggtgccaagaatacaaagatggaatggcaacatggtccctaaccttagaatgctctggtctactgggagaaacaaaatgcaaaagaagtaatcaaaatagaaggatgtccaaagtactatagtttatattcagatatacaatataaaaccatcacggctgggcacagtggctcacccctgtaatcctagcactttaggaggctgagacaggtggatcacgaggtcaggagttcaagaccagcctggccaagatgctgaaaccccgtctctactaaaactacaaaaattagccgggtgtggtggcacatgcctgtaatcccagctactcgggaggctgaggcaggagaatcacttgaacccaggcagcagaggttgcagtgagccaagatcatgccaacgcactccagcaaaaacaaaaacaaaaatcactaaaaacctcttgttcacctggtggttccagttagataaacaagagaaacaaacaaacaaacaaaaacaaacaaaaagcacaagctttctgagcttctccaaagaccttgttttggtagttctgttcttcctaccttgtcttttaggagcatgcgtttccacaagtctacttgctaacaggacccaggcacagtttaaagaaaaagaaaaaaatctgccatcagagcatcagccacagacatgcagcaaaaagtctggtgataaatcccagggccctacatgatctggcccctgtctatatccctagctccatcccatgccactgtccagatcttctggtctctcttcagtttttcaatgcaccaagcttgttcgcacctcaaaacctccacacaagatgttcctttacagagaatgctcttctcatcactcttagtctacctaactccttttccatcaggtcttggcttacgtgtcagtttattccagccccaatctaaatgtcatccccttccacaacattctctctcacactactctgtgcttcttcacaatacttatcatgtgtgtgattatatatttatgtgattacttgattaatgtccggcttcccaacagaccaagttctatgtggataggcactgtttattcagcatactatcccataccgagtacctagcctggtgcctggaatacggcaggggaatgaataaatgaatgaattactgagtgaacacaaacacagagtgaatatctatgtacagattcagatcaagttaagcagagtgacaggaaggactgtaagaagagtgtatgggtcaggcgtggtggctcacacctgtaatcccagcactttgggaggctgaggtgtgtggactgcttgagcccaggagtttgagatcagcctgggaaacatggcgaaacgctatctctacaagaaataaaaaaattagctgggcatggtggtgcacgtatagtcctagctactcgggaggctacgaggtgggaggatcacttgaacctgggaggtcaaggctgcagtgagccatgatcatgccactgcactccagcctgggtgacagagtaagaccctgttgcgaaaaaaaaagaaaaaaagaaaaagtagtatatatggccagaacagcacttcatttcaatcacacagggtgatcccaaacaagctttcttgcccccgagggtcaactacacatcaactcagtacactctggcctacaagcacatacaccaaacacatgcagaaaggttagtgagtaattacagaaagaagaaaaacatcagcctccagatgagaggataaatagttatatagggctgagttctagctcttttgcttaggggttaaaatatgatacttgtgatggtcaaatctctactgcactatttaatgtctaagaaaaactcctaaactcgaccactctggcctaatgcatttatccatcttatattgctcattccaaaaaggaaacacaggttaagagactatggacgaggagagacatagcctatccccagagctgtctcaagatatccacatggcggcacaatattctgtgagaagcagtcagtgtcttctcaatgtgacaccatgcctcttcttaaatcattatgctcccaattggaaaacagacaagtcagctgctcttatcaacaagtgttccagagtttgaggaaggagcagcagctctttcttcagggcttaaactgaagttctttgagtccaagctctgaagaaagacctgctgttccttcctcaaactcagccctgaacttaagactgaagttcttagacttctaagttctttgagaaatacttgggaagataactcccacacttgagtccatgcctataggctgaaaatctccccacaccattcccttggactagctattaggaagaaattaaagcaaagggaaaacgttccctacaggctgggcagaagcagggttctgaaatcgcctcttcaggctaacttatttggtagcccaaggaactcatcagttgttatttcacgaaatgtagaatccctgaaaaactctagagatacacaacacccttggagagcttcaaataagctgaggggaaaaaagaagcagcattttataaagtcaggctgaaacttcatgaagttaaagctcagcactttgcaggcaatagtacaagacccaagagaaacatgattggatgtctgctatcttaaaggaggtatcataaaaaacaagtctaaggctggacacagtggctcacgcctgtaattccagcacttcgagaggccaaggtggggagactgcttgcactcaggagttcaagaccagcctgggcaacatggcgaaacccagtctctacaaaaaatacaaaaaaaaaaaaaaaaaattacccgggtgtggtggtgtgcacctgtggtcccagctactggggaggatggcttgagcccgggaggcagaggctgcagtgagctgagactgtactactgcactccagcccgggaggcagaacgagaccctgtctcaataaaataaaataacaacaaaaaatcaagtctgtaaaactaatggacagaacaagaaaaaaatgcttttcattccacctaacaactttatttgattaatcctttccaaactatgaggaaaattgctgaggctaaatttctaatttttttttttatcagaagaaactacagtggagataggttaactaccttgccactaagtggatggcatagcagggaaaagaaaaacaattctagaaaaaattctagaaaatcagaagacctggaacctagccttggttctagaacttattaaaatacagtatttggccttaaagcagccaagagtcactcttcaagtcctagtttccttgcttgggaaaaaaaggatccacaaattcatttggatcaactaaataaggggtgtgaaaagatctcaatgctgcaatatcctgcagaatgcccttgctatcactggatacacaggctttcctggtctcacctcagtgctctctttctttgcactgcattaaccttctaagcaggattagctgattcttttccagacagccttcaaccaggaacaaactattctgcaaggtggggtgccatgtgttctagatattccaaaaagcaccaaatatttgggtgctgggtaactctagccagcaaatatccttcttttttcaaaggatatttccaggctaccatcctcaatccagatcattcaagagccctgcatctgctggtccttatcaggttacagtgatgttacacactcctaaaagggaattcacaggaaatctacccagtggaaagatggcttagggagatgtcttgctctacagtcacaaagcagacttcaatctgtttcttcaaacctaacttcaatctgactggattaggtcaagagactacattctaagtgtgactctcctattgactaacattgttaccctgaacaaatcactacttcacagcctcagtttctctatgattatagtgaggggatcatctatgattctccaatctggctgctcattagaatcctttgggaatcttttctagactactgggccttacctgagatactggattggactctcaaagggagaaccaaatatatctcatgtcccttctgcatggcgcaactatggattatgaatgtcaagtaagctcagccacactccctcccaccttcccaggagctgcccaccactctcacctgtactccatgttgctggcattcttacgagtggcactcagttccaccccattctttgtccagtagctgtatgtaagggtgtgagagctggaggtgaggttacactgcagggtgacagggagaacagggctgtctcgaataatgacctcttcactggtgacaatccttggctctgtaataagagtgcacaatgatagggggcaatagccttccatcctctgtagccctggcctgagagttggacggggtaggagggggaaactagaaaaagagggagggcagacaggaccacatgaggaatttcactttaccactttggaggaagtcaagaaaggaaaaacaatgattataagcaaatgaccactagcgcagacaacagcctgaagaccagttggcctagacgtgaaagaatgggagtattacgggtgcttgtactggtaataatccacttacgtttttgaataccacctttttataagaaccaccaaacaattcggcttcaattagacaaccaggctccaccttgccattctgaagacaaaggccatatcatttatatacctattataataaactccctattgtaccactgggccttggaacagtaataattacataatacatgtatagctttccccacatttaaatgttaaacctatggcaaaccataggccattatttatgcagaaaaagacattgtggattctaaaaagcaaacttcctattggaagtcacttgcattttccaaattttgtggaggcaaaattcttgagaaagcatcatcagttcctcctctccagccatacctattcccaaaacaagttgttgttttcagaattgcactttaaaacacattccattctgagaaaatataactagagtgcaatattgtgttggtattatgggctcccagaattttagaaaggcccttagagttcattgaatcccactctttttttaagagctggaaaagtgaaatgatttgtgcaaggccgtaagtattactaatggcaaagctgggcctagaagacatatctgactgaattctctatccttgccccccatccccaagaccacccccaccaccttgtgtcctgggcaaggtatatatacttcaccttctgattctattctgcgcttagataacctgggatcactagcttatctacaaaaataacctacttgagtcaaatattataatacattgaacaaaaatgtttaaaatcactctatattattcctggaagcttcatctttaaagcactttgaaatctatcactgtattaaagtcaagacatttctatgtttgttgtcttttgttaatgtgctttgtctttattatttccccaggcttagttttctctacttttgatcaaacatttccaggtgaagtctacactaaccatcttttcccaaccacaataagaggtatttgctgtttgtttgttttccaattctctctcagaaacccttgactgacttcccatttccctgtgtctagtcacttcctatctacagctttgcagcagctcccctcaccattttatacagtattgtgctgagccttaacgtgaggaaagaactctctccctccatgggaactaagttgcttgctgttcagggagggggaaagcatggggaagtcgtgggatacttgggaaatgtaatgtcttaaggacctcctaaccgatgtaacatttctgacttgtagagttaatgtctttgaagaaacttgtaataatgcaaaaccttaagtttgctcaattaacaaattagttctattttccaactctggcaaaaggataacggttatcttccattcagcactggtccttatcagtaacatcaaacagggtctctatgtacagataatggaggcatagcagccactaagacagaagcagatgcatgtaaacacgttagcgcagtggtgtcccatggtttccaagacacactggacagaagccaaatccctgggccttaagaagtcgagcagaacggctgcaaaccctgcaatggaaggcgcacacacaccatcagcagaaagcatcacaattccaagaaaaatcaaaaccaagcaaaaacaaaagagaaaaagatagaaccagtactccacagaagagaaattaaaaaaatataaaggcaacattaaaacccaaacacacttttaggtttttacttaatttttattatccaatttcattttctgtcccacttgggactctcgttctgggtattcctctcagactgcactgagaaagggtaaactctgagaatgaggccaagagcttccagatgtttaaatacaaggaggccaaagtaaatgctactcttacctgtggcgatgcaaatgaccactgcagctcagggagattaagaagttgatgaaagcaacctggtagactttctgccaagtattctttgaaggcaaaggaaagcactttttcccttaagtgttaaagatccaggagagagtcactgggagcaagtggataatttaaataggtttaaatatgattctgcaccataggagggttgtggggtagggtaacctgcctcctgtgattgctgtatatgaaaaacagtgctacaccaagttccttggccatggtgcctcaactgcattctgcaccaggatgaaggtggggcttttatttttgtggccaagcgctgcccaaagtccaagagagatgaacatttaggagaagttcaaatgtgtttacctgccactgatgtctatttaaaagcagtggataggagacccttaccccagccatcatgcatatataaagaacatgctatggccagagagatacctaaaaactgggcacacttctcttcttgccttacatactcaatgagctttggggaaagtactaccaggaggtcattcttagatagaacacctgatgtccccatagagcaatgtcttttgggacgctgagatcataaaacagtccaattagagttggatccagggtgttttaaaaaaaaaaaaaaaaaagcagcagcagcagcaacaacctcctggctctccaaaacagctaacttgggttaactgactgatggggaagtctgaagagagtctagccaggatttggatttgattcaaccacatgcagacaattctaagtaaactggggaatgctatgtattctcgggattggtaggtaggtaccccaatgcctcatctttttctagccccttggcatggccattctagctatgagtcaggctcttggaagtataagtgcaaatgcccagcccagtccatacctataaacttccacagacctttgtggccatgtaggtaattctgcttttataaggaaaggagcaagggggcaggagaaggaggcgtgcagggtaaaaatattgttaaaaaaaaaatcactgggttaatgttccccattttcacatagacaaggttttcttttcctctttccagaagcaggttctttgattcaacagtgccaactgcagcagcctctcctaccactgccctacaaaggactctttttttacccataggatcttcaagtggctacaaagaacagacactaatttgctattttccatctaagtatatagactcaaggcccatgtcttactactttatgttattaccaaattcctcatcaaagtaagattttactattcttactttctctagatcaatcagctctttaagctggaactggctatagatctctcattgtgtcctcaaagagaaggtgaaaaacccagaggatctttccaaaagtgaatgtcccctcaattataaccaggtttgatgtggggccagaactcttcttggccaggaacgttggttctgtggtggcttctccctctctctgcttctcaacataaggtagcaagtcactttcaagaaagagagagaagtggccacaaaagtcccggtgtcatatgtctcacgcatacctgctacaaggagaggattctgagccagctggtcagctcaccccatcactatgagaaaccaggttggaagttagtttcctcttttttcaagacacaaagaaaaggccagtgtgagtggtccccacactatgtctggagttcccatgctctgggataaggtacactgtgccaacagctactcatcagagtcaaaccgtgaacaggaatcaactgcaactctgacttccaaacagtgtgatgggctaaaaaaataataatttgcagcttagtgtcacctggctcctaacagcaaaacataagaaggaagtcccaggctgctgcttttaaagaggagactaattagcaggcccagtgaggagtacactgctgcagtagagggctgttatcagagaagcacatgccacggttttagaaaagaaaaagagctggaactatgaaaatatccaagcttacatgccacccaacaaccaaaacacaccaccacactgcacccatggcaacattcccatcacaacaagatgacaccaagtcacagttaaaggaagaggctgggcagacacaaacttaaaaccatagaggtgaaggcagctacttagagagcttcaaacagaagaacagaagaaataaaaagtagttagactggggagagaaacaaaaatagaaaggcaccagagaagaaatcagcaaaagtatagcaggaaacctactacaaaatcaaaggggagggaaaaccatttcaacactaccctccttggactgcctggttttatgagttttaatttaagcttcccagttctccctccccaactcttcccaacacagatgattttggacagtcacggatttcctcaagttctttgttcctgagaagaaagacacagagaagggttgggggataagggaggcagagagaacggcaaagaaaagaagaaaaaaagttgccacagatgttttcatacactacaaccagaagggtcatgggattgaaaaaaaaacgaagacaaggggtggggtgagtgatcatactggggaagagggaaaggatgcagaagggaagggtcattgggccacctctaatgactacagtactactactgtagggtgctggactcactctgaaggacgcttatggtggcctgggctcgaatccatgttatggaggggttttgcctcaagtcattcctcttggggtcgttgctggccctgcactcgtaagtcccagagtcctccaaggtgagccgggttattctcagcacactcacgccgtttgacccgtaggcggtgtttacggtgacacggcgcttccgagcaccgtcccacagctgtctgaaagactctgcccggttgacttctgcgtaccaccactggatctctggcgtggggctcccgaccacgtcacagtacagctcaaaggcgtcccccgtgagcttagtttctgacatgggcgacttgacaaacccagctagagggagggggagcaggaatgcagtgacaggccaatcagaaaaaaaaaaaagaatcaacaggtgttaatagtaatttaaagaaaagaaaagaaaaaagcaaatgagttgcaaagaacaaaaaaggattcatttttaaactataaagagacagtacagcaattcatacaagcttttagaagaagaaccacaccctgggaagcttatgaagcaaaggcaggctaattacaagctggggcagcccaggtgctggccaggcagaagcaagcccactggaaagcattttagcaatgggcccagctggtaggaatgagaaagcctcaggtcttgggaagagcctctttccttagaacacaaaccatttattacctttttaaactcaggcaagtgatgaaagataaccagaagaggcagtagttttatatgccaaatcaggatctctcttttggatgggcaaacgctttgttagaaatgcagtgtcttttgcaagcctcaacaagaagtattaaatgacctactggtgccttctcttgggattcagagttcaaatttcaactgaaagagtagcaaatttctctctcacacaggattctatcctgggttcgattagactttctccacctcctattcttccctgggcctatggcaaacaaacaacccagttgtttagcgttaggcagcctcttcctgaatgcagaccctcaggagaacaagacagtctgtacttcacaccacagtgagatattaatactttgtgggtcagctcagaagtgggaccaacaataccagcaacccaactcactgccagctaatggagggactgtgccctccataaccccatagatccattacctagaaaaatctgaaaagctatggtatttgacaggctccatacagttgaattgcctggcttctagaagccagctcagaagaatgagaaatgtaccctgatgaattaaactaaacactagggtgaaagccaggcctcaaccaacactcttaggaactgcccaggaactaaagttgatgcctacctctaattgcccataatttgcttgaggttacacttccataagacaaggtggaaatggcagaaagagttaaaaaaaaaaaaaatccaggcttagtttaaaaacttggagttaggtccataggaaacaaaatcagagtgcaagcatactctctcttacccttccaccccacctagggttcattcagcatttctactgattcagacagtatccgaaggtataaagagagacactaaaagagggcattctgattggcttggaaacgtcccctgggaggcctgctgcataagccaagccagcccctgtgcagtaagcagggagtgaggtcaggatctgccaacatcaaattaagaacattccagaggaaaggatgaaataaatggaactgttttcctacagtccagaagccaaggatgttaacagggctagctgaaaatggaggttactaagtggaaaaattcctgtttacatccatagcagtatttgcctttggtgataaccccacaccatggactaagaacattaatggaggtactatacttactcaagtagaggccaagacctccaaattcatactagtctttcaattcctgacattttcagactctggggagcacaggaatgcagtgattaacaggcttagactaaacgttctgcctttaatatgccattttaaactacctcttcagatccagcatgcattccttgtaaggaaatatctaccagaggccccaagaagcccaacagatgtcattctcagatgcaggagaagctttagaattacagaaaggagcccccaagcccctgcatgaagagctgagctcactgcccaataaagtggtatccaaggagccatgtctcggtctcacaaactaccacctgcccacctgtcaaagtcaatgccagctaatataaacaaagaagtaaaggagggccgggcgtgatggttcacacctgtaattccagcactttgggaggctgaggcgggaggatcatgaggtcaggagttcaagaccagcctggccagtatggtgaaaccccgtctctactataaacacaaaaattagttgggcatggtggtgctcacctgtagtcccaggtactcgggaggctgagacagaagaatcacttgaacccaggaggcggaggttgcagtgagccaagatcgtgccactgtactctgccctgggcgacagagcgagactccgtcaaaaaaaaaaaaagaaagaaagaaagaaagaaaaggaagggagggagggaggggaagtaaaggaagttggttttatttattttactactggctcaatcaccagagaaaactggatatcagtaaatccctgaaatgcagtaaaagtattattctgttttaatcatattcttgaccataagtggtaatcacaaatggtcttatcacattatctgtgaacttggggagttacagcctctcaaatgcggtaattatgtactcgattatgccctagaactgttagtggatttcttttgtactttttcccttcttctgtattgtacttcaaagcagccttagacttaagcctgtttatcaatctgttgacaatgctaatgtaaaaaagatgcctgaaagtatcctttcaccaagaatccatccaattccactgtaaccccaagtcctaataacacacaagtcacaggtagctgagaaacagtctgactatgattcccactgcacacaactgggcgagtcactcagccagatcatgccaccctgggcaagacttcctgctaagagtaaggaatgctgatctgagtcagttcaattttctacctgtatcaaggaaaatgggaccaagacaaaaatgttctttgcattagtaaattataggatgtatatttaaatgaacttttaaaacacaagataaaaaaccctttaaaatgccaacaatggtctttgaaggccattattgttattaccattattagacatatagagtaacagtgacattttctaagtatgcattatatgtttaggcaatgtgctaagcactttattcattatcatattcaaaattcatttattcattatgataagtgccattataatttttcttaaagatgtggaaactaacgtccaaaaaagttaaatattttgcccacggtcacaagctaataacaaagagtctggcctggaatccaaagtgaaagcatggtctcttaacacttaccacaactgtggtcaatgtgtctcactggcctgaaaaggtttttgtagttacttaagttaaagatatgctttgtcaccacttagtttaattaataaattaattaataataattcctggccacaaaaagccaggaacctttgaccaattgtgcaacatactatgatcactaactccataaaattataatcttactagagaatggagatagagaagcactgggtcaaagagttcttaaagcaactggggggagggtgaacagtgtgaaaagataagatgattctgaggcaagactgcctctagttctgatgattccaatgccctgctctggagaaggctggcttcagagaaggaaggaatttacaagacactggaaaaatttctctgatgctgtagtcaggagccaaattaataaagggcagcacctgaaagttttataaaactccgcagtttgcaaagagcttccacatacatcacatctcatttcattcgcacagttccacaaggttcatacatagggcaggtgcggagacaggtttatgacttgcccaaaatcacttaggcagttaatcctgagtggggctgggactagaatgcaggtcttagcttagtctagggttctttccaataaactgtgctgcctctaaacaaactaaggaattccttgatagctgaacactcatcaaaaaccatgaaaagagatctattccccctccaaacagcatggaaaagaaagaaaagaaaaagaaaaagagaaaagagaaaagaaccctctttacaaagtactgtgaaatcacaattagcaagggaaagttattagcaaccatccaccttattatccatccaaaattagcttcaattcaggaaaagaactggctctcagcagcagcagcaggaggttcagagcctgactcactgccctgcctttcattactaagggctttcaaacaaatatgtaccttcaacaagaaagcacacactgcctaaagttgggaggccaacagaagcatctgtttgctctctaggtcaagggtcatccaatattttggaaaaaccctaaattttgtaagacaacctcctaccccaccctcttccccaccatcgtctccacccactatcttaagtgactgggcccagatctgcaagagttttgggaaagtattaatatcagtgcattcagagcaacagtgataaagagggaaactgaacagtggttactggctttgagggaggaagagactagaagctgatgctggagggggtagcaggcagagcattaaaaatggaggcagcaaacccaagagaagcgtaatgtaaaattgcataactggggatgggggatgggaggcaaagatgacagctgggactagcagccggagaaaaggaggagcttgctggcaggaaaaactggatgtgtggatatgtagcagagggtgagaagaaaaaggaaacacagaagagcaagttgagcccaatcccaggaaaactgctttcatatatgccctaaggaagtaaaaaaagctagcctagccctatataggagagactatcatgatttttcacatttacctccagggcaacccacagaacaagaaatcagactaactttctctctccctcaactgactactgccaaggccaggcctttaagtcttgcctgcttttgtcacctcttttaaaaacagctgttcccttcaaaccccctctacctctaattccctgtggctggctcatgctgttctctccttcgttcctcgcaataaagagaaaatgacagccaagatcataagagcgtttctctcctctgtctctctcacacacacacaaattcaaatcgtctacctcaaaataaagactgagcaagacccactgacatctaaacgtgaatacaggaactatgagtatttcaaatgtctaaaggacccttaactgctgtgaggctgtcacagacttgagcctacacaaactactgtagagcctgcctatccttcctgttaatcaggaaacagatcattcatcactattccttaacaccaaaggcaggtcagaagtctatatgcactcattctgtgtgtactgaccaagggtaaggcaggcttgaagtcctgggagcagaggaaatggggtaacctcattctctgcagcaggaagaggtaccacagattagtctcatctctaggtagagatggcagcaattacaaaacattttccaaattcaaacctgctccttccacaggtaccttgatcaggcagatatgacaaaagtttggaaattaagatcatccctatcactagcttctaaaccagggtccaccctttattctgaaattataccattcaaaatgaccaaaggcatctataccagccagccttctgctttggaaaaataggggaatctagttcatgccaagagaaactacatagtttagtgaccaaatgcagcaaactctaaaatcagttgtctggattcacataaggctctgtcactaactgtatgactgtaagcaagtgacctaacctctctgagcttcatctccctaatctgtaaaacgggactaataatagcagctacctcacagggttattgtgaggattatatgagataacatagcttaaaacagtacctgacacatagtaagcactcaataatgttagctattattatatgtctccatagaaataagtgctaaacaggccacgggcagcagcctgcagcactgctccacaacaggctgggaagcagaacttcacatccaaaatgagcttaacttaaaatccaagttcttcaagaaacaacaaaaaactaaccttaaccttccaaataaaatgagaaccagaacggaaatgttaactgcagaagggaatgaaaaagaagggaattcttcattccttcctatctttagagcaaactggaatgaacaaagtgataatagcagacacatgtatgtggactcaaggaattagcaagtgttttcagagttataaaccattaaatctaagatattatgaataatctggaaagtccaagaataataagaataaagagaggcagtacaaattctccttttcaaaaaaaattcttttaaagtagaaaataatcctatcaattataaatcaggctgcttaacaatatttgggaagatactggatattgaacaggccaaactgttaatttacaaaatataagatgtagttatggaatctgagatcatgtcacattagcttaatttcagcctaagaaaaggtgtcaggttttgagtcagcacctccacaacacaaattctcttaactttaagcagtttcttcaaatgggaatgatgccactttctttatagggtagttgtgaaaatcatgttacattatgtgtaagagttctgtaaactactctatgcaaatgttaagttactttaggacagacaagaaataagcatttggtatgacggatctccctcaacaaaaactttcattcagtcctgttgccaattcctactgacaagctaaacaagcatgatctacctagatctacaggtttaaaaaaaagtcaatgacaaaaaagaaaaaaatttaaaagtatgatttaaaaaaaaacatgggccgctcacactcataatctcagcactttgggaggccaaggtggtctgatcgctcgagtccaagagctcgagaccggcctgggtaacacggcaaaaaactgtctcttcaaaaaattagccaggtgtggtggtgcaagtctatgattccagctactcaggaggctgaggcaggagaatcacctgagtccaggaagttgaggctgcagcatgctggggtcacaacattgcactccagcctgaacgacagaggagaccctgtctcaacaaagaaagaaaacaaaaattatgggaatctctcaactcagaaaaatataaccaaagttttgcatatttcaggggtcttccagaccctgagtctagattgtactactgttagatgagtgaacagttaagggtctattaagatgagagctcaccttatagggaaatgagccatggtttaaaaaacttgggatggatttttccatttcttcaacctcagtttcctcatctgaaaaatggggacaatgattcctatcttcttcataaggtcatggcaagattcacatgaacaatgtacataaaattactttgtaacctgtaaagctataaatgtaataacatgtcagttttatgcaagcattctactctattaggtaaagaatgatctaaggccaggcgcagtggctcatgcctgtaatcccaacactttgggaggctgaggtgggaggactgcaccagtctggacaacatggtgaaatcctgtctctaccaaaaatagctgagcatggtggtatgcacctctagtcccagctacttggaaggctgaggtaagaggatcaattgagcctgagaggttgaggctgcagtgagctatgatcattccactgcactccagcctggtgacagagtagagaccctgtctcaaggggggggggggaaaagaatgatctaaactagtcctgagtgttctattaacatacctcaaaagcagtgtggaagaaactgggggcagggctcacacacatccatgaaggagggggatgtctactggactgactgtttccaaatctttccattttccaaaagaaaaaagcactgcaaaccactgatccagaaaattaacatgtttcaaatagaaagtgacattaaatgaggtaaggctgccagaaattaataaaaatgatttagaataaattctggttaaaaaaaaaaaatcttacaaaaatagaacctgacatcagacctgagaaacagaaagaattggaaaatgtaggtcgggtgcggtggctcatgcctgtaatcccagcactttgggaggccgaggcgggcagatcacctgaggtcaggagtttgagaccaacctgaacgacatgaagaaaactcgtctctactaaaaatacaaaactaggtgggcatggtggcgcatgcctgtaatcccagctactcgggaggctgaggcaggagaatgaggtgaacccaggaggggaggttgcggtgagctgagatcgcaccactgcactccagcctgggcaacaagagcgaaactcacctcaaaaaaaaaaaaaaagaattggaaaatgttaaaagcaaagagaagaatcagctcacaattgaacccctcttgcattccttttgtacgtctgtcttccagggttccttcctatgatcctgaatatcctcacatggactcttaacagattgaaagctctgcctgtatgttacttatcagaaaatactatggccatcatgcggtggctcacgcctgtaataccacctacttgggaggctgacgcacaagaatcgcttgaatgcaggaggtggaggttgcagtgagccaggatcacaccactgcactccaacctgggtgacaaagcaaactacttctcaaaaaaaataaaaagaaaatgctagccacttgcaggcttttacagtactcaggtaaacagcttcattatcaaagacactgctggagactaacaatgtttctccttcaccccagggaggaaaaaggcatttaatttactcttgagcagtcagatccaagaaagtgtggccaaatacaataaatcagggcccattttgactttgacatcaaaatgaccatgacttttttaaaactaaggatgtgtctgtccaaggagaaaaatgcagcagccacaaactattgtcaagctagtattttcaggggaattttaggtaattcacttcccaacttcacaaatagtacttaagctgctggtccctaagagaaaaagctggttttgctagccattaaaaaccaggaatgtctcatgcaggggaaacagaaaaatgcacacaaataagctatatcttaaagagagttattaatgaaaggtctggttcaaatatgtaagtgaaacccttacatatttaagcaaatgctcataaaagctctcttatcccaagagattgtcaaaagtagctatgggcagatctagaactacatccaaaatggagctttgaggccaaaaacaattttaattaattaaaagaaaaataataccagttacaaaacatttaaagagtgtacttcaactgactctccagttagcattaaagccaaaatgaaaacaatatactagaaagctttaatacttcaattcgacaaagattctttgcttgaccaatatgtaggcttctgaaccttctcctaggcccatctgtgaacttccttgtaaaattcagttttagcaaagaaccttgctaagtcagtttagcaagaacccccatctttgatcatcctcagtatcagatcaggttcttcagcctccaccattccctagctgaggtctgatcaacctggcctatcctcagtgagaatgtttaggttggcttagccaaatcctccttacccctaatgtttcctcttagtaattttccatccactgacccccacctgcctatgctgtattcagagctgagcccatctctctccccagtgcagaatctcactgcagtggtctggtccctacatctatcaccatgttctaaataaagcctttcttaccatgctttaacacgttatcatttttttttctttagcaagttgaataaaccattctcaaaagccataggtaattactgctcaaaagctaatctttgccaaactttttctgtgaaatgcacctgtctataaattcagcgtaacttctgataacaagcttactttctgtctctgacaacacagtaacaatcaggacttaaatgttaagataccaaaattcatctcattcttccatcatcatatatcgcatgaatatgacaatgaacacaagcagtccaagctgatagtctaagtataatctagaagacattttaactgaaagaggtagtaagctacttctccccacctttttttaaacagccattctcagaaaccacagagtcaaaaactctgaccagagggaaattcaagttttgaatcacatctcaggatgttaggtaaccgtagtcctagtcttcccagctgatgaactattaatatttccaaagcataaatagcttatagcagaaatcacactgagaactttgtcattacatacaaaaggcaaagctttccttagatgacaaaattctaaagcagtaattcttaaattttaccatgcagcagaatcatttggagggcctgttagaacacagactgaggcctgagactgcacttacaagttctcaggtgatgcccgtgctgctgctccagggaccatactctgacaatatcttggagaatctgaaactgtgcaaatattgtgcaaattttgagcttgtttaaatggaaggaaaacaaaggcataagagccacacagatgtttctgaaatcatataaagattctcccaacagctgggtctgtgatccatggccaaaagaagtagagtagcaaaaacagttgctaaaaaaactgtgtcactatgatttcaaaacaatgacttttatcttggatttgttcagttttccagtgtatacactgacaggatgcttcaatttaccatttattgaggtcctgtttaccaaggactgtgcacagggataaactttgttcctaaacagatttcaaccttgcaagacacaagacagaataatcaaaatacaataccactgacaacagcacttctatgacaggtatgtacaacaggaacatatataaaaaataattttgttggactaacgtatacctagaaagctcatgcattgaaatctaaatctagccttgtcagttgcggggagagatggtcttgttctaggcaagaggaaacaccatgagcacagtattacaattagtaggaatgagttctagataaaggtgaaaaaattcaacattttttgagtgctattatatgtcaagcacctattaagtgctcatgctattcagaaaaatatcctcaagacctcacaatatagggagaatgacaggtatcctgtaagctatgaagagcatattgggcttctttccatagaacaaggggtatgactgctctgactggtggcagtacaatggctgtcagaaataaggaagtcaacaaggagttaagaagctccttcaataatccaaatgaaaaatagtctgaactaattaagagtggctgtgggaatggtgagaaggtaacagacatgagaaatgtttacaagatagaatcaaatgaacttattgacgtggggtgggcagtgatactataactgtaataagggaaagcaggctgagctggctttacagacatctggagatatccaaatgtagttaaaaataaggatctgatatgcaggagagaggtggaggctggaaatatgcacttgggaatcatcagcttatggacgttgaagccatgggaggagatgagctgactcagggaggatgaaaaagaaactgagaatggaactttctacataattatacttctttccaaatgattcaccactgaatgcaatgcactttcactaggataaaataccccaagttaggaactaattcccttcccatatctagacaacacttttaataatgtcaagtaaatattttattactttgcttcagaagacttaaaactccatgtcaatgactcagatataaggcacagtatccataccagaaggtctcaaagcagcattagacttcgcttgagtagagtgtgtaatgctattagcctttacaaagaatcctggccgggcgcagtggctcacgcctgtaatcccagcgctttgggaggccaaggcaggtggatcacctgaggtggagttcaagagcagcctggccaacatggtgaaaccccgtctctactaaaaaatacaaaaacttagctgggcgtggtggtgggggcctgtaatcccagctactcgggtggctgaggcaggagaatcgcttgaacccaggagatggaggttgcagtgagccgagacggcgccattgtactccagcctgggtgacagagcgaaactccgtccctgaaaacaaacaaacaaacaaaaaacacacacaaagaatccttaccttctgagaaaaacagtatccatatggttccaaagattacctttggaaatgcttttttccccttacttttttatatgacacataaaaattatatttatatgacacataataagtatatatatttatgggatacatagtgaagtttcaatatatatacaatgtgtaatgatcagattggggtaattagcatatccatcatctcagacatttatcatctgtgtcgtgaacactcagtattttctattttagcaacatgaaagtatgtattactgttatagtaatcctacttctagtattttctagctataaaacactacaacttattcctcctatctagctttaattttgtgtccttaaacaaatccctccctattcctttcttccctcaccttcctgttctactttttacttttttttttctttttttagagacagggtctcgctcttgtcacccaggctggagtgcagtggcatgatcatagctcactgtaacctcgaactccttggttcaagcaatcctcccacctcagcctctagagtagctaggactacaggtgtgtgccaccccacccagctaagttttttagttttttgtagagatgagggtcttgctacgttttttgtacagtatgctagtctcaaactactggcctcaagtggtcttcctgccttgacctcccaaagtactgggattacaggcatgagccactgtactggcctactttttacttctatgagatcaacttttttttaagcttctgcatatgagtgagaacatgcagtgtttaaattaccattcctgggttatttcacttaacatggaatgctttctgtggagaaaaagctaacgcataatcccaaccaaattttctcaacttttaaaaaggaaaacaagcggaatctcagcctaaagcccaaagctaaaccaactcccactctgcagtaaagagtactgaaaagaaacaaagccaatatgccacggaccagtgattctagagaaaatattaacagaaatagtaacccctattttagactgtgataaaagttcatgaaatattacaatgtttatgccccttttcctacccttctggtcccctccagtatttctgtaaagattaaacaaatatgattttggaaaataaggatatgatagtgatacacaggcaactgaacaagagactcttcacttccacaatggcatgaaatgggaacattttcccccctctaggccccagtggtttctcaatttaaaaaaaattgaggatgctcagcagaactttactgagtcttattttgaatcttgaaaaatgagacaaatttgactccgttacatatggaccatatggacaatgtgctgaaactgcaaacattcccactacttaagttgtgatagtagcaaaaattatttatacagttacactgagccagagtccaaagaatatttgatatttggtatgacacagtttatgaagatcctgtatttgtccctgaattctcaacaactcatataattattgttcattcaggaagacaatcattcttaaagtaatacgcaatttcactcccattaaatgggaatttatcacgtattcaactcactgttaaataattaaaagttcccacttgtggaatttagtatgccaatctcgaaacagactatcaagaacattttcttaaaattaaatatgctcccaaacagtaaaatactattcaatgcaaaaacaaaacaaaacaaaacaaaaacaaaacaaactctcaagccatgaaaagccaaggagagaccttaaatgcatattactaagtgaaataagccaatctgaaaagggtacacagtatgattccaactacatatatgacattctgaaaaaggcaaaactatagagacaataaaaagatcagtggtcccaggagataagaaggaaggagggatgaagaggtagtacacaggggatttttaggacagtgaaactatctgtataatactctaatgattagcgtatgtaattatatatttctcaaaactcatagtatgcacaacatcaagaatgaaccctaaactcaaagtcctaaactgtgatctttgagtgatgatgtgtcagtgtaggttcatcaactgtaacaaatgtaccactctggtgggaatgtgatagtgggggctgtatgtgtgtggggacagggggtacatgggaactctctgtacttcctgctcaattttgctgtgaacctaaaattgctctaaaaatgcagtcgatttttttaaattaaaagtatcaactgaaaaatacttataatcatgtactgaggtttatttgcacttgacactgagcatatctgattggaattttttaaatgatacataaatgcaaagctacttttgagcaagcaaaaataacttctgctcggacaagctagtaatggtcacctatcttgtgtttctgatgcaagcacagaaaacatgggacaggttgggcctagtggctcatgcttgtaatcccaacacgggaaggccaaggcaggaggatcgcttgagcccaggagttcaagaccagcctgggtaacatagggagaccctgtgtcttacaaaaatgtgaagaattagccaggcatggtggtatgtacctatagtcccagctactcaagaggctaaggtggaggaacacctggacccaggaggtcgaagctgcaataaaccgtgatcacaccactgcactctaacctaggcccacagagcgagatcctgtctccaaaaaaaaaaaaaaaaaggaagaaaagaaaacatgggactcttaaaccttaagatctatcagactggccaggcgcagtggctcatgcctataatcccagcactttgggaggccgaggtgggcggatcacgaggtcaggagattgagaccatcctggctaacatggtgaaaccccgcctctactaaaaaaaatacaaaaaattagccgggcgtggtggccagtgcctgtagtctcagctacgtgggaggctgaggcaggacaatggcgtgaacccgggaggcggagcttgcagtgagcagagatgcgccactgcactccagcctgggcgacagagccagactctgtctcaaaaataaataaataaataaacaaatctatcagacttcaactaggctatcttaattaatgctctcctaactccattaaacagaaatctcccatcataaggaaaagaatgtcataggaggaaatctcctaagcctttatcacgttaaatgcccaggagaataaattacacttatgggtaaggtaaccatataatttgtcatctaaacctgaatccttctgagagtgaaaggggtgctgttaataattctgacagggcaacaggcacaaactgagaattatgattactcaacttacagggaacctggaggatgtattatgtaagattaagcaattagagtggagatatcccagaataaaattctaggtcaataaacttccaattctaaatacagtatatttgtgatttaaaaaccttccccaaaacctggagcaataattttccaagaatccctttgattgttaaatatctgagtctcagattcaaatgtatcaagtcctccaaagcacctccaaaattcctattttatttttatctattaaaattataaatcttccaccttattcttctacattcaatattaattggtaactataccacccttagctaatttttccattaactagaacctattgtcttagaataaagtacacaattcaaggccctactgctccaaaagaaaatgcctctcttgattttaaatggtagtatacaaagatcaatgaacagtaatatttacaaaaggtagttctccacttagtaatttcagattatcatatttagtaaaatcataaactctggttaaaaaaaaacaggccaagattgtgtcagctagcaatgatgctctagaatttattaccatatactctctaatagtgtctcagaaatgaatacgaagctacgcggtaacaaaatgctggacatatcttttttttttgagacagagtctcgctctgtcgcccaggatggggtgcagtggcacaatctcagctcactgcaacctctgcctcctggattcaagcgattctcctgcctcagcctcccaagtaactgggattacaggcgcccaccaccatgcctggctaatttttgtgtttttagtagagacagggtttcaccatgttggccaggctggtctcgaactcttgaccttgagtgatctgcctgcctcagcctcccaaagtgcggggattacaggtgtgagccaccgtgcctggcctggacataccaatttaaattgtaactttttgaaaagtatatttaagccaggtgtggtggctcacgcctataatcccagaactttgggaggctggcgcaggtagatcacttgagcttaggaactcaagatcagccaaggtaaccagacaaaacctcatctctacaaaaaatacaaaaaaaaaaaaaaaagctgggcatggtggtccacacctgtagtactagctacttgggaggctaaggtgggaggatcatttgagcctcggaggtggaggctgcagtgagctgagactgtgccactgcacttcagcctaggcaacagaagtagaccctgtcttaaaaaaaaaatgcatatttatagaaatcattccatttaataaatacatacacatatattaaaacctgaaacctcagttcccttgtgtatataaccagaagactggaatggacaatttctaaggtcctttcagctttaatattcagcaaatctatgtatttgtagatgtaattgatgaattaattcaaatgccatattctatgaatccatgaagatgcacaaggtaagaagaaagaatatatgttaacagattataaattatttggaaaccaggatatgtctctaattttgtttccccacagtgccttgctgcacacattatactcaatatttgttaaaagaaaggtgaggaataagattcttattaatgaaggattaagaaaaaaatcctttcattaaattgcaacctattaaaaacttaaaatgtactagtcatgttaataaatgtataataaatgaaaccatctttctttgattagtggagtttttcatagaaaggtagccatcagagccatctttcttaatatcaacagaatcatattaatacattctaaaagactagactttgttatatttgaatttaccacagataccttagaagttaccttttgtttaaaaaaatcaaatccctaatgtcagtttgttttctaacaagcaagggaataaatttgagtttaaaatagatttcttatttgagtttttactttacagttaggtttcaacttaaccactgttttccaagttaggtagtgatgctgctcatcactaggtctaaaagagatggatgttcacagtttctgtgaaactcctagcatcaaaaacaaacagcttaacaatctttttttttttttttttaaagataatcttgaagaaaaccatggtgggccagggatggacagggaataggacactttttaactattcttaaaaaataaaaaagaacatttcaaaaagattactgagcacataactaatgtctctgaaaggaaattcattataacagcagctagcctttattgatcatttgtgttagacataacgcaaagtatatcataatttaatttgctacataaagatacagtctacctcttaaggttgcttttgccattctacacagtacagaggaatgatgcacaccttggcagtatacttccagagcttgcaatcactacactatactgcctcactgacagcaatgcttttactataaacaatcagaactaaacaatatcctatatacattatttaatccaaacacattttatcttagaaagactgtacacagtgagttccacttctctgtcatcaaggttaacagttcaggcctttatcactacactttcatccccgatctgaattacctatacaaaaagtctatgtgggcctatgagtttaaaaggcatttggcattactaacaaagaccgatttttaaaagctgatgttcctaactagtaaactggaacttggcagtaggtttccagttcttactgacagatctccaagatggttactaaaatgatacgcccctaagattttcttcccaccaagaagagatgaaaatagcaggttcatcctctttccaaccagagacttaacagcacatttctgcactctatcatgtacatatacctggatttcaaaactcgggtaagtgacaggtagctctttcttccccagaggttggcaagccttgtaataaaaattattttactgaatccattttgcatagggtaattatatttgtgctattttatacattctatcttaaatgggtcatcttttctgttggtcttatttcaacaatggacatatatataagtatcttaattctcagttttacaaagtatgcacaggacctcttccgtgcaggtatcaagactgaccaagtacattatgaaccaaaggtacaaaacactcttatgcaaaaactttaaaagtaggtctacaaaggggtcatccatttttcaatttaaaaacccggctccacagaccctaaagattctttggaacacttatgggactccctctacccctcaaacagctctacttgtatctaattaacaacaacaaactttctgcagctaaaggttgaaaactcctaaatctaattcttgccccaaattaacactcagatataccacgggccaaagaggctatactttagttgcagaacccttagctagaattcaaatattctgactcctgttcactaatgctctatccactaaaacctgctgcctcctcagtccctcaggaaatcccaaaattcagccaattgtccaaatctattctattctcccttcacaattacttcttatttctactctcctcaacttgtttcaggtctgtattacctcgtaactacatgattaagtagaattttcacctctgcagtgaggtagagagtcaggttatactacttacctagtgtcccaaacaccagtaaaaaatattgctgcttgtcttgaaaagggacagcaaaattgtttccagaatgctttcgctaaaaattagcagagctgtcccaggagttacccacatggctaagatattaaatgtgtgaacactgaagacttcagccaaaaactggataaaattgaagtagtatatttttctattccatttaatgaagcttttccctgcttccctctcagtaggccaatttcaatatcaagaatgcagtcactatcaacataattccctttggtgacaattagtaacaacagatgtattccagcagttccatacgtttacataaatgaaaatatctgtcactccaattactatattcaaaaaaagactataaataccaagatgaattgtaacatactactaaatgcaaagcatcacagtatgtaaatgacatgcctacataaaccaagctttgaaaggatacacaacaaactactaacactgctaactaaaaagcaggaatatcaaggagtaaaaggaagaacttcaacattttaaacaccaaagtattatttgaagttatcatgtaagcaaatcctttcataatttttaaaaatccaataactttttccttctttcaaaaagctgaatgaaataattcagtatcaaaatgttggctaaccactatccaatgcaggaggattcatccttcctaactaaccactggtattccctcctgtggttagttacagctattctttggaaatttgacctgatgaaaacttcactaaattctaggcacagatggctgacaagcttatgtatctggttacctcaggctcacctactactgggcctgtcaagtttttccagtggtatattttgagagttcaagacttgacacaattctttagttctttctgtgacaaacagatagtgttgcagaatggtaaggtgacactctactaagacactactaaaaacacattccactcaaactcccattcggctttacaaagctgctgaaatacacacacgtgttactaaaatacaaatgccaggaaagctcattcttctgataacttctgagcaattttcactataacctaatgttcctacagcaagaactactactttatatactctactggtgtttttttctccctttaatgcatatcaaaatttgccctttcatcctccagctgtaaagtctgactacccctagcaccactccacctcataattgaatttttaatgtctacttgccactgagtagcaaattctatgctccatgggcagacatttcgtttcacaacgtttcacgtatgctactccacagtaagtggtagctctgcagggaagcaagtaccacatagctcacaatcaatattcattactagccgcctgcctggaattctttctgcctcgatgtcctcacttccatcaggaattaatttcctttgtgactaggccttgaagaccagctgagctgtttctgagaaacatgggcattatgaccctttggggattaaaagagttaaaaaaaatatatgttagaaagatctctaccatacaaagaaagtcattaaacagctattaggaaatgcaaaaatacccactcacaatatggaaacactcctgctcaataaacaccagtcatctaaacttttatattacacttagaatatggaaccactacctctctgtctaaaaaggattaaaatagaatttaaaaattttaagtggcaaatgtttatctagaaacaactgaagataccagaagaaacaggatcaagaaagtatgtgtaagaagagaataaaattaagataggaaaaataaaataactttataagaaattacaggctgggtgcagtggctcaagcctgtaatcccaacactttggagaccagcctgagcaacagtgagactctgtctctatgaaatatttttaaaaattagctgggcatggtggcacgcacctgtggtcccactactcgggaggctggggtagaaggatcacttgagcccagacaatggaggctgcagtgggctgtggtctcaccactgactccagcctggatgaaagagcaagatcctgtctcaaacaaaacaaaacaaaaacacctccctgggcaacagagtgagacaccatctctacaaaaaagttttttaaaaaattagccgggtgtggtggtgcacacctgtaatcccagctgctcaggacactgagacaggacgattgcttgagcctgggaagtcgaggctgcagtgagctatgatcataccactgcactccagcctgggcaaacacagcagcaagaccctgtctcaaaaaaaaaaaaaaaaaaatagtaacaataaattaacttaaattaaaaaatttaaactaaggcatagaggtctttaaaaggattccaaatcatattgtagaggaaaacaaagagggacaacagaattatggtgatgggaataaagcttctattgctttaactatttagatcattgtcttaattactaatgtttaaaaagaaaactttctgctgctaaaagctgaaaacaagatgtacagcaagctatgtacgtctctacaaaattttacaagaagcaagaaaatgtaaaactttcaaaacattcactggaaaactggaagaaaataatatatcatagtttcctagtaaaactcatgctgctaaatttctaagtcaagcaacaactaccaaaacatgtcacttctatggaacaacttaattttgatggtgcaatacattactgtagtattagcaaaattacctgctgcaagacggcttcaaaaataaagaccactgctacctggatacattaatgttaaaagctaacctgaaagaccaaggagggtgatctactgaaatagtttggaataagcatatttagcgttataagcatcaggcttcacacatcctaaatggtaaataagttgtgtgttaaccaaaaaagttcattgtaattactttctagcttgttaaaaataagaagggactaatatcctctatattaaagatttcaaattttataatcattttactatagaacacatagctagctttaaaacaacagattaaaaagtaaccaagataactgaatgggtattagggcaaagagaaaagttcactaagcacatgtatcttgtgtcatgtactgtactgggcattgtatatatgcagtctcattctaaccaccatcctgtgaggtatgcgttatgtctaataagcgactgagaaaacagaggctaagagagattaagagatttgccaaaaatcagggtttcaacctaatctctcaggctccaaaattcataatataatcctttggtgaaagggacacaacttagaggcccactgataattttatttcatcagcacagtgtttttaaatccaactttcagtgttttcaaagcatgtattctctagtttagcaaatggtacttgtttagctcttgtggtaaatgagtttgcaaaccctgctttaatgcatgtcaacaaaaagagtaaaggcaagtcaacagctgttctccttgcctttccattcctagaaggcatgtggctttgactactgatagtcctagggactaagtactataatcctacctcagaggacacttacaagtacaggaacaaaatgaagatattctcaatgggggttgccctgccttttatagggcattttggaaatttctctatttttggttgacacaatgactgaggtgaaactactagtctttagtgggcaggcaccaaggatttgcaacatcccacaaagtaaggaaaagtcttgcacagtaaagaattgtcccgcttcctataccactttcaaatgacattcaagatgaaaaacttgttctgagcccagaacccaactctgttttaaatataacacaaagtattcttgcatgattttaatcatcacttaattttccaggaatgtaattactgtgtaaagtgagaatagactgttctttcgttcatttggaactctaccaagagctgttcaccttttcagaaaatcacattatcaacagcaacactgtctatagtattcaattcaccattacagcacaactgtatcggtctgaatttgtagcttggtttttctaatataaacaatgggctacttcaatgtctttctgtccagccatctcttagcacttacagactgatctaaacattgtattattagagttacttacccttattttctcctttatattacatttaggacatcagattgttttttcttcaataacatgtaggtaggtcaaaacatctatgaattttatttcaggatagtaaaagggagctacaaaaatttgctataaaaagttaacacagatagacatctgatttcactttcagtcacctatctcggggaggagagaatggggatgaaaaataacaagggtccctgtgactaaatttaacttgaagtgagagcagtgagcacactacaaagattacagaaattcgatattaaccttccctagtagagaggaataattaattcaatgaaaagactggcctattaacaaccatctaaaatgcacattttaatgatatgctcatcatttgtcaaaagagccaaccttgaaataatctggcctttctcattagtactttatttttcctcttaactttcttatgaactaccagagttgcagttaacctattaagggtaaacactataaataccatgccctataactcaaagctaaacaagcatgccatttaaaaatatagcagtttattaagcacttcagcatacattgtaatttaatcccataaaactctatgggttaagtattacactaatttttaaaacagaaaccagagtactaaaatgcaaacagacagtattacagggctactgccaaatccagtgttctttctacttaacttcattacccaacaagatgaccttttcagtatagttcttattcacattttatatttacaatggtaatttcctactttcataaaaactacaagttacttttagtactttttaaaattaccttaaatatatttcaaataaatatgggtaagtataactagggttatgtttcatgttccttaatatcattctccctggaacctattccactgttcgagtcctcttattcttataggcaccactccttgccttagcccataacaaaaggacaaaagggagagctcttacaatgaattactgataaacagggacaaaccactactaaaaactcatcaaaccatgattttcttagtactgaaatttaggtataaagtaatcacatcccataggagactgaggcaggagaatcactcgaacccgggagatggaggttgcagtgagctgagatcgcgccactacactccagcctgggtgacagagtgagactccatctctgaaaacaaacaaaaaaaaccaaacaaaaaaacaaagtaatcacatccctagtctgtctgcattgttaacatccactttctgactctctaaatcaggtggttacaattcagcaagtgaaaattattttgaacccattagaaagaaaagggtgtggtcaatcacatcttcatttatacctttttcttcttccaaaccaagaatacaaatatattccaagcccccaggcacaaatatggaaaagggcaatccttaaacgagaagtcccagaaacatccttatcatataccctttaggcaataatgccctaaatttttaaatattttaggtaagaagagggagaattgttttaaaaaaaaaaaaaaaaagcctgacgccctcagcccaccttcttctcgaaaacagctttaatttcagagaataaatgaaaaaaattactgtcagatataaggtagctgaactgaagaaaacacatatagaaatgtgaggttatcaaaataaaacaatgctactctaacctatattttctcatacaaaatttgcaatgcaacatgattttgtccatattaaatctactttaggaaggtttcttttaatacacaaaaacctcaccaaattacaaggctgtcttttaagttctaactggaaggccaaaatagcaaagatacattcttccagggttgccatattacgtaaataaaaattcttcatttttgatctgaaattcaaatataactgggcatcctatattttatctgacaaccctacactcttcaaactaaagtgagctcccacctctaccaaggtattacagcaccagctcccacttctaaagacaggctgtggcttctatcacagcaggattttaactaatgaagtcttaggagttaggatgaaagtgtccttttccaggtttttaatagcatacatttaccatataaaagaaaaagcttaatttctaatggccaaaggttatacttttactaggtttcatataaagtctaacgggctctttattatctaggcttctttgtattcaacacgtattggaaggatttcatagtttagctttttgataacaaaaagaagttgcttctgaaggttatagtaagcaaaattctgttctaatatcacaggcaagtcctaaaagctaccttaatggattccaaagttaatctaccattttacttggattcataatcatagaagtttagagctagaaacactaatttctgatctttaaaaacttctggctggcaggggggctgtggctcatgcctgtaatcccagcactttgggaggcacaggcaggaggatcactttagtccaggagtttgagaccagcctgggcaacatagggagacctcatctccacaaaaaattcaaaaattagccaggcatggaggtatgcgcctgtggtcccagctacttggaaagctgaggcaggaggatcacctgagcctggaaggttgatgctgcagtgagtaatgatcacgccactgcattccagcctaggcaacagagtgagaccctgtttcaaaacaaaacaaacaacagaaaaacacactaacttttgaaaagtccatttcatttcatattcatttccatatttttctctcattgagcttctaaacaagcacagtactatgtaagaaagagatcatttctgtttttgagtaccctctcaaccagctctttgtcctacttataatggttctgacgatgagtgcaaataactctattcttccgctagtttcattaaaatcatcttaatactaaacctatgctttcttccctgtgctctaggccattgctctttgatacagcccatccatctttggagactgcctaattcccttacttcatttacactgctaccttgaaagtattaatagataatcacatccccctagtgctccctgttcctaagtttagctccttcaggcttttctcctaaatcttaagctaccatcaacatagattctatgtctcttccaaaatgtggttagaaagtattcttatttggagttcaatcctagtagaaaacagtaatgctgttaggttagcaccatacttttgatacgtgatcactatgttatttgtgtaagggtaattcaatgacagttcactgcaagctatttgaaacctctttatacttgcttttttccaggtagcagtttcctggtttgcattaaggccatttatttcatctcccttgatgcacgatttgagattcagcattaatgaatataatttcaatgctggagctccttgtgctatttttttccagttgttcggcaatgattcccaaacctgctaaactcgtataatcaaaaaaatcccaagttaaatttaacacattccttcaatctatgaatttagaagtttttcacagatagttgccaacaaaggaggacatcttgttgcctttttttcctccaggaagcagtgtctaaaaactaggaaataatcccactactctaggatcttaaacatgaacggcagatgattctttagtgatggttctgcttaccctctctctctcttcccttggccagtattcaagtcaatctgtactcaacagaaatgtgcctcagactacagcaaccaagtaaagcatttggcttagaataaacattagtactcccagccctgcaaactcaaaggctcaggaataaggaacacaaggtctaatttaaaaggaaggtcaactgaatatactggaaaagttatgtcttgattatattcaaattactgtggcttcccctttttctaaagttctaaaaggaaaaaaaatcgctatatataatggctaatgtataaatccaaaatgttttattttctttactcataatgactaataacagtatatgctgatattactgataaatgtctagtgaaaatccttgtgttaacaaaaatcataattattccagactaacatggcatgtaaaaaataaacaaaagccccaaactactccatacctgaaaatgctgtttttcaaactgagtttcacggcccatgaattgtgaattcaatttagaaggtcactatggttctcttaactacctcacacagattaataataggtaatgtttcacaagatattacatatttgtgtaattttgttataaatttctattagtcaaaaactacttctctatctgggtcacagacaaaaaagtttgaaagcctttttctaaagagctttttttttttgagacggagtctggccctgtcacccaggctggagtgcagtggcatgttctcggctcccgggttcacgccattctcctgcctcagccccgagtagctgggactacaggtgccggcgaccacccctggctgattttttgtatttttggtagagatggggtttcaccgtgttagccaggatggtctcgatctcctgacctcgtgatccgcccaccgcagcctcccaaagtgctgggattacaggagtgagccaccgcgtccggccaagagctttatttttcaagtaatttcaacatgattacatgtgaaccaaatattatcttttactcatataaactaacccctactgactacatttcaggtcctagaaaattctagtttgcaatgtaatttttaggttatttttaaattaataagtagcaagggtgtagctgaaactagatgatgaatacacaggggtttattcattacttaatctatttttgtacatgtttgaaattctaaagatctaaaagaaaaaaaggaaaagaaatggacctaacagataacaaagtagtaccatgaatgtttacaacttgagacctttaaacacaatgtttctaaggaataacaatcaaggaacttgctaggatttaattcagttaacacttggggttgccttcttcgactataatggacggatttccaggtcttaaaaaatgcataagggactgcagaaactaactcatatatagaaaacaaactttctcgaaagataacataaaaatacaaatagttaagtgtgtttcattgtctctttattagtcaaccactttcagccaacagaaagatcataaaatacctacctacctggcaggaatattcacttctttattcacactggcaattttcccagcaagtttaatataagatctctgcataacagacacggttctgcctcccttgaaacaagaactgcaagggttgtctgaagtagatttagaggcatttagatttcaaaacagtgcatgcctcaaagttaattttcattatattcaaaagtaagtttctaaaaacttttaaacagaaagtgttatcatctctgagcctttaacctattggagacagtatctaagctataagggcaagatatttagtaatttttagaactgaaaggaaatttagacatcatctagtccaatggtttccaaatcctaccatcaggaagaaaagaatctcaaaggcataacaatttatatatgcaaaacaaactcttacttgtgtgttttcctgtatcttcctgcacatgaaatactatgccttattagtattctatcaggaaaggatgtgacatttcgttatgcattttatatttaatcacatttagtatgtgagtatccatttagatatgattaaaactattggtacgatttgggacttaatgctttctaattatagaaacttacataatatatccaaccctaatactttcagagtgatttcataccatctcatttatatttcactgtctagtaaatttgaagtaatacctgggtgaccgatgatttttaataaggcaagagaaggatatccaaattggcatatttcagccgggcacagtggctcacacctgtaatcacagcactttgggaggccgaggtgggcagatcacctaaggtcaggagttcgagatcagcctggccaacatggcgaaactccatttctactaaaaatccaaaaattagctgagtatggtggctggcgcctgtaatcccagctactcaggaagctgaggcagggagaattgcttgaacccagaaggtggaggttgcagtgagctgagatcatgccactgcactccagcctgggcaacagagcaagactccatctttaaaaaaaaattgacatatttctggaaaataccataaagtatatcataaagctccagtagttaagattatttggtaggaaggctagtcttaaaacattccataattgtttcagaaatgcaagagaataccatttagtgctttttagtacaagaaactcaatacaaaatgtttccctcgagctgactacattctattttaatgaacagataacactcagtttatttatttgaaaaacaagaaacacaacaagaaaacagcaggtatctgaggaatattaaatgtctcccctaacttactgtgtgcaagtaaatttacatacgtaggaaattctttaaatatttagaaaaccccatttctatacagatagacaaaagttctgagcaatcaggtcaaaataatctcaaattaataagagttgattgataaatgtttgcctttgtacatacacaaaagcaaacaaaagttaggcctactttcagtttcagacaatataataaattgaaattaaatacaaattttgactctccttcctaaactgaatagatccttaaaaagcagatatattttacttgtgtattcactcttttaaatttagacatcaatatcactagaataatgtttttacacaagatcacttttaaattcagtaagaagttttgttatgtatataagcctaaaatatgtaaccatttataaccaattaattttactggaggggtttcctgtcttcccgaagttaatccttaccaactaaaattaggaattttgaaaaaaaaaatccataaaaatttcacaaacaagcttacaaatgcattatctaaggtgcttaaaattaaactccatattatgaacaacattttaaaaatttgtataaaatgataatgttttgtttaaagaggcatactgaaagctaagccaatttttcacaggaggtgattctccaacattattttaactttgatgtgtgaatttactttagaggtccctggtctatttactctttctgacagcttatatttttccggatgctcctcaaacaaagattcattcctcattcttgcatcctgcttttctccttgtactactgcagcctttcttctgtctttccctttctcttacaacttcattctctacttctgatcctgtccagattgtactctcactgcaaacagtaaattgaatagaatacatcagaacgattttcataaaattcacttttccaaaactactctgcataattttattcaaacttttgttgaacatctcttgtatggtatccaacatggtcactcactgtttctctacatacttcattttaatagatattagcactttatctccttcccgaatcgttgtaaaaaacctttacacagacccagcaagtttcagagtttacacacaaaacatcttacttttaaaaagtacctcagactaatgaaaaacaatgttcaaactgacagagcacttttctaattacatttggtcatctttcaaggcccaattaaatctttttttaatttaaataattatttttatttaaactttattttaaagttaaaataaagataatataatgttgctttttattaatgtctaaaggcatattccacaaaagaaactgtttcacatcaaatctgtattaatgagaaaaaacaatgggattcccttaaaacagtctaatttctcataaggatctgtattaatcaagcgaagtcagacctgtaatgaattccaacctcacatctaaggggttttatttccttttgtggttttaaatcttggtatattcacaagttaagctctactgcgtctggcaacacaaaaacccatctgtatctctttctaatttggatccagtaaccttgtaaaacaaacccagggaatgggtcctgatgtagtaacatggcctatcctcccagaccgaaccaatttctcatgcctgggtgctgcattatatcagtagtgacattttagccagtagcctgagagactgaaagcctgtgatctccttaggaagggctttatgtcaaggcaaactatttcttctggtcaaatcttatttggattatttcaaaattttttgcttgacattcggcatgtcatttgtgccacagctgccatagataagatgtgtcttctgttgctcatttcagttcaaagaggaaacacgcaatcaattagcaaatacacctctaaaaatgtactcagtgagagaaaattgctaaaccactgaagcaaacagcccttgacagaaaagaaaaagatccatgaatcatctaatgcaaatactggcattattacaaagcacaatgttcacaactatctagtatcacccaaacaaaatggtttctaaaatttaggtcgttaaaaataagattcattagattccttattttcctccattgaacagtgttaattttgtgatgtcatattttccatatgaatatattacgtttttacacaccactccacattcattaattcagctaacatctataacactcccactgtgtgccgggtaccacactctatttctcttattcacaacaataatactctatgagaaagtgatacctggcccacttgaaagatttggttcacagaaaaaaaagaaaaaaaaaagccataaagtctctcccagaaactcaaataaaaatattaacttcctcaccagaattggcaattgcagacacagtgcagctggtcacttttctgagaaagttacataagcaaaagcacaaatctctatgtggggccttcaaatggcctatttaccatgacagcagcattaacaatcaagttttcaatatacacatgaagaaaaataaataaaaaataatgctcctttttaaaggatagtagtaatagctaacatgtactgagactcaggctgaaatctaagcggtcattatctcatttaatcctcacatcatccctagggaatggacatgattgtaatctccactttacagatgatgaactgatgaaactgaagtttgcattactcaagatcactcagctactgacagctggaactcaaacctgagtctgtcaccgtccaaagcctgcactcttgatcatcacattatactgctttgtttacactcactcaattgcagtctaatgcttttgaatgtcttataaggttactttttagaacaagttcctctttaaactaccattttgatgatacatatagaagtcaacaaataaggattttacttggaattggtcttacaagtttaaattcttggatgagaaacaaaatccatctgaatgaaagccctgaatgtccacaacaatgggtcagaaactcactggagcttcaagagaccttgagagtcatacaggccaaattcttcattttaggaataatgaaacaaatgccttttgaaaaacatctatattcaatctaaactactacattcccaattcagagatacttgtgagtttttttctccagtcatttaaatagaaaatctaacatttctaacatttcaacatcatgcacaagcaaggtatccctttttgaaagcactgtaagaaaacacaaactccatgacatgaagtcagatcactgcagggctatttattaccagctgaaagcttgaatattataataagacatgttatatagaaagctataaaatggcatccataactataggaactcaaactcaaaaatagccatctcttccttgaattaaatttacattcatttgggtcaaccagcagctcagcttcatttcatcggtcatgtcatgtgactgaattcaagctcatttcaagggaaaggccgttctatgctgtatttagaacacatatcactgagcagacagatgagtctttataggcctatccagaaaccttgctttagttgctaagaaactacaattttaccgtattataaatcattggaaaaaagctaagccagcagagattaaacatgttaagatcaagaatctctcacctattgtgcaaaatgaaactatgctattaccataaactgaatagctaaaattagcattaggcttctttaagtcatgttgacacagtcgaaaaactgataagacaaataagactaactctaccctgccttccacagtggactcatgcttagaggaaaacaggaaaaatacccaatacacttagcatattcaatgctagagacagaaaaaatgtttccttcctgacccctgcagtgatatccaaggccatgaagcacacataaaatttggtactacgaacacatatttaactgatggatattgtcaatcctttattcgttttaggaataatgaaacaaactctaacattcagcattttaaacccagtttctcaaaaaactccactggctctatcactgattttttaaaatttaaattgcagcctctctaataagagtaatcataaattgttctggcctaacaataaacaatgaaagattagcaaaaataatttatagttcactctccagtactgacttctcataaattccttcacagaaaaaatattctttaacctcttaatggctgtttccacaagggcagaaacaggttcacaatcctagactcacttgtgaaagatcaattcagcagctgaatgctaacacatgtcttcaatcagaatctgctctgtttaggtccctatgcccatgattccccaccacttctccatcttctcaaaggagcttcaattcaaaacccagtaattctctgctttctactgtaccacctcccaggggccactttcatgttcctcggaaataacgtctcttctgtcttgaaacttttaaatctcaaaaatccacttccccatctccctgtcgccagtcactgccctcaatcccaccactgcaattagttgcagctatgtgtccctgttttcccaaaggcccgaccaatatcatacagcatttgccacatcccaactcctcccttccctaatttatcctccacactgcaaaccaacattacacccccgacttcctgcattttactcccttcccttatttttcgtcttcccccacccccatctctatacccaggcctccttacttctctaataaatattcccccacctcagttccaaccctttccctccatcctctgctcattttcctctccttatttagaaactcctttttgctctcccaaccactaccctagaatgcccagcactccaccctctttagcaaacccagccctcttcccccagctcatttggagacactgctgcttctctctccaggtcccctactgcagtcaacccactccctcatcttcccacccaccttccctctatccctagatccaaggttccctgattctttaccccctcctttggtctctagtactcagctcaccattagtgttcctcaggactctcttccccccaatttcccccttatttttaaggatgtcaccagtcctacggggcctcagtagaatcctggacgaccccagctcccggggggcctgacggacaccaccatccccgtcgcccggaacacaaacgccggtcttgtgccaccctccctaagagctgcgccccctcctcatccgcccccgctactccagctccccacgtcggcttcctccgtgtcccctcgccgacccggcacgacgagccccacgacgtggagcctccgagtgggcaacacctcgggctcaccccggacgcccccgccgctcggataggagcctccggtcctcacacccgcgcctcctcaaacccgcagccggtacctcctctcggacccgcagcccctcagacgcccactcggcccccttccccgagctccagcgtctcctcaggccagagccgggccccctccggccccggcgcccctcaacccccgcccggcccgcccccggcgccccgcttaccgttctgagcggcgcctggccctgggaggagggagccagagaccagcaacagcgagagggccagggcgctgggcagcgacgaacccgacatcctccctagcagaagacccaacagcgaatgggccggggccagagccggggccggggaagggaggggagggagggagggggcgggcgagtgcgcgagggagtgagcgagggaggcagccgcggctcggctccgtccttccccgtcctcctcctgccgccgcagcgcccaggcctcgcgagaccttcgctccgggtcgt

SEQ ID NO: 955 - DNA, 48705 bp, Homo sapiens
cctctccagaggcgggccctgagccggcacctcccctttcggacagctcaagggactcagccaactggctcacgcctccccttcagcttctcttcacgcactccaagatctaaaccgagaatcgaaactaagctggggtccatggagcctgcacccgcccgatctccgaggccccagcaggaccccgcccggccccaggagcccaccatgcctccccccgagaccccctctgaaggccgccagcccagccccagccccagccctacagaggtactattgggttaggggatgatggggttaagctttgttggtttgctgtggtggggagaggcgggaagagagggtctaacggaggatttggtcaagtaccctagagagtgacacaaagcgggaagtccagacaccagggtcctgaccgtctcgggtggggcagggaagggagggtaggatagagtagaaaagaggacacggaggagttggggcggcctcgctgggctgcggtttctccactgagcagttgggcaaggtgagaagggtcagtggcctccgggcctgggcccttccgcccaccctcgagccctgcctcaactttgcctcagatgcaggacttcagattagggaggatggaggtagtacccctgttgcgctggcctggagccaggggcatgtcccaggcacggcaaaactaaaaccaacttcccagatccgaggtgagaaactggctcagactgaagaggtatctttgccaaggcctcccagctcatgtggtttctgcttaaggaagcctccccaacgaacccttctcttgccacacctttcctgcccacctcccacctcccccgacaaaggaactacttgggtttcttgctctgctgcctttcaggcccttttactccccttcatgaaagtacagaggacaccgtattacagtaacttttataaacattattacaactaagaataacattacttaacaatactaggtaacatttatgagcacttcaaatgtgccaggtactgtattaagcactttggtttttttttgttgttgtttgtttgttttgctttgttttttgtttgtttgtttatctgtttgtttttgagacggagtctcacactgtcgcccaggctggagtgcaatggtgcgatctcggctcactgcaacctcctccttccgggttcacgccattctcctgcctcagcctcccgagtagctgggattacaggccacgccaccatacctggctattttttatatttttagtagagatggggtttcactatgttggccagattggtctctaactcctgacctcgtgatccacccacctcggcctcccaaagtgctgggattacaggcatgagccaccatgcccggcctgtttttgtattttacaaaatgtggtaaaatatacctaatggataagttcctatgttaaccatttataagtgtaccattcagtggcattaagtagattcacaatattgtgtaaccatcaccaccatctatttccagaactttttcattactccagaaactctgtactctttaaaccataggggagggaaagatggcttgcctccacccttctagtttccttggctgggctatgaattaaatagcctatgaattaaatagtcataaaatagattaccagcggaaaacccatatttaattacatatgtatactcaggagtcccacaatatatgagactcaaagaaaggtcagatgattgaagcctgtataacatcctgagctacggaaaagagcttggagcttctgggtgatggtgataacacaagttatgggagggtgaggagaggagctgtttggtgaatagaggttgtcttgctatgtagattaaaagttcttagataataaaagttgtctggagcagccctcttttaatatagatcattttactaatgtagattttcttttaagatataaatgcctttcttttttacaaaaggagagcttttcagagctattcctgtatcagcagtttctcagaataaccagcttaaaatatgccaaagaagtatatttcaagagcctcctgcagtcatactttgaagtggtgtgtcctgagccccagtaatgcaatagctcctcattttctccttcccctagcccttggtaacttctaatctaccttctgtccctatgaacttacttattctagatatttcatgtaagtggaattgttaccagtagaggatcttgactgcaaattgttcaggttcttggcattttgaacaaagaattggacaaaatgtacagcaaagcaaggaaagagtgaagcaatgaaagcagagatttattgaaaatgaaagtacaccccacagggtgggagcggctagagcagggctcaaggaccccagttacagaatcttctgggttccaaataccccctagaggtttcccattggccacttggtgttcaccccattggttgcagaaagcaaccaaccagacgtactttcaattttccatctgccctgcaggaaatggggtgatttgcaaagagagtagcctctcttccttttgttactgaggcatggagagttgcggttttcctttcgatttagttctaggaagtcagagggaatcggccttaggttccctgcctccagaccctattctcctgcctcagaatcatacagtgtttgaccttttgtgactggcttatttcacttagcataatgtcattgaggtctatctatgttgtagcatgtatcagaatttcatttctttctaacgctgagtaatattccattatatgtgtagaccacattttgtttatctattcatctgttgatggatacttggattgtttctacattttgtctattgtgaatagtgttgctgtggacattgttgtacaagtatctgtttgggccttgtttttacatcttttggttatatatctaagagtggaatttctgggtcatattgttgttccatgcttacctctttaatgaacccccaaactgtgcattaagcactttatatgaggttggtacttagtgtatctaccttccaaactgagttccttgaaggcagaatgtatcctacacctcttatatctcagagcctattactgtgggtgatgagaagtagatgctcaataaatggtgcagtgagagctggagggcctgaataaatgggggtattggggtgctgataagccagggttttgcatcatccaatgactggctggaatggaatatgaggtcctactccagggtccagctgtaagggtggttggccggtaggtgggggcttttgggacttctccaggcctcacctgcctctctggtcccccagcgagcccccgcttcggaggaggagttccagtttctgcgctgccagcaatgccaggcggaagccaagtgcccgaagctgctgccttgtctgcacacgctgtgctcaggatgcctggaggcgtcgggcatgcagtgccccatctgccaggcgccctggcccctaggtgcagacacacccgccctggataacgtctttttcgagagtctgcagcggcgcctgtcggtgtaccggcagattgtggatgcgcaggctgtgtgcacccgctgcaaagagtcggccgacttctggtgctttgagtgcgagcagctcctctgcgccaagtgcttcgaggcacaccagtggttcctcaagcacgaggcccggcccctagcagagctgcgcaaccagtcggtgcgtgagttcctggacggcacccgcaagaccaacaacatcttctgctccaaccccaaccaccgcacccctacgctgaccaggtgagtaggccggcacagggtggggtggtgcatccaagtaccaggtagagggcgagaggagcaaagatccaaagagtcacacagctgaggacaaggagcttctggggccttgcaactctaaatgtggtctgcagatatgcagtgtccgtgttgatgaccacaatttatgctgccagtccccacgcaggtggatagtaagtttccagtttcctcctgtaataaataatgctgcagaatcatctttgcatctttatccagtaacttctttaggataaatttttagaagtgccactgctgggtgtagggggacgggaattctacatttgatacatgttaccaaactgccctttagaatttagtggaattttccgagagcactgacacggaatctcagtaaggctggattctaggatcagagacaagtagttagtttctgtctgaaaagttgaaaccattaacaccaggcagcgctatctgagaatgtctgtatggggaaaaaaaatcacatccagttgtaattatttttattaaacagattttaactcagttttttaataggtaatacattcgtacagttcacgaacaaaatttgtaaagaggagagagagagtgcaatcttctgtccatgcccaactgcctaattcccaccacttctccctcttcccatccacaggtagccattgttactagttttgaatgtttcttctgagagtttctttacgaatatatatgcaggtaggagcaatcttatcaggtcctattttccctcttttagccaaaaaggtagcataactatgtgaacttttcaccattagcaatagattgttcatagaaggcgcttcttggttcttagagatccacttgcaaaatgaaagcatttttcgctggtttttgacaactcagaactatatatggctaaaccacatatttgctgaactacatatctgctaaactgactgtgatttgtttcctgctttaggataaacttcccacactatcagaataagctttcccctccgactcctcaacagctggtatcaccacgtttcttagcttattgtaaaggttgagtggctttccacttgtttattggccattgtgtttctgcatttgcgagtggcctgtttaggtcctttgcctgttgttgttgttgtttccgttgaggaattaagggactaattaaagaattcaggaacaaattcctcgaaagaaaaaaatgtatgcatttcttttgctcttacaatttatgcagttttaaaacttacatatttattggattttgattgaaattgcaataaattaggagaaattggctttatctctggttctatcttttggatttaaaaaattttttttaattttttttttttttttttgagatggagtctcgctgtgtcacccaggctggagtgcagtggcgcgatctcggctcactgcaacctccacctcccgggttcacgccattttcctgcctcagcctcccaagtagctgcgattacaggtgcacatcatcatgcctggctaattttttggcatttttagtagagacagggtttcactataatggtcaggctggtctcctgacctcaggtgatccacctgcctcggcctcccaaagttctgggattacaggcatgagccaccatgcccagccttatactaatttcttaatgaatttgtaagctttcatgttttgaacgtgataatgcagccatcccacgggatccatgggagtctgtttcaaattcatagatgctcaagtctctgatataaaatggcatagtatttgtatataacctctacacatcctcctgtatactttattttttattttatttttattttttgagacggggtcttgctctgtcgcccaggctggagtgcagtgctgcactcgtggctcactgcagcctcaatctcttgggttcaaacaatcctcccacctcagccaccagattatacaggactgcaggtgtgcaccaccacactcagctaatttttaaattttttgtagagacagggtttcacgacattgcccagactggtcttgagaactcttgggctcaggcagcaaccctccctaggcctctcaaagtgctgggattacaggtgtgagccactgtacccatcccctcctgtatactttaagtcatctctagattacttataatgcctaatacaatgtaaatgctatgtaaagagttgttttactatatttttgaatttgtatatttttttattgtggtacttttttaattgattttttttcgcctgaatatttttgatccaagatttgttgaatccacgggtgcgtaacctgcagatactgagggccaactgtacatataaattgtttagcgtagtgcctggcacatattaaatactcagtgaatgttaaaattctattataatttctctgctctagaacaatttgaagaatataagaaatttaggcttataaaagttttttgaaaaaccatcttggaactggtgccttttttatagtagatttttgggaacttttcccatttttgccatggcattaatctgttttggctcttgtgtcagatttttggaagattttccagttcatcctgagttatctttcattatttaaaaatctcctatatgcctgtaactataccccctttttttatttctgatgttgtatatttgtggtttagcagtcttttcaaagtactgtacttttagtctttccttagattgcttactgattttaatgttttccttctttctgtttgatcattttatttttgtcattttcttccttctaacttttgtcattattcattttctagcttcttgaacttataattcatttatttgcaatctttattgtttaataataataacttttttttttttgagaatctccctctgtcacccaggctggagtgcagtggtagatcttggctcactgcaacctgtgcctcctgggttcaagtgattctcctgcctcagcctccccagtagctgagactacaggtgcccaccaccatgcctggctaattttttttatttttagtagagacggggtttccccatgttgaccaggctggtctcgaactcctggcctcaagtgatccacccgcctcagtctcccaaagttctgggattacaggcgtgagctacaatgccctgcctaataataactcttttaaggcataagttctctgtatatggttttggctgtatgccataactttgataacttcattagtgttctcatagtcaatcatttctcaaatttcatttcagtcttttcttaaaaaggttctcttgcttaaggtcaagagttcgagatcagcctgggcaacatagcaagacctcatctttacaaaaaataaaaaaaattagccaggcatggtcggtggtacatgcttgtagtcccagttatttgggaggttgaggcaggagggttgcttgaacctaagaatttgagcctgcagtgagctgtgatggtgccacttcactccaaccagagcatcagaaccggaccctgactcgaaaaaaaaaaaaaagaaatttttttctcttgaaaagttttagagaatagtgttttctaaaattttcaagtggttttgatgtttggtttcttgttctgtcacccaggctggaatgtgatggtgcgatttcatacttgttaatttctgcactatggccagtttatacagtttgtatgagttctacatctaagactatattgagattttcttagcggcctaggatattccttggactcacatattcctagcaataatccttagagttgaaaagttgtatttgttgtacacacatatatatacatacacaaatatatgtatataatatatatgtgtatatatgcatatatctatatgtatatatccatatatatgtaagttctagtgcttgtgtgtgtgtgtgtatctccacgctattgaaactttctacctttctttcttttctttttttttttttttttttgatggagtcttgctctgtcatccaggttggagtgcagtggcatgatctcggctcactgcaacctcctcctcccgggttcaagtgtttctcctgcctcagcctcctgagtagctgggattacaggcgtgtgccaccatgcccggctaagttttttttttttttttgtatttttagtagagaaggggtttcattatgttggccaggatggtcttgatctcctgaccttgtgatccacccgcctcagcctcccaaagtgctgggattacaggcgtgagccaacatgtctggccgaaactttctacctttccttccattctgtttcaccagttctctaaatgataattacagagtggtaacttccccatcaaaacatatatataggccagatgtggtggcttccacctgtaatcccaacactttgggaggccaaggccggtggatattttgagcccaggagtttgaggccagcctgggcaatatggtgaaaccccgtctctacaaaaaaatacaaaattagctggacatggtggcacatgcctctcgtcccagctattcgggaggtggaggtattcctcagagaggatcacctgagcctgtccgttcaaggatgcagtgagccatgatcacgccactgcactccagcctgggtgacacaatgagactctgtcttaaaaaaagaaaaaaagtgggccaggcgcagtggctcacgcttgtaatcccagcactttgggaggctgaggcaggcggatcatgaggtcaggagttcaataccagcctcaccaacatggtgaaacctcgtctctattaaaaatacaaaaattagccgggcgtggtggcgggcgcctgtaatcccagctactcgggaggctgaggtaggagaattgcttgaaactggaaggcggaggttgcagtgagctgagattgtgccactgcactccagcctgggcaacaagagtgaaactccatctcagaaaaaaaaagtgtatacacacaccaacacacacatacatgcacactctagaacctatctcatctatcaccacaaagagtagaatataactattcttccagagaaaataaaacatttagcacacttttatagtttttcttcttccctcttccttctcactttcagatttagttgaaataatgtgaacttttagttccagattactaccaaattgttaatttttttttcttttgtaaacatcctttctgaacaggtattaagcttcatggtcatattacaacgcacttgttagccataccttatactttaattggtttcattgctcatgataagttttcctatagcttttcttctcctttcttgaattatttaaggtgattaattttccatttggcaggaatactccatcaagtaattaaaaaaattattccagagtttactttctgagaccttaagtgtctttacttgtatgtccttcttttgctgtcacatgtgagggaaagttgagctaggtgtaaaattctgaggtcataatcacagtgctttcacctcagaatatataaaccttgcttcataaatttctagtctctggtgttgtagatgagaagtccactaatggtctattttttctctgtgagtaatctgtttttgtttgttaaggatctttatttatttttatttattttactttttagagatggggtctcactctgtcacccaggttggaatgcagtggtgcaatcagagttcactgcagcctcaaactcctgggctcaagcaatcctcccaccttgacctcccaagtagccaggactacaggcacctgccaccgtgcctggctaataaatatagttggatggttttcatttgtttatttgtttgtttagagataagttcttgctctgttgcccaggctggtgtgcagtggtgtgatcatagctcactgtaacctcgaactcctagactcaagaggtctgctagccttagtctctgagtagctaggactataggtgcctgccaccatgcctggctaatttttaaaattttatgtagagatagggtctcactatattgcccaggctggtctaaactcctggcttcaagtgatcctcctgccttagccgcccaaagcactgggattacaggcttgagcccatgcccagcctgctaaagatctttatataattttttcttttttcaataatcttctatcgccattgttgatctgaaaaactcaagtctttcttcagctcttcatctcagggaaattgtattctgctttttaattttttttttttttttgagatagagtattgctcttggaatatagtggcatgatcttggctcattgcaacctttgcctcccaggctcaagcagttctcatgcctcagcctcccaagtagctggaactacaggaatgcgccactacacctggctaatttttgcattttctttttagtagacacaaggttttgccatattggccaggctggtcttgaattcctggcctcaagtgatctgcccgccttggcctcccaaagtgctgggattataggcgtgagccactgtgcctggccatactttttaatatactgatagcccttcatttgtttattttattttttatttttattttttgagacagggtctcactctcacccaggctggagtgcaatggcacgatctcggctcactgcaacctccacctcctgggttcaagtgattttcctgcctcagcctcccgagtagctgggactacaggtgcgcaccaccatgcccagctaatttttgtattattagtagagacggcgtttcaccatattggccaggctggtctcgaactcctgacctcgtgatccacccgcctcagcctcccaaagtgctgggattacaggtgtgagccactgcacccggcccatttgtttatttttaaaatttttactactgttgttatatggatattggaactccaagaacatattttacatcttttaaattttttccccattaattctgttgctttgcttttttccccgagattctcagagagctcctcgaattgtttttctaactcgccagctcatcttttcgccgctgactccattcttctatctgctacccctgtagagttgttgtgggtttttttccccccagcaatctttttttttttaattgccaaaagagcttaatgctctcaggatgctttttcttggcagcctgctcttgttttctcattgtagtgtgttcttaagtctccctgaaaaacacagttggcatttacagaggtgtatgtttcctacacgatccccttttcaatgggtacttgctcagtttggctgctgattctcttcataggtcctgcggtctgtgctatctgctcccatgtaaaagttgacatctagattgttcagtgtttgtagctagcgtgggctggcagcaattgtgtaaagcacaatttataccccacattcaatccctgcagtggaacagggccgctccccacgagccccagatggtgtcagcttgtaagtagtcccacctctgctgtgggggtcagaggtggatttctctccattagggatagaaaaaaaccttttgtctgtacccattttagatgtccagctaggtccctgtaaattagactaacaagatatagattaacacgagaaaagcaggctgggtgctgcggctcacacctgtaggcccagcgctttgggaggctgaggtgggtggatcacctgaggtcaggagttcgagaccagcctggccaacatggtgaaaccccatctctaccaaaaatataaaaattcgccaggcatggtgtcacacacctgtaatcccagctactcaggaggctgaggcaggagaattgcatgaaccctggaggtggaggctgcagtgagctgagatcacaccactgcactccagcctgggcgacagagcgagactccgtctcaaaaaaaaaaaaaaaaaaaagaaagaaaaacaggagctttttagcatgtgcatctagcatgggtatcacatctagcatgggaattgtgcatatacctgggagtatccagagatgagtaactcaaagcgttggttagaacttcagcttacatagcatcttaatgaaagagaaagaaatgtttagagaagtggcagggtaaaagaaaggggttttaggcttgcaaaggtggcaaactgttggaagttgtgtttctgttttgcattgctagaaggaatacctgaggctgggtaatttgtaaagaaaagaggtttatttggctcatgttctgcatgctgtacaatcatggcaccagaaacctgcttggcctcaggtgaggctgcaggtaggttttactcatggcggaaggtgaagggggaacaggcgtgtcgcatggcaagaggggagcaagagagagagaaggaggaagcaagagaaggagatgccaggcgcctttaaataaccagctctcccttgaactaccaaagagaggatttactctttaccacgggatggccccaagccattcataaggcatccaccctcatgacccaaacacctcccactagaccccaccttcaacattggaggtcacacttcaacatgagatttggtaaatatatgggaactctaatggagtaaggtttgtttgtgcgggcctacttggtgccagctttccatcttcgtggctgtaaaacttccctgagagaggagatttatggtagttcttgtttctcagaagtttctgttttttgtcataagagcaaagagcgtaagagtcaaaagagtttctgtttttagtcatgagagaagctcttagaaggctcctttctgcgtctgttggttttcatttgcctgcagctcaaaacaatcatatgccaaagtggcatattttggagtggcatatttttatcccttatgtcaggtacaatgggcagggaaggttcagccagcaagagggcaggattcctgttccttgagcacggtgcatggccttaacaaacctgaaaaatcatgtgctcccactcccatttcacattgtttcacaatttaccagtggttactggacaaactcaacttattttttctgcacaaaacttcaatgccataaataagagctcacaactttcctctggtcacaagtcagttagcagccacctcgctctttgaccctgggctgatttagagctcacactggggagcagccccagaggtggctttaaacctgggactcggggtgtctgccctggggtggctgccctggggtggctgccctggggccattggtatttgctccacatgcctgtggagtccattttttcatgttcatgtcacacctactgtgttgcatgttctttactagggggtggggtagaaatatgaatggacatagcccctccttgagatcacagcctggtaaacagatcagccattaacaattgaggcggcagggttccgtgcagaaggctgcatgactttgctgtctattgtgactgcgttttgatagttacctttgtcacactgtcttctgtattatgtttgccctcagcaacatgtcgtatctggcacagggctgacatcctgtttgtgctcagtcatttgtggaaggaagaagtcaggcaggcacaaaggtggctgagctcagaaaaggccacttaccctgctgggatcagctggggaaggtggcttccaagaggccatcacacttagtgtgatgtataaggaaatagaaaggccacagacaggagggactgcacgtgcaaggaaggggcactagtgagtttgcagcatctcaggaactgcaatagaaggttgatgtgagggcaggcactagaagggtgagttggggtcagatgtggcaggcttggaaggagtcaggactctatgctacaatttccagaacactcagtgttctcagctttctcctttgtcatgccttcataccacctaatcttctcaccagtgactatcctctggaagacaatgggaatgggaccctgtggagggctctgttgaaaacccattgatggggccgggcgtggtggctcacgcctgtaatcccagcactttgggaggctgaggtgggcagatcacgaggtcaggagattgagaccatcctggctaacatggtgaaaccccgtctctactaaaaatacaaaaaaattagccgggcgtggtggcgggtgcctgtagtcccagctacttaggaggctgaggcgggagaatggcgtgaacccaggaggcggagcttgcagtgagccaagattgcgccgatgcactccagcctgggtgacagagcgagactgtgtctcaaaaaaaaaaaaaaaaaggaaaacccattgatgggcattgaggagtggtgggatgatcagagcctctctctgcactctggtactttgacaagagtgggcaagtttgggaacagggatatcagtatttctttggctgcatacttatttatatttcaccccattccacggagaatttgaggggatttatcaccagatgtgggatacttatccaatagaaactgaagcaaagaatctggacaagggaaagggagcctcatgagtacactaggtcttaggtccaggtgggggtgaggcctgcaagaatgcagagatggaggggtgtggagacggctgtggtcccacactgccagcacttgcctgaccagacattctcaggagtgcttccacccaagcatggtgtgggtctagggctgcaggtggagctaagtcctgtctgcgtctgggtgtcagatcctaaaatttgctggatggagttggggaattaatccagctgaaagagcttgaattatcattgaatggaggaaacaaaaggcctattaatcaagtttaagaggtgtgattgaaggattggcacctatccctgcttggtgctctcttggtgccctctgtgaagttagcagtaaattgcattttattggggattgatattattgggattgcttcctggcctgcaaggagcattacatgggcagaagaaaggctgctgccaggagttgggcaacatgatgaaagatgtggacaataaatgacccatttcctagtttttctatgaacttatcttgaaggtagatttatagaataatatgtggataaaaggggttttcctcctggtctcctttgatgttttggagaaagaagcaaggactttatttatttatttgtttatttttgagacagtgtcttgatctgacacccaggctggagtgcagtggcacagtcatggcttgcggcagcctcaacctcccaggttcaagtgatcctcctaccttagccttcctagtttgtagagacgagttttcaccatgttgcccaggttggtctcgaactcctgggctccacccacctcggcttctcaaagtgctgtgattacaggcttgagccaccacgcccagccagaagcagggaatttaaagcagcgcaagccaagatcaggattagggctggtgctccggtctcacttctcctgaaggccaatcgcctctactttctgcagctatgggagtgggctttgctattcagggatggaggcctgggacattttagaacaatttgggttttttagttttgtttttttgagacagggacttgctctgtcacccaggctggagtgcagtgtgcgattatagcttactgaagccttgacctcccaggcccaagttatcctcccacctcagacccccaagtataatagctgggactacagacatgcaccaccatgcccagctaattttttttttttttttttttttttttttgtagagatgggctttcattatgttccctaggctggtctcaaactactgagctcaggcaatccacctgcctgggcctcccgaagtgctgggattacaggcgtgaaccactgtgcccagcctttagaacaatttttaacaagacttgaaattaacaagcttttggcatagtggtgcacgcctgtagtcccagctactagggagactgaggtgggaggatcacttgagcctcagaggttgaggctgcagtaagccataatcatgccattgcactccagcctgggcaacagagcgaggccttgtctctaaaaaaaaaaaaaaaaaaagaaattaacaagcttttctcattgattgctaactgataaaattaaaaactattaatagaaccaccgccagccagccagacagccattgagcaatcacttattgagcatttatttcatgactggtgttatgatagctattgccagatgaaaaagaatgcctgccttcgaagcttgaatttgtggagagtttcagcctatggataagttgcatgtgtgtgcagacttgtactctatggcaagaacccagaggtcccagaagatacgttcagatcaagtgctgtggcagttttcagaagggaaaacttgtatttatgtgggagggtcagggaaaccctgatattttagcatttgggctacaccttgaagggtttatttgtctctataagttgcatctaaaacaaactgtataaattagtgagtttttttagttagtagcttaagcaaaagctggattgatggctgatgtaagtgcataggggtcaagctggcctctgacctgaccaattagatattcagattgtgtcaccaggaggtactttctctgtatttcttgtgacctggctttcttccaagactggtccattcacagaagggtttactcctcatgggtgccagatgattgcaacagctccagaggttacaccctcagccccaaattcaaggggaaaagagtgtgaatctctcccagcattccaagctaaatctcagtgtgtctttgattgggtcaggttcctctccctgcaagggtggctcaggctaggggggttctcagattagcgtaagcctgagtcatatgctcccccaaagctcatggactgagaacaggaatgtgtggctacctaaaggcaaagtccagtttcatattggtacaagaagaaagaagaatgtgcctttaatacatcttagaaaaaatgtccaatagccaccgtaaatgaaagcaaagaagaaaaaaacactccaggtatatggaaggcagtggaacagaaactgaagtgcaggggacaggtttgaagccagcctcaagtgaaacaccctgaccccttggtgcctgggtaaactcttttcaatagaaagccatccttttccaaccaggttagggaatgggctgttcaggctgcatgcaacctttcctgttgacaaagtggagaactatcctgccatttgagatgtttttcctgtgctattctcctaactcccacaccctcctgtaagattatcaggaagagagaactgttccctttgtacaaacaaggcgagaggccagagagttaacaggagcttcccaaaagggagagcttgccagagccggggccagaacaggatgcagggtttcctgattgcagaatgggtgcccctttcctactcctgctggactctacattcaggcagcccacagctaatgactgcactgagttgcaaaaagaattctaaaagttgtttcttaagaatttagagtgtatcttaagtaagcatgcaatttaagcaatgttgaacttaattttcccttttacagaagataaagaaactaaagtgaaattagacttgctgaacttcaaagaaataattcttcatcttaaaatattttcctaaaaggtccctctaagattaagagaaaaaaaccccaagacattaagaggttggagccattttgttttttgaaacagagtctcgctctgttgcccaggctggagtgcagtggcgcaatcttggctcactgcaacctccgcctcccgggttcaagcaattctcctgcctcagcatcccgagtagctgggattacaagtgcctgccaccactcctggctaatttttgtgtttttagtagagacagggtttcaccatcttggccaggctggtcttgaactcctgacctcgtgatccacccaccttggcctcccaaagtgctgggattacaggcgtgagccaccgtgcctggccatttttttgtatttttagtagagatggggtttcgccatgttggccaggctggtctcgaactcctgatttcaggtaatccacccacctgggcctcccaaagtgcttggattacaggcagaagccaccatgcccagccccatatcgtttgtttttaatgaaatgcttctattttacatggtagtaactgagtctctgcaatgaaagatcaagatggttggcttccatccttctagttttggttccatgtcaataggactgtaaggttcaccactggtctttttactttaacatcacttttcccaagttttgtattttgattgagctcttaattggatagatattatcaaaaagcaattttttttttccaagaaggacttttttgttctgaattccttgagtctcttggtgttgagaatgtctttgggttactctgatacttgaataatatctcggctgggtataatattcttaggtcacaatcactttcacaattttgtagacactgctgcattatcttccagcatcaaatgttcattaggacagctctggggtcaaactgacttgctttttctgtctttatgcctaaagatattttttattcttgaaatttattaatttaaccaagctgtcttggtgtttaacattttgtatcaaattattctggaacctagcatgctccttcaatctaaaaattatctttatttcaattgcttaaattacttctcctccatcttccttttcttccttctcattttcttctttttcttgctctattactaataatatcacaatttgtaatttattaactttaggtgtgttcagtttagtaatataacagtactactaccatttagggtgggggaacttatttacttaatgacttaatgaatgagtaacaaagattagaaccaccatatacattcacttgatacatatttttataaaagtgcttgagaatatcagaattatttatgtcacacaaggagttactgcctgttttctgtgtcaccagattctattaacatttaatgattacctttactctttgaattttgaattttgtaacaaattcctgctgtggcatattttgcaatttggttatgttctgccaaagctgtaacagtaggtgaggtgtttcaaatttggcatgactgaatagaagagctgcccgttctcaccatatgttactcaactcatatattgctatgttatttttaccttactcatcaaattatcttttctcttatacatggctttaattaattgattattttaggtatttccatctctggacatttcatgtactgaaaatagatcagatttaaataaaatagctttataatcagtatttatgtgataaactctgtcttatttcttgcaacatttaccggcatgtaaatccaaattgaatattggttaatgttcagcaatattcaatactatataattgtagtgtattgttatgaaagtcaatgaatttccccccatgatgtactttgttccaaaatttgaatctcctttaataacatataacacataagttgcttaaaaaatttctcactgctgacactatttggattgtacttatgacaggcatactggccatcacctcagcatatgaggataaccatattttagaaataccatgctggtggcactggggagagctgattggagctggagagaccagaggcagggaggcctcttaggacatcgtgctcaaggagataagcaataattgaggcaagaacagaggcagtagcagtgggaactgctgggacaggtttaggagccagcattctgccttaatcatctttacacccttgccgcatgcctagacctagttggtacttagtaattttgggggggtttttttgagatagagtctcgctctgcctcccaggcagtagcgcagtggcgtgatctcagctcactgcaacctctgcctcctgggttcaagtgattctcttaccctcagcctcccaagtagctgggattacaggtgcccgccaccacactcagctaatttttgtatttttattagagacgggaggccgaggcgggtggatcacaaggtcaggagttcgagacgagcctgaccaatatggtgaaaacctgtctctactaaaaatacaaaaattagctgggcgtggtggcgggtgcctatagtcccagctactcagtaggctgaggcaggagaatcacttgaacctggaaggcagaggttgcagtgagccgagatcatgccactgcactctagcctgggtggcagagcgagactctttctcaaaaaaaagaaaaaaaagaaatcattgaagccatagaggacagggaggcatccaggagtggccattgaatggtggtgccattccccaccataaagatggcaggagaaacagggaacccacgtggcagtgtacccactgcctgttgaatgagtgacatgatccaggggaacactgcccactatggatacaccagccatatgccttgggagcaggtacctgtgtagaaaagagtggagaagaaaaagcacaaactttctcctccccattcctgggtgtggcaccagcatcagacaggagttcaaacagtgcttcctttcaccgctttccttgctgcttttctattctggtatcttcttctccaagacctcaggctttcccctctccaacactaccttctcagccaataaatcactggaggggaggtccataggaataatgcattcactctcttcaaatatcccaggctctagaattacccatctcctctcctggtttcagaaatcttgttttttcaatggtgagatagcaggaaactgatctggtaaaatgcattcatactactgtataaatgattgatggatccttttaactgtagttacttgaatttccaaaagagctctcttttaccactctaccaaagtgaaagtgccaagttgctgcatggaaatgggacaggtagaggagagtttttggtcaccattcaggcaagccaggtggtaccagctctccttcactggtcctatttcataacatttttgcttcttgcattttagagctaccagtttcctagaacagcagaagtagcatgctcccctggcccaaccaacaggtgcggctatagtggcctatctgtactggggaggggacaccccaaatctgacattgacaggttcacccaacagcagggatgtcctgtgccatgtgtaataccccctcttctttcatagctccagaatgtccaatgactacatagcactgtgctgagtccttcacatacaccagcctgtctttgtgcttgtaacagtctataagggaagcattattactcccattctacaggtggggaaattaagactcagagagaaaaggtaatttgctcaaggccttgtagctagaaatttggaagagctaacacataccactcttggcatagcagtttagacatggacagctttaggatggggagactgagaacccaggaaacacgttgaggcttctattaaaatacactactcggccaggcgagatggctcatgcctgtaatcccagcaatttgggaggccgaggtgggcagatcacgaggtcaagagattgagaccatcctggccaacatggtgaaaccctgtgtctactaaaaatacaaaaattagctgagtgtggtggtgcacgcctatagtcccagctactcaggaggctgaggcaggagaatcacttgaacccaggaggcagaggttgcaatgagccgagattgccccactttactccagcctggtaacagagcgagactccatctcaaaataaataaataaataaaaataaataaataaaataaaatacactactcaggaggctgaggtgagaagatcacatgagcccaagaattcaagtccagcctgggcaacatagcaagaccctgtctctgaaaaaaaaattaacagtgtggctatttcactgaataatcataaagggataaatgaaacaatacatcccagagacgagaaagagctttgttgtaatacctagatgggatgttctttgagtgttccccattgcttcctatttaaagtccaaactcctttacttagaattgattatagaaagtttaggaaaatctaaataggtgaaaaggagggatgagagaaagaggaaactactatcactctagaccttttcctttcctttttgctatctctgtgatcatctaaaacaaaatgaacaacatttagtgttgtataacttgcttttcttataaatagtcatgaagatctttcaaaaaaatatacagttttgaattttttaggcagtggcatcttttttttttttttttttttttgagatggagtctcgctctgtcgcccaggctggagtgcagtggtgcgatcttggctcactgcaagctccgcctcccgggttcatgccattctcctgcctcagcctcctgagtagctgggactacaggcacatgccaccatgcccggccaattttttgtattttttagtagagatggggtttcaccatgttagccaggatggtctcgatctcctgacctcgtgatccacccacctcggcctcccaaagtgctgggattacaggcatgagccgccgcgcccggccgggcagtggcatctattgattgtatggtttcttttatttcttcagtaattatagtgtctttactatggtgagagtaaatagtccactgtgttttctccttcgagatgtaattttacacatttaactttgtgattcattggaagcatatatgggtatgaaacaagaagcaaggctctaacttcattcctgccccctaccctcctccctagccaatttctctgattccaattgttgaaaacccctttaatgtccatcagtttgggctgctggctgggcgcagtggctcacgcctgtgatcccagcactttgggaggcaggggctggcggatcacctgaggtcaggagatcgagaccagcctggccggcatggtgaaaccctgtctctactgaaaatacaaaagaattagccaggtgtggtggcgtacacctgtagttccggctgcttgggaggctgaggcaggagaatcgcttgaacccaggaggtggaggttgcaatgagttgagatcacgccactgcactccagcttgggtgacacagtgagactctctcaaaaagaaaaaagagaaaaagatgggttgctttctttgttatataaaatattacatttctatagatgccagggactacatcaggcctatctggtctgttctactgatccttctcttgactcttgaactagtaccatattctcttaataatggcatttctataatgtgttatcccttccttacactgattcctcaaacatttcttagcagctggtcatagtggcttaggcctgaaatcgcagcacttttggggccaaggtggaaggatgacttgagcccaggagtttgagaccagcctgggcaaaatgttgagactctgtctctataaaattaaaaatttttttcttagctattttatctgtttgttccttcatatgaaatttagaaacctagccaggcgtggtggctcacgcctgtaatcccagcacttctgggaggctgaggcgggtggatcacctgagatcaggagttcgagaccagcctggccaacatggtgaaaccccagctctactaaaaatacaaaaaaaattagccaggcatggtggctcacacctgtagtcccagctacttgggaggctgaggcacaagaatcacttgaaccagggaggcagagattgcagtgagccaagattgtgccactgcactccagcctgggcaacagagtgagactcagtctcaaaaaaaaaaaaaaagaaaagaaaaagaaagaaaagaaatttagaatactttggttaagtttcaaaaataatttaaattgccttaaacctgtttattaactcaaggagaattaataatcttataatatttagtcttatctcttagtaggtttttgtcattttctaggtattttgtaccttcttttttttaatttaaaaaaagttttttagagatggagttcttgctgagttgcccaggctggcctggaactcctgggtgtaggcaatcctctcaccacagcctccctagtagctgggactataggcacacaatcatggctttgtagaattttttaaatagctgctgtgaatgggaagatggatttttttcccatatttcttctcatttgctttgctaagatagaattatgctatttttctttcttaattattatgtaatctagccactttggtgagcaatttcttattaagttagtggtgtttttgcttattgttttgagtattccagaagcaaatagatgttatttcgcctttctgaagatacggttaagtctgggttcttgtcacggagcccttctgggcagtttcccacttcacctctgcctcctccaaagtgccaagcacgcagcaggtactcagtgagtgtcctctgaatgaaggtaaaggaaccgcttggctaaggtcattcctggccctgggtggcagccctttgattcaggatctgcacctcagtcttaccagagggctgggggcttttagacccaggtgtctgattcaggctagccacctcacagacacttgccgcccatttccatctagagggaaagcaggggccagtcaccctagggagaccccattcaggacaaaagaagcttagaaaaaggacccagcggaggctatggccatccagaacgtcttgctctctatccagccaggctgcctgaggcgtgcccttccaggcttggaaccctgtctccaaggaaggggatccaacatcagacacagcccctctccccaagtgtccaagatccaaagggggaaaataacaactgtttcttattctcttccctttattcctataccctatagaattgcccacatttattagtattctgttttttaatttcaaaaaaaggaatacattcatacattcacaaggctcaaacataatctaaaaaggtatgcagtgaatgtcttactctaccctcattccacccatcccatagccacttttattaatttgcatgtccttttaatatttatttattcaaatacaatcaactatgaagatattcttatttttccccattcttacacaaaaggtagcatctgatacacacatttctgcaccttgatttctaacttaaaatatatatcataataatacaaatagttagcatttattgaacactcattgtatgccagtcatttttcaaacttttatccatatattaactcatttaatccttccagtactcctattattaacctcatttctccatggagaattttccttatcagtatataaagagcttcctcaatggcttacagctacatagtattccgttgtatgggtggatcataatttatgtaactaattgccttgtgagggacacgtgggtggcttctaattctttgctattgtggactgtgctgcagtgaatatattgtatggatatcatcttgttatgtgtagagatagagctgcagagcagatccaaagaaagaggattgctgggttaaatgcatttgtaattctgatgggtattgccaaattgccttctgtagagttattagttcttttcataattgcttagtatttctaattaaacgtagcattgatgagcactatgtatcagtctggctggctagtaggctctctgttggtggttccagaacaagttgatctcagtgtagtcccagatgagaccctttcttctggcctcaggtgggctgacttattccttttttttttttttttttttgagatggagtcttgctctgttggccaggctggagtacagtggtgcaattttggcttactgtaacctccacctcctgggttcaagcagttctcccacctcagcctcccaagtagctgggattacaggcgcacaccaccaagacttattcttatcactgccggtgagagtaaattacagcaatatttctggggaactaacagtattttccctggtaatatttgaagaagcagccttgtaatggttaagaacatggactctaagctggactgcctgggtttttatattttctttcgctgctgtaacaaactaccacaaatttaggggcttaaaacaatgtaaatgtattctgttatggttctggaggtaagaagtctgaaacaggtctcactgaggtatataaaggtgtcagcaggctttgctcctttgggaggctctcagggagaacgttttcttgcctttcccagcttctagaggctgcccacattccttggtgcatggcccctttctgtcttcaaagccggcaacatcacaacattcccacctctgcattcatcacatcacatctcctctcattctcctgcctccctgccctttcctttgaaaggattcacgtgattacgttgaacccacccagataatctagaataatctctttatctcaaagtccttaattgaataacacctgcaaagacccttttgccatagtaaggtgacatattcacaggtctcaggaatttgcacgtggacatctttagaggccactattctgctactacagtttgcatctagactctaccacttactaatcgtgtgatcttgaacaaattattttgcctcttgcaccagttttctcatccttaaaatggggataataatggtatctattccactggattgtcaggaggattgaatgagtaaatatttgccaatgcttataatagtatctgagacacaataaatgctatggaagtatctgctagctaaaatatattaaccaggccaggcacggtggctcacacctgtaatcccagcactttgggaggctggggcgggtggatcacctgaggtcgggagttcaagaccagcctgaccaacatggagaaacctcgtctctactaaaaatacaaaattagccggggtggtggcgcatgcttgtaatcccagctactcgggaggctgaggcaggagaattgcttgaacccgggaggcagaggttgcggtaagctgagatggtgccattgcactccagcctgggcaacaagagcgaaactccatctcaaaaaaaaaataaccaaataaaaatattaaaatacaaacactttgatctagcaggcctatatttataatctatttcataggaacaaaagcttccatgattaggctatataacttggatattactaaagtgttgtccatattggcaccaaaagaaaaaaaaaaggaaaggaaaacgaaagaaagaaaatgcacaaacaggaaattacctgaatgccagcaaaacgacagtgattgaatcaattgtggcccatctgggatataccagagctattaaagagaatacatctgatctgtgcctatgcacctagaggaatgctctgagtgaaagttcgttgagaggaggaagttcaaagtaattatatgacttgatttatttctttcttttttttgagacggagttttgctcttgttgcccaggctggagtgcaatggcaccatctgggctcaccgcagcctccgcctcccgggttcaagcaattctcctgcctcagcctcctgagtagctgggattacaggcatgcggcaacacacccggctaattttgtatttttagtagagacggggtttctccatgttggtcaggcaggtcttgaactcccgacctcaggtgatcctcccgccccggcctcccaaagtgctgggattacaggcgtgagccaccgcgcccggccgatttctttctttctttttttttgaacaaacatcagcccccaaaattattgtagatatctaggtcaatcatttaacatgttctgtttcttcctctgggaaatatgtataacgacaattctcactcaaggggctcttgcaaaggttaagtggcatggctgacatgtgtcaagtctgtaccatcctgcaagcagcagcccagtctggcatttgtgtaaggcggtttcagtggagagatgtgtggaagggtgcaccccacgatgctcacctggtgcttcctcggtggggaagggaaattcagaagtggtggaaagagatgattgtcgtttcgtatatctttgtattgtttcccggatgttgaaattgttactgtagtaactttttatactcatgtgttattggtagtttggatactatcaccataaccacaaacactgaattaggaaaagcagaaacctagaaacatgccatgattcaaagtctggtatttttggaagaggaatttaataacgaacgttttaagaggaaaaagtcaggagagtcctaacccaggccaaccttgtgtgtccacagcatctactgccgaggatgttccaagccgctgtgctgctcgtgcgcgctccttgacagcagccacagtgagctcaagtgcgacatcagcgcagagatccagcagcgacaggaggagctggacgccatgacgcaggcgctgcaggagcaggatagtgcctttggcgcggttcacgcgcagatgcacgcggccgtcggccagctgggccgcgcgcgtgccgagaccgaggagctgatccgcgagcgcgtgcgccaggtggtagctcacgtgcgggctcaggagcgcgagctgctggaggctgtggacgcgcggtaccagcgcgactacgaggagatggccagtcggctgggccgcctggatgctgtgctgcagcgcatccgcacgggcagcgcgctggtgcagaggatgaagtgctacgcctcggaccaggaggtgctggacatgcacggtttcctgcgccaggcgctctgccgcctgcgccaggaggagccccagagcctgcaagctgccgtgcgcaccgatggcttcgacgagttcaaggtgcgcctgcaggacctcagctcttgcatcacccaggggaaaggtaagcacgcacgccaccttcctgggcggcctgtgcctctgctgcaccctagggaaggcgagtcagaagagatcatctccatttgacagaaaagaaaactgggtgtttattcagtctttgggggttggtaaggtcttaggttccagggcacaggataagggggagatgaggccctgacaaagggctgcagccacccagaggggacacattttactaatttacaagactctgtggattgacctagcgatgactcatggggaacacgtgaaagttgaaaaactgcaaagctgagaatcagacccagtatcattttggcgccagagggaccaagcacttcaggaggttctcttaagccaccggtgtctcggaacagagaagtcaattgggacctggggttacggtagaagggggctaagaaaacctcctggggatggttggatgcttacccaaaaccatacagtggctcagtggaggagatcccttgtctgcaggatgacctgctgtctgccaacctttgcgcgccctgcctagtgttggacgcttgagaggtaaggagacacagactagtttctgatctcaaggagccagagccacttcacgtagctggagaatgagacagtgctcagctctgcaatccaaatccgggagatgtagcagctgtgtattagctggaacaggggggctttcaaaataaggggtagggggagtgtgccagagagtctccaggagtctttgactaaatctccaagctggaatgtgagctctgagcagctagtataggatgcccttactgggaaaggggagggaggctatggaatctgaaggcacctgggtagggtgccagtgacaaagagcttatttacttctcctggagctggacatgggtcatgaaggataatcttagagggcctggacctgtgccttctccacctaggtagtgaatgtcacccatattaaggaaatgaccccacagagtttacacagcttgccttgggtgttataactgggcaatagcagagagaagggttattttattctgaagcataagagatttagatttaataaaaaccaggctgcagataaggaagatcatggagctctcactatatgtagagagtcagtgagccggtagtgatggctttatgattgcgcacacttagccttgctgttggctcagagatggagagaggtacacttggggtttggagccaaaagcaagcactctaatgccacctccttttcccttctggctgggttcctgcccactgcattcgagagagctctccttccagctgcccctccagggagttgtccagtgctttgggatgccctggaaaataggtatcctggaaaagcaacagggacctcctctctatcactgtcccaggtcaggatgtcccttaccagcatgtccttgacctgcctgtgaccttctttgtgttctacagatgcagctgtatccaagaaagccagcccagaggctgccagcactcccagggaccctattgacgttgacctggtgagatgggtttgaggtctgaaggggtggtggtggggcccagcaggtcaggcaggttgtgagtcctgctgtccctgtgtgtgcagggagagcgtctgagtgagggacagcaagtggctggactggaaatttcagtgagaggaagtaaaggaagacattaaagaagggttggctggctagctggctctgactctaggctcctaaatgccaaagttgctcttgatgggccatgagccaggttcagtgggggttagatgtggggtagacagtcggccacagatcagggctgctgcagagggaattccagcattagatggcatattagtgccttccagccatgagaaactatggttgtcagatgtatggttagatatagggtcagcagtcctgagggatgtgcagatgtcctctcccctcctacaccctacccccaatgtgggagccttctcttggagtcagaataggtgggccttcccctgctctttccccacagatggttcttggaaaggaacggggaatggtgccaggagtcagatttcgatcccagttgcccgggttctgctggtgtgattccagggccaccatacatgtaacaaagcagactgtctcagggttcaaggtatccatgtcccatctaatgctggcattccttctgcagcacccctgacctgtggctgtccagctttcatgtacacatctccagggacaggaagcttgctcattctagaggcagctgctcccaactctggactgctctgacttagaaagtgcttttccgagtggaaatgcagtggtgtccctttgacttgccccctttggcattcacaagtatggctcctttccaccagaataagcatcctcggtttcttcctggacttggcatctggtctcttccctagcctagtcactcaggtttgcatgcgcctagcctatcaaggatctggcccaggactggccagtccttcatggacagcaggtcttctggtggtgggtaggggcctagcttttgccatggcatgacccataggagagagagagtgctgtaggttgaggcaatcaggagaggcttcctggaagagacaggacttaagagtctcagagttttagagccaggcaagagcatggagtctaaccccctttttttcacagaggacgaagctaagacccagaaaggatgtgacttacccaaggctacacacagcaaattaggggcaagattaaaagctgactctgttttttgtttgtttgtttgtttgttttttagatgaaggctcgctctgttgttcaggctggagtgtagtggcgtgatctcggctcactgcaccctccgcttccggggttcaagccattctcctgcctcagcctcccgagtagctgggactacaggcgcgcaccactacgcctggctaatttttgtattttttagtagagacggggtttcatcatattggccaggctggtcttgaactcctgacctcatgatctgcccgcctcggcctcccaaagtgctgggattacaggcgtgagccactgtgcccagcctaaaagctgactcttaactgccttgggtactgcattcctatatacacaacctcaagtaaaaagaggaattttttaatatatgtgtgcataatacaatcacatagtcagaaataaaaacatagaaagtgatcaatagtgtcttactcccactttagcccccagttcttatgcccatataactatcttttaaaaatttcttttgagacagtcttgctctgtcacccaggctggagtgcagtgacacaatctcggctcactgcaacttctgccccctgggttcaagcgattctcatgcctcagcctcctgagtagctgggattataggcacgcactaccacacccagctaattttttgcatttttaggagagatggggttttgctatgttagccaggatactctcaaactcctggcctcaagtgatctacccacctcagcctcccaaaagtgctgggattacaggcataagccaccgtgccccacctcttttttaaattcttatatatccttccagaatgtatgtaattacaagcaaatattattatagatatttgccttttgcattctgtgtttcacaaaggtaggataataccagatacacatggtatcataccagaattcttatcctatcaataggtagagagcttcccgatacctttttgcagctgcataatggaccattaaatggatatggcaggctttatttagccagttccttgttgctgcatatttaggttgttttgctattacaaacaatgctacaatgcatgatgtttgcaaataaataatataaaataataaggccaggtgtggtggctcacacctgcaaacccaggaccttgggacactgacgtgggcagattgcttgagcccaggaatttgagaccagcctcggcaacatggtgagaccctgtttctacaaaaagtgtaaaaatcagccaggtgtggtggcacatgcctataatcccaggtactcagcaggctaaggtgggaggatcacctgagcccagggagtttgaggttgcagtgagctgtgatcacaccactgcattgtagcgtgagtgacagagtgagaccctgtctcaaaaagcaaataaacaaataaaatcaaaataataatagggaaatgcccttggtccacagactcagctgtcttccagatgctagtcattggtgaatgaacaacaagagagcctgcactgtcttgtgtgaaggtctaggtattttgggtctttgtcttgataaaatcagaatagacgtggcctctcactatcagctaggaagcagtttgaacttggagtatcagagggttgctctttttgccaagcctctggcttcaatccttgcctggggatggcagtgctgctgagggaaggaagtggggaacactgtgagtgcaaggacaggtgaggcaggcacagacggctgtcccaagggaaagtgctccatcagctgtgccaggagagaagcagctcttgggtccgtgtttctgccttagaaggcaggagttgggcatctagctccagcactcatccctcttgaaactgctggtttgtttactttcattgcaactatatgcctggaagagatgaagagaaagctcaacaggcttcactaggattgtttgggtggggtggcagcagctcagatattttccctcctctgtttttcataggctttttgtaatcgtgttataatactttaatggaaaaaaataaatttattattttaaagctataaaaattataaatcagtcattatgatgtgtttttctctactgagccctctggtgtgttccctgttttattaacgtggatggagggtgtgtcagggaggttgggacagaggcagagaagaggccagcccggccttcggggagttcgtggcctgtctggaaagagggtcttttacataccagcagtttgcagagccagacacagaacgatagagcaggaccttttaaactcctttttcaaaaaaaaaaaaaaaatgtttaattttggtaaaatacacataatataaaatacatcatcttaaccatttcaaaatgttcagttcagtgtacactaagtgtacagttctttagcattgagtacattcacactgctgtgcagccattaccaccacccgttccagaaggattttcatcttcccaagctggaactctgttcctgttaaacagtcactccccatgctgcctccctcagccctggtgacccttgtctactttctgtctctatgattttcaatactctaggtacctcctataagtggaatcacacagtatttgtccttttgtgactggccactttcacttagtgcagtgttctcagggttcatccatgtagcatgtgtcagaatttcctttctttttaaagctgaataataatatcccattatgtgtatatgccacattttgttgatccattcgtctgttggacacttggcttgtttccattttttggctattgtgaatctgctactatgaacacgggtgtacagatatctccttgagaccttgctttcaattattttgcatgtttactcagaagtgggatcgctggatcatatggtaattctatttttaattttttttttgaggaatcaccatgctgttttccattttttattgcaccatttgacatttccaccagcaccgtgtaaaagtttcgacttctctacagcctcaccaacatttgttatattgtctctctctctttttttcttaaataatagtcattctaatgtgtgtgaggtgggttaaactcttttttgaccactatcctctattgaaaaaaaatatatattatatcttaacttatagtatatacatatgcacacacatactgtagctaaaggagttttataaaataggctgggtccagtggctcacgcctgtaatcctagcactttgggaggcggaggcaagtggatcacctgaggtcaggagttcaagaccagcctgaccaacatgatgaaacctcgtctcttctaaaaatacaaacattagccgggcgtgatggcaggcacctgtaatcccagctactcaggaggctgaggcaggagaatcacttgaacctgggaggcagaggttgcagtgagccaagattatgccactatactccagccggagcaacaagagcaagactctgcctcaaaaaaaaagaaagaaagaaaaaagttttacagaataaattatgattgttacatgggatgtactctgataatttctattctatactattatttttgacataaaaatgttggtcatgccccactaaattgctttcatggttggatccactaatgggtcacaagctgcagtttgaaaaccactggccttaagagtgactagactttcctagaggcctggcagagacagatcctgggagataatctgttctctctccttcccaagacaggctcacactctctaatccagagaggtcatcctccttctttttaaagatttggagaaaaagaaaggaaggaaggaagggaggagggaaggaggtcaatccatcatggccaatggtgtggagcccatgagaaggacccaccgcggggttctggtacctggcacacccaggagccagcactgtgctggggccatccctgccttaactcacatgcccagcagcctctgtcgggagcctccttgcccagccccagcttgcctgggtggttctcagaaggcccacacaggagggacagagcttgtccctgtgaggaaggtgtatccctgccactcactcattttcaataatcggtccagtggacgcttaaagttcacaaaagagagaaagatggtggggagggacataaaagactcatcaagtaaagaaaatgaagagcacgccggggcaggaagaggcctccatttcaagacactggatttggccaggtgtggtggctcatgcctgtaatcccagcactttgggaggccgaggcgggtggatcacctgaggtcaggagtttgagaccagcctggccaacatggtgaaaccccatctctactaaaaatacaaaaattagctgggcgtggggctgtgcgcctgtaatcctagctacttaggaggctaaggcaggagaatcgcttgaacccagaaagccgaggttgcagtgagccgagatagtgccactgcactccatctcctgggcaacagagcaagactctgtctcaaaacaaacaaacaaacaaacgaacaaaaaacactagattcaagtcaggccaggggtcccgaggtatgtgaccttgggaaatcacttcacctctctctgcctccgtttccttctctgaagattggcaataatcatagtacggtacctactttttttttaactataatttttatggcgataaaattcatataaaattcaccattttaactcttgaagtgtgcaatttagtggtatttattacattcataatattttttaaattttttaattttttttctttgcagctccagctcaaatgattaaatttttttctttttaattttcagagatgaggtcttgctatgttgcctaggtgggaggctcaggtgattctcccacctcagcctcctgtactttcataatcttgcacagccattgccacctatctagccccagaatatttttatgcccccaaaaggaaaccccttacccatgaagcagtcagtcccatttccccctcccccatctcctggcaaccaccaatctgctttctgtgtctatggatttatccattctgggcattgcatgtaaataggatcatacaatgtgtattttgtgtctggtttctttttttaaaaaaatttattattattattagtgtttgagacagagtctcactctgtgccccaggctggagtgcagtgacacaatctcggctcactgcaatgtctgcctcagggctcaagcgattctcatgcctcagcctcccaagtagctgggactacaggtgtgcaccaccacgtctggctggtgtctttcatttaatgtaatacattcaaggctcatccatgttgtacatctcagtcctcattgctttttatggctgaataatattccatcacgtggctataccacattttgtttattcagtcatcagttgatgcacatttagtttgttttaccttttggctattgtgagtagtgctgctctgaacattcacgtgcaagcttttgtttaaccgtctgttttcccttcttttgggtgcacacctggggtagaattgctaggtcatatggtaattctacatttaattttttaagaaactgcctctatttcattttgagataggtacatgaagcacttagcactgtgcctggcacagagtagtaataagaacaatatttatcatcatcaatgacattttctaagtgccaggtattttatattttacttgtattaacacatttcatccacattaccatatgaggtagatgttattattcccactttatagagggggactgaggcctgaggagttttaagcaattcatccaacttgtgtagtagctgacccaggtagagttaaggctgagagggcagaggcaaggtcccagggaggccagtttcagctcaatgggaggattttctcactgttaaaggagctgctttcgccagtagtgagcactttgtccctggaggtgtgtgtctaagtagggctaattactgagcatgtcctgagttgggcagtgtgattcctggggtatcttccagccctgttaggacacacaacaaccaaagtggtccctgggctccagtaactcagagtcagaaggaggtgatgccagtcgcggtggctcgtgcctgtaatcccagcactctgggagactgaaacaggagaattgctcaagcccaggagttcaagaccagcgtgggcaacatagtgagaccctgtctctacaaaaaaatttttttaaaaaaaggaggtgatgtgatggagagtttggaggacttcttgtccccagtgagctcggagctttgagtcagggagcctggacctgtgacttggtgaggccccagggattaggccaaccacaggtctggggtacctggccctggggctgctgcctagtcatttctgactcaattttcccaactttgcagcccgaggaggcagagagagtgaaggcccaggttcaggccctggggctggctgaagcccagcctatggctgtggtacagtcagtgcccggggcacaccccgtgccagtgtacgccttctccatcaaaggcccttcctatggagaggtaaggttctccccagccccagccttccctcctgaaggcctgagttccaccaggaaagtgagctggcactggggtgggaatccaggccttcatcagatcagctctttgtgggaaagtgtttgctcaacgccttctctgtgctctcccctgttcttggctgcatggtcagggagcttcccataagcatggcccactcccagcccagcaggggtgctgagacactcagggttgtcagaggccagcagagactggtggacagcagatagtaccagcttgggaaggcttcctgtctgaagagagacgtaatctgcgtggttgagagcagaggagaggggacagcaggagcaaaagggtggccacaagtccctggcagtcagggcaggctctgcccactcacccctgcaggcacctgacctggctctgtgactccctctatgcaggatgtctccaatacaacgacagcccagaagaggaagtgcagccagacccagtgccccaggaaggtcatcaagatggagtctgaggaggggaaggaggcaaggttggctcggagctccccggagcagcccaggcccagcacctccaaggcagtctcaccaccccacctggatggaccgcctagccccaggagccccgtcataggaagtgaggtcttcctgcccaacagcaaccacgtggccagtggcgccggggaggcaggtagggaggtgggtagggcagtggcctgggtgctgcccgccagggtctgggcggtgcccctcttctgtattttggccccatccagaaagcccaaagccaacaggagtcccttattcccactgaataagatagggaaagttcacagtgtgcgtgggggtgagagtggacacagtttaccatgtgttttgccatgattgaggtgtggggagcctgacaggctaaaatgcacagttctatgagtcctttctcccaaacactactgtgcctttgcacagggcaggtctccacaagaagtttgttggctgatgcctagcatactcccagagagggcttgggcataccataacaggaaactggactccccatgaccttaactctgctctctcagtctacacccatcatttccccaagtgtttctgcaaaggccacctacctaagtatctcatttgtcagagttatcttctatgaacactgccaggcaggtagtcagttgggcaggagttgaggtcaacccagaggaatctggaacaagagagttctaaggatctgcttcacccagagtacagctttgttcctcattctgactgagccctagccttggtcacacactgagcactgactgatattccttacccacaaatgctattggtaatcgatgggttttgattaactaaatgaagcgtcttttaactctagacatcccagctcatggagctgagaatggggacagtgtgcttctttaggattgcagaaggttccagaccaggtagcagttgtcaggcctcctgtacagggggcaaattctgaattctgggcagataacttaattgaatattcatagataaggcacagcaagaaattatggaaacccatttgtgaattactcaaatccaaatgcaaagcagagtcacattggcacacacagtggctgttcccgtccccctgcagggcatccgtttcccccagccgactggcctgcaaggattcccataggtgcacacccacacccctcccagcatgcatcctaggcagttcataatgcatctccccttccccgtttcagaggaacgcgttgtggtgatcagcagctcggaagactcagatgccgaaaactcggtgagtggcccagaagttcagcccaggactcctgcctccccccatttcaggtcccagggggcacagccacagcaggtgactctcagacttgccttgcgcctggggaattttccagtgaggcattgagtcccaagctgtgctgaggacagtctccaaatgacagctgcatgcctggaccaccccagccctcccactacaccagggccaggagctcttctgaaatgctgatagcatgtgtccagagccctgtctcttttctggaatgtccaagacctttgtctggagcttccttatgcattttctgtcctctaagtcctcagtgaggagggctggacaagaatccattccttggtttattacagccagtgggggccagtgaaggggtgtcaggccacagggcagctatataggggccaaacaagtgaggtttgactccatccatgtagaaagatatataaatccattccacagtgaaacaggtggcctcgtgggtagtgacccttctgtccctagaggtttattactagaggctggactatcacctgtccaggggaaaaggggatctgaatagagtgaaaggttggactgggtggcccctgaggtctcttccagccctcagtctgaggttctgtattggaaagtgcatggagcccatggagaccgccgagccacagtcctcgccagcccactcctcgccagcccactcctcgccagcccactcctcgccagtccagtctctgctgagagcacaaggagcctccagcctgccctgtggcacataccaccccccagcttggcctccccaccagcccgctgagcaggctgccacccccgatgctgagcctcacagcgagcctcctgatcaccaggagcgccctgccgtccaccgtgggatccgctacctgttgtacagagcacagagagccatccgccttcgccatgccctccgcttgcaccctcaattgcatcgggcccctattcggacttggtctccccatgtggtccaagccagcactcctgccatcacagggcccctcaaccatcctgccaatgcccaggaacatcctgcccagctgcaaaggggcatcagcccaccccaccggatacgaggggctgtgcgatcccgcagccgctccctccggggctcctcccatttatcccagtggctcaacaacttttttgccctccccttctcctccatggcttcccagcttgacatgtcttccgtggtgggggcaggggaaagcagagcccagactcttggagcaggtgttccccctggggactctgtcagaggctccatggaggcctctcaagtccaagtgcctctggaagcctctccaattacattcccaccaccctgtgccccagaaaggccccccatcagcccagtcccaggcgcccgtcaagcaggcctctgagagtgctacccttctcttgtaaccttgcagccaacacccctgcccggcccctgagctgcctcctccagcccatgctcttacaggccctgcacagagtagcactcattaattcttggttaaggaatgaatcaacgaatgaatggctatgcatggacctctgggcagggagacctgggtcttctctggctgagaggggaaggctaaggcatggctgagattcaagccaccattccaggcctctttgcccaagaaagaaacttctgtcacccttgcactctcctgtattctgagtccctggccaatagcacagccttccatgccccgacccccaccccaagcctctccactaggcctctgccaggatctaagcccatgagcacagggactggctatcccaagacctggcagatgtggctgctcaataaacacttgttgaaccatcacccttgcgaacccttattccacgaccatcgcgttctccgatggatccagctcctccctgcaggctgttctctcttccctatgctggaactcagttctcctctggggataccatgtcccctcttcctcccacactcatgggcatcagaggtgggaggtagggtcaaggccccctgcttcctggactgttccagccccttcctggccgtctggtaagatcctctgtccctctcagggtgggccccatgctccccagctcatcccagacacccacctgcccaccctcattgagggcagacgtgagcattcacctcccagatttcttctccctgctcaggtcctgccttcctcctgagtgacttctatttccacccacctgcccgccactccttaacctctcaggggttgtcaccccattcccccagacagctgcctgccccgtggccgtgccctgcaccttgccatcaccgagcactgtcggtccctcagccggtcctctcagactctgaccgcagcctcctgttccttgagctctcagtcctaccttcgcctccctccagccccgcgcactccccatttcatcccatctttcatcagaattgcagctccctgcccagcagaaaatcctggaaggactcaggagcttgtcgcctctgtgctgccacctggagaccgagatctgcaggagaaaggcctgggaaaactatgagtggttgcctgtgactgctaagggctccttggtgctccgcccagcatgtccttttgctctgcagggcagcccccgcctgcctttcttcactgggcccttgtcccagcctcaccctcagctgatggcggcaccttctgctccagggagaaaacaggagctctccaatggcatagggacagttgacatcttgctatttacagatccccatcgcaccccttccctgccctcgttagggtggaagggatgtccacctgcctccaggactcaccctgtgtcctggccccagcccttgaccccctgggagcctcactcctcctcctcatctctcttgcatcttctaatgtatccactgccttctgaactaaacaccctgaatgaggtctttctcatctcagaaaactccacccacttctctctccagctgtcggctccccttcctctgctctccttgtttacacttcagccccctccttgccccttcttcaccccacctcctgcgcttccccgccagtaccagggtggcctctgtgcctctaggtgcagtgtcgcgtttagtcgttattattcttgaccggcgctgggcccggtctttcctggaaagatcgcctgctcggatgcagctctgggcactcctccctctcctctgcaggctctgttttttcttggttgtggtgctcctgcaggtttgctgctgggccctttcctcttttcagtctgtgtattctcccaggtgctctcagccacgcccctgacttcagttactgcccaggggtagctgatacccaacactcgcacctgcctgccagaccagcatggccagtgaccttccaacagctccgcatggatgcccataggtacctcaaactcagcaccttctcctcccgtctcactggctcgccccactctctgcccggttgcacaagccaagaccccatagccacccagggcaccccccttttgattattcctcacatccaaccagttattgagtcttgtctttctagggtgtaaattcctctgaaatctgggcacttctttccatcccataatcttggtaaaattaaagctaccactgaccctgggtagaggcagaagcctgggaaggaaaggtggagaacaggtttggagtgccaacagtgtccccagatgtcatggagaatcaagtagagggaccccagcaatattgggggtggggcggggagtatgtaatgctcagctatcagcaaggagtcattaggggctatacagtgaattaagggagggggtaaaagcacatttcaggtgatgatgaattaaatacctaggagctcacattagagagcaggcctagagacgtggggagagagccagaggaccgctgcttttgtgtatgtagctttaagacacaggttttaaaaattgttataggagtcccaaactttagaaaatatatattttaaaaccccaacaaattaggtcccccctatgcatttctcacccaacttctgggccctttccagacccctggtgcccccagagtacacccagcaccaccactgcaaattcctactccccagcttggagggggtggggtgatattcccaaggtgatcccggctcccacctaacccatcctccccagctctgcagcttatatccagctttgcagtgaggaaagttgcagaatactggtctgctacattactactttccaagtgtatcagggcatttaggaacccctcccttgagcttcacctgtgtcctagggattcagtgagagactgtttgtgcaagaaggagcgagaggcagcagggcatagtcatggggtggagcagtgagtcccccaggcctggttgtggagtacctggggtgaggactttgcttaaaaactgccagagtgggtcagcagtgcgcctgccctggggcccctgctttaggatccaaagtggaaaagataggtgttttcacccactcttgtgacagattactggctccggtgccttggtggcagcagcaacaggagggggccaaggtgagggggcagcctgtggcagaagtggcagtggtgacggcggaggaagggaggcctgtggggaatggctgatccaggggaggggccgtggcactggtgagtgtgcatctgagaaaatgaaacggaggtgctggccaagaggctggagctaggcagaagggcagcagaggccacaggctggccgagtttatggtccagttcactcataacatgtgcagtattcctggggtctttgaggctttgcaagagctggggttttgtgtctgcagaaagatagcaatgcatgtgtcttgccaaactgatcccagctgtagctgatgcttaagtgctcagaaagttcttcaggagcttgagggctcttgataagcatgaatgtcagatgttctgtatcttccagaggctggatgctgactatcagagtttggcttgtgtttggctgatgagcaaacctggaatgaatcagtgataaggacaattgttctcaagctggctgtacactggggagttttcccaactacagattcctaggtcctacgccctgagattctaatcgaatcagtcttgggtgcagcctgggcctcagttttttcttaaagctatgaatgcctaaccaaagtcaagaaccactgaatcgggggattcattgcatgtctgtggtagaggaatgctgctcatttgtttatagatgtggcagtcttgaatgcaggtgacattttcataccagggtgtaataccgcagaggaggggagaggctggatcttccctgatgtacctcctggacttttggagtgtgattacaatgccaatccagccacttcctctgagcatgcttgggacgactgttagacctgctgtgttgagttagaatgcacttgacctgctcaggccgtgaaatctatgaggaaggggagtgagatggatgtagctcatgagccagattgcaggtgtatccaagttgcatgtatatcctgaaaaaatcctggctctcacgaggctcagcctgaacacagttttgcattcaaagaaacaatgtccattaaccaagtataataaagaaataaatcccagtatttacttgcatcttttgaaagaacattaaagggaatccagctcataaccccagcagcacttcttcagtccttcttccccttttctttggcgcctggcatctctcactgcatagcaaagctttcccccttgattcccggtcctcacacgcaggctcaaggctctgtttcccatcttctttcttctgtcccccttccttttctcttccaagcaaatctaagtcttttccagtgactgtccctctctatgctcccccgacacccagttatcctaatttgcggaataaggccaaggtgtggggcctgggggcagaatgggagagtctcccctagtgagcagggaggggagtatgttctgcaccaggccactatgtctgatggccctgctggcaaacctgagtctttcagaaagtcttgtttaaatgcgtcagcactccccagctgtgatgctggagtttaaggcggagcaggggagaattctgggtttacagctggctggagttccagtgagaccagctccatgggtggccatactttatggaagtccccaagggcaagaggaattttggaggaagtgagtcagggctgaaaggtccagcctctcctccattaacaagcttggtggaaagggggtgtccttttattaaaggagacagtagaggtttcttagagaaggcagctcgagtaagtttaggacaaaggacatttccctggccccgggacaatggaaggctctaaaaacgaggttctagtggctgccataaatgaccctgctgtaacgatgggaggggtggcctaaagagacagtactgtggctctccagggagctctcctcttggaagagcagatctgaaggcgggaagactggttctaaggccgaggacattgccccgagctttgtggaggcactcaggaacacaaaggggcatttccagttgggtttggagcaggaagaagaacgaaaaagagaaagtcctgtgtgccatgtcagtgggtggcagcatggactcagcctcagctattggcaccaaggatctgaaccagggaggacccagaaggggagcccagcccctccaccagcttgtgggagagcgctgctgcccagtgaagcctggagagaggaaacaactggattctcccaaagcgggagaaggtggagtctccagccacccagctacaagctaggaagacgccttgtagaaggctccttacagggaggaaaccgagttggaaaggcgagacagcagtgtgggctcacccggagcaagacgtgtgaaatcagcttttgacagcgtggctgaatgaggatctggagatgcgaggcgctgggcagactctctgactagatccctggatatgaagaggcaaagccagctctagatggattcatagtgagtgtctgcttctgacaataactggcagaaagctgatgagcctggagcagggctgtgaaatgcaaatccagtgaaatccagccactcctacaaaaacccaccacatcttaggttacttgtgggtggaaacgctttttctctcagttgaagcttggttggaagcagatgtttcacttgggcattggaagggtctggggaaatgtgctgcctcctaggccagggacattagccagaggccagaattaactgaggctttagcaccaggtgacaccaacttcattgagaagccagcggcagtccataaagaggaaaaacccaaggcctgccctggactctgtcccagccatgctcccaattggccctgtgatcctgtccatgtctcttccttgctggtctctggctaacgtccacaggtggcattcatgggaggttccaagttggtcatcaaagactaaacatctgggcttggcagctgagcagatgataagcaattaactctgtattaccatcagaggctccacctccctctgtagtcccagtcccttgggaaaatctcagagctggagcccttccctcatcctctggctccccaccccatggcttctcgaacagtgttcccaccaggaccttgggacaggagagaacgcctcacctgaaggactcccaaaactcaggtttctctaagctgctggggcagatgccaagagcctccactgctctctcactgccaaggacctgggtgtccacctagatgtggccttcaggaggccaagcagtccttcccctcgcctttgtgtaggacactggcacctcggctgacttcggggacaagaaaaggcaggctcccgaccccttccaaagaatcatctggggttcaagatgaggcttctttctcccgtcccaagttttggtgtttcttctgagtctgctcagaaagatgaaattaggagcagacatctcaggtcctgcctgccatagcagatggctccttccctgagcctccataagcagcacagcacactcatgcacacacccactggcattttctctcacactttcatacacttgtgtcaacgcaggttcacagctcacacttaactgtgcatgcacacacagatttagcacttggattcattcccacacatgcacgttcacaacctgtgtgtgtcacccttcctcccctactcatgagggtgtatgccctggttcatacatgtaaccctcacatgtgacacacccagttcacacccattcatgcacacataccttctcttgtgcacacgtcccctttcccagtggtacaccctccttcatgtgcacgcagatgctcccagctataccagcttgctagtgttctgcacaggtgcttgccttggccctctgaatccctgacgcttggtttttctgtgttgcagtcctcccgagagctggatgacagcagcagtgagtccagtgacctccagctggaaggccccagcaccctcagggtcctggacgagaaccttgctgacccccaagcagaagacagacctctggttttctttgacctcaagattgacaatgaaagtgggttctcctggggctacccccacccctttctaatttagtctctgagtcccaaaaagaagtgcaggcagagccatctgccaggcccaggagagctctgagctctggccaacaactgcagccaggctgggcagagcactccggctcacctgggctcctggcgtgtcatttgctggcttgaataaagatgtccgccttatccagtgcctgagtgtgcgagagaggcagatgcctcca

SEQ ID NO: 956 - DNA, 15589 bp, Homo sapiens
gcaacccatctccgaaaaggattaagcatcactagggctccaagtgagttctgatcagaggctgttcggaagacagcaggggccatgaccaccctctctcctgaaaacagcctctctgccagacagtcagcctccttcatcctggtgcgtgttctttgtcagctctgagtgcctccctccccagcctctggttggcactgggaccattttcccctgctgggtaggaaaagctagaaccctgagctaacatagaaggtggagcaagggcggttgtaccttactcttaccatcagcccaaggacaggactgagacatccaagccccctttcaccttctttccaagccagcaaaaccttctccacatatgtgctattctaactttattgagttgtaggtttgcaggtgcgaacctgaagatgctgatagattttcatcggtgctttttgccaacaattttggtatactgccaccaggtggcagtaatgcttttgttagtaggtagttctaaacccagtttacaagatacagctatttgttagaagtcggcttcagtcataaaaattttccacacggtattttttcaaaatcataactaattacaataactttagccaatcttaagtctcattaatcatagtgattaagagagtgatacataaaaatgcaaaatggacactcctctccctgagttttaaatgttactgctttatggcaaattatcaccaggccttgctttaaattttctttatatctttctcatttctctgagcttagagaaggctaataaaataaactgtcacatagcatttattatgtacgatgaatgttctaaatgctttatttatagtcattcattctcatcacaactctatgaagtgaataatgctgttgtcttccttttataaatgagaacatggagccacagagactttgtcacttgcctacagtcacacagcttgttaagtggcagaagttgtatttcgacccagacaggtggggtgcaaaactcagtattctcaaagtgtggcatccaaacctgcagcattagcaccaactgggaacttgtaagaatgcagactcttgggccccagatcttctgaaccaataaactggagacgaagcccagagatctgtgttttttgtaactcatccctccagggcactgtgatgcacaattagctttgtgaaccactgttttaaaccattttcttcatcacggtgctgtactgatgatacaccctccacacctgggttggtaataattgctgaagtgggaaccccttgttacggttgggagtctatcttgtcctcaggtgaactggagtagaaaagagaacctgtccaggtgcagtggctcacgcctgtaatcccagcactttgggaggccgaagcgggcagatcacctgaggtcgcgagttcaagaccagcctggccaatatggcaaaaccctgtctctactaaaaaatacaaaaaattagccaggcgtggtagtgagtccctgtaatcccagctacttaagagactgaggcaggagaatcacttgaaccagggaggtggaggttgcagtgagctgagattgcgccactgcactccagcctgggcgacagagtgagactccatcaaaaaaaaaaaaaaagaagaagaagaagaagaaagaaggaaggaaggagggaaggagggaagaagggaaggaaggaagggagggagggagggagggagggaagcttaagcaaagtcaatgaccttccctgggctttattggaggttctgtggctatgagtattcagagaaacttggcattaaaaccctcataaaaagtttttcttgtcctccaaaggctttctttttttactgaaaatatgggagaaaacccctaacccaatgatgcagtggggagaggagatttatgcctgaagccaaggcctctagcagcaggaaacttttagagggactgagccacttagggctcccacttctggtccccttccccaggggaagaatggccaaggcttcctcaggtttgctgatgtagaactttaacctgcctagatacaccctgaaggtgggagatttccatagctgctctatctagcagtacgcttcccaggacactaggaaaggcaccactgcagagctggagggtatccagccccctcgcaaactgcagacttcccctcccggattaccaggtcattatacccagtgtatggaaaagggtgttattaggttggttgagcaaagaacagaggaatatgggaagatgaaggttgatttgagaagccactgtgttgacaatctccgtcacattaaaggagcccagatacacattctctgatttctagcataggcaggtaggtggtgtgcatgtagagagagggcttctaagtgacatttccccctttgccttctgcgggtcaacagccttcttgttctggtccttggcttgctagcaagtgtctgagatagtcttgtgggtggcctatagtttgctgaagtttggagagatacagggaactggtgggtgtagagaaatggagtttcctagaaggaagaatcagtgactttttttgtgggttttttttttttttttttttttttttttttttttttttttttttttgagacggagtcttgctctgtcacccaggctggagtgcagtggtgcgatctcagctcactgcaagctccgcctcctgggttcacgtcattctcctgcctcagcctcccaagtagctgggaccacaggtgcccactacaacacccgggtaatttttgtttttttttttttgtattttttttagtagagaaggggtttcaccatgttggtcaggatggtctcgatctcttgacctcgtgatccacccgcctcggcctcccaaagtgctgggattacaggcgtgagccaccgcgcccggccgaagcagtgactttttataaacaaattcaaccacggcaaagtaggcagatggccaattgttacaggtagaggtttagaaatgcaaattctctgaatactcaacagatgtcttcttgtgatgtttctaattatttctgccttattgcgttgatgctgtatcttttgttacggtgtgcggtgcatattactttaatttcaatattacctctccattgtgtttgactttttttcgtatctttgttcgtcatttattttttaatcattgtagggcatttgattttaaggtatttcttttgttcacagcttgtgtaagatacatattttttatttgagtggaaaatccttgccttttaattccttcccactgcccctcccacccccagcatggcattagggttaagcctctgactgttgcatcaaacagcttagggttcaaactccagctctgatactttctgtatctaatctcagatatgctaattaaccctcctgtggtctcagttccctgatctgtaaaacagtacaagaactttaccacttcatagatatttgcgaagattaaatgggttgatatatgtaaagtgcttagaacagtgtctggcacatcatcaattgctttttaatgtttacagctaataagagaatgaaatgcatttattttcataattaattgctttgggtttctatcatttttatgctttatacttttattaattccttgttgtttcctatattgcttgcttttattttttaaagtgagttggaagatgtcctgttcctataaattcctaatttttaaagtaaaaaataaagcaatttcttttgactccatcctaatatctaataaagaaatagaatctgcaattaaaaactttcccacaaagaaaactttagcccagatggcttcactggttctaccaaatattttaaaaagaaataataccaattctatacaaacacttccagaaaactaaaaaaaaaaaaaaaaaaaaaaaaaaaaaaaaaaaagaaatccctactcattttatgaggccaacattaccctgataccaaaattagagatcttacaagaaaagaaactcacaggcaaatgattcttgtgaacatggatgcaaaaattctaaataaaattttagcaaatagaatacaacaatgtataaaaagcatagtatatcatcaccaagtggggcttatcccaggaatgtgaggcttacttaccattcaaaagtactcaatataatttaccatactaacaaactcaaaaaaagaaaaccatatgaccatttcaacagatgcagaacattatttgacaaaatccaacatccattcctaattaaaaactctcagcatgctagaactggaagggactgtcttcaacctgataaaaggcatctgtagaaagcctagagttcacatcatactgaactgtgaaagcctgaatgctgctcctctaagatgaggaacaaagcaagaatgtcttctctcaccacgtttattcaacattgcacttgagttctagccagtgcagtaaaacaagaaaaaataaataaaaggtattcatacttgaaaggaagaagttaaactgcctttactcacagatgaacatgctcatctatgtcagagttggcaaattttttctgcaaaggtcacaatagaatttttggctttatgtccacgcagtctctgttgcaactactcaactctgccatcatagcatgaaaacagccacagacaaaaatgagtgggtgtggctgtatcctaataaaactttatttagaaaaacagattggaggccacatttgatccatggatcataatttgctgacccctggtctatgtcaaaaatcccatggaatccacaagaaagccactacgactactaagtgagttttactaggttgcaggaatacaagattgatatatagaagtacattgtatttctattagaaatttaaattttaaaatgatactttttacagtagcatctgaaatatgaaatacttatggataaacttgacaaaatatatgaatgacctagacactgaaaactacaagacactgctgagagaaattttaaaagacctacataaacagagaaatatattgtgttcacaggtcagaggactcaataatgtcatcaattctcccaaactggcttacagattcaatacagtctccaccaaaatcacagctgcctttattatagaaatggacaaattgactaaaatccttatggaaatgcatttctaaagttaaagcatttccttttatagttaaggatcccgggacacagcccagctttgcctgttcccttctgcttcctgccacattgcatgctgagtgttgcagtttctgaatgagtgtaggttgggagaacatgatgacaatcagaggggcagaaagcttgctctgatgagtggcagtgtctatgcaggtggggaacacatcagggcagaccctgcttcccagggttaggcccacaccgagatttgtaacttcttggcccatgtgtcctattttggttcagatgacagggcatacatgagttattaaaaatgtgtttctcaatccatttccatcaaatatacagttagtagaaattatcccaatttggagcctgtaggctcttatttttagttaacaatgctgctttgccttcatttatttatttatctatttatttgagaaggagccttgctctgtcacccaggctggagtgcagtgccatgatcttggctcactgcaatctccgcctcccaggttcaagcgattcttctgcttcagcctcctgagtagctgggattacaggcaccccgccaccacacccagctaatttttgttttttgtttttttttagtagatatggggttttatcatgttggccaggctggtctcgaactcctgacctcaagtgatctgccagcttgggccttccaaagtgctgggattacaggcgtgagccaccatgcctggcctgttttgccttctaatactttactactcatgtggtttgtggactagcagcatcacctgttactcaggagcttgttagaaatgcatcatcttgggccccaccccaaaccctctgaatcaactctgcacctgcagaagatccttaagtgatttgtacgccaatttaattttgagtcacatattcagatgtatactaatgggaagttgggagtgtgtatatttacatgtctactcagctctgtccatcagcacatctttatgtctgcaatgtggcatttcaagatattcttctctccagcagaagagagtatcccaggaagaaaggaatcttctcttattccaacaggaaccctcactcctgttgttgttgttgttgttgttgttgttgttagagatattattattattatgtgctctgttgcccaggctggagtgcagtggtgagatctcggctgactgcaacctctgcctaccgggttcacgtagttctcctgcctcagcctccagagtagctgggattaccggcatgcgccaccatgcctagctaatttttgtatttttagtagagacagggtttcaccatgttgccccaggctggtctcgaactgacctcaagtgatccacctgccttggcctcccaaagtgctgggattacaagcatgagccactgcacctgaccctagttattattttataagcattttgaattactttgcatgcagtgcactcacctctctccaacacatacacacacacatgttcacatacacatagcacacagatatataccacacacacacacacacacacacacccttatcaaaagcagagactatctctcataatgaaccattctacatttccaggaaaggtaaagtggagctcataactgtgtctaattaatgcttattttatattttcctgtgatcaaagcagtgtacattattatagaaaattttaaaaatacaagaaaggccaggtgcggtgactaacgcctgtagtcccagcactttgggaggctgaggcaggtggatcacctgaggccaagagatcaagaccatcctggccgacatggtgaaaccccctctctactaaaaatacaaaaattagttgggtgtggtggcgcgtgcctatagtcccagctactcaggaagctgaagcaggagaatcgcttgaacctgggaggcagaggttgcagtgagccgagatccaccactgcactccagcctggcgacagagtgagactccgtctcgaaaaataaaaaatacaagaaaaaggataaaaagtacttatttcctatcactcagagataatcactgctgtttttagtgggggagaggaacttttttgtattttctcagtctttttctaacaactttatagtagtcaatgcattatatattagagtttatgtggggtattattataatatataacggacacaatacataggtattactatgagggccatagttgtactatatagtacatagagaaaatgctagatatacaattctgtattctgcttttttctgttaacatttgtattttttctgattattattcattccttgtaaacaacacttatatgcctcaaaatattccattaagcacataaaccacagtttacttaactacccccttattgcagaacatttagagtgcttgcatttttcatgttggtgagtaatgtgcatgaaaattattgtgcatacaggattttttctatatattttcagtaatgtcctcaagatagatttccgaagtaagtcaggctgtgcgctttgatacatattgcaaagtccagaacatattatttaaaatcacacttaaaagccgaagccttctaacataaggcagaactggttgctgcttttgccaggtgaagagaaaaccacccattgacaagacagaatgggacagcttctttgatgagagtggccacttggccaaatcacgggacttcatttgtgttaacatcctggaaagggtgggtccccaagctacccttggccttgccctggaactgggagcatggatgggcagggggcaggtgtggcgttggatgaagcccttttggtaggcatcgatagagcccatgacctccacctcccacccccaccccagggtctgcaccccttcgtgaggactgaagcctggaaattcctcacgggctacttctcatggcagagttcccaggatgagcggctcacggtggacagcatgaggaggtagaacactccagaccctgctgggacaggaggggggcctgcaggtggcaggtgctgcctccccagcctgcagactatcttctgcccccatgcaacttcttattccgagaggaaccccatgcctcctgacccaggcacagcacacaggaggtgcggccagttcgtgccagtgccttctctccctgagctccatttaccagcccatcaactgccaggcatgggcttggtcccagccactcctcttacccctgggccccaagtcccatccttccttatggcctatgcattcttcctctgaagcagcccttgaacagagtctgccaccctcttccctgggtgccaccccaactccacctcctccctgccccccatggctgagctgcctcccgggtctagtctccccactccctgcctgtgcccactgtttcctcccggtgcccaggggaaggtacaaaacccagtatgggctgcctgtgtccttagatgaaacactcccagtggtgtaactggtaacgtttcaaatagcacatcttctcttccaaaaacttcctgatcctagctccacatcgcccactatcccagagcctgacattccaaccacactgacagcctcactgactcctcatctgcccactcctgccccagcacagaccacgtttgcactcccctctgtccttggttcaccctttctcctccctccacaatggctttctatcatctgcctatcagtagcccacccttccttcaaggcccagatcccacagtatacctactccaagcagccctcccagatctcccaagggagccagggatgaggcactttgtttcagtagataacacaccatctttgaacttggaccgtcttggatttggaaaccgggttcaaatttcagcactctgatttacaccctgggtaaacttgcccatgaacttcagtgctgaagtctcagtctcctcctctataaaatgcaggtaacaatctatttcacagagtggttgtgggggctcaatcagataatacaggtaaggcaccttgcacaggggaggaatcagtagcttttatgattttgatgggaatcctccctccctgaagccggaggcccttgacttgcacttccatgaccctgggcacttggtcccacagtagtgagaacggagcctgtgtcttccctcccaggttgaatgcaaacaagggcagaggctgcagccagtttgcctttgtcttgggccctctcctgaccttgcctgtccatgggagggctccgtacacactggctgagtcagactgactccactgctgaaaatcttcccatcagaggaacggactcctttggattgtggctgcatgactatgtagcctgggctggactcacctgtctgggagcctgaagcaggggctaggcccagccccaagggagcatccagacagaatgtggaaaagattcacgtgtcggggccagccagagtgacccggggtgggacgggggtgtgagggctgggctagggagctcagagaggttcaggagctctgacaagagcccacctgtgttcatttcctgaggctgccttagcaagtaccacaaactgggtggcttccgacaacagaaacctgtcttctcgcagttctggagccagaagcccaaaatcaaggtgttggctccttccaaaggctctagggtagaacccttccttacctcccagcttgtgtggctcccggtgttcctcagctggtggctgcctcactccattccctgtccccatggtggtgagaccttctgctttctgtgtgttataagaacacatgtcattggatttggggtccacctggaaagtcttacggatctcgtccggagatccttgacttagtcacatctacaaagactcttttcccccacatggttacattcacaggtcctaggggttaggacatggatatgtctttttggaggccaccatgcggccagcaataccaactaatcatattctaataatgaggacaaaacaccgcctcactcagcacttccaattctgaggcacaggtgccagtattatgcccattctacagatggggaaactgaggcttagagatggaaagtcgtgtccccaagacttgcccccagtggcagacaccccgttattaagatgtagagccaggattcaggtgcagcgtttggagtacagagcccaagaagttaaactgtctctgttctgcagtccaggtgcatgttggaggacagttagggtggcacaggttgagatgagggacagcatcacaggtagggtgcatggctgggtgagggtgctgccctggatctgcctggggcctggtagctgcagctgctcattcaccacttatcagaaggggaaaagccaccttgttcagcctcagttctgttctcacaggaagaactacaaggccttatgccaaatgtatgagaagattcagccccttctggaaaacctgcaccggaacttcacagagactcgcaataacattggtgagcaaagtggggtggagagggctgggcagagggagggcttgaagccaaccctgcccccttctcagccacttccagggagggatggctccaggatcctgggagttgctttgacttgtgcctggagtttcgccagctgaaccttggttaatccaccccaccagtctctcctgggtggccctagatgccccataccatgttttcctgggtgcatgatgttcctgctgcctggtcttcctctctcctttctttggctttgaatgaggttggatttgaactggacagagaggaagggtgggggaggacattcctggccgagggtacggcctcgttagagggttggaggtgggaagaaacacagacagctcaaggtgtggtgaggaactgagcctggcaggggctgatgtacctttcacagctccctctccctccaggatgtcctagggcctgcccattggggtaggggaagaaattcacccatagacctgctggatgtgatctggtgccacctacttgccccttgcttccaacctagcacgtgacattcagaaaatctatgacaaagatcccctgggcaacgtcctcatcgacaagaagaggctagagaagatcctgctcctgagttacgtctgcaacacgcaggcaggtgagcctcagcctccccttgtcaatgccctcccaggacctggcccaacctaagccaagggtccaggctctcccacccagcccctcctccccaaccccctcttcgccacagagtaccagcagggcttccatgagatgatgatgctcttccagctgatggtggagcacgaccacgagaccttctggcttttccagttcttcctgcagaaaacggtgagggcaaggcctgagctcagggacgcccctccccaaccccccactactccccaaacaactctttgaggatgggcaggcattggccaccccagccattccttccaggcttctgggtctcagaggagcctgggagggtgacgctaaacccagtggttcaaagtagtggtggtggggaggcactgaagtggagaagggggatggagcaaagctctgggtccacctctcaacaaaccttgaaagagcatggctggccaggcccagggaaggtgccctctcctggcattttcttccccaagcacggttctcctccctcctcgctgcttcttcctcaatggctccctgtggcctccagaataaaatccaataaccttagccagtcattcagggctgttcccttcacataacctgaattccaggcacaccaggggactcaatagtccccaggggctccctcactgtccaagttgaggggttttgaaggtgcagctccctggaacacctccctggaaagcctttcctcatgatctgcgagaggctgcccagaaccctccctcatccctccctccaccccaccatccctgcacatgtgcttgctgcccttcccttgtcccagttggctctgccccaacactattgtgtgagggaagaactgggcaactgggctcactagactgtgagccacagttgagaatctctactacacacacatacacacacacacacacacacacacactacacagccacccagaggcgtacaacatatacagacaaacttgcatacacagatcacagtcacatagatatgtatgcacacactcacacacacacactcagactcatagagacatgggcccagcgcacagacagacacacagagcctccagaagtgaagctgggggaagcagagttgactcttccggtgccttgaagccaagggggactcagtctgtctcccaccatcgtgtgcaggaacacagctgtgtcatcaacattggcgtggccaagaacctagacatgctcagcaccctgatcaccttcctggaccccgtgtttgctgagcacctaagtgagtggttcccacctcctgccacctcacgcaccccccaggcatgggaagggggctgggacccaactgtcagtccctaatcatgggggggctggagagcagcagaatcatttgattgcttctccaggccctgggaagagggttatctggatggggttggagcctggacagttgaaagttgactctaaaccatctcccagggcagctggaaaaggggcggcaggctttttgtatttcccaagtgttttgcaggctctgtagtttggcctcatctgcatgtgtttgctgcatcatatgtgttttcccctgaccacagcctcaccttctctccccacagaagggaagggtgcaggggctgtgcagtccctcttcccctggttctgcttctgcttccagcgtgccttcaagtccttcgatgatgtctggaggctctgggaggtgaggtgtccagctagggatcatcaggctgggctccacccatcaggcagagtggaagctgcaagtcttccttgcctccccctttcttcctggcttggatggagttcagtatctcggggttttgttaggtcagcaaccctgctcccaccttgctggaggaagctggagcatcactttgtccatatgttcatttaacacaaaggccccactgactgtgccttctgctagcagttgacacaggagggccctatggcctgtgcagtgggagcctgggcctgcagctccacttccccgctgccctgcccaggtggcctccccacgctttcacttccccagctgtccccccaaccctggccttccccttccccagagtgctgctcctgtggaactctctcacagaaggtgggtccctaaggacacctgtagtcctgtgaccacaatcctcagggccatcagcagatgaaccctctgaggaatgccacccccacccatcaatgccctgcccatggccaccgctgcctgcagtgtccagcccaaccatccacctggcatgtagggccccacagatctattcccacctgcctcttggctggctggtctccatgcccaagtccatgaccacacccaggcctttggtgacatccttgggtcatttaattcccatcaacccttgcttgccaaaaccccactcaaattcgacagtttcctagtgtcttcccacccctcattgcctccctccccttcctctatctaatgaattccctgaagcctctatctctgaaacccccaggagacagcacaatgcctagaaccaggagtacctgtgagcacatgcctgagtgagtggatgagtgagtgagtgaatgaaggaatgattgaatgagcaagtcagcagcaaggcccaggaatggctgactccaggcacgtggttggtgggtacctcaccatcctcagggcatctgcagtctcagaccacagggcccagactgagacgtcctgacccacaggttctgctgacggggaagccctgcaggaacttccaggtgctggtggcctacagcatgctgcagatggtgcgggagcaggtgctgcaggaaagcatgggcggggatgacatcctcctggtgagagcaccctcgggcaagctaccacccctgctcctggaggccctgacaccccaccccaccccagctgaaagaccggggttcatggggtgctgggcaccagtgccaccttttccccccagacagaaagggcaatgagatctaaggtacggattaccgtgccaagggcttttaatagagcttgtttaagcctcaccacaagcttgacacagggaggctataaccatcatcatcacccctagttaacacatgaggaaatggaggccttgaacactccctaactattaagctctaccatctcgcagttaaccctgtggccctaggatattgctgaaacagaaggacctagagttttccaccattttaaaaaagctactgaagtctttgttggaagaaacaaatcttaggtgacaccctaattataaaccaagtcctccttcaaagcccctaagacacttggtggagccccaggactcctagagcctaacatgaaagctaacatttaccattgccccaaaatatcaaattttaggcattgagccaagcaggctggggagaggtcaggtggtccccagcgactgctgtgagcagcatccttcttccctgggtgctgcaggcagctgcatgtgcccaagagtgctgggagatgtttgccccagccccacccacaactgctcccacactcccatgcaggcctgcaacaacctcatcgaccttgatgctgatgagctgatctctgccgcctgcgtggtttatgctgagctcatccagaaggatgtaagttgccccaatgatgtgtcctcctcctcctcttcctcctcctcctcttcctcctcctcctcctcttcctcctcctcctcctcctcctcttcttcctcctcctcctcttcttcctcctcctcttcttcttcctcctcctcttcttcctcctcctcttcctcctcctcctcttcctcctcgtactcctcctcttcttccttctcctcctcctcttcttcctcctcctcctcctcctcatcagagcctatcctgatctcccaaacgcagcccatggcaggtgcattcaacttcagagacacagactgtgccacgttctctaccactgacccatgcatgttgctcctcatggtcttctcgttgtttgcacatgtagctccttcctccctgagcaggctgtactacttgagagcagggccctcatcccccattccctgtgtccatcccagtgggtctgggcacccagaggctcaggagaatgtcgctgcttagaagaaccgaagaatgaaagggacagaccaatgtctgtgcacctcccacctgcctcctccctaggttcctcagacattaaaggatttcttcctctgaggacaccaaagcccgcagtggactgatgccttcgatgggcaggatgaaggccaggggcactggagtgagggagtagataaaacagctgcaatataaacagtcctctggaataa

SEQ ID NO: 957 - DNA, 41723 bp, Homo sapiens
cctctccagaggcgggccctgagccggcacctcccctttcggacagctcaagggactcagccaactggctcacgcctccccttcagcttctcttcacgcactccaagatctaaaccgagaatcgaaactaagctggggtccatggagcctgcacccgcccgatctccgaggccccagcaggaccccgcccggccccaggagcccaccatgcctccccccgagaccccctctgaaggccgccagcccagccccagccccagccctacagaggtactattgggttaggggatgatggggttaagctttgttggtttgctgtggtggggagaggcgggaagagagggtctaacggaggatttggtcaagtaccctagagagtgacacaaagcgggaagtccagacaccagggtcctgaccgtctcgggtggggcagggaagggagggtaggatagagtagaaaagaggacacggaggagttggggcggcctcgctgggctgcggtttctccactgagcagttgggcaaggtgagaagggtcagtggcctccgggcctgggcccttccgcccaccctcgagccctgcctcaactttgcctcagatgcaggacttcagattagggaggatggaggtagtacccctgttgcgctggcctggagccaggggcatgtcccaggcacggcaaaactaaaaccaacttcccagatccgaggtgagaaactggctcagactgaagaggtatctttgccaaggcctcccagctcatgtggtttctgcttaaggaagcctccccaacgaacccttctcttgccacacctttcctgcccacctcccacctcccccgacaaaggaactacttgggtttcttgctctgctgcctttcaggcccttttactccccttcatgaaagtacagaggacaccgtattacagtaacttttataaacattattacaactaagaataacattacttaacaatactaggtaacatttatgagcacttcaaatgtgccaggtactgtattaagcactttggtttttttttgttgttgtttgtttgttttgctttgttttttgtttgtttgtttatctgtttgtttttgagacggagtctcacactgtcgcccaggctggagtgcaatggtgcgatctcggctcactgcaacctcctccttccgggttcacgccattctcctgcctcagcctcccgagtagctgggattacaggccacgccaccatacctggctattttttatatttttagtagagatggggtttcactatgttggccagattggtctctaactcctgacctcgtgatccacccacctcggcctcccaaagtgctgggattacaggcatgagccaccatgcccggcctgtttttgtattttacaaaatgtggtaaaatatacctaatggataagttcctatgttaaccatttataagtgtaccattcagtggcattaagtagattcacaatattgtgtaaccatcaccaccatctatttccagaactttttcattactccagaaactctgtactctttaaaccataggggagggaaagatggcttgcctccacccttctagtttccttggctgggctatgaattaaatagcctatgaattaaatagtcataaaatagattaccagcggaaaacccatatttaattacatatgtatactcaggagtcccacaatatatgagactcaaagaaaggtcagatgattgaagcctgtataacatcctgagctacggaaaagagcttggagcttctgggtgatggtgataacacaagttatgggagggtgaggagaggagctgtttggtgaatagaggttgtcttgctatgtagattaaaagttcttagataataaaagttgtctggagcagccctcttttaatatagatcattttactaatgtagattttcttttaagatataaatgcctttcttttttacaaaaggagagcttttcagagctattcctgtatcagcagtttctcagaataaccagcttaaaatatgccaaagaagtatatttcaagagcctcctgcagtcatactttgaagtggtgtgtcctgagccccagtaatgcaatagctcctcattttctccttcccctagcccttggtaacttctaatctaccttctgtccctatgaacttacttattctagatatttcatgtaagtggaattgttaccagtagaggatcttgactgcaaattgttcaggttcttggcattttgaacaaagaattggacaaaatgtacagcaaagcaaggaaagagtgaagcaatgaaagcagagatttattgaaaatgaaagtacaccccacagggtgggagcggctagagcagggctcaaggaccccagttacagaatcttctgggttccaaataccccctagaggtttcccattggccacttggtgttcaccccattggttgcagaaagcaaccaaccagacgtactttcaattttccatctgccctgcaggaaatggggtgatttgcaaagagagtagcctctcttccttttgttactgaggcatggagagttgcggttttcctttcgatttagttctaggaagtcagagggaatcggccttaggttccctgcctccagaccctattctcctgcctcagaatcatacagtgtttgaccttttgtgactggcttatttcacttagcataatgtcattgaggtctatctatgttgtagcatgtatcagaatttcatttctttctaacgctgagtaatattccattatatgtgtagaccacattttgtttatctattcatctgttgatggatacttggattgtttctacattttgtctattgtgaatagtgttgctgtggacattgttgtacaagtatctgtttgggccttgtttttacatcttttggttatatatctaagagtggaatttctgggtcatattgttgttccatgcttacctctttaatgaacccccaaactgtgcattaagcactttatatgaggttggtacttagtgtatctaccttccaaactgagttccttgaaggcagaatgtatcctacacctcttatatctcagagcctattactgtgggtgatgagaagtagatgctcaataaatggtgcagtgagagctggagggcctgaataaatgggggtattggggtgctgataagccagggttttgcatcatccaatgactggctggaatggaatatgaggtcctactccagggtccagctgtaagggtggttggccggtaggtgggggcttttgggacttctccaggcctcacctgcctctctggtcccccagcgagcccccgcttcggaggaggagttccagtttctgcgctgccagcaatgccaggcggaagccaagtgcccgaagctgctgccttgtctgcacacgctgtgctcaggatgcctggaggcgtcgggcatgcagtgccccatctgccaggcgccctggcccctaggtgcagacacacccgccctggataacgtctttttcgagagtctgcagcggcgcctgtcggtgtaccggcagattgtggatgcgcaggctgtgtgcacccgctgcaaagagtcggccgacttctggtgctttgagtgcgagcagctcctctgcgccaagtgcttcgaggcacaccagtggttcctcaagcacgaggcccggcccctagcagagctgcgcaaccagtcggtgcgtgagttcctggacggcacccgcaagaccaacaacatcttctgctccaaccccaaccaccgcacccctacgctgaccaggtgagtaggccggcacagggtggggtggtgcatccaagtaccaggtagagggcgagaggagcaaagatccaaagagtcacacagctgaggacaaggagcttctggggccttgcaactctaaatgtggtctgcagatatgcagtgtccgtgttgatgaccacaatttatgctgccagtccccacgcaggtggatagtaagtttccagtttcctcctgtaataaataatgctgcagaatcatctttgcatctttatccagtaacttctttaggataaatttttagaagtgccactgctgggtgtagggggacgggaattctacatttgatacatgttaccaaactgccctttagaatttagtggaattttccgagagcactgacacggaatctcagtaaggctggattctaggatcagagacaagtagttagtttctgtctgaaaagttgaaaccattaacaccaggcagcgctatctgagaatgtctgtatggggaaaaaaaatcacatccagttgtaattatttttattaaacagattttaactcagttttttaataggtaatacattcgtacagttcacgaacaaaatttgtaaagaggagagagagagtgcaatcttctgtccatgcccaactgcctaattcccaccacttctccctcttcccatccacaggtagccattgttactagttttgaatgtttcttctgagagtttctttacgaatatatatgcaggtaggagcaatcttatcaggtcctattttccctcttttagccaaaaaggtagcataactatgtgaacttttcaccattagcaatagattgttcatagaaggcgcttcttggttcttagagatccacttgcaaaatgaaagcatttttcgctggtttttgacaactcagaactatatatggctaaaccacatatttgctgaactacatatctgctaaactgactgtgatttgtttcctgctttaggataaacttcccacactatcagaataagctttcccctccgactcctcaacagctggtatcaccacgtttcttagcttattgtaaaggttgagtggctttccacttgtttattggccattgtgtttctgcatttgcgagtggcctgtttaggtcctttgcctgttgttgttgttgtttccgttgaggaattaagggactaattaaagaattcaggaacaaattcctcgaaagaaaaaaatgtatgcatttcttttgctcttacaatttatgcagttttaaaacttacatatttattggattttgattgaaattgcaataaattaggagaaattggctttatctctggttctatcttttggatttaaaaaattttttttaattttttttttttttttttgagatggagtctcgctgtgtcacccaggctggagtgcagtggcgcgatctcggctcactgcaacctccacctcccgggttcacgccattttcctgcctcagcctcccaagtagctgcgattacaggtgcacatcatcatgcctggctaattttttggcatttttagtagagacagggtttcactataatggtcaggctggtctcctgacctcaggtgatccacctgcctcggcctcccaaagttctgggattacaggcatgagccaccatgcccagccttatactaatttcttaatgaatttgtaagctttcatgttttgaacgtgataatgcagccatcccacgggatccatgggagtctgtttcaaattcatagatgctcaagtctctgatataaaatggcatagtatttgtatataacctctacacatcctcctgtatactttattttttattttatttttattttttgagacggggtcttgctctgtcgcccaggctggagtgcagtgctgcactcgtggctcactgcagcctcaatctcttgggttcaaacaatcctcccacctcagccaccagattatacaggactgcaggtgtgcaccaccacactcagctaatttttaaattttttgtagagacagggtttcacgacattgcccagactggtcttgagaactcttgggctcaggcagcaaccctccctaggcctctcaaagtgctgggattacaggtgtgagccactgtacccatcccctcctgtatactttaagtcatctctagattacttataatgcctaatacaatgtaaatgctatgtaaagagttgttttactatatttttgaatttgtatatttttttattgtggtacttttttaattgattttttttcgcctgaatatttttgatccaagatttgttgaatccacgggtgcgtaacctgcagatactgagggccaactgtacatataaattgtttagcgtagtgcctggcacatattaaatactcagtgaatgttaaaattctattataatttctctgctctagaacaatttgaagaatataagaaatttaggcttataaaagttttttgaaaaaccatcttggaactggtgccttttttatagtagatttttgggaacttttcccatttttgccatggcattaatctgttttggctcttgtgtcagatttttggaagattttccagttcatcctgagttatctttcattatttaaaaatctcctatatgcctgtaactataccccctttttttatttctgatgttgtatatttgtggtttagcagtcttttcaaagtactgtacttttagtctttccttagattgcttactgattttaatgttttccttctttctgtttgatcattttatttttgtcattttcttccttctaacttttgtcattattcattttctagcttcttgaacttataattcatttatttgcaatctttattgtttaataataataacttttttttttttgagaatctccctctgtcacccaggctggagtgcagtggtagatcttggctcactgcaacctgtgcctcctgggttcaagtgattctcctgcctcagcctccccagtagctgagactacaggtgcccaccaccatgcctggctaattttttttatttttagtagagacggggtttccccatgttgaccaggctggtctcgaactcctggcctcaagtgatccacccgcctcagtctcccaaagttctgggattacaggcgtgagctacaatgccctgcctaataataactcttttaaggcataagttctctgtatatggttttggctgtatgccataactttgataacttcattagtgttctcatagtcaatcatttctcaaatttcatttcagtcttttcttaaaaaggttctcttgcttaaggtcaagagttcgagatcagcctgggcaacatagcaagacctcatctttacaaaaaataaaaaaaattagccaggcatggtcggtggtacatgcttgtagtcccagttatttgggaggttgaggcaggagggttgcttgaacctaagaatttgagcctgcagtgagctgtgatggtgccacttcactccaaccagagcatcagaaccggaccctgactcgaaaaaaaaaaaaaagaaatttttttctcttgaaaagttttagagaatagtgttttctaaaattttcaagtggttttgatgtttggtttcttgttctgtcacccaggctggaatgtgatggtgcgatttcatacttgttaatttctgcactatggccagtttatacagtttgtatgagttctacatctaagactatattgagattttcttagcggcctaggatattccttggactcacatattcctagcaataatccttagagttgaaaagttgtatttgttgtacacacatatatatacatacacaaatatatgtatataatatatatgtgtatatatgcatatatctatatgtatatatccatatatatgtaagttctagtgcttgtgtgtgtgtgtgtatctccacgctattgaaactttctacctttctttcttttctttttttttttttttttttgatggagtcttgctctgtcatccaggttggagtgcagtggcatgatctcggctcactgcaacctcctcctcccgggttcaagtgtttctcctgcctcagcctcctgagtagctgggattacaggcgtgtgccaccatgcccggctaagttttttttttttttttgtatttttagtagagaaggggtttcattatgttggccaggatggtcttgatctcctgaccttgtgatccacccgcctcagcctcccaaagtgctgggattacaggcgtgagccaacatgtctggccgaaactttctacctttccttccattctgtttcaccagttctctaaatgataattacagagtggtaacttccccatcaaaacatatatataggccagatgtggtggcttccacctgtaatcccaacactttgggaggccaaggccggtggatattttgagcccaggagtttgaggccagcctgggcaatatggtgaaaccccgtctctacaaaaaaatacaaaattagctggacatggtggcacatgcctctcgtcccagctattcgggaggtggaggtattcctcagagaggatcacctgagcctgtccgttcaaggatgcagtgagccatgatcacgccactgcactccagcctgggtgacacaatgagactctgtcttaaaaaaagaaaaaaagtgggccaggcgcagtggctcacgcttgtaatcccagcactttgggaggctgaggcaggcggatcatgaggtcaggagttcaataccagcctcaccaacatggtgaaacctcgtctctattaaaaatacaaaaattagccgggcgtggtggcgggcgcctgtaatcccagctactcgggaggctgaggtaggagaattgcttgaaactggaaggcggaggttgcagtgagctgagattgtgccactgcactccagcctgggcaacaagagtgaaactccatctcagaaaaaaaaagtgtatacacacaccaacacacacatacatgcacactctagaacctatctcatctatcaccacaaagagtagaatataactattcttccagagaaaataaaacatttagcacacttttatagtttttcttcttccctcttccttctcactttcagatttagttgaaataatgtgaacttttagttccagattactaccaaattgttaatttttttttcttttgtaaacatcctttctgaacaggtattaagcttcatggtcatattacaacgcacttgttagccataccttatactttaattggtttcattgctcatgataagttttcctatagcttttcttctcctttcttgaattatttaaggtgattaattttccatttggcaggaatactccatcaagtaattaaaaaaattattccagagtttactttctgagaccttaagtgtctttacttgtatgtccttcttttgctgtcacatgtgagggaaagttgagctaggtgtaaaattctgaggtcataatcacagtgctttcacctcagaatatataaaccttgcttcataaatttctagtctctggtgttgtagatgagaagtccactaatggtctattttttctctgtgagtaatctgtttttgtttgttaaggatctttatttatttttatttattttactttttagagatggggtctcactctgtcacccaggttggaatgcagtggtgcaatcagagttcactgcagcctcaaactcctgggctcaagcaatcctcccaccttgacctcccaagtagccaggactacaggcacctgccaccgtgcctggctaataaatatagttggatggttttcatttgtttatttgtttgtttagagataagttcttgctctgttgcccaggctggtgtgcagtggtgtgatcatagctcactgtaacctcgaactcctagactcaagaggtctgctagccttagtctctgagtagctaggactataggtgcctgccaccatgcctggctaatttttaaaattttatgtagagatagggtctcactatattgcccaggctggtctaaactcctggcttcaagtgatcctcctgccttagccgcccaaagcactgggattacaggcttgagcccatgcccagcctgctaaagatctttatataattttttcttttttcaataatcttctatcgccattgttgatctgaaaaactcaagtctttcttcagctcttcatctcagggaaattgtattctgctttttaattttttttttttttttgagatagagtattgctcttggaatatagtggcatgatcttggctcattgcaacctttgcctcccaggctcaagcagttctcatgcctcagcctcccaagtagctggaactacaggaatgcgccactacacctggctaatttttgcattttctttttagtagacacaaggttttgccatattggccaggctggtcttgaattcctggcctcaagtgatctgcccgccttggcctcccaaagtgctgggattataggcgtgagccactgtgcctggccatactttttaatatactgatagcccttcatttgtttattttattttttatttttattttttgagacagggtctcactctcacccaggctggagtgcaatggcacgatctcggctcactgcaacctccacctcctgggttcaagtgattttcctgcctcagcctcccgagtagctgggactacaggtgcgcaccaccatgcccagctaatttttgtattattagtagagacggcgtttcaccatattggccaggctggtctcgaactcctgacctcgtgatccacccgcctcagcctcccaaagtgctgggattacaggtgtgagccactgcacccggcccatttgtttatttttaaaatttttactactgttgttatatggatattggaactccaagaacatattttacatcttttaaattttttccccattaattctgttgctttgcttttttccccgagattctcagagagctcctcgaattgtttttctaactcgccagctcatcttttcgccgctgactccattcttctatctgctacccctgtagagttgttgtgggtttttttccccccagcaatctttttttttttaattgccaaaagagcttaatgctctcaggatgctttttcttggcagcctgctcttgttttctcattgtagtgtgttcttaagtctccctgaaaaacacagttggcatttacagaggtgtatgtttcctacacgatccccttttcaatgggtacttgctcagtttggctgctgattctcttcataggtcctgcggtctgtgctatctgctcccatgtaaaagttgacatctagattgttcagtgtttgtagctagcgtgggctggcagcaattgtgtaaagcacaatttataccccacattcaatccctgcagtggaacagggccgctccccacgagccccagatggtgtcagcttgtaagtagtcccacctctgctgtgggggtcagaggtggatttctctccattagggatagaaaaaaaccttttgtctgtacccattttagatgtccagctaggtccctgtaaattagactaacaagatatagattaacacgagaaaagcaggctgggtgctgcggctcacacctgtaggcccagcgctttgggaggctgaggtgggtggatcacctgaggtcaggagttcgagaccagcctggccaacatggtgaaaccccatctctaccaaaaatataaaaattcgccaggcatggtgtcacacacctgtaatcccagctactcaggaggctgaggcaggagaattgcatgaaccctggaggtggaggctgcagtgagctgagatcacaccactgcactccagcctgggcgacagagcgagactccgtctcaaaaaaaaaaaaaaaaaaaagaaagaaaaacaggagctttttagcatgtgcatctagcatgggtatcacatctagcatgggaattgtgcatatacctgggagtatccagagatgagtaactcaaagcgttggttagaacttcagcttacatagcatcttaatgaaagagaaagaaatgtttagagaagtggcagggtaaaagaaaggggttttaggcttgcaaaggtggcaaactgttggaagttgtgtttctgttttgcattgctagaaggaatacctgaggctgggtaatttgtaaagaaaagaggtttatttggctcatgttctgcatgctgtacaatcatggcaccagaaacctgcttggcctcaggtgaggctgcaggtaggttttactcatggcggaaggtgaagggggaacaggcgtgtcgcatggcaagaggggagcaagagagagagaaggaggaagcaagagaaggagatgccaggcgcctttaaataaccagctctcccttgaactaccaaagagaggatttactctttaccacgggatggccccaagccattcataaggcatccaccctcatgacccaaacacctcccactagaccccaccttcaacattggaggtcacacttcaacatgagatttggtaaatatatgggaactctaatggagtaaggtttgtttgtgcgggcctacttggtgccagctttccatcttcgtggctgtaaaacttccctgagagaggagatttatggtagttcttgtttctcagaagtttctgttttttgtcataagagcaaagagcgtaagagtcaaaagagtttctgtttttagtcatgagagaagctcttagaaggctcctttctgcgtctgttggttttcatttgcctgcagctcaaaacaatcatatgccaaagtggcatattttggagtggcatatttttatcccttatgtcaggtacaatgggcagggaaggttcagccagcaagagggcaggattcctgttccttgagcacggtgcatggccttaacaaacctgaaaaatcatgtgctcccactcccatttcacattgtttcacaatttaccagtggttactggacaaactcaacttattttttctgcacaaaacttcaatgccataaataagagctcacaactttcctctggtcacaagtcagttagcagccacctcgctctttgaccctgggctgatttagagctcacactggggagcagccccagaggtggctttaaacctgggactcggggtgtctgccctggggtggctgccctggggtggctgccctggggccattggtatttgctccacatgcctgtggagtccattttttcatgttcatgtcacacctactgtgttgcatgttctttactagggggtggggtagaaatatgaatggacatagcccctccttgagatcacagcctggtaaacagatcagccattaacaattgaggcggcagggttccgtgcagaaggctgcatgactttgctgtctattgtgactgcgttttgatagttacctttgtcacactgtcttctgtattatgtttgccctcagcaacatgtcgtatctggcacagggctgacatcctgtttgtgctcagtcatttgtggaaggaagaagtcaggcaggcacaaaggtggctgagctcagaaaaggccacttaccctgctgggatcagctggggaaggtggcttccaagaggccatcacacttagtgtgatgtataaggaaatagaaaggccacagacaggagggactgcacgtgcaaggaaggggcactagtgagtttgcagcatctcaggaactgcaatagaaggttgatgtgagggcaggcactagaagggtgagttggggtcagatgtggcaggcttggaaggagtcaggactctatgctacaatttccagaacactcagtgttctcagctttctcctttgtcatgccttcataccacctaatcttctcaccagtgactatcctctggaagacaatgggaatgggaccctgtggagggctctgttgaaaacccattgatggggccgggcgtggtggctcacgcctgtaatcccagcactttgggaggctgaggtgggcagatcacgaggtcaggagattgagaccatcctggctaacatggtgaaaccccgtctctactaaaaatacaaaaaaattagccgggcgtggtggcgggtgcctgtagtcccagctacttaggaggctgaggcgggagaatggcgtgaacccaggaggcggagcttgcagtgagccaagattgcgccgatgcactccagcctgggtgacagagcgagactgtgtctcaaaaaaaaaaaaaaaaaggaaaacccattgatgggcattgaggagtggtgggatgatcagagcctctctctgcactctggtactttgacaagagtgggcaagtttgggaacagggatatcagtatttctttggctgcatacttatttatatttcaccccattccacggagaatttgaggggatttatcaccagatgtgggatacttatccaatagaaactgaagcaaagaatctggacaagggaaagggagcctcatgagtacactaggtcttaggtccaggtgggggtgaggcctgcaagaatgcagagatggaggggtgtggagacggctgtggtcccacactgccagcacttgcctgaccagacattctcaggagtgcttccacccaagcatggtgtgggtctagggctgcaggtggagctaagtcctgtctgcgtctgggtgtcagatcctaaaatttgctggatggagttggggaattaatccagctgaaagagcttgaattatcattgaatggaggaaacaaaaggcctattaatcaagtttaagaggtgtgattgaaggattggcacctatccctgcttggtgctctcttggtgccctctgtgaagttagcagtaaattgcattttattggggattgatattattgggattgcttcctggcctgcaaggagcattacatgggcagaagaaaggctgctgccaggagttgggcaacatgatgaaagatgtggacaataaatgacccatttcctagtttttctatgaacttatcttgaaggtagatttatagaataatatgtggataaaaggggttttcctcctggtctcctttgatgttttggagaaagaagcaaggactttatttatttatttgtttatttttgagacagtgtcttgatctgacacccaggctggagtgcagtggcacagtcatggcttgcggcagcctcaacctcccaggttcaagtgatcctcctaccttagccttcctagtttgtagagacgagttttcaccatgttgcccaggttggtctcgaactcctgggctccacccacctcggcttctcaaagtgctgtgattacaggcttgagccaccacgcccagccagaagcagggaatttaaagcagcgcaagccaagatcaggattagggctggtgctccggtctcacttctcctgaaggccaatcgcctctactttctgcagctatgggagtgggctttgctattcagggatggaggcctgggacattttagaacaatttgggttttttagttttgtttttttgagacagggacttgctctgtcacccaggctggagtgcagtgtgcgattatagcttactgaagccttgacctcccaggcccaagttatcctcccacctcagacccccaagtataatagctgggactacagacatgcaccaccatgcccagctaattttttttttttttttttttttttttttgtagagatgggctttcattatgttccctaggctggtctcaaactactgagctcaggcaatccacctgcctgggcctcccgaagtgctgggattacaggcgtgaaccactgtgcccagcctttagaacaatttttaacaagacttgaaattaacaagcttttggcatagtggtgcacgcctgtagtcccagctactagggagactgaggtgggaggatcacttgagcctcagaggttgaggctgcagtaagccataatcatgccattgcactccagcctgggcaacagagcgaggccttgtctctaaaaaaaaaaaaaaaaaaagaaattaacaagcttttctcattgattgctaactgataaaattaaaaactattaatagaaccaccgccagccagccagacagccattgagcaatcacttattgagcatttatttcatgactggtgttatgatagctattgccagatgaaaaagaatgcctgccttcgaagcttgaatttgtggagagtttcagcctatggataagttgcatgtgtgtgcagacttgtactctatggcaagaacccagaggtcccagaagatacgttcagatcaagtgctgtggcagttttcagaagggaaaacttgtatttatgtgggagggtcagggaaaccctgatattttagcatttgggctacaccttgaagggtttatttgtctctataagttgcatctaaaacaaactgtataaattagtgagtttttttagttagtagcttaagcaaaagctggattgatggctgatgtaagtgcataggggtcaagctggcctctgacctgaccaattagatattcagattgtgtcaccaggaggtactttctctgtatttcttgtgacctggctttcttccaagactggtccattcacagaagggtttactcctcatgggtgccagatgattgcaacagctccagaggttacaccctcagccccaaattcaaggggaaaagagtgtgaatctctcccagcattccaagctaaatctcagtgtgtctttgattgggtcaggttcctctccctgcaagggtggctcaggctaggggggttctcagattagcgtaagcctgagtcatatgctcccccaaagctcatggactgagaacaggaatgtgtggctacctaaaggcaaagtccagtttcatattggtacaagaagaaagaagaatgtgcctttaatacatcttagaaaaaatgtccaatagccaccgtaaatgaaagcaaagaagaaaaaaacactccaggtatatggaaggcagtggaacagaaactgaagtgcaggggacaggtttgaagccagcctcaagtgaaacaccctgaccccttggtgcctgggtaaactcttttcaatagaaagccatccttttccaaccaggttagggaatgggctgttcaggctgcatgcaacctttcctgttgacaaagtggagaactatcctgccatttgagatgtttttcctgtgctattctcctaactcccacaccctcctgtaagattatcaggaagagagaactgttccctttgtacaaacaaggcgagaggccagagagttaacaggagcttcccaaaagggagagcttgccagagccggggccagaacaggatgcagggtttcctgattgcagaatgggtgcccctttcctactcctgctggactctacattcaggcagcccacagctaatgactgcactgagttgcaaaaagaattctaaaagttgtttcttaagaatttagagtgtatcttaagtaagcatgcaatttaagcaatgttgaacttaattttcccttttacagaagataaagaaactaaagtgaaattagacttgctgaacttcaaagaaataattcttcatcttaaaatattttcctaaaaggtccctctaagattaagagaaaaaaaccccaagacattaagaggttggagccattttgttttttgaaacagagtctcgctctgttgcccaggctggagtgcagtggcgcaatcttggctcactgcaacctccgcctcccgggttcaagcaattctcctgcctcagcatcccgagtagctgggattacaagtgcctgccaccactcctggctaatttttgtgtttttagtagagacagggtttcaccatcttggccaggctggtcttgaactcctgacctcgtgatccacccaccttggcctcccaaagtgctgggattacaggcgtgagccaccgtgcctggccatttttttgtatttttagtagagatggggtttcgccatgttggccaggctggtctcgaactcctgatttcaggtaatccacccacctgggcctcccaaagtgcttggattacaggcagaagccaccatgcccagccccatatcgtttgtttttaatgaaatgcttctattttacatggtagtaactgagtctctgcaatgaaagatcaagatggttggcttccatccttctagttttggttccatgtcaataggactgtaaggttcaccactggtctttttactttaacatcacttttcccaagttttgtattttgattgagctcttaattggatagatattatcaaaaagcaattttttttttccaagaaggacttttttgttctgaattccttgagtctcttggtgttgagaatgtctttgggttactctgatacttgaataatatctcggctgggtataatattcttaggtcacaatcactttcacaattttgtagacactgctgcattatcttccagcatcaaatgttcattaggacagctctggggtcaaactgacttgctttttctgtctttatgcctaaagatattttttattcttgaaatttattaatttaaccaagctgtcttggtgtttaacattttgtatcaaattattctggaacctagcatgctccttcaatctaaaaattatctttatttcaattgcttaaattacttctcctccatcttccttttcttccttctcattttcttctttttcttgctctattactaataatatcacaatttgtaatttattaactttaggtgtgttcagtttagtaatataacagtactactaccatttagggtgggggaacttatttacttaatgacttaatgaatgagtaacaaagattagaaccaccatatacattcacttgatacatatttttataaaagtgcttgagaatatcagaattatttatgtcacacaaggagttactgcctgttttctgtgtcaccagattctattaacatttaatgattacctttactctttgaattttgaattttgtaacaaattcctgctgtggcatattttgcaatttggttatgttctgccaaagctgtaacagtaggtgaggtgtttcaaatttggcatgactgaatagaagagctgcccgttctcaccatatgttactcaactcatatattgctatgttatttttaccttactcatcaaattatcttttctcttatacatggctttaattaattgattattttaggtatttccatctctggacatttcatgtactgaaaatagatcagatttaaataaaatagctttataatcagtatttatgtgataaactctgtcttatttcttgcaacatttaccggcatgtaaatccaaattgaatattggttaatgttcagcaatattcaatactatataattgtagtgtattgttatgaaagtcaatgaatttccccccatgatgtactttgttccaaaatttgaatctcctttaataacatataacacataagttgcttaaaaaatttctcactgctgacactatttggattgtacttatgacaggcatactggccatcacctcagcatatgaggataaccatattttagaaataccatgctggtggcactggggagagctgattggagctggagagaccagaggcagggaggcctcttaggacatcgtgctcaaggagataagcaataattgaggcaagaacagaggcagtagcagtgggaactgctgggacaggtttaggagccagcattctgccttaatcatctttacacccttgccgcatgcctagacctagttggtacttagtaattttgggggggtttttttgagatagagtctcgctctgcctcccaggcagtagcgcagtggcgtgatctcagctcactgcaacctctgcctcctgggttcaagtgattctcttaccctcagcctcccaagtagctgggattacaggtgcccgccaccacactcagctaatttttgtatttttattagagacgggaggccgaggcgggtggatcacaaggtcaggagttcgagacgagcctgaccaatatggtgaaaacctgtctctactaaaaatacaaaaattagctgggcgtggtggcgggtgcctatagtcccagctactcagtaggctgaggcaggagaatcacttgaacctggaaggcagaggttgcagtgagccgagatcatgccactgcactctagcctgggtggcagagcgagactctttctcaaaaaaaagaaaaaaaagaaatcattgaagccatagaggacagggaggcatccaggagtggccattgaatggtggtgccattccccaccataaagatggcaggagaaacagggaacccacgtggcagtgtacccactgcctgttgaatgagtgacatgatccaggggaacactgcccactatggatacaccagccatatgccttgggagcaggtacctgtgtagaaaagagtggagaagaaaaagcacaaactttctcctccccattcctgggtgtggcaccagcatcagacaggagttcaaacagtgcttcctttcaccgctttccttgctgcttttctattctggtatcttcttctccaagacctcaggctttcccctctccaacactaccttctcagccaataaatcactggaggggaggtccataggaataatgcattcactctcttcaaatatcccaggctctagaattacccatctcctctcctggtttcagaaatcttgttttttcaatggtgagatagcaggaaactgatctggtaaaatgcattcatactactgtataaatgattgatggatccttttaactgtagttacttgaatttccaaaagagctctcttttaccactctaccaaagtgaaagtgccaagttgctgcatggaaatgggacaggtagaggagagtttttggtcaccattcaggcaagccaggtggtaccagctctccttcactggtcctatttcataacatttttgcttcttgcattttagagctaccagtttcctagaacagcagaagtagcatgctcccctggcccaaccaacaggtgcggctatagtggcctatctgtactggggaggggacaccccaaatctgacattgacaggttcacccaacagcagggatgtcctgtgccatgtgtaataccccctcttctttcatagctccagaatgtccaatgactacatagcactgtgctgagtccttcacatacaccagcctgtctttgtgcttgtaacagtctataagggaagcattattactcccattctacaggtggggaaattaagactcagagagaaaaggtaatttgctcaaggccttgtagctagaaatttggaagagctaacacataccactcttggcatagcagtttagacatggacagctttaggatggggagactgagaacccaggaaacacgttgaggcttctattaaaatacactactcggccaggcgagatggctcatgcctgtaatcccagcaatttgggaggccgaggtgggcagatcacgaggtcaagagattgagaccatcctggccaacatggtgaaaccctgtgtctactaaaaatacaaaaattagctgagtgtggtggtgcacgcctatagtcccagctactcaggaggctgaggcaggagaatcacttgaacccaggaggcagaggttgcaatgagccgagattgccccactttactccagcctggtaacagagcgagactccatctcaaaataaataaataaataaaaataaataaataaaataaaatacactactcaggaggctgaggtgagaagatcacatgagcccaagaattcaagtccagcctgggcaacatagcaagaccctgtctctgaaaaaaaaattaacagtgtggctatttcactgaataatcataaagggataaatgaaacaatacatcccagagacgagaaagagctttgttgtaatacctagatgggatgttctttgagtgttccccattgcttcctatttaaagtccaaactcctttacttagaattgattatagaaagtttaggaaaatctaaataggtgaaaaggagggatgagagaaagaggaaactactatcactctagaccttttcctttcctttttgctatctctgtgatcatctaaaacaaaatgaacaacatttagtgttgtataacttgcttttcttataaatagtcatgaagatctttcaaaaaaatatacagttttgaattttttaggcagtggcatcttttttttttttttttttttttgagatggagtctcgctctgtcgcccaggctggagtgcagtggtgcgatcttggctcactgcaagctccgcctcccgggttcatgccattctcctgcctcagcctcctgagtagctgggactacaggcacatgccaccatgcccggccaattttttgtattttttagtagagatggggtttcaccatgttagccaggatggtctcgatctcctgacctcgtgatccacccacctcggcctcccaaagtgctgggattacaggcatgagccgccgcgcccggccgggcagtggcatctattgattgtatggtttcttttatttcttcagtaattatagtgtctttactatggtgagagtaaatagtccactgtgttttctccttcgagatgtaattttacacatttaactttgtgattcattggaagcatatatgggtatgaaacaagaagcaaggctctaacttcattcctgccccctaccctcctccctagccaatttctctgattccaattgttgaaaacccctttaatgtccatcagtttgggctgctggctgggcgcagtggctcacgcctgtgatcccagcactttgggaggcaggggctggcggatcacctgaggtcaggagatcgagaccagcctggccggcatggtgaaaccctgtctctactgaaaatacaaaagaattagccaggtgtggtggcgtacacctgtagttccggctgcttgggaggctgaggcaggagaatcgcttgaacccaggaggtggaggttgcaatgagttgagatcacgccactgcactccagcttgggtgacacagtgagactctctcaaaaagaaaaaagagaaaaagatgggttgctttctttgttatataaaatattacatttctatagatgccagggactacatcaggcctatctggtctgttctactgatccttctcttgactcttgaactagtaccatattctcttaataatggcatttctataatgtgttatcccttccttacactgattcctcaaacatttcttagcagctggtcatagtggcttaggcctgaaatcgcagcacttttggggccaaggtggaaggatgacttgagcccaggagtttgagaccagcctgggcaaaatgttgagactctgtctctataaaattaaaaatttttttcttagctattttatctgtttgttccttcatatgaaatttagaaacctagccaggcgtggtggctcacgcctgtaatcccagcacttctgggaggctgaggcgggtggatcacctgagatcaggagttcgagaccagcctggccaacatggtgaaaccccagctctactaaaaatacaaaaaaaattagccaggcatggtggctcacacctgtagtcccagctacttgggaggctgaggcacaagaatcacttgaaccagggaggcagagattgcagtgagccaagattgtgccactgcactccagcctgggcaacagagtgagactcagtctcaaaaaaaaaaaaaaagaaaagaaaaagaaagaaaagaaatttagaatactttggttaagtttcaaaaataatttaaattgccttaaacctgtttattaactcaaggagaattaataatcttataatatttagtcttatctcttagtaggtttttgtcattttctaggtattttgtaccttcttttttttaatttaaaaaaagttttttagagatggagttcttgctgagttgcccaggctggcctggaactcctgggtgtaggcaatcctctcaccacagcctccctagtagctgggactataggcacacaatcatggctttgtagaattttttaaatagctgctgtgaatgggaagatggatttttttcccatatttcttctcatttgctttgctaagatagaattatgctatttttctttcttaattattatgtaatctagccactttggtgagcaatttcttattaagttagtggtgtttttgcttattgttttgagtattccagaagcaaatagatgttatttcgcctttctgaagatacggttaagtctgggttcttgtcacggagcccttctgggcagtttcccacttcacctctgcctcctccaaagtgccaagcacgcagcaggtactcagtgagtgtcctctgaatgaaggtaaaggaaccgcttggctaaggtcattcctggccctgggtggcagccctttgattcaggatctgcacctcagtcttaccagagggctgggggcttttagacccaggtgtctgattcaggctagccacctcacagacacttgccgcccatttccatctagagggaaagcaggggccagtcaccctagggagaccccattcaggacaaaagaagcttagaaaaaggacccagcggaggctatggccatccagaacgtcttgctctctatccagccaggctgcctgaggcgtgcccttccaggcttggaaccctgtctccaaggaaggggatccaacatcagacacagcccctctccccaagtgtccaagatccaaagggggaaaataacaactgtttcttattctcttccctttattcctataccctatagaattgcccacatttattagtattctgttttttaatttcaaaaaaaggaatacattcatacattcacaaggctcaaacataatctaaaaaggtatgcagtgaatgtcttactctaccctcattccacccatcccatagccacttttattaatttgcatgtccttttaatatttatttattcaaatacaatcaactatgaagatattcttatttttccccattcttacacaaaaggtagcatctgatacacacatttctgcaccttgatttctaacttaaaatatatatcataataatacaaatagttagcatttattgaacactcattgtatgccagtcatttttcaaacttttatccatatattaactcatttaatccttccagtactcctattattaacctcatttctccatggagaattttccttatcagtatataaagagcttcctcaatggcttacagctacatagtattccgttgtatgggtggatcataatttatgtaactaattgccttgtgagggacacgtgggtggcttctaattctttgctattgtggactgtgctgcagtgaatatattgtatggatatcatcttgttatgtgtagagatagagctgcagagcagatccaaagaaagaggattgctgggttaaatgcatttgtaattctgatgggtattgccaaattgccttctgtagagttattagttcttttcataattgcttagtatttctaattaaacgtagcattgatgagcactatgtatcagtctggctggctagtaggctctctgttggtggttccagaacaagttgatctcagtgtagtcccagatgagaccctttcttctggcctcaggtgggctgacttattccttttttttttttttttttttgagatggagtcttgctctgttggccaggctggagtacagtggtgcaattttggcttactgtaacctccacctcctgggttcaagcagttctcccacctcagcctcccaagtagctgggattacaggcgcacaccaccaagacttattcttatcactgccggtgagagtaaattacagcaatatttctggggaactaacagtattttccctggtaatatttgaagaagcagccttgtaatggttaagaacatggactctaagctggactgcctgggtttttatattttctttcgctgctgtaacaaactaccacaaatttaggggcttaaaacaatgtaaatgtattctgttatggttctggaggtaagaagtctgaaacaggtctcactgaggtatataaaggtgtcagcaggctttgctcctttgggaggctctcagggagaacgttttcttgcctttcccagcttctagaggctgcccacattccttggtgcatggcccctttctgtcttcaaagccggcaacatcacaacattcccacctctgcattcatcacatcacatctcctctcattctcctgcctccctgccctttcctttgaaaggattcacgtgattacgttgaacccacccagataatctagaataatctctttatctcaaagtccttaattgaataacacctgcaaagacccttttgccatagtaaggtgacatattcacaggtctcaggaatttgcacgtggacatctttagaggccactattctgctactacagtttgcatctagactctaccacttactaatcgtgtgatcttgaacaaattattttgcctcttgcaccagttttctcatccttaaaatggggataataatggtatctattccactggattgtcaggaggattgaatgagtaaatatttgccaatgcttataatagtatctgagacacaataaatgctatggaagtatctgctagctaaaatatattaaccaggccaggcacggtggctcacacctgtaatcccagcactttgggaggctggggcgggtggatcacctgaggtcgggagttcaagaccagcctgaccaacatggagaaacctcgtctctactaaaaatacaaaattagccggggtggtggcgcatgcttgtaatcccagctactcgggaggctgaggcaggagaattgcttgaacccgggaggcagaggttgcggtaagctgagatggtgccattgcactccagcctgggcaacaagagcgaaactccatctcaaaaaaaaaataaccaaataaaaatattaaaatacaaacactttgatctagcaggcctatatttataatctatttcataggaacaaaagcttccatgattaggctatataacttggatattactaaagtgttgtccatattggcaccaaaagaaaaaaaaaaggaaaggaaaacgaaagaaagaaaatgcacaaacaggaaattacctgaatgccagcaaaacgacagtgattgaatcaattgtggcccatctgggatataccagagctattaaagagaatacatctgatctgtgcctatgcacctagaggaatgctctgagtgaaagttcgttgagaggaggaagttcaaagtaattatatgacttgatttatttctttcttttttttgagacggagttttgctcttgttgcccaggctggagtgcaatggcaccatctgggctcaccgcagcctccgcctcccgggttcaagcaattctcctgcctcagcctcctgagtagctgggattacaggcatgcggcaacacacccggctaattttgtatttttagtagagacggggtttctccatgttggtcaggcaggtcttgaactcccgacctcaggtgatcctcccgccccggcctcccaaagtgctgggattacaggcgtgagccaccgcgcccggccgatttctttctttctttttttttgaacaaacatcagcccccaaaattattgtagatatctaggtcaatcatttaacatgttctgtttcttcctctgggaaatatgtataacgacaattctcactcaaggggctcttgcaaaggttaagtggcatggctgacatgtgtcaagtctgtaccatcctgcaagcagcagcccagtctggcatttgtgtaaggcggtttcagtggagagatgtgtggaagggtgcaccccacgatgctcacctggtgcttcctcggtggggaagggaaattcagaagtggtggaaagagatgattgtcgtttcgtatatctttgtattgtttcccggatgttgaaattgttactgtagtaactttttatactcatgtgttattggtagtttggatactatcaccataaccacaaacactgaattaggaaaagcagaaacctagaaacatgccatgattcaaagtctggtatttttggaagaggaatttaataacgaacgttttaagaggaaaaagtcaggagagtcctaacccaggccaaccttgtgtgtccacagcatctactgccgaggatgttccaagccgctgtgctgctcgtgcgcgctccttgacagcagccacagtgagctcaagtgcgacatcagcgcagagatccagcagcgacaggaggagctggacgccatgacgcaggcgctgcaggagcaggatagtgcctttggcgcggttcacgcgcagatgcacgcggccgtcggccagctgggccgcgcgcgtgccgagaccgaggagctgatccgcgagcgcgtgcgccaggtggtagctcacgtgcgggctcaggagcgcgagctgctggaggctgtggacgcgcggtaccagcgcgactacgaggagatggccagtcggctgggccgcctggatgctgtgctgcagcgcatccgcacgggcagcgcgctggtgcagaggatgaagtgctacgcctcggaccaggaggtgctggacatgcacggtttcctgcgccaggcgctctgccgcctgcgccaggaggagccccagagcctgcaagctgccgtgcgcaccgatggcttcgacgagttcaaggtgcgcctgcaggacctcagctcttgcatcacccaggggaaaggtaagcacgcacgccaccttcctgggcggcctgtgcctctgctgcaccctagggaaggcgagtcagaagagatcatctccatttgacagaaaagaaaactgggtgtttattcagtctttgggggttggtaaggtcttaggttccagggcacaggataagggggagatgaggccctgacaaagggctgcagccacccagaggggacacattttactaatttacaagactctgtggattgacctagcgatgactcatggggaacacgtgaaagttgaaaaactgcaaagctgagaatcagacccagtatcattttggcgccagagggaccaagcacttcaggaggttctcttaagccaccggtgtctcggaacagagaagtcaattgggacctggggttacggtagaagggggctaagaaaacctcctggggatggttggatgcttacccaaaaccatacagtggctcagtggaggagatcccttgtctgcaggatgacctgctgtctgccaacctttgcgcgccctgcctagtgttggacgcttgagaggtaaggagacacagactagtttctgatctcaaggagccagagccacttcacgtagctggagaatgagacagtgctcagctctgcaatccaaatccgggagatgtagcagctgtgtattagctggaacaggggggctttcaaaataaggggtagggggagtgtgccagagagtctccaggagtctttgactaaatctccaagctggaatgtgagctctgagcagctagtataggatgcccttactgggaaaggggagggaggctatggaatctgaaggcacctgggtagggtgccagtgacaaagagcttatttacttctcctggagctggacatgggtcatgaaggataatcttagagggcctggacctgtgccttctccacctaggtagtgaatgtcacccatattaaggaaatgaccccacagagtttacacagcttgccttgggtgttataactgggcaatagcagagagaagggttattttattctgaagcataagagatttagatttaataaaaaccaggctgcagataaggaagatcatggagctctcactatatgtagagagtcagtgagccggtagtgatggctttatgattgcgcacacttagccttgctgttggctcagagatggagagaggtacacttggggtttggagccaaaagcaagcactctaatgccacctccttttcccttctggctgggttcctgcccactgcattcgagagagctctccttccagctgcccctccagggagttgtccagtgctttgggatgccctggaaaataggtatcctggaaaagcaacagggacctcctctctatcactgtcccaggtcaggatgtcccttaccagcatgtccttgacctgcctgtgaccttctttgtgttctacagatgcagctgtatccaagaaagccagcccagaggctgccagcactcccagggaccctattgacgttgacctggtgagatgggtttgaggtctgaaggggtggtggtggggcccagcaggtcaggcaggttgtgagtcctgctgtccctgtgtgtgcagggagagcgtctgagtgagggacagcaagtggctggactggaaatttcagtgagaggaagtaaaggaagacattaaagaagggttggctggctagctggctctgactctaggctcctaaatgccaaagttgctcttgatgggccatgagccaggttcagtgggggttagatgtggggtagacagtcggccacagatcagggctgctgcagagggaattccagcattagatggcatattagtgccttccagccatgagaaactatggttgtcagatgtatggttagatatagggtcagcagtcctgagggatgtgcagatgtcctctcccctcctacaccctacccccaatgtgggagccttctcttggagtcagaataggtgggccttcccctgctctttccccacagatggttcttggaaaggaacggggaatggtgccaggagtcagatttcgatcccagttgcccgggttctgctggtgtgattccagggccaccatacatgtaacaaagcagactgtctcagggttcaaggtatccatgtcccatctaatgctggcattccttctgcagcacccctgacctgtggctgtccagctttcatgtacacatctccagggacaggaagcttgctcattctagaggcagctgctcccaactctggactgctctgacttagaaagtgcttttccgagtggaaatgcagtggtgtccctttgacttgccccctttggcattcacaagtatggctcctttccaccagaataagcatcctcggtttcttcctggacttggcatctggtctcttccctagcctagtcactcaggtttgcatgcgcctagcctatcaaggatctggcccaggactggccagtccttcatggacagcaggtcttctggtggtgggtaggggcctagcttttgccatggcatgacccataggagagagagagtgctgtaggttgaggcaatcaggagaggcttcctggaagagacaggacttaagagtctcagagttttagagccaggcaagagcatggagtctaaccccctttttttcacagaggacgaagctaagacccagaaaggatgtgacttacccaaggctacacacagcaaattaggggcaagattaaaagctgactctgttttttgtttgtttgtttgtttgttttttagatgaaggctcgctctgttgttcaggctggagtgtagtggcgtgatctcggctcactgcaccctccgcttccggggttcaagccattctcctgcctcagcctcccgagtagctgggactacaggcgcgcaccactacgcctggctaatttttgtattttttagtagagacggggtttcatcatattggccaggctggtcttgaactcctgacctcatgatctgcccgcctcggcctcccaaagtgctgggattacaggcgtgagccactgtgcccagcctaaaagctgactcttaactgccttgggtactgcattcctatatacacaacctcaagtaaaaagaggaattttttaatatatgtgtgcataatacaatcacatagtcagaaataaaaacatagaaagtgatcaatagtgtcttactcccactttagcccccagttcttatgcccatataactatcttttaaaaatttcttttgagacagtcttgctctgtcacccaggctggagtgcagtgacacaatctcggctcactgcaacttctgccccctgggttcaagcgattctcatgcctcagcctcctgagtagctgggattataggcacgcactaccacacccagctaattttttgcatttttaggagagatggggttttgctatgttagccaggatactctcaaactcctggcctcaagtgatctacccacctcagcctcccaaaagtgctgggattacaggcataagccaccgtgccccacctcttttttaaattcttatatatccttccagaatgtatgtaattacaagcaaatattattatagatatttgccttttgcattctgtgtttcacaaaggtaggataataccagatacacatggtatcataccagaattcttatcctatcaataggtagagagcttcccgatacctttttgcagctgcataatggaccattaaatggatatggcaggctttatttagccagttccttgttgctgcatatttaggttgttttgctattacaaacaatgctacaatgcatgatgtttgcaaataaataatataaaataataaggccaggtgtggtggctcacacctgcaaacccaggaccttgggacactgacgtgggcagattgcttgagcccaggaatttgagaccagcctcggcaacatggtgagaccctgtttctacaaaaagtgtaaaaatcagccaggtgtggtggcacatgcctataatcccaggtactcagcaggctaaggtgggaggatcacctgagcccagggagtttgaggttgcagtgagctgtgatcacaccactgcattgtagcgtgagtgacagagtgagaccctgtctcaaaaagcaaataaacaaataaaatcaaaataataatagggaaatgcccttggtccacagactcagctgtcttccagatgctagtcattggtgaatgaacaacaagagagcctgcactgtcttgtgtgaaggtctaggtattttgggtctttgtcttgataaaatcagaatagacgtggcctctcactatcagctaggaagcagtttgaacttggagtatcagagggttgctctttttgccaagcctctggcttcaatccttgcctggggatggcagtgctgctgagggaaggaagtggggaacactgtgagtgcaaggacaggtgaggcaggcacagacggctgtcccaagggaaagtgctccatcagctgtgccaggagagaagcagctcttgggtccgtgtttctgccttagaaggcaggagttgggcatctagctccagcactcatccctcttgaaactgctggtttgtttactttcattgcaactatatgcctggaagagatgaagagaaagctcaacaggcttcactaggattgtttgggtggggtggcagcagctcagatattttccctcctctgtttttcataggctttttgtaatcgtgttataatactttaatggaaaaaaataaatttattattttaaagctataaaaattataaatcagtcattatgatgtgtttttctctactgagccctctggtgtgttccctgttttattaacgtggatggagggtgtgtcagggaggttgggacagaggcagagaagaggccagcccggccttcggggagttcgtggcctgtctggaaagagggtcttttacataccagcagtttgcagagccagacacagaacgatagagcaggaccttttaaactcctttttcaaaaaaaaaaaaaaaatgtttaattttggtaaaatacacataatataaaatacatcatcttaaccatttcaaaatgttcagttcagtgtacactaagtgtacagttctttagcattgagtacattcacactgctgtgcagccattaccaccacccgttccagaaggattttcatcttcccaagctggaactctgttcctgttaaacagtcactccccatgctgcctccctcagccctggtgacccttgtctactttctgtctctatgattttcaatactctaggtacctcctataagtggaatcacacagtatttgtccttttgtgactggccactttcacttagtgcagtgttctcagggttcatccatgtagcatgtgtcagaatttcctttctttttaaagctgaataataatatcccattatgtgtatatgccacattttgttgatccattcgtctgttggacacttggcttgtttccattttttggctattgtgaatctgctactatgaacacgggtgtacagatatctccttgagaccttgctttcaattattttgcatgtttactcagaagtgggatcgctggatcatatggtaattctatttttaattttttttttgaggaatcaccatgctgttttccattttttattgcaccatttgacatttccaccagcaccgtgtaaaagtttcgacttctctacagcctcaccaacatttgttatattgtctctctctctttttttcttaaataatagtcattctaatgtgtgtgaggtgggttaaactcttttttgaccactatcctctattgaaaaaaaatatatattatatcttaacttatagtatatacatatgcacacacatactgtagctaaaggagttttataaaataggctgggtccagtggctcacgcctgtaatcctagcactttgggaggcggaggcaagtggatcacctgaggtcaggagttcaagaccagcctgaccaacatgatgaaacctcgtctcttctaaaaatacaaacattagccgggcgtgatggcaggcacctgtaatcccagctactcaggaggctgaggcaggagaatcacttgaacctgggaggcagaggttgcagtgagccaagattatgccactatactccagccggagcaacaagagcaagactctgcctcaaaaaaaaagaaagaaagaaaaaagttttacagaataaattatgattgttacatgggatgtactctgataatttctattctatactattatttttgacataaaaatgttggtcatgccccactaaattgctttcatggttggatccactaatgggtcacaagctgcagtttgaaaaccactggccttaagagtgactagactttcctagaggcctggcagagacagatcctgggagataatctgttctctctccttcccaagacaggctcacactctctaatccagagaggtcatcctccttctttttaaagatttggagaaaaagaaaggaaggaaggaagggaggagggaaggaggtcaatccatcatggccaatggtgtggagcccatgagaaggacccaccgcggggttctggtacctggcacacccaggagccagcactgtgctggggccatccctgccttaactcacatgcccagcagcctctgtcgggagcctccttgcccagccccagcttgcctgggtggttctcagaaggcccacacaggagggacagagcttgtccctgtgaggaaggtgtatccctgccactcactcattttcaataatcggtccagtggacgcttaaagttcacaaaagagagaaagatggtggggagggacataaaagactcatcaagtaaagaaaatgaagagcacgccggggcaggaagaggcctccatttcaagacactggatttggccaggtgtggtggctcatgcctgtaatcccagcactttgggaggccgaggcgggtggatcacctgaggtcaggagtttgagaccagcctggccaacatggtgaaaccccatctctactaaaaatacaaaaattagctgggcgtggggctgtgcgcctgtaatcctagctacttaggaggctaaggcaggagaatcgcttgaacccagaaagccgaggttgcagtgagccgagatagtgccactgcactccatctcctgggcaacagagcaagactctgtctcaaaacaaacaaacaaacaaacgaacaaaaaacactagattcaagtcaggccaggggtcccgaggtatgtgaccttgggaaatcacttcacctctctctgcctccgtttccttctctgaagattggcaataatcatagtacggtacctactttttttttaactataatttttatggcgataaaattcatataaaattcaccattttaactcttgaagtgtgcaatttagtggtatttattacattcataatattttttaaattttttaattttttttctttgcagctccagctcaaatgattaaatttttttctttttaattttcagagatgaggtcttgctatgttgcctaggtgggaggctcaggtgattctcccacctcagcctcctgtactttcataatcttgcacagccattgccacctatctagccccagaatatttttatgcccccaaaaggaaaccccttacccatgaagcagtcagtcccatttccccctcccccatctcctggcaaccaccaatctgctttctgtgtctatggatttatccattctgggcattgcatgtaaataggatcatacaatgtgtattttgtgtctggtttctttttttaaaaaaatttattattattattagtgtttgagacagagtctcactctgtgccccaggctggagtgcagtgacacaatctcggctcactgcaatgtctgcctcagggctcaagcgattctcatgcctcagcctcccaagtagctgggactacaggtgtgcaccaccacgtctggctggtgtctttcatttaatgtaatacattcaaggctcatccatgttgtacatctcagtcctcattgctttttatggctgaataatattccatcacgtggctataccacattttgtttattcagtcatcagttgatgcacatttagtttgttttaccttttggctattgtgagtagtgctgctctgaacattcacgtgcaagcttttgtttaaccgtctgttttcccttcttttgggtgcacacctggggtagaattgctaggtcatatggtaattctacatttaattttttaagaaactgcctctatttcattttgagataggtacatgaagcacttagcactgtgcctggcacagagtagtaataagaacaatatttatcatcatcaatgacattttctaagtgccaggtattttatattttacttgtattaacacatttcatccacattaccatatgaggtagatgttattattcccactttatagagggggactgaggcctgaggagttttaagcaattcatccaacttgtgtagtagctgacccaggtagagttaaggctgagagggcagaggcaaggtcccagggaggccagtttcagctcaatgggaggattttctcactgttaaaggagctgctttcgccagtagtgagcactttgtccctggaggtgtgtgtctaagtagggctaattactgagcatgtcctgagttgggcagtgtgattcctggggtatcttccagccctgttaggacacacaacaaccaaagtggtccctgggctccagtaactcagagtcagaaggaggtgatgccagtcgcggtggctcgtgcctgtaatcccagcactctgggagactgaaacaggagaattgctcaagcccaggagttcaagaccagcgtgggcaacatagtgagaccctgtctctacaaaaaaatttttttaaaaaaaggaggtgatgtgatggagagtttggaggacttcttgtccccagtgagctcggagctttgagtcagggagcctggacctgtgacttggtgaggccccagggattaggccaaccacaggtctggggtacctggccctggggctgctgcctagtcatttctgactcaattttcccaactttgcagcccgaggaggcagagagagtgaaggcccaggttcaggccctggggctggctgaagcccagcctatggctgtggtacagtcagtgcccggggcacaccccgtgccagtgtacgccttctccatcaaaggcccttcctatggagaggtaaggttctccccagccccagccttccctcctgaaggcctgagttccaccaggaaagtgagctggcactggggtgggaatccaggccttcatcagatcagctctttgtgggaaagtgtttgctcaacgccttctctgtgctctcccctgttcttggctgcatggtcagggagcttcccataagcatggcccactcccagcccagcaggggtgctgagacactcagggttgtcagaggccagcagagactggtggacagcagatagtaccagcttgggaaggcttcctgtctgaagagagacgtaatctgcgtggttgagagcagaggagaggggacagcaggagcaaaagggtggccacaagtccctggcagtcagggcaggctctgcccactcacccctgcaggcacctgacctggctctgtgactccctctatgcaggatgtctccaatacaacgacagcccagaagaggaagtgcagccagacccagtgccccaggaaggtcatcaagatggagtctgaggaggggaaggaggcaaggttggctcggagctccccggagcagcccaggcccagcacctccaaggcagtctcaccaccccacctggatggaccgcctagccccaggagccccgtcataggaagtgaggtcttcctgcccaacagcaaccacgtggccagtggcgccggggaggcaggtagggaggtgggtagggcagtggcctgggtgctgcccgccagggtctgggcggtgcccctcttctgtattttggccccatccagaaagcccaaagccaacaggagtcccttattcccactgaataagatagggaaagttcacagtgtgcgtgggggtgagagtggacacagtttaccatgtgttttgccatgattgaggtgtggggagcctgacaggctaaaatgcacagttctatgagtcctttctcccaaacactactgtgcctttgcacagggcaggtctccacaagaagtttgttggctgatgcctagcatactcccagagagggcttgggcataccataacaggaaactggactccccatgaccttaactctgctctctcagtctacacccatcatttccccaagtgtttctgcaaaggccacctacctaagtatctcatttgtcagagttatcttctatgaacactgccaggcaggtagtcagttgggcaggagttgaggtcaacccagaggaatctggaacaagagagttctaaggatctgcttcacccagagtacagctttgttcctcattctgactgagccctagccttggtcacacactgagcactgactgatattccttacccacaaatgctattggtaatcgatgggttttgattaactaaatgaagcgtcttttaactctagacatcccagctcatggagctgagaatggggacagtgtgcttctttaggattgcagaaggttccagaccaggtagcagttgtcaggcctcctgtacagggggcaaattctgaattctgggcagataacttaattgaatattcatagataaggcacagcaagaaattatggaaacccatttgtgaattactcaaatccaaatgcaaagcagagtcacattggcacacacagtggctgttcccgtccccctgcagggcatccgtttcccccagccgactggcctgcaaggattcccataggtgcacacccacacccctcccagcatgcatcctaggcagttcataatgcatctccccttccccgtttcagaggaacgcgttgtggtgatcagcagctcggaagactcagatgccgaaaactcggtgagtggcccagaagttcagcccaggactcctgcctccccccatttcaggtcccagggggcacagccacagcaggtgactctcagacttgccttgcgcctggggaattttccagtgaggcattgagtcccaagctgtgctgaggacagtctccaaatgacagctgcatgcctggaccaccccagccctcccactacaccagggccaggagctcttctgaaatgctgatagcatgtgtccagagccctgtctcttttctggaatgtccaagacctttgtctggagcttccttatgcattttctgtcctctaagtcctcagtgaggagggctggacaagaatccattccttggtttattacagccagtgggggccagtgaaggggtgtcaggccacagggcagctatataggggccaaacaagtgaggtttgactccatccatgtagaaagatatataaatccattccacagtgaaacaggtggcctcgtgggtagtgacccttctgtccctagaggtttattactagaggctggactatcacctgtccaggggaaaaggggatctgaatagagtgaaaggttggactgggtggcccctgaggtctcttccagccctcagtctgaggttctgtattggaaagtgcatggagcccatggagaccgccgagccacagtcctcgccagcccactcctcgccagcccactcctcgccagcccactcctcgccagtccagtctctgctgagagcacaaggagcctccagcctgccctgtggcacataccaccccccagcttggcctccccaccagcccgctgagcaggctgccacccccgatgctgagcctcacagcgagcctcctgatcaccaggagcgccctgccgtccaccgtgggatccgctacctgttgtacagagcacagagagccatccgccttcgccatgccctccgcttgcaccctcaattgcatcgggcccctattcggacttggtctccccatgtggtccaagccagcactcctgccatcacagggcccctcaaccatcctgccaatgcccaggaacatcctgcccagctgcaaaggggcatcagcccaccccaccggatacgaggggctgtgcgatcccgcagccgctccctccggggctcctcccatttatcccagtggctcaacaacttttttgccctccccttctcctccatggcttcccagcttgacatgtcttccgtggtgggggcaggggaaagcagagcccagactcttggagcaggtgttccccctggggactctgtcagaggctccatggaggcctctcaagtccaagtgcctctggaagcctctccaattacattcccaccaccctgtgccccagaaaggccccccatcagcccagtcccaggcgcccgtcaagcaggcctctgagagtgctacccttctcttgtaaccttgcagccaacacccctgcccggcccctgagctgcctcctccagcccatgctcttacaggccctgcacagagtagcactcattaattcttggttaaggaatgaatcaacgaatgaatggctatgcatggacctctgggcagggagacctgggtcttctctggctgagaggggaaggctaaggcatggctgagattcaagccaccattccaggcctctttgcccaagaaagaaacttctgtcacccttgcactctcctgtattctgagtccctggccaatagcacagccttccatgccccgacccccaccccaagcctctccactaggcctctgccaggatctaagcccatgagcacagggactggctatcccaagacctggcagatgtggctgctcaataaacacttgttgaaccatca

SEQ ID NO: 958 - DNA, 41723 bp, Homo sapiens; identical to SEQ ID NO: 957

SEQ ID NO: 959 - DNA, 116856 bp, Homo sapiens
cgccggcagtgcgtgtggtgaggcaggacatggcggaggcaggaaaagtgcccttgagcctcgggcttaccggaggagaagcggcagagtggcctctgcagcggtacgcccgctgcataccctcaaacaccagagacccacctgggccatgcctggaagctgggacagccccctgccccacatggaaggtgaggcccgaaggcaggaatatccctgaggtgcccacagccctcaggaggggaggctccgcgaatacactgggccagtgccccgaaagcaatgccgaggggacaccgagtgactgccaggcctgttggggaatggacaggccgacaactaagataggaaatacatacatagcagtaggagacatggttggaaccctttacagtctcaaaataattatgcaagggagtagtaaacattcatatattcaatgtgtatttattgagcgtcaagtatgtgctagactctattcagggtgctagggatggagcagtgagcaagatataaacgctccccacccttattgatgtttttagtttagtggaggatatactatttatccaaataactaattacagaagggacaactgagtcatcccgtaaccaagcattcacacaggactaaatttgaatcctcgcgttgccagtgaatttctgggaccttgctttagttacttaacctctctgtaccttatttactttgtcttaaaatagagataataatataatagtacaggccctcagaaatattgggattcggttccagaccatcacaataaagcaagttacgacctttttggcttctcagtgcatataaaacctgtgtttgcactgtactgtagtctattaacttgtctaaaacaattatgtctaaaagaacaacgtacccaccttgattcgagaatactttattgctaaaaaatgctaacactcacctgagccttcagcaggtcagtctttttgctgctggagggtcttgcttcatgctggtggctgctgactgatcagagtggtggtttcccaagattggggttgctgtggcaatttcttaaaataagacaacaatgcagtttgtcacatggattgcctctaactttcaggaaagattgctctgtagcatgcaatgctgtttaatggcatttttacccacagtagaactcctttcaaaattggagttaatcctctcacattttgctgctgctttatcaactaagtttatgtgatattctaaatactttgctgtcatttcagcaatgttcacggcatcttcaccaggagtagatgccatcttaggaaaccactttctttgctcatccataaaaagcaactcgtcatctcttcaagttttatcgtaaaattatagcaattcagtcccatcttcaggcttcacttccaattctagttctcttgctctttcaacacatctgcagtcccttcctccattgaaatcttgaactcctcaaaagtcatccgtgagggttggaatcaacttcttccaaattcctgttaatgttgatatgttgacctccgtccatgaatcacaaatgttcttaatggtatctagaatggtgaatccttttcagatgttttctattaactgcccagatccatcagaggaatcactatctacagaagctatagccttataaaatatatttcttaaataataagacttgaaagcagacaattactccttgatcatgggctgcagaatgaatgttgtgttagcaggcatgcaaacaacattcatctctttgtacatctctaaccaagctcttgggtgaccaggtgccttgtcaatgaacaataatattttgacaagaatctttttttctgaggagttggtctcaacagtgggcttaaaatattcagtaaaccatgctataaacaaatgtgctatcatccaggctttgttgttctatttatagagcacaggcagagtagatttagtacagttcctaagggccctaggactttcagaatggtaaatgagcattggcttcaatttagagtcaccagtgggattagcccctaatgcaagagtcagcctgccctttgaagctttgaagccaggcattgacttctcctctttagctatgaacgtcctagatggcctcttcttctaagaaaaggctgttttgaatacgttaaaaaatcagatcagactttggcttaagggaatgttgtgactggtttgatcttctatgcagaccattacaactttttccatttcagcaataaggctattccacttatcattcctgtgttcactggaatagcatttttaatttcctttaagaacttttcctttgcatttacaacctggctaactggcataagaggtctagcttttgacctattttggctttcaacatgccttcctcactaagcttaatcatttctagcttttcatttaaaatgagagatatgtgatttttcctttcaccttaacactttgaggccattgtagggttattagttggctggatttcaatattgttgtgtctcagaatagtgaggactgaggagagggagagagacagagcaaaggctggtggatggagcagttggaatatacataccatttattaagttcactgtcttctatgggcatggtttgtggcactccagaacaattacaatagtaacatcagagatcactgatcacagatcaccatcatatataataataataataatgaaaaagcttgaaatattgtgaaaattaccaaaatgtgatacagagacatgaagtgaacacatgctattagaaaaatggcactgagagacttgattgatgtggggttgccacaaaccttcaatgtgtaaaaaatgtaatatctgtgaagtgcaataaagcaaagtgcagtaaagggaagtgtgcctgtacctacttcataggattattttgaccattgcataagctaatacatgtcaatcacctaaaatagtgcctagtatatattaagttaggggtttgctcttattatcattttgttctagtggtatgctttaacaccatgggttgccagtcattcagttcccttttgtctggtttgactattggatgaggaacctgggattttggattatacacatacatgtacgtcacatgtgtgcacacatgcatacatgtttgtgtattttgggcagcagtagataggagaagaattaaagagaataaaggtcccaggtagctgggtgtggtggctcatgcctgtaatcccagcactttgggaggctgaggcaggcggatcacctgaggtcaggagtttgagaccagcctggccaacatggcaaaaccccgtctctacaaaaaatgcaaaaattagccgggtgtagtggtgcctgcctgcagtcccagctactcaggaggctgaggtgggagaatcacttgaacctgggaggctgaggttgcagtgagctgagatcgtggcactgcactccaacctgagtgacagagcaagactctgtctcaaaaaaaaaaaaaattcccacaacatgtacagaggccacaacatacctgaaaaaacctcagcatgtaatgtatagtgagaaggctagcaaatctggtgcttagagaataagggaaatggtagcttgagataagcctgtctgaagatgtaggcaggtgccttgtgaacattattataaatccagtgggaagccaccgaacagttttaagcagaggcattttcatctttgaaagatcactctggctgtggtgtgaagatggaattggaggggaatatgagtggattcagaaagatcatttagaatgctattgcagtgttataggcaagagatgatgatggcttagactcagggcatggcagtagagatagggatattgggaatatattttggagaccaaaatgaaaaggcttggtgattgattgtatatgggtggtgagagtaaaggacttctgggtttctagcagaagcaactgagtagatggttgaagaatgggaaacactggaggaggaacagtgagggaaaaatccaagatgtcagttttggatgtattgaatttcataagattgtgaagcatccaagtggagatactgaataggtggttgggtatattggtctagactcagaaggaagatctgggctagagatgtaaaggtgtgagtcatcagcataaaggtgatatttatagtcatgggattaggtgagattcgggaccaagcttaaacgtaatccaacatttgtaagttgggtagaggggacagagccccaaagaagactgataagaggcctggcacagtggcttatccctgtaatcccagcactttgggaggccaagatgggtggatcacttgaggtcagaagttcagaccagactggccaacatggtgaaacccgaggctacttgggaggctgaggcaggagaatcccttgagcctaggagacagaggttgcagtgagccaagattgtgccactgcactccagcctgggcaacagagtgagactctgtctcaaaataaataaataaataaataaataaataaataaataaataggaaaatacaacaagatagccgaataggaacagctccgatctgcagctcccagcaagatcaacacagaaggcgggtgatttctgcatttccaactgaggtacctggttcatctcattgggactggttggacagtgggtgcaggccatggggggtgagccgaagcagggtggggcatcacctcacctgggaagtacaagggttggggaatctccctcccccagccaagggaagccgtgagagactgtactgggaggaatggtgcacagatactgtgcttttcccatggtctttgcaatcagcaggccaggagattccctctggtgcctacaccaccgagggccctgggtttcaagcacaaaactgggtggccatttgggcagacactgagctagctgcaggagtttgtttgttttttttttttcacacgccagtggctactggaaagccagtgagacagaactgttcactcccctgaaaagggggctgaagccagggagccaagtggtctggctcagcgggtcccaccccaacagagcccagcaacctaagatccactggcttgcaattctcactgctagcacagcagtctgaggttgacctgggatgctgtatcttggtggggggaagggcatccgccattgctgaggcttgagtaggtggttttacccttacagtgtaaacaaagccaccaggaagtttgaactgggtggagcccaagacagctcagcaaggctgctgcagccacactgcctctctagattcctcctctctgggcagggcatctctgaaaaaaaggcagcagcccagtcagggacttatagataaaacccgcatctccctgggacagagcacctggaggaaggggtggctgtgggcacagcttcagcagacttaaatgtccctgcctgacagctctgaagagagcagtggatctcccagcatagtgttcgaactctgataaggaacagactgcctcctaaagtgggtccctgacctttgtgtctcctgactgggagacacctcccagtaggggccgacagacacctcatataggagagctctggctggcatctggggggtgcccctctgggacaaagcttccagagtaaggaacaggcagcagcctgttctgcagcctccgctggtgatacccaggcaaacagggtctggagtggacctccagcaaattccagcagacctgcagaagaggggcctgactgttagaaggaaaacaaacaaacagaaaggaatagtatcaacatcaacaaaaaggatgtctactcagagaccccacccaaaggtcaccaacatcaaagaccgaagatagataaatccacgaagatgaggagaaaccagtgcaaaaaggctgaaaattccaaaaaccagaaaacctcttcacctccaaaagatcacaacgcctcgccagcaagggaacaaaactggatggacaatgagtttgatgaactgacagaagcaggcttcagaaggtgggtaataacaaactcctctgagctaaaggagcatgttctaacccaatgcaaggaagctaagaactttgaaaaaaggttagatgaattgctaactagaataacctgtttagaaaagaacagaaatgacctgatggagctgaaaaacacagcacgagaacttcatgaagcatacacaagtatcagtagctgaattgatcaagcagaagaaaggatgtcagagactgaagatcaactcaaagaaataaagcaagaagacaaggttagagaaaagagtgaaaagaaacgaacaaagcctccaagaaatatgggactatgtgaaaagaccaaatctatgtatgattggtgtacctgaaagtgatggggagaatggaaccaagttggaaaacactcttcaggatattatccaggagaacttccccaatctagcaaggccggccaacattcaaattcaggaaatacagagaacaccagaaagatactcctcgagaagggcaaccctaagacatataatcgtcagatacacaccaaggttgaaatgaaggaaaaaatgttaagggcagccagagagaaaggttgggtaacccacaaagtgaagcccatcagactaatagcagatctttcggcagaacccctacaatccagaagaaagtgagggccagtattcaatattcttaaagagaagaattttcaatccagaatttcatatccagccaaactaagcttcataagcaaaggagaaataaaatcctttacagacaagcaaatgctgagagatcttgtcaccaccaggcctgccttacaagagctcctgaaggaagcactaaacatgaaccagtaccagccactgcaaaaacataccaaattgtaaagaccatcgatgctatgaagaaactgcatcaactaactggcaaaataaccagctaacatcataacgacaggatcaaattcatgcaacaatatgaaccttaaatgtaaatgggctaaatgccccaattaaaagacacagactggcaaattggataaagagtcaagacccatcagtgtgctgtattcaggagacccatctcacgtgcaaagatacacataggctcaaaataaagggatggaggaatatttaccaagcaaatggaaagaaaaaaaaaagcaggagttgcaatcctagtttctgataaaacagactttaaaccagcaaagataaaaagagacaagagcgttacataatggtaaagggatcaatgcaacaagaagagctaactatcctaaatatatatgcacccaatacaggagcacccagattcataaagcaagttcttagcgacctacaaagagacttagacttccacacaataatagtgggagactttaacaccccactgtcaatattagacagatcaatgagacggaaaattaacaaggatatccaggacttgaactcagctctggaccaagtgaacctaatagacatctacagaactctccaccccaaatcgagagaatatacattcttctcagcaccacatcacacttattctaaaattgaccacataattggaagtaaaacacttcttagcgaatgcaaaagaacggaaatcataacaaacaatctctcagtccacagtgcaataaaattagaactcaggattaagacactcactcaaaaccgcacaactacatggaaactgaacaacctgctcttgaatgactactgggtaaataaagaaatgaaggcagaaataaagatgttctttgaaagcaatgaaaacaaagacaaaacataccagaatctctgggacacctttaaagcagtgtgtagagggaaatttatagtactaaatgcccacaagagaaagcaggaaagacctaaggttggcaccctaacatcacaattaaaagaactagagaagcaagagcaaacaaattcaaaagctagcagaagacaagaagtaactaagatcagagcagaactgaaggagacagacacttgaaaaacccttcaaaagtcagtgaatctgggagctggttttttgaaaagatcaacaaaataggctgctagccagactaataaaaaagcaaaaggagtagaattaaatagatgcaataaaaaatgataaaggggctgtcatcactgatccctcagaaatgcaaactgccatcagagaatactataaacacctctacacaaataaactagaaaatctagaagaaatggataaattcctcaagacatacaccctcccaagactaaaccaggaagaagttgaatccctgaatagaccaataataagttctgaaattgaggcagtaatgaatagcctaccaactaaaaaaagtccagaaccagatggattcacagctgaattatactagaggtacaaagaggagctggtaccattccttgtgaaactattctaaacaatataaaaagagggaatcctccctaactcatttgacaaggccagcatcatcctgatatcaaaacctggcagagacacaacaaaaaaaacgaaaatttcaggccaatatccctgatgaacattgatgcgaaaatcctccataaaatgctggcaaaccaaattcagcagcacatcaaaaagcttatccaccacgatcaagtcagcttcatccctggcatgcaaggctggttcaatgtacacaaatcaataaatgtaatccatcacataaacagaaccaatgacaaaaaccacatgattatctcaatagatgcagaaaaggcctttgacaaaattcaacagcacttcatgctaaaaactcttaataaactaggtattgatagactgtatctccaaataataagggctatttatgataaacccacagccaatatcatactgaatgggcaaaaactggaagcgttccctttgataactggtacaagacaaggatgccctctctcaccacccctattcaccatagtattggaagttctggccagggcaatcgggcaagagaaagaaataaagggtattcagataggaaaagaggaagtcaaaatgtctctgtttgcagatgacatggttgtatatttagaaaacccaatcgtctcagcccaaaatctccttaagctgataagcaacttcagcaaagtctcaggatataaaatcagtgtgcaaaaatcacaagcattcctatacaccaataacagacaaacagagagccaaatcatgagtgaactcccattcagaattgctacaaagagaataaaatacctaggaatccaacttacaagggatgtgaaggacctcttcaaggagaactacaaaccacggctcaaggcaataagagaggacaaaaacaaatgggaaaacattccatgctcatggataggcagaatcaatatcatgaaaatggccattctgccccaagtaatttacagattcaatgctatccccatcaagctaccatgactttcttcacagaattggaaaaaactactttaaatttcatgtggaaccaaaaaagagcctgcatagccaagacaatcctaagcaaaaagaacaaagctggaggcatcagctacctgacttcaaactatactacaagtctacagtaaccaaaacagcatggtactggtaccaaaacagatatatagaccaatggaacagaacagaggcctcagaaataacaccacacatctacaaccatctgatctttgacaaacctgacaaaaacaagcaatgggaaaaggattccctatttaataaatggtgttgggaaaactggctagccatatgcagaaagctgaaactggatcccttccttacatcttatacaaaaatcaactcaagatggattaaagacttaaatataagacctaaaacgatgaaaaccctagaagaagacctaggcaataccattcaggacataggcatgggcaaagacttcatgactaaaacaccaaaagcaatggcaacaaaagccaaaattgacaaatgggatctaattaaactaaagagcttctgcacagcaaaagaaactatcatcagagtgaacaggcaatctacagtatgggagaaaacttttgcaatctatccagctgacagagggctaatatccagaatctacaaagaatttaaacaaatttacaagaaaaagtcaaccccatcaaaaagtgggcgaaggatatgtacaaaagaagacatttatgcagccaacaaatatatgtaaaaaagctcgtcatcactggtcattagagcaatgcaaatgaaaaccacaatgagataccatctcatgcctgttagaatgatgatcattaaaaagtcaggaaacaacaggtgctggagaggatgtggagaaataggaacgcttttatactgtttgtaagagtgtaaattagttcaaccattgtggaagacagtgtggcaattcctcaaggatctagaactagaaataccatttgacccagcaatcccattgctgggtatatacccaaaggattataaatcattctgctataaagacacatgcacatgtatgtttattgcagcactgttcacaatagcaaagacttggaaccaacccaaatgcccatcaatgatagactggataaagaaaatgtggcacatatacatcatggaatactatgcagccataaaaaaggatgagttcatgtcctttgcagggacatggatgaagctggaaaccatcattctcagcaaactaacacaagaacagaaaaccaaacactgcatgttctcactaataagtgggaattgaacaatgagaacacatggacatgggtggggggcatcacacaccggggtctgtaggggagtggggggctgggggagggatagcattaggataaatacctaatgtagaccacaggttaatgggtgcagcaaaccaccatagcacgtgtatacctatgtaacaaacctgcacattctgcacatgtaccccagaacttaaagtataataaagaaaacacaaacaaaaataaattaaataaataaataaataaaagattgacaagggacagagagttgagaagcacccaagagaatggaggtttatcagtgctaaagagagttatttccaggggaaagagtgattgattaactttgttgaatgatgctgcaaaatgaagaaacatgatgactaagggatatctattccattcagcagtgtgaacgtccttaatggtctttaccaagagaaatttaagtggagtgaagggagtggaagccagataggagtagggtaaagaatggctgatgggtgaggaagtgtagccaatgtgcacagacagttcttctgagaggcttggctgtgagtatgattagagaaagggcacaatgaattattcaccacattctagaatattagagccaggggcactccttcaagattgaaatcagtatatctaggaccataaaaaagacattaaattcctagttgtactgttctgaaaccctgtatcctgagaaatgatataggctgaaatacaaaatgaggtgaagaagagttaaatataaggatgactgacctataattggatcttataaaaagctgggaatgtttggtgacatatttaatttttgagactgctccacaggttccttgataccttctcataaaacactttaaaccctttctcctaaagcatctgtgttgggtgcagctgaataattcttaaattcttatcctgcaacccagaggccaggacatttgaccattctaaggagttgattgttattacaatttttttacttctctttgcaaagctcttcataattgcttataaggaacagtgcttttaacagttttcaaatgtttggcataaagccacagctacagtgacaagagatgaggttggcttttgcagtggttttgaaaactgaacatttgtaccttcctttgaatctgtgccgaaccatcctacccgctgtgatcagtttcagcctaggtctgtcattttttttttggaaaaaacgaaagagaaaacaagatttgttctattttatgggcactgggactattgtgcagtaataataataaaagatgagccatctaaagaactgtactctctaagtctcatgtgaattttttattttaaaaatatgtggtacctgcagtaaaaaaagaggttaggtaaagcataaaaatatattattgtggaggatagagtcattctagttgttttttctttagggaactttcagattcaatcttggttgaacctattttgagttctttgattttttctgattataggagaatctgttctcctggtactgttctctatagctgtttaattacagagaaaactttcatcacaatggctctatatgctgagacaaaaatgtcaactcaagagaaaaaatgaatagtacaacaagactcctaagactcgaagtcctagttgagagggaagatcaattctgagacagaaagaatgttatgtataaaatatctaatatattttatagaataatatgcttcattatgtatactgatttgatttacttctttgaactgaattaatcttgttaaaagacactgtctagagataaacacaattcggaagcaaataaactttgtaaaacacgcatgcacactgaaaacccaatggtttagagctgtgctacccagaccttaatgtgcatagaaatcatctgagggttttgttaaaaatgcaaattctgactcagtcagaataggtctggtatggggaatgagattctagttctaacaagctcccaggtgacacagatgctgttggttcaaggaccacactttgagaggcaggggtttagaatatcttgaatgaaatgatagccatatagtaaaattgataaaatgaatttatagagttatgaggtaaggcaatcagattcataatgactgtgcaaatgttttattaatagggttaatatttaagccatctgtcgtcatttaagtggaatgagcaaatgttagttccttagatctgttggctcagcctttctgaaaagatataataacagattggtccattttatgtattttatgtctgaatataatttagtctactaataagtagactaatttgaaaggtgatgttaattgcaggttgcttttaaagttttaccatgtttttcagatttcaaggatttctcagacatgccctaattggttgaacctgacaacttcttagactttttttttttcctttcaaagggaaaaaaatcctttttttataggaggaacttaaaataattgccctacttagaaattaagaaatagaatgtgaagtttgtacttgaaatgaacttttaaatgtggattcaacataagatatattttggatcttctcaacagtgttcttttttctttcatattcctagtgcctacataataccaagtatatgatagatgctcagtaaatgtttgaatgtatggtgtggtaattttccttatgataatgtgttaattattaaatgatagctattatttatcatttgctttggtgtattttttacaagagccctatgaagcaaatattattatacccattttatagataagtgaactgaaactcaggttcagtggctttcccaggaacacaaagataagttgaaaagaaagaatttagacactccttttcttgtctgtaaaatctgtgcttctaagctctatgctgtttgccttaaaactgttaatatcttatatggaatgtagcaattcaattatgtggatgaagaattttgagattaacacacaggataaaaataacaaaaataacagttttttaatttgtttttaaggaaaatttaaaatagtaaaatagttctttgtatgcttgataattttttattgcaggcctaatgttgtgaattttactttgttgggtacagggtatctttgtatttctgtatttctgagcttttttttttttttttttttttccagataagttatttggaaacagtttgatcctttcaagttttgcttttaagctttgtcagctgggacaagagtggctgggactagggctaatttttcccacttctgaggcaaagctcttgaatattctactcaatgtaaattgttttctctactaagaacaggcactattccctgtcctgtgtgagctctggggattattcccttaaattctttcaggtggtcctttccccaccctctggcagtttccttacgcatatatatatgttgatcagtactcagctgaagcagaggaggaggttctgcaagtgtctggagttcttcccttcgtacaggtctctcttctctggtgttttgtcttgcaaactgtagctgcactgacctcctaggactcgaagcttcatctcctcaactcaattatcaccaggctctgcctgggtttatcatccttgcactctgacctggaaactcgtgccaagaagtaacctggggcagtggtaagggctcacttccttcattttctgtcatttctcaggaattaacatcctttattacgtgatacctattgacttgagagctgttgcttcctttgatttgttcagttttttatttcatttaggaggtatgaaataacctgttaaggaggtacttgttaattcccgttggccagaagaggaagtctatagtgagtcttttgattcagttccactttgtttttctactgcaggtcatcaaacaaagcattattaaattatctgctaagtacttgacattcaactaggcattagagattctatggaactgtgtgcttcacacagtcttaaaatgttatgttacttgagtacaggattacaaggataggtggggcttgatcactggagccaagattcctcctggtgagcagacaactttcatcagtcttttggggtgcttcttgaaaatgcagcttcattgttcctgtgctaggcctactgaatcaacttctggggtggctctctaattgattctatgagttgtaatcagtcttcatggcccaattctgaagaaagggtggtagggaagaggggacaattcactaagtggtactgatactatatggaactttcaatttacaaagtattttcataaacctttttccatttaattctcacattaagacttcctgggtctcattaccatcttatagacaaaaagctgaggcctaattagggtaaatagtttgccaaagggtaacataggaagtggaagaacgaattctaaaactcaggttttcctcaagccattgcttcttctgccatacaccgacacttactgcattagttatcttctcatatgcagatgtaggagtatcatcaagagttattatcctttcatgtagcatgctttttttgaagagttaacaggtaacattttgtattaggattaagataggctctgagtgacatataacagtggattaaataagatgaaagtttatgattttccgcataaaagtccacagctggtgtggcactatagtgataggtactgaggctccttctttgttctctgctgtgcatggccatggtctcacagtctgagatagaatcagtatcctagacagcttgtggaggaggggataaagaaatggacaaaggtatatgattgctgtctcttaaggaagtttcctgtaagccaccatgacactttcctagagcacagtggccagaacttagacctgtggccatcctagctgcacgggcagctggtatatatggtctgtattccacaagttcatatgtctagctaaaaaaactaagggttctattaccccataagaaggaaaaatggatattggagggtaactggcagtctgccacacagttctcttctgatctagagactgctaagaaatgaagacttattctttgagcccctggttggaataacaaaaacaactacttaatgagtaattattgtatgttaatacctagaacactgcttggcagatgcccccaaaatattaattgaaggaatgaaggccagacattctgctaagcatctgatctcacataccatttaatctttcagatgatcctataaggtagtattacaatttttattttacattttacagatgcggtaattaaatatactttttcttttttctttttttttttttggagacagagtctcactctggcactcagactggagtacagtggtgcaatcttggtttaccacaatctccacctcgcagggtcaagcgattctcctgccccagcctcctgagtagctgagattacagttgcctgccactaccgcccggctaatttttgtgtttttttcagtagagacggtttcaccatgctggccaggctgtttttgagctcctgacctcagatgatccacccgccttagcctcccaaagtgttgggattacaggcatgagccaccgcgcccggccctaattaaatatgcttctaaatggcaaaactggaatttgatcctagctgtaattccagatattgtcttttataaagtagtagtcattagtgctgttcaccaaatatgctcagattgtatattcctggcctcttgaagttaagttttttatatgactggttttggccaatgaaatgtgagcagaaccaactgtcatgggcagaagctttaagaaccagtgcatgattcatcttattctttttctttgccagtgttgcagatattggcttctctcttagcctaggtcctacagtgaaaacataggcagtgtgaggtagagtgtgaagacaggtagaataagggtggataggtaatgtaagtgagaaacctttgcttttgggggttaatttctgcagcatactgtaagctacacctgactgatatggaaatttttttttcttttggttatgtttaattgaattatgtcatgtacattgtagagtgcatgggcttttgaggaagaaccttataactgatgttctaacattttttttctatgacaaaattattagttgttctaaagcattagtttataaatgtttccaacttgggaccagtctttgttctctttcttcagtaaacaaaatcttaattttattgtgtaacagacatagttttcatagaggctatggattgtttatgaaacatgatttaaggtagaatttatttggacaaataactgaagtttttttcagcttagtggtttaaggagtctaagaagttacagtttagaatgaggcccaagagtattaaaattcattcatttttaggatttattctttatccactatgtgccagacactatgcaaggctctgtttagagatggttaaagcatctctacttaaagagctagccaattaagctcaagtacctgcttatttcaatataggtgtttttgacttcacaaatgacagcactgtatctgagaaataaagtaaggtgtttccttaactcaaatttgaaatataatttgattactggaactgttatgagcttaagtgtgctttgtgaatgaatagaagagcatgcctatgaagataccaaaggtgagtgagagttgcagagacctaggataggtttgataatgggaagtaccactttctggtatagttagtgattttatcagatttagtagtctgggaaatgtttaaaggatactttaaacatgtgggagaaatgttgtgggagtatttgttatagaaataaccagagtggccttgactggtaatttcaaagacataaggaacttattcttctgttacatggaaagtgttttgagtaaatgtagtctatttatggctactgataattcttctgttacatggaaagtgttttgagtaaatgtagtctatttatggctactgatagaggtgatgaagttaattctagtaattgggtttaaaaagactggataatttcatgatcaataatcttagggatatgtggtaaaaggggaattacatctcatgctttgatacatgagataatttttgtacattgtaaaagaaaaagttctctatatatatgattacttttttggtggtggggaaggtctgcgtgttattgctattgttttttttttattgttacagttaaaactttgtatttctgtgaaacaccaaaaaatgctgaattttattgtctggtaattggtatttggcaggaccacttttattagcataatacactctacaagtttgttgaaataatttatgagactcttgctaccaagagtcagtgggaaggcagttgatagcctacttagcaattttgcacacttttcatattttatagtgcataaaatagcaacttgagccaatatataaagctgtgacactttttgaggggtcttaaaagcagaaaacaaaacccctgatctagtacataatttaattcatcacaatctgaataatactattttcacctttcatgtagatataatttagggtaagcacatttggaatacttttctgtattttcatactcttttgacttttttctacctgatgttagatttttcttatagtactgacttgcacaaacacatgcatgtaaattttgagaagattctctgtttaaccaatatataggttgtgctattgttatttaactgatgtataagcttgtgatagggaggttccaaataaagctgtgtgtgctgctgtgttgatggcaacatactgccataggcggaggtcatattgatgtcaatgttaagctacgtttagattggcaactggaacgaagagaagatgtaaactttatgtatgttctctgtgaccccttaacattaatgtcttctgttatgatttggtcattagagataacatttttctttttctttttcttttcttttttttttttttttttttttttttaaagacagagtcttactctgtcacccaggctggagtgcggtggtgcgatctcggctcactgcaacctctgccgcccgagttcaagcgattttcctgcctcggcctccttagtagctgggattacaggcacctaccaccatgcccggctaatttttgtattttttgtagagatggggtttcaccatcttggccaggctggtctggaactcctgaccttgtgatccacccacctcagcctcccaaaattctgggattacaggtgtgagccatcgtgcccagccaacatttttctttaagctttccatattgtgttaatgtgaacatgccagtagtataaagttatcagtcattaaaggtatttcccaagggccagaaataagcaatttttttttctcagatacctggattatgttaggtgttatgatattggaatgtctcggtagaattaggacattatattcaaatcctaaatacagtatcgttgtcctttgtggtaagctgaatgcttttcttaaccttgattctacctagtcgacaaagaacatggaagcctctaacaacttgtattctaaagcatttcaaacataatcaaaggtagacagaataatatagtgatacacgtatgcatcatctagctttaagaattaccaactcgggccaggtgcggtggctcacgcctgtaatcccagcactttgggaggccgaggcaggcggatcatgaggtcaggagattgagaccatcctggctaacacggtgaaaccgcatctccactaaaaatacaaaaaattagccgggcatggtagcgggcacctgtagtcacagctactccagaggctgaggcaggagaatggcgtggacctgggaggcggagcttgccctgagccgagatcgtgccattgcactccagcctgggcaacagagtgagactccgtctcaaaaaaaaaaaaaaaaaaaaaaattaccacttacagctagtctaatttcatctacaccctatccacttccttctcatcatgttattttgaagcaaatcccagacatgatatcatttcatcagtaattatttcggttcatatctctaaaagaaaaaggactttaaaaaagcataaccataataccccaaaattaacaatttcataatattatcagtgttcaaatttcaagtagtcttacaagtgtcataattcttttaaacatggccaaaaattgtgattgattggtgtatcttttaatttttaggtttctctgcagtatttccttgacctcacctctctctcttccttgcggtttaagaaatcaggttgttctacagagtttctcagtctggattttgctgaccgccatctctgtggtgcagtttaatgtgatcctttgtgctctgtatttcttgtgaactggtcattgaatctagaggctttgtcaaattcaggttggattttcttgtattttctttatatatcatctagaatatttctgtaaagaaaaacatccccttatctattagaggttacccggtggttggtttttatagcagagctaggataaattcttgatgttttctcttcatttaccacttaaaaaatgagttaagctgggcgctgtgcttcacacctgtaattctagcactttgggaggcccaggtgggtgaatcacttgaggtcaagaatttgagaccagcttggccaacatagtgaaaccccatctctactaaaaatacaaaacttagctgggtatggtggcgcatgcctgtagtcccagctacttgggatgctgaggcaggagaatcacttgaacccacgagacagaggtttcagtgagccaagatcgtgccactgcactccagcctgggtgacaggaaaaggaaaaaaaaaaaagagttggttccctagactccttcggtgttggaggatgtttttgtttttaactagaagcttttaagatcttcttctatccatggaattcaggaatttaatcaggatatgtctagttattgattttttaaaacccccatccccattaatgcctggaacttaaaccgtttgtatcttcagtctcacttctttctgcagttgtagaatatttcattctattattttttcaatcagttcctttcctcagtctttttttctccctctactttagaccctctcactaacattttttctcctggatctgaatctttgctccgtgtatcttgttacacatgatttctttctcctagttttgctctatttttctcctgcttgctcttttaaactattaatttggcctcaatagtgtccatccaattcttcaattagctattgaaatttgtattcataaaatagttttagcttcaagattctcaagtgtgaataataattatatttatcattatttaataagaaatacagaaatatatatttattattattacagttattatttagttcaagctgttgtcagtctcctctagcagcttgttcccccgggagcctcgtgttttgggttttctgttgttcttcattgctttagcccattgggtatgtagctattttcctttgtctaacttatgggtcttttcactcctgggtgtcatctccaagagtggacactttaaggtgctgagtgttgggagatgcagaagtcacagtgctgtgggcctcctgtagagaagtaggaaggattgagttaagttggccaactcctttgtgactccttggaggttgagagaccgctaggaacttcagagcacatagtctggtctgcccatcttcatgaggtccaccaatttctagggactaggctctctcacaagaactgcagcattgtctttgcctcagggctccttgcttagtacctcctttctcctgtagggggaaaacgtcctactagctctttttttgtggaccctgagacctcaatccacccttctggctgtcttggatgatgtgttttttgtttgtttgtttgtttgttttgagatggagtctcactgtgttgcccagtctggagtgcaatattgcaatctcagctcactgcaacctctgcctcccaggttcaagagattcacctgcctcagcctcctgagtagctgggattacaggtacccaccaccacgcccagctaatttttgtatttttagtagagacagggttttgccatcttggccagactggtttcaaactcctgacctcatgtgatctgcctgcttcggcctcccaaagtgctgggcttacaggtgtgagtcactgtcccctgccagatgctggtcttaataattgcttaaggaaaggtaaatggcatttggattggatttggaaagagaagacttcagggatgcaatgaagctaccattttttcttgaaccccttggaagttcttaaaatggatattttctaactatatgagcacattatgtagaccttttggatgagggattgcaacagacatctgaaaaatcataagcctggaattctcctcccccagctacctggttaactttcatacctttggtctttgctcaagcctcaccttctcagatgcctaccttaacctctctatttatattgtaacatctgtgtcctgtctttgcactttgattccacttgtcctgctctatttcttccctagctcttagcattatctcatatactagataatttttttatttgctatgttcagtgatgtgcctagaacatctgacacctagaatgaatatttttttaacatcttcttcccctgaatgataaaattattttctgaaataatcaagttaaatgaaaaatattatgcagcggacattctctcttactgagttttgttataataattatgccaaataaataggaaaaatacagtataaggcaggaaaaaaaatccacaactatttagcccattgtttttattttattttatattgtgttattttattttattttgagacggagtctcgctctgtcacccaggctggagtgcagtggcgcgatctcagctcattgcaacctctgccttccgggttcaagcgattcttctgcctcagcttcctgagtagctgggactacaggtgcacaccaccacgcctggctaattttttcatttttttagtagagacggggtttcaccagttggtcaggctggtctcaatctcctgacctcatgatctgcccacctcggcctcccaaagtgctgggattacaggcatgagccaccgcacccggccaccaattgtttttatatctagttaactgtttgaacttggattctgcagttacagactgatattttatgaaattgttcattaactaataagtgaagtttttttaagtaaaattaagcatttccgactgggttcggtggtgcatgcctgtaatcccaacactttgggagtctgaggcaggtggatcacgaggtcaggagtttgagaccagcctggccaacatggtgaaaccccatctctaccaaaaatacaaaaaattagccaagtgtggtggtatgcacctgtaatcctagctactcaggaggctgaggcaggagaatcacttgaacctgggaggcagaggttgcagtgagccaagatggtgccattgcactctagcctgggtgacagagcaagactcccgctgggggaaggaaaacaacaacaacaaaaacctaagcatttccaaaaggtacaatttacgcaactattaataaaattgttgatatgttttatcccctcttaacgttctttagtttcaaaacacttaatttgaagagaataaatttcaatgttaaagatattgttcaaatttagtaaaatattttgtgaactaaaatttgcacttattaaataagttacatcttgctatttacacttgcaacagtgttttaaattttagacaaataccaaaaggtcccataaaaatgacagaattggagtgcctcaagttgtttcttggtctttacaatcactgtgctatctttgttttattttgaatctatcatttaaatgcacaagaatgtagtaccacagggagggaaaagccaactgcatcctaagaaagggttggattaagaacttcatgttaagcagtcttcaggtttaagaaagcctggtgcactgcttttgaaacaagtgtatgtgcctaagtttgcatggatgggggttagctgtaactgggagtttccccaatgaacttatatgtagacaacaatttaagaataaataacaaatctgatattttgaagcttacatatatattatttaaactcagcagtaactgcagtaattatttggaacttagaccaacaaaatgtttttttcaggaaggagtatttttatcactgacattgattagaattactggcacatggtggtaataaactgattttagtcagctttttaattgtttataaattctctacagaccaagcattgctttattgccagcacctgcagtgtactgctcccaacatcccacctttggtatgtcactaattatatttgttgtgtattgtctgtactcttgctctgcatcaccatttcacacttgctccattaggattaggatctgtgttttgttcagtgatactgcaatcatatatttgttgaatgaagaattaatgaagttcaagttcagagactttctatgtcttttttcttctccatattataagagggatcagtacatagtggatactttgctattgttaactcactgacttaaatgcttggcatatagtctctttggactcttgcatttcttgaaaaatttggaattttgattgggattggatagatcaacttggagaattagtgtctgtactaatttcttagtgctgctgtaacaagctataaacttagtggcttaaaacaacgcaaacattagcttatagttctagaggtcagaaatttgaaatgggtttattgagctaaaatcaaagtgtcaggaggactgcattccttctggaggctcaagaatctttttttttttttcctggccttctctaacacgtagaggttgcctgcattccttagtttgttacccaccttccatcctcaatgccagcaatcacattccttctgactctttctgcctccctctttctcttgtaaggatgcttctgattacaataggttcacctggataattcagggctatccctccagctcaagatattttaacttaatcacatatgcaaaatccctttgctatgtaagataacatattacaggttccgggtattaggacatagacatctttagggggaccgttgttctgcctattacagcattttaataatattaaatcttcctatctgtgaacaaaatatttctctccatatatttaagtgttcttaaatttctctcaattttcaatgtgctggtcttcttttgtcatatttatcccttagtattttatatttttgatgttgtaaattttgatgcttttaaaatttcaggttctagttcttcattagtgtatgtaaatgcaattggtttttatttattgatcttctattctgtaacctttctaaaattcacttattctagtaaaatcaactggattttctacatagatgatcatgttgtctgtgaataaagacagttttacttctttccaatctggatgctttttcattctttttcctgtctgattacagtggtaagaacttgcggtaacaatgttgaatagaagtggtgaaagtggacatcttgtcttgtttcttatcttagggagaaagctttcagtatgaagttagctgtagttttttttttttttttaatagatgccctttatcagcttgaggaagttacttctattcctggtttgctgagttttaaaatcaggaatagatgttggattttgtcaaatgttttttctgcattctctcatattgaggtgatcatatggtttttcttttttaatatgttaacatggtgaataactttgagttcacaatatttctgatttcccttttaatttcttatttacccatgagtaaataagaatatttggggctttttttcagagacctgtttttgatttctaatttaattcatctgtgctcaggtaacattctcttaaatcaaccagaacttgttctgtggcttagaatatagtctttgtgaatgctctgtgtatacttgagaagaatgtgttttgtgttggtgttagatggagtgttcaataaatgtcgatcaatcatgttggttgacagttgctcaagtctgctatatacttggtgatttgctatgtgctttttctatcagttattgagagaggggtattaaaatctgactgtaattgtgaacttgtctgtttccccttacagttctatcacttactgcttcgtgtatttttaagctctgtattggaggaatacatgtttgggatgattatctttcttgattaattgacccttttattatttgaaatgaccttctttgtaaccttttgatattcttgtctaatattaataaaaccactccagtttttattttttatttttatctttttagtgaaagagtctcactctgttacccaggcctctgggtgcagtgtgcagagtgcagtggtgcaatcatagcttacagcagcctcgaactcctgagctcaagtgatccttctgcttcagcctcccaagcagctgggactacaggcgtgtaccaccgtgcctggctaatttttacattttctgtagagatcaagtcttgccatgttgcccaggctgatctcaaattcctggccttaggcaagccttagactcttttttttttttttttttttttaagactccgtctccctcctttgcccaggctggagtgcagtggcgcgatcttggctcactgcaagctccacctcctgggttcacgccattctcctgcctcagcctcccgagtagctgggactacaggtgcccgccaccatgcccggctaattttttgtatttttagtagagatggggtttcactgtgttagccagggcaagcctgtgctgagattgtaggagtgagccactgtgcctggccttactctagcttttgactagcattagcttggtatatattttttctatccttttgtttttaacctgtttgtttttatatttaaagtgcatttcttgtaggcagcatatagcttgttttgtcttttttatccaatctgacaacctctgcctttaattgaggtgtttacatttaaatgtactattatatttaatatgattattgatagggttgggtttcagtctgttatcttgctatttgttttataattttcccatctgttctttgttcccttttaattttgatcttgcctttcgtttggataaattgaatattgtttatcaatataatcccatttatcagttatcttttaaagatatttaggtaaaatttttatgcatttgcccatgtaattattatttcctgcactcttcattcttttgtggagatcttagtttttatctgataacattttctttcttcctgaaggacttcctttcacatttctttcagtgcagatctgctggtgatgaattctttctgaagacatctttatttcctttgaaaattttgcatcttaatatggtgccttcatttaaaagttcttatttacttaaccatccaacaaaatattgggtgtctattgtgtgccaggtactatcctaggcatttgaatataacagtgtccaaaacggggaaaaaaaaatctctatcttcatggagcttaatttctgctcagggaagactagtaacaagtaaatataacaaagtggtaagagctatggataaaaataaagctggagaagggaataggagtagtgtggtttagataacatgggggagttttcagatggatggttaggaaaagttttacctgaaaacatgatatttaagctaaggtttgaagatggagtgagtcgtggtatctagaagaagagaatttcagatagaacagcaattgtagaagccctgaggtttataataatcagtgtgcctagtgggttcagggagcaggaaggaggctagtgtggctgatgagagtgcacagtaggtgggtgctacaggacaagagcagagaggcagtggagggcctagaccgtggagtgcgttgcaggagcttctgaatgagatagggagctattgcagggctgtaagctggaaatgacatgatctgacttatatttttaaaggatcactctggctactgtattgagaataaactctgtgttggagaagggaagcaagaacagaaattgaaaagccagttaggagattattataataatccaactagagagaatgataatttagacaagacctataagaagtggttgaattatggatattttgaagatagacatgaaggatttgctgatggattggatatgggtgtgagaaaaggagtcaagaatgattccatggtttagccaaagaaatggaaggaaagaattaatttcttaagtgttgcatatagaaacctgaaaaagaagaaaattattttctgaggtgaaaatgttgtgatgtcaaatgtctacaacagcctagcacagggtaggtactttgtaaatagtgaatgagaaggttaggagttcaagttaggggctgttaattttgagataactattaaacctttacatggagatgttgattgggtgattaaatgtagcaatttggagggcaagagagtagtctaaactggggctctcctggaagttgttggctatgatttgaaaaaaaaataatttgggaaaaatagaaatctttatagtgagtgtttctatccaacaagagacatatgtaagaatgttcataacagtattatttgtagtgaacctaaactggaaaaaatacccatcagcaaacaaacaaacaaacaaaaaaagggtggtatcatcatagaaggtattcaagaatcatgaaaatgaatacacatgcaacaacattgatggagccaaatgtcaaataattctttatgattccactcatataattaaaactaaagtatagtgttagaagtcaggatgggagattattttaagggaaaaagaagcagatagtgattttaagacagcaaacactagaggaccttctggaaatctggtaatgttctatttcttcatctgggtgatgtatttgctttgtcattgttcattgagctgtacacttatatttcggatgctttttggtatatatgttacatttcttaaaacaaaacattaaactatcatgttaacacattgccttccaaataattcattgaccagactgtagttgtgaaagctgtacttgactcctagctatgcttctggttctaactagtcattaaaacacacaggataattcatttaaactgtgacaagaagagtgttgtgccactgaccaagttccaaatactgggaaagagggagaattacaaccactgaaggaattagtgcaggtcttattgtatcccctttgatatctaaaatgttattcactttttaagtttggaatttaaaatgaattagagaaaacacagtagaaatcttggatttaaatatagcattaaaactccaaaccccacgtatgaaactataagagcattgttagtagaatgcagtaacctcataaaaacatatctaagttgaattaggtatgtgttaattattttgaactttgggcattaagatgagtctataacatcttattgtttatgtaaggatgtttaccttacggtgtttattaaggatatgaaagccacctatatagtatagtcacttaagacccagatcccactctaatgtatctatcagtcatgtccttccctgacattttgatttaatttcttcggttcctcactatatctcgataggttggaactatagatccaatctaacaagataaaatataatggggctaatccaaggttttatgtttaggttcaagatgaataaagggaagtatgatttaccaacataggtaatgaagtgtcaggaggttatattgatttaagatcaaactcttcagtgtactaccctctcaaaaagttaatgtgattataggcaatagtattgcaagtaatgggaaataattagactacaccaagcagattatggtaagtttatggcaccatattttaagagtgacactgacaaactagagctcatccaaaggaaagcaccagatgttaaggggttatgaaaaatggagggctgggtgcgatggctcacgcctgtaatcccagcactttgggaggctgaggtgggcagatacttgaggtcaggaattcgagaccagcctgacgaacatggtgaaaccccatctccactaaaaatacaaaaattaaccgggcatggtggcgcatgcctgtaatcccagctactcgcgaggctgaggcaggagaatcgcttgaacacaggaggcagaggttgctgtgagccgagatcacaccattgcactccagcctgggcaacaagagtgaaactctgtctcaaaaaaaaaacaaaaaagaaaagaaaaatggattacatggctgaagaaattgggactgtgaagtcttacagcaactctgtaaggtgctatctccattttacagaaagaatactgaggctcagagagaataaattatttattaaaatgtaactaaaaagtggttggctcaggacccacaactcatgattcttaatctgatattctttctgtttcaaaatattggcttttaattttattttttaaaagtctggctgttagcctatatatatggagaagcttaaagttgtaagggaagggttacagattaaatgaatggaaaagcaaagagaatgctcggagtaaaaagatcaatatgagaaaacacttggtcatcagtattgtaagtttatcagttatagaaatgtattatcttttacatatttttctccttctccctttcaaggtttttgattccaatgaagaatctggatatcttgttctcaccatagttatatcaggtcatttcttcattttccaaggacagacactactggtaggttttatgcataacagtttaatatggaaatacatctttgtcttcttagctttacatgaatttttgtatcctcaagcttcttcagtctcactgtaattcatcaaggtcaacacattaagcatttatcgaatgtgccataatagtgggaaatacagaaacgtactgaatattgcctgccctaaaggggtttaggattttgttgggagtcagagtggatcaaaagattgaaattaaccagtatgataaaggattctgtagtaagggagattgagttaagataggcttgttaacaaagacaagtgtggagggttttccagatagggaaaacagcatatgcagagggatagatttgcagaaataaagaaaacaaaaaggtgttactgttaattgatagcgtcctctataaaactctaattttatggtgatacatgtgttctttattctgaatatatgtacactttaggaaattttggaatgaagaaatatgtaaagaaaataagaatcaacttggttgaaagtttaggttttatttggtacatagaaaccaaatgaaagaaaaaaaacaattggtaacttccaatcaaaggaattgtacaagaaaggaacatataagggaaagttattatatcatttagctgtgaatggggtctacattgacataaattcatacaacaaatatttactatctacatgggcataatttaacaaatatttattgagtaattgtatatgctaggcattttaggggatgctagggatatagcagtgaacagtgaagacagaaatctctttcattatgggatatcatcattctagtgggggaaaaacagcaataagcaaataggtcaagtacatttaaaagacattaattctttttggatcacttacatgttctatcataatatggtaggatctcacatgtgtatgttgtgatgattcatatttccgcttaaatatagccttctcattgaacgtgagatgacctgcaaagtcatctttgtattcctcgtgacttttaaaactgcagcatgcgttgtactattttgctttatctgctactgtcagggtctgcatcagttgcaagagataaaggtttcttcagctgctaatgagtgttgcaaatggtagacttgaagaatacctagtgcacagttagttctccctgccaatatcatgggtctttgctgaatggtgacattaatgcagtttggcttcctcgggcatattagaccaccccatactgtgtctctgctccatctttttgccccagtggtgactattatgaacaaatggatagaaatttctttgtatcacacatagaatgatttttgcactgtagtcacaaaaccaagttatcaaattccaagatacccactacagagaaatgtaaggataactctgcaatttggtgcatgttgcatatacagtcatgtgtctcatcacaacatattagtcaagagaggaccacagatatgatagtgatcccattagattataagggggctgaaaaattcctatcacctgtgatgtcttgatgatactggcccttgtaggcataggctaatgtgcatgtttgtgtcttagtttttaacaaaaggtttttaaaatacaatgattttaaaaatgtaaaactagaaaaaatattgtatatgttttaagttattgtaaaacagtccaaatgttttttaaaatttttttgaagtttataatgtaaaaatgttacagtaagctaaggttaatttgtgattgaagaaagatactttttaaaataaatttatttataaaaaatagtcattaaggaaatgcaaattaaaaccaccatgagataacaatacacacttaattaggatagttaactgagtgtacagtgtttataaagtctacagtagtgtacagtaatgtcctaggccatcacattcattcaccactcactcacccagagcaattttcaccttgcaagctacattcatggtaagtgccctatacaggtgtaatgtttactgtaccttctctatgcttagatatacacatatttagcattgtgttagtgttacggttgcctacagggttcagtacggtaacatgctttacaggtttgtagcctaggagcaataggctatcccacgtgacccacatatgtagtaggctgtaccatcgaggtttgcataagtgtactctatgatagtcacacaatgacaagatcacctaatgacacatttcttagaacatatcctcattgttaagtgacatatgactatacatatataacttaaatattgtaatttgtttaatcttttttaaaattatttttaaaaatcacttttattgaggtataatttacataaaattcactgactttaagtgttcaatttgaagtgttttaataaatctatagtcatgtaaccatcgccacaatcatgatacagaacatttcaattaacccaatttccttgtggctctttgcagtgagcttctctgcccaccctcagcacctagaaaccattgatctgctgtcactctagttttgccttttttaaaataatttttgtttatatatatctttaattgacagataaaattgtatatatttactgtgtacgttattttgaagtatatatacattgtaaaatgactaaatctagctaattaacatatgcattacctcactgtagttttgccttttctagaattcatgtaatggaatcatatgatatgtagtcttttcagttgggcttcttccattcagtataatttgagattcatctctgttgttccatgttatcagtagtttattccttttcattaatgaagaatattccattgcataggtaaacctattttgcttatccattcaacttttgatagacattggggtggttttcattttttcagctgttatgaataacactactgaatatttgtatacgagcctttgggcatgttttcatttttcatcgttaaatgtccaagagaagaaccgctgagtcatatggtgtgtctgtgtttaactttataggaaactgcaaaactgttttccaaagttgcattctcataagcaacgtatgagggttccacatgttccacatcctcaccaacacttggtattgtcagtctttttaacttatctatcctaataagtgtgtagtattatctcatggtggttttaatttgcatttctttagtgactaatactgttgagcatcttttcacgtatttgccatttgtatgtctcattggtgaagtgtctgttcgtgtcttttaaccattgagttgtttgccttcttatattcgaatttaaaaattcttactctggttacaactcttttatcagaaatgtgttcttcaaatatttctaccagtttatagcttaccttttcatttctttgtgtcttttgaagagcagaagttaaaaattttgaagttcaatatttttttctcttatggtttatcctttttgtatactacttaggaaatttttacctatgccaagattgcaaagtcattttttttgagtcaggatcttgccctgttacctaggctggagtacagtggtgtgatcatagctcactgcagccttgacctcccaggctcaagtagtcctcccatctcagcctcctgagtagctgggactgtaggcatacaccaccatgcctggctaatttgttatagtttttgtagagacaggatctcactatgttgcctaggctgctctcaaactcctggactcaggcgatcctctcacctcagcttcccaaagtgttgggattataggcatgagtcactgtgcctggctgcaaagatttttaaaaatgttttcttctagaagctttatgctttcagctcttatatttaggcctctagttcattatgaatttttttagtattaatatttttatttttatttcatgtagtggtccttctttcccacaattaaagcaatgtggtattgataaaaattactatattatggaatgtaatcatggatcttaggcaatttacttctggaaccattgaattaattttaatatatggtgacagttaagaatttgggtttattggccgggcgtggtggctcacgcctgtaatcccagcactttgtgaggccaaggtgggtggatcacctgagatcaggagttcgagaccagcctggccaacatggtgaaaccccatctctactaaaaatataaaaactagcctggtgtggtggtgggcacctgtaatcccagtgactcgggaggctgaggtgggacaattgcttgaacccaggagacagaggttgcagtgacccgacacggtgccactgcactccagcctcagtgacagagtgagactctgtctcaaaaaaaaaaaaaaaaaaaaaaaagaatttgggtttattttttgcacgtggatatcgattattttagtaccattaattgaaaagactagctttctctcattgaattacctgggtatcattgtttaaaattaatttgctaagtatgtgttagtctatttctggactcttttttgttctgttgatctatatgtctatccttactccaataacacactgtcttctgctttgttgtaatttttgaaatcaggtagtttaattcttccaactgtgttctttttcaaagttgttttgactattataggtcatttgcatttccatataaattttagaatgacatttcctacaaaaaagcttgctgggattgtgatgggactgatttgaatctataaatcaatttgagaagaattgatttcttttaccatcttctaagtagtgagcatatttaaaactctccatttattgatttctctcatcaatgttttgtagttttcataatacaggtcttgcacatactttgctaaatttatccacaaatatttcatattttttatgttcttgtaggtaggattttaaaatttcaatatctaatagtttgttgctgatgtttagaaacataattgatttttaaatattgaccttgtatcctgtgatgatcttgctgaactcattagttctgcagcttttttgtaaattctttagggttttctacatacatgatctgtgttctgtaaataaagatgttttacattcttcctttcaatctgtatactctccctgcctgcctcacccgcttcccacagattatgctggctaggatgtccttttcaatgttgaatagcaatggtgagagttgatgtccttgccttgtttccccatcttagggggaaagcatttagtcttttcaccattaaatataatgttagctgtaggtttttttttttgtagatccaattcataaaaccagggaagttcccttctattcctagtttgctaagggacttgttttttccctttgagcttctggtatttatctatttttaaataaaaattatatatattaatatacatataattaaggtatacaatgtaatgttttgatatacattgtaaaacaatgactgtagtcaaacgaattaacatatcgttacctcacaattaccattttatatatgtatggtgagaatatttaagatctattctagcagatttcaaatatacaatatagtgctattatctatatttatgctgtacattagatctctagaatttattcatcctatataactgaagcttcataccctttgaccaacatctcatttcctctaccttccctggcccacccctagtaaccactattctattctctgcttctatgaattttactattttagatctcatatataagtgagatcatgtaatttttgtgtgtgtctggcttatttcacttagcataatgtattccaggttcatccatgttgttgaaaatggtaggatgccttcttttttaaggctgaataatattcatgtgtgtatatgtacctatatacataacaattttttatccacttatccactgatggacccttaggttatttctgtatctcgactattgttaataatgctgcagtgaatgtggagtacagatacctcttcaaaatactaatttcatttcctttgggtatatacctggaagtgggattgctggatcatatggtaattctatttataattttttgaggaaactccatactatttcccaaaatggctataccaatttacattaccaccaacattgtacaaggattgctttttctccatattctcaccaatacctcttgtcttctgtctctttaatagtagccatcctaagaagtatgagggaataatgtcattgtggtattaatttgcatttccctgatgattagtaatgttgaacactttttcttatacctgttggccatttatgtcatttgtggaaaatgcttattcaggtcttttgctaattttttttatttttatttttttgaaatggagtttcgttctgtcacccaggcttaataataaataaattatttaaataaacaaatttatttaaaatttttaaattttataataaaaattttcaattactgaatcaacctttattgtagaagtatttgattttttaaattatgtacatatgtaagtgtgataaaaataagaatacatatttaaaatatattttgccccctaaattacagaataattttcatcagttcatgccatttattcataatctttcttggcctccacagaaagcaacacgtagaagagcaaacacatttggattataacgcatttataacatgtgtaattttatgttggtattacatttacacaccctctcctttcatactaatctgggtcatgatacatttttagaacttttttttgagatggagtctcactctttcgcccaggctgggatgcagtggtatgatctcagctcactgcaacctccgcctcctgggttcaagcgattctcctgcctcagtcttctgagtagctgggattacaggtgcccaccaccacacccagctaacttttgtatttttagtggagatggggtttcaccatgttggccaggctggtctcgaactcctgacctcaggtgattcacccaccttggcctcccaaagtgctgggattacaggccaccgcacctggccttagaacttttttcataaaaggtagagacaggacagccatagaaagttttagccatttctgtcttagtacaattattcaatcactggcgtgaatctaaatatcatatatttatattttcaaagttgtgtggaagctgcatccataaaacccctccaaaaagtagtaacagcctagtaacagcttcatgtgtgtgatatgtttatgtaaaactcaaaacacgtcaacatggttttgggctttctgcttggtcctgggaagttatttaaatttaatttcctttaaccatcataggtctttgattgccactccctgtgagatccatgggaacttaatgcttcagattaaactgcatgcatggtatctagtaatactacagatttccatcttgcttgttcatatagcacctgcattcaactggggacatcactgccagagggctccatggagacataccactagactgttctattgtcatttatgtcaaagggttaatatagcaagaaggctgagatatcttgaccccatcctcagtttaccttggacttgggctcaactgactttcccttgctagtcttgagagtttgaacagattctcccttggccgttttgggtttcacattttttttttccctaattgtggtaaatacatgtaacataaaatttaccatcttaactcccttttttttttttttttttttttttttgaggcggagtctcactctgtcgcctaggctggagtgcagtggaacagtctcggctcaccgcaacctctgcctcccaggttcaagcaattctcctacctcagcctcctgagtagctggaattacagctgcacaccaccacgccaggggctaatgtttgtatttttagtagagatggggtttcaccatgttggtcaggctggtctcaaactcctgagcttgtgatctgcccacctcggcctcccaaagtgctgggattacaggcgtgagccactgcgcctggcctatcttaaccatttttaagtgtacatgtcattgacattaagtacattcctatcattgtgccaccagcagcaccatctatctccagaactcttcatcttgcaaaacgaaaactctgtacccattaaacaactgcccattatttttcccccaagcccttggtaaccaccattctactttcagtttctatgaatttgactattgtaggtacctcatataatggtgatatagtttggatgtttgtcccctccaaatcttgtgttgaaatgtaatccccagtgttgaaggtggggcctgtaggaggtgtatccctcatgaatggcttggtgctgtcctcacgataataagtgagttcttgctctgagttcatgcaagatctggttgtttaaaatagtgaggcacttcccccttctcttgttcctgttcttgccatgcgacatgcctcttccccctttgccttctgccatgattgggagcttccgaggcctcaccagaagctgagtagatggtggtgccatgctttctatatggcctgcagaactgtgaaacaaataaacctcttttcttcataaattacccagcctcaggtattcctttatagcaatgtaaaaacagcctctaatacaagaggaatcatacagtatttgtcattttggactgtttcacttagcataatgttatcaagattgctccatgctatagcatatcatagattccttcctttttaaacagaataatattctactataggtatatactacattttgtttactgatttatctaccaatggatgttcagttgttaataccttttgcctattgtgaataatgctgctgtgaacatgagtttacaaatatccctttgaaaccctgctttcaattaatttggatatgtactcataagtagaattgctggattatatggtaattctatttttgatttttttttttttttgaggaactgccatactcatttccacaggggctgtaccattttacattcctagcaatagtgcatgacagttccagtttctccacatccttgccaatgcttattattttctgttttttaaaatagtattgatcttagcgggtgtaaggtggtatctccttatggttttgatttgtgtttctctaatgattagtgagattgagcgtcttttatgtatttgttgcccatttttgtatcttgtttagagaatgtctattcagttttctttttcaaaaaaatatttaacagtttattttctttgagtacttctggtcaggctttggcagggctctctggattcctctggtcatgttttgagctgccgctgctgctgctgctgctgctgcaacttttaaaggctgtttttgcttcttcagcttttgagtctcttggaacatccagaacgcacagtcttctcagtcaggacttggcaatgggctgctccatcaaaaagatgtgctcagtccccagtgtgtcttctcagagacatcatattggtctaacgaaggtttttgagcatctttttcctctggacagtgcccatcaccaatagtatttgtgggttttgttatttcagtgtttctgctgtgttcttcataattgtgggctttggtcaagggaataattcgagcctccaggaagctggtgtccttagggtttgccacgactttgttcatcagatgttcttacttgatatttagcttctccttttggttggtcatttccaaagacaaggatcttttcactgtatcattgcccttctcaattccagggatggtctggtggtctttgagcagcatggaaaggggaaggtcatggtcctgtctaggccagactggtttctggatggtgtatctgctgcagcctggaggaggagactgcaggccccttcagttggaaggaagcctggcattccctcagcccagcagcccaaggactggggtctgggtcactgcctgggtccaatagaactcggcactctctatgtggccctcagcatggtgacttctgacccccaccaactcccctggggcctactccacagcctccagccccttcactgtagggactgggttacacaggcctcttcaattttctgattggggttttgttgttgttgtgttgtggaattggtgttgtttttttaaaatgataattcccctttacacacacacatgcatacacatcctccacctagtgaatgtagcttttaaaacatttttggccagatctcatgtgatcttctccactcctgtttcttctttcagcttggatgaggtgtaggataagcactatgagccctttttagggtagggactagaaagtgtggcttttcttggagcacagagctctgtgccatgctgtgccctctccccagtcacccttatatatcaagttgcttctgccacctgcttctttgttgcctgctcaatcctcctcggcttcttctgtcctggagctggagcttctgattattagcaggaggtacacttactcttcagtgggctgccatcttttcctggatctcaaattcattctttaaaaaagtggaattcgtaactcctttggggatatttctccaaatttaaaaacacattctcttacatatcattgtaaacctctaaagatctaccttttgtcagcatcttccttctcaatccagaagttgcagaagccaaagtttcaagccaggttctaaatatatccaaatgggagaagttatttcccaaggctttagcctctatttccagccattcctttttatctcagttggctttggtccagcatgagtgtctttacctagatataattatgcctgaaacacagaatggttttgagacaattttaattctgtttgtctggaaaacatgggtcattctagaaatgatagagttcagcaaattttggttttagtttcctttttatttttcacacccggcccaaatgttcttccaacaggaattgtctttctgtttaccagtgaaaatgctatattcctatttaagtgaactctgaaacctttaaacactaattttaacccaattagtttttaaaaatgtccaaagcagtcttaactacagaatcttctaaaaggaaagatttagcataaacttttaaagtcaagttattcataccattaaactatttatttaatatttattttgagatggagtctcactctgtctccactgcagtggcacgatccctgctcactgcaacctctgcctcccaggttcaagcgattctcctgcctcagcctcccgagtagctgggactacaggtgtgcgccactacgcccagctaagttttgtatttttagtagagacagggtttcaccgtgttggccaggatggtctcgatctcttgacctcgtgatctgcctgcttcagcctcccaaagttctgggattacaggtgtgagccaccgtgcccggccaactgtttaaatcagaacctgtctattctttggccactgatatggtttggatctgagtcctacccaaacctcatgttaaattgtaatccccagtgttgtaggtggggcgtggtggaagatgattagatcatgggggtggtatctcataaatggcttagtactaacctcttggtactgtccttgagatattgagtgagttctcgtgagatctggttacataaagtgtgtggcgcttgctcaccaccttgctcctgctcttgccatgagataagctcctgcttcaccttctttaagctcccagaggcctccccagaagcagacgctggtgctgtgcttcctgtacagcctgcagaactgtgatctagttaaacctcttttctttataaattacccagtctcagatattctttatagtaatgtaggaatagcctactacagccactttttcaggaaagaatgagggaaacaaagctcttcataactttatcaccccctcccacatttaaaaccactgtgatcaatttaattccacttttgtgtgttttgttatttctcttataaagacagttgggttagcaagagttaaagcattttactgttctacgtttatactgtcctacatctaaataaacttcagctcttatgcaatacttgcttgcaaatttgctgattactcaactggaagaaatatgaggcgaggcaatcttccaccataccttttttcctttttttttggaaatggaatctcgctctgtcaccaggctgaagtgcgatggcgcaatctcggctcactgcaacctccatctcctgggttcaagcgattctcctgcctcagcctcctgagtagctgggattgcaggcacgcaccaccatgcccagctaatttttgtatttttggtagagacagggtttcaccatgttggtcaggctggtctcgagctcctgaccgcgtgatctgcccgtcttggcctcccaaagtgcttggattacaggcatgagccactgtacccggccaccatacctttcttatcttcctggcttttcagctccctttgggaatctgcgatgtgaaaaaccagggaataacgccttaagctatcttacctttccctcttttacccattgggctcaatttgtcagcagggagttcttagtccatttgtactgctataacaaaataccatagactgagcattttataagcaatgcaaatttatatcttacagttttagaagctgggaagtctgaggtgccagcaggattcgtgtctgaggtatctctacttccaaatggtgccttgttgctgcatcctccataggggaggactgcggtatccttacatacagaagaacataagagaggtactctattctggctgggcgcagtggctcatgcctgtaatcccagcactttgggagactgaggtgggcggatcacctgaggttgggagttcgcaaccagcctgaccaacatggagaaaccccatctctgctaagaatacaaaattagccaggtgtggtggcacatgcctgtaatcccaggtacaggagaatcgcttgaacccaagaggtggaggttgcggtgagccgagatcgcaccattgcactccagcctggacaacaagagcgaaactctgtctcaaaaaaaaaaaatactctattccctgaagcccttttctaaggaccctaatcccatttatgagggccctgccctcatgacttaatcacctcttaaaggttctacttctgtatactatcatattggcaattaagtttcaacatattacttttgaggaatacattcagaccatcaattccacccctgttcccaaaattcttgttctcacatgcagaatatattcattgcatcccagtacccccaaaagtcttaacttgttccagcaccatttcaaaagtcttcaaagtccagagtctcatctctaaatcagatgtgggtgagactcaaggtaagattcatcctgaggtaaatttcttttcagctgtgagcctgtgatatcaaacaggttatatccttccaaagtacaatggtgagatgggcataggatagacattcccatttcaaaagagaagaaatggttaggaagaaagggataacaggttccaagtaaatctaaaacctaataaagcaaacattaagtcttgagagtaatcttctttgacttcatatcctacttttgtacacactggggtggagttgggctccaagggcctggaaggccctgcccgttagaactttgtgagcacggcccacacagcagttctcatgcgttggagttgggtgcctgcagctcttccaggctaagatcacactctggtggctctacagttgtgagatctcaggagtggtgctgctcccgtggcctcactagacattgccctaatagggagtccttgcagtagccctgcatccgtggcttcactaggcattgccctggtgggggctatctacagtggccccaccatgtggtatttttttttgcctgggccctaaggctctctgagccatcctttgattctaagtaaaggtagccatgcctccacagcttgtgcaccctacacacctgcagaattagcaccatgtggatgctgtcaagatttatgtcttgtgccctctggagtggtggccagagctgaacttgggcccaccttagtcacagctggggtggtcaaggaacactgcaccagaattctgggagcagagacttgaggcagcctggagcagtgagcaccaaggtcaatgggcactctggggccctcccttaaaactgttctgccctcaaggctctggcattgtggacctatgatgggtgtggtagcctcaaagttctttgaaatacttttggggttattttcccattgtcttaatgaattgtatctggctttcttctatccatactattctttttatcaaatagttgcttggccatacctttagggttttcttccaaacactcttttatattctttacatggccaggctgagaattttccaaatctttatgttctgcttccatttgactataaattccatgcttaattaatatctctcttcttgcagtttattataagcagttaagagagtccatacagcacctagagtattttgctcagagatttcttctactaaatattctatttcattgcctttaaattctgccttcctcaaagcagtgggacacaaacacaattcaaccaagttctttgccattgtataacaagaatggcctttcctccagtttctaataagatattatttatttttgtataagaccttatccaaatggtctttactgtccatatttctaccaacattctattcactaccacttagattatctctaagactgaggctttctttatagccgtcctcttctaagccctcacctgaatcatctttaatgctgtgttcatagcaatatgggccttttccagcattcacttcaaaactattccagcctgtacccattacccagtttcagagccacttccccattttcaggtatttgttatagtaacacccctttcttggtaccaatttctgtcttagtccatttgtgcagctataacaaaatgtcacagactgggtaatttataaacaatagaaatgtatttcttatagttctggaggctggaaaatccagatcaaggcaccagcaggattggtgtctggtgagtgctgctctctgcttttgagatggcatctttttgctacatcctccatagggaaggaaaactaagtcttcacatggtggaagagcagaagacagtgaacccattttctgaatgcccctcccccacctttttttttttttttttttttgagacagagtctcactctgttgcccaggctggagtacagtggtgtgatctcagctcactgcaacctctgcctcccaggttcaagcaattctcctgcctcggcctcctgagtggctgggattataggcaggtgcaaccacgcccagataatttttgtatttttttagtagagatggggtttcatcaacatggtcaggctggtcttgaactcctgacctcaagtgatccactgacctcagcttcccaaactgttgggattacaggcgtgagccaccacgcctggcacctggagccctttcctaagggccctactcccattcatgagggttctgccctcatgacttattatttcttaaaggcccacctcttaattctattatattattattaacttattatgtaaaggcccacctcttaattctattatattattattaacttatgtaagtttcaacatttgaatttaggggaacacgttcagtccatagtgaggggagagtctgtgcactcttacatggctactccagaaaaaaaaaaaacaaaactcaactctctaatcacccagccttcctcaggcagcagttcccttatttgcttcctagcagtccttccaaactctaacaacagtggtggtttatctgtgccaatctcatgtctgatgccaactgtagcatttcaggtagtggaaggagtgagtacactcaaacacagtagagttccttgcttaattgtaaatgtggaatcttttgagagtgaggtgaccacccatgactggaataggtacagtgaatctcaggatagcttttgctaaccccattttctgatgacactttgctaggctgtagcccttatatacttgggacctaggtcaccattccaaaagaatttcactaatagcttctgattaagagaatgtttataagcattggatttacatctgcatttttttcaaagacagaaagttgtcagtgctcagatgtccatgaaattattcttttgccaagcttttcagcattctggaaatccacagtgctcttcacattttctgttgggatactaaggttttgttatgtattattggaattatctctatagaataagaatattacgtctttgaatatatgttgaaatagttttgcgtggtttgtcattgactattcttaaaatgagttttattagagtacaatttatatataataataaagtatctgggcgcagtggcccatgcctgtaataccagtgctttgggagggtgagacaggagggtctcttgagcccaggggttcaagaccagacctggcaacataatgagaccctatctgtacaaaaaattagccaggcatggtggcatacacctgtagtcccagctattcaggaggctgagttcagaggattgcttgggagatggaggctgcagtgagccctggtcgcaccactgtattccagtctgagcaacagagcaagaccttgtctcaaaaaataaagaatgtatatatataatatactcactgagttcattgaattttgataaatgtattcaactatataaaccatcacaatcatgatatgaacatttctttcattccttcgcccccaccaaaaaaaaattccctcttacttgcccaccttcatccccagagaactactttctgtctgctttctggcactacagattagttttgcttttgctggaaattgattaaatgcaattattgtaatatgtgctctttttgtgtctagcttctttaattcagcatgatgtttttgagccttatccgcatcatgctgaattaaagaagaacatcgtacatgttctttttttgttgatttgtatttcattttatggatgtaccacaatttgctcatctattaacctgttggatatttgggctatttccagtttggggaaattatgagtagagctgttatgaacatttatatataagtctttgtgtattatcttaattttgtgtatttgtgtattatcttaattttgtgtattatctttgtgtactatctttgtgtattatcttaattttttgtattatctttgtgtattatcttaattttgtgtattttcttaatttctttttgtatatataagtatttgtgtattatcttaatttctttgtgtactatcttaatttctttgtgtattatcttaatttctcaatttgctcatctattaacctgttggatatttgggctatttccagtttggggaaattatgagtagagcttttatgaacatttatatataagtctttgtgtattatcttaatttcttttgggtaacaccttagagtagaattattgggttgcccagtaagtgtctttataagaaagaagtaacttcaaaagaaacttctgtacagtttttcaaagtgattgtatcagccagatgcaatggctcacgcctgtaatcccagcactttgggaggctgaggcaggtggatcacatgaagtcaggagtttgagaccagcctgaccaacatagtgaaaccttgtctctacaaaaaaaatttaaaaattagccaggcccggtggcacatgcctgtaagcccagctacttgggaggctgaggcaggagaatcgcttgaacctgggaggcggaggttgcagtgagctgagatcatgccgctacactccagcctgggtgacagagtgaaactctgtctcaagaaaaaaaaaaaagtgattgtaccattttgcttttccaccagctttgtttggcagttcaagttgctctataatcttgctaacagtggtactgtcagtctttataatttaagttattcttgtgtgtgtgcagtggcatgtcattgtcatttagttctcattttctgaatgactagtgaagcacattttttatatgcttattggcctcgttaagaaacagaacattttcagtatcccagaaacctttctcatattcccttccagtgactactacacaccccactccgcaaagactaaccaccatctgacttctaatagcatagtttccctgtttatgtactttatatgaaatgaataatacaggactctcctgtctgccttcttttgctcatcattatatttatgggacttgtccatattatatttatgggacttgtgcaaaatgagattgttcattctcattttgtgaatatataacaatctatccattgatgggtgtttgagcaatctcaaatttttagctaccacaaatagtgcttctgtgaacactcttgtatatcttttggtggacacttgtatgtgtttttgttgggcatacaactaggagtggaattaatgagttatagggcagcgcttctcaaacattaacatgcatatgaattatctgggctcttattaaaatgttgattgtgaatcaccaggtctgggatgtagtctgaaattttgcatttctagcaaactcttgatgatgccgattatactcatctatgaacacactttgagggacaaagtcatagagtatgctttggtaggtattgctggagttttccagagttattctgctcaatttatactcttacaaataatgcatgagagttctccacattcttggctatacattcctgatattttctttttagccgttttggtaggttttcatttatattttcataattaatagtgagtttgaacacttttccttatgtttattggccagctggatatcctcttttgtgaagtatctgttgcaatcttctgcacaattttctcttgggttatctttatgtagtttttatttctgccattttttttactcttctttatttttttttatttttatttatttattttttttgagacagagtctcactctgacactctggctggagtgcagtggtgtgatcactgctgactgcagccttgaattcctgggctcaagaaatcttccagcctcagcctcccaagtagctgggactataggcacatatgccaacacacccagctaatatttctaatttttagtagagatgagatctcaccgtattgcccaggcagctgcttattcttttatttcttcaagctccttgtttatttattctttactcttagtgaaatctctgactgttgcttattatctgatctttactctcttgtttcaaagaatctgcatttttctgaatttagtttttttgtggtgcaattttaattaaaatttacttctatttccagttttgtttgttttcaaaactatgcccttttctgtatcttgagggttaagttttcccctttcattttgttgcagaatgttttcatagatctattattttttctttttttcttctttttattttatttatcctcatgcatggagatgtctcatatgtagaggcctgagggtggattcatctgcaataacctcactgtccttagaaactaatagtttcctttcaaatattacataagagacctggctaatataagtttacatttctgttcattgatctagaagcctgagaggagtgaacttagagcctgtcctagcaaaggagttatctctaatttcttctgtaaggaatcagttttttgctagccacaatgccagttgaatactgtagttattcatccacccttctggtatatctgcctattatttctcacacaaattttttatttctccgattattatctggtacgctgcattacacattctagggcacagttatttcagatgatcttgattagtagtggtgaaacagattccagatgagggctttcttattttttctatggctcccctattcagtagctcttgctcctcttggtaatggtgtttctgccagtgtcttctctttctctctgagtcacagaactcctttctcaggaaggtgcatcactagttggctcttggcatctttcttccatcacaataccatgtcttgcataaattcttcaacagttttgtcatatgaatggcatctagtcctagtttctagtattgatatagttctctactattttatatttgttttggcattttcattttgataagatgaaggtatgagttaaaagttcaagatacaccctggaggcagagattgcagtgagccgagatctcgctactgcactccagcctggtgacctgtctctactaataatacaaaaattaactaggtgtggtagcacgcacctgtagtcccagctacttgggaggctgaggcaggagaatcatttgaacctgggaggtggaggttgcagtgagcctagatcatgccacttccctccagcctgggtgacagaacaagaccctgtctcaaaaaaaaaaaaaaaaaattgaagatattttcttacctcaaagtctaaaaccctttaaattatttttctttttttctaaaatgctttaagtattaaaaagaaatgtaccttttctcaccataggataacagttatgcagctttctgtgacgtttggttgttcgtggtatctcagatgatgttacatttttgcaattggttgatattctataagtgggccagaatatccaaatatacatcaagaacatttatgtagatgtaaataattcactttctatagtggatcagacagatgagacactctaattgggtagctaaaatggagatctttgacctaagccttgttatactaagtgtttaatggaaagttagcgtatatatctagcttcactaatatggtaatagctctgatagggacccgaagggcttatctagcctggtttgcttttaaaactgcaattacacttttgttttgttgcacttacattgtgacttttatatgaatttcttgtctctctttcattagggactaattcccgacaatttttaaaagagattctgctttgtatttagtatgaaaatcttaaccatgtgaagccagtaataccattttatttcttctcctcatcttttctcttctctctaaagtgagtcaagactttggaataatcttttgaaagggtactaactactcacaaagagtaattttgacactttaaacctaactgcctttcccacccttcttttttcatttcctagcatattggagtcaaagacatttgccagattgtgtagactgtctttatttttagagctcttgtttactttactagatttgtagtttcgaaaaaaaagtacctcttcggggctaagttctggttggttccttttgggtatgttgaaagtttgcatcaatatgtagcttactagttatctctgatatgttctatcctcagtgtcgtaacccaaaacaaaacataaataccacagtcttaaaatattttgcactgccagtcttaaaaaaaaaaaaaaagcaagagaactttttttttgctgtgacaaaataagtcttgatttaatttatatccctatttatcatcttatcaaattacaggcataagaagcttagttatagtacttagccagacctctagattccttcttttattaagaggctatagaatttagggtcttttcaaaaacacatctttggtataagatttttttctcacagtattcaattaagtctgtactaggttcaattggattagctttacttggattcctttaaaatagtaaatcttcttattgttggagaaaaattgttattttttatatcactaatcattaatgaaagggaaatgagcacattttactttgactattactaattaaactcttcttaaatctttaatatttgggaatatttaatccttcagtggaccttattgagcagataaaatttatacacttgaaacaaagaaagtgcagttccaaaagatgggaaagatgctctagcagcataatatttttttatttaaactttttatttagaaatagtttcagacttataaaaaagttggctgggtgcggtggctcacggctgtaatcccagcattttgggaggctgaggcaggcagatcacgaggtcaagagattgagaccatcctggcaaacatggtgaaactccatctcgactaaaaatacaaaaattagttgagtgtggtggtgaacgtctgtggtcccagctactcgggaggctgaagcaggagaaatgcttgaacccgggaggcagaggttgcagtgagctgagatcgtgccactgcaaattcagcctggtgacagagcaagactccttctcaaaaaaaaaaaaaaaaaaaaaaaaaaagttgcaaaagtaggccgagcgcgtaatcccagcactttgggaggccaaggcgggcatatcacttgagatctggagaccaccctggccaacatggcaaaacctcatttctacaaaaaacacaaaaattagccagacgtggtggcggacacctgtaatcccagctacttgggaggctgaggcaggagaattgtttgaatccgggaggtggaggttgcagtgagctgagatcacgcaactgcactccaggctggatgacacggtgagactccatccaaaaaaaaaaaaaaaaaattgcaaacgtagtataaggaatgtgtttataccattcacccagctttcccaaatgttaacatttagcatagaatggtaatccaaaccaggaagttaacactaacacaatactactaactgatctacagaccttattcaaaatttgaagttgtcatactgtgttttttgctggttcaggatctaacctaggattccacgttgcatttagtttttatgtcttcttgggttccttccatctgggatagctcctcagtctttatttttttttttttttaataactttgacacttttgaagagtactagccagttaccttgtgaagtgtctctgaaagacagaagagatgttcagttcattatctcaggaggtatatgatattgatatatcttgttactagtaatgttaaccttgatcacttggttaaggtgatatctgccagtttgctccattgtagttactccttttccctttgtaattaacaactatgttgccagaagatattttgaagtatgaaaataccttctttctcacaatactcttgtccactaattttagcatcaattggtgattcttgcctgcaacagttactgctctggtgtttgccagatggcaatttcctatttctgtgattccttctgcatgtactaattggaattctactgtaataaagggctgtcccttttcccttatttatttatgtatttatttgattctatcagtatggactcatagatgctcacttcattctgtaggttatccatcactatcattatctatcactatcactaatctcccactgatcacttttctttagtcttttagtctctagcagcatgctatcagttagaatatcagggttcttactctaacttcctatgtgccatgaaattcacctttaggcaaaatattcaactattgttaccctgagtgccctctctcataaaatgggaataatacctgcttgtggtatataaatagatttgtaaactatagaatgtgatacatatagtaatattgtcattattttattgctaaatgccacaataggtattcagagaacaggggctcttttcaggggctgacttaagaattaattcttttagagtgtccacttatttctatagggaggcccaagaatgaaagtggagaggaacagttgtatggagatgaaaggcagaaggaagccaaaagtaagtcacagaaacacagagcagcatttattttcacattctgctgtgtacagtaaataattactgaattccctagaatatcatgcaatagtaatctatttctttgactattagttttgaaaattcccttgtttcatgtaacaaaatatttttaaattaaatgtggcatatgaaaacaacattaacttaatttttcctgaacctcaagctattgtttgatttggaaatgttatctctggtgtactttaaggatgtgtgaagcacacaaaaccataaggtgttatgaatgttattactcttgtttttttttttccgagtttgctttgtgagtctttttagatacctatgacaatactgtgtacagaagtccttgatgtgactttttcctcattaaatttctgaatcaatacatacatccactgcccgagatcatttgtttctccatcctctttgctgtaggtatttggaggatctgttgaatgctaagtttgtgatttaaggtaggggtgtgtgtgtgtgtgtttccttttttatgttttattttgtctttggggatgagagttttatttcttcctgtcacaacaattgggcaaaaaatagtagactaaactgctaagtaggtcgacctgcctgagcaccatgaggtggcaaattctaataagatttcctgacttcagcagttatcagtgatgggaacagggagtagaaatagcagtatttgaacttcaaatatccagggaagaataaatgagtttctgctttgttcaacatttgtaactaaagaaagattttacacctttttctatttcattttaatgaatattaccaaataaaggcatgaaaccagaattaaagaataagatcacagtaaattattatattaatggatttaggctgtgtagtaggcaccttctgtattctctaatacagtaaaagattagaaatagccttgcctccttgttgcatatgtgtataaaagtgaacgttaggcgttgaagctattaagggatactattttgtgtcagttattttggagatggatgttttgtaaaatcctcttagacattaaaatcaacaaatgctttgaatgaacttcagacctttggctttagcttagcttttggtcataggctggaatttcattttttgttgttgttgttggtctttggctactgacttgtttgcagaatggtgctcagctaaactcttccccatgtcattggtctaccaagtatcttaaaactctccagataacaatggcaagcgcattggacactgtaaagaaacacctcttaaggcgttaacacttctgaatgaattactccgattcctttaggttggtgcaaaagtaattgcgattttgccagcagaaagtgcaattacttttgcaccaatctcataattgacctgaaaccagttatgaggaggcaagtattatggaaaaatatttttcattcctgcaaggtcatgtggagagtgttttaaatagcaaagtcaagtacttattcaccagaatccagtttgatcacttgctgtctaattagtcttttgtgttaaatctttcagtttggttgagggacaacagggtagttttcgacaaatcatattaaaaccaagtagttttaacatttgagttccctacatctttattaccgttacctcagtttagtcctcattatctcttgtcagggttactactgtaatctcccactgatcactttctttagtctcttattaagtctgtactaatatctgaataatcatttaaaaatacaagtctggtcagataattttcttgcttccagtttcttcaaagctcccaatcgccttagaataaaaccaggctttcttagcatggaatgcaaggatcttagtgatctagtcatggcctgacttttcagtcctgtttccttacaacttcccccaaatgacttgtgggtccctgaaaactctgcagttttgcttttcacccttgcttttaatgtttctctgcttggcgtgttattgtattactgactagctcctatccatgctttaagacacaatttaaattttagaaacttttaattatggatattgtccaaacatacacagaagtagagagaataatataataaaccccatgcatccatcacccaactttagagtatcattttgcaaatttttcaaccatgatttttttttccaactcagtcttcactggagtcctccatgacctctctaagcaaagtgagccactcttttcctgtgttctctttagcaccttgaccatcctgctattagaatgcctgcaaatataattcctcatttacctgtctctccctctacaatgtgaatcctttagggtaggtaccaagctcttttcacctgttctctatgcctagcatagatgccaacacatcataggtgttaaatatatgtgaatgaaagtaataacctcttatcttcttcatccccacttgctgtcaccctttctttccttcacagaaatagcaaaaaaaaaaaaaaaacttgtttccccaaagaaaccagatacgacaaaagagtgtgttatgtatgcacatgtgcatttatttttactttttcaagaaaggcaaaactagtctatggtgatagaagtcaggatagcagtacctttggcagcaggtgagatggaggcattgttcactggggagagatcacgcatggaggagccttctaggttctagaaatgttctatgttgatctggatggtggttaaatatatgtgtgtataaaattgtatcaagtggtaaagttaagatatgtgtataatactttgctgtatataagttacagctcattttttaaatgtctgtttgttttttaaagcctgttctcttcaattattgttttttttttttttttttcactgctggtaacatcattttcttgattacccaaattgcaaaactgggagtttctccagacttctcccactccctcctctgaactctgatgaatccattttataaatagcatttgatctttcccttcttattcatccttagaacctctgcccccaggatatggaccagcctgtgatgggcccactttgtgtcaggtgtccccatggtcttatgtatttagggaggagtcatctggcttactacccacttaacaggagttgtgagtgggacatggctcaaaggccttgtttgggaaggcagtgattcacatcacttatatacagtatgtgagaatttaaggcatatccattaagccatttttagtacctagataagtgtatccgtgtaaatgaggttatggtatttgaagtaaaataacacaatttttgctaactgtatattttattgcagcacatctatgaaggtgtgccattcaatctcattggataaatgttaactaaagtttaaaagaaacaagtttttattacatgtagtgtggaaacgtgtagcacaatttaaggcaaggtgcattttacctaagtatcccttgtcattcttcttctattgaaggaaacgtggtaaaaataaaaagccataggaaggttccaaatggtgataagagtttatcctgtgagccttttccagttttatcagcagcagcagcagcattattattttaggcagagtctcgctctgtctcccaggctggagtgcagtggcaccatctcagctcactgcagcctccgcctcccaggttcaagagagtctcatgtctcagcctccaaagtagctggaataacaggtatgtgccaccacacccagctaatttttgtatttttagtagagctggggtttcgtcatgttggccaggctggtctccgtctcctgacctcaattgatccactcacctcagtctcccaaagtgctaggattacaggtgtgagccaccatgcctggccaccagttttattattaaagaaggacagaattgactcacttttaagcaagctgattttatgtttggttcttgagaataaatgtctcatcaaataatcagaacagatacaaggatgcaacgatcagaacagtgaatacttaaatgtgtgcagttccggagtagagtttattttcttatgtaatgacatttaagatcatattcttctgaaaataaactcagtatttaagagagttgcattgtggaaaatgcaactcaaagagttatgagctgggcacagtggctctcgcctgtaatcccagcactttaggaggctgaggctggagatagcttgagcccaggagttggaggctgcagtgagctatgaccacgccactgcactccagcctgggcaacagagcaagaccttgtctcttaaaaaaaaaaaaatgacagaatgccaggaattttagatacagaatgtaacatttgtttactttgtattcttcatatcattgttaaataacacatcttatagaaaaaaaaatataaaagctgaggattaaatttccatggtaacatcaccttattacactacagttgatccttcaggatgcaggggttaggggcaccaaccccttgcgcagctgaaaattcaggtataaattttgactcactgaaacgtaactaatagcctaccgttgactgccttaccagtaaaataatttttaacacatattttctatgttacatgtattacatactgtattcttatgataaattaagatagagaaaataatcataaggaagagaaaatacatttactttttattaagtggaagtggatcatcataaaggtcttcattgtcatcatcttcatattgaataggctgaggaggaggagtaagaggagggattggttttgctgtcttatgggtggcagaggcagaagaaaatctgcctatacatggacctgcacagttcaaacctgtgttgttgaagggtcacatgtaattagttttagattccatttaagtaagttttagtgctaaaattgttcagagcataaatatttgaaaattttatgttgattttatggaacctggcacattctttagaatcctgttacctccaaaacttatttgtaggctattatttgcataaaggacaatatttttctatgcatgcttcaattcttactgaattgattgcattgattagcgaaatacagattaaaaccccaatgagataccactatatatctattagaatggccaagattaaatgaactataatacaactgtttgcaaggatgcagaataaatggagctgtcatgctttgctgttggaaatgcaaaaggatacagccacttggcaaaaaatttagcaatattttgtaaagttaaacagtcacttaccatatgacccagcaataaaggctcttaggtatttattcaagagaaataagttactttcacacaaaaattggttcacaaatgcttacagcagttttattcattatcacgccaaactgggaaacaatccagttcatacgttccccagtgtttcaactgagttgtggcacacaactcatagaactgtatactaaaaagggtgagttttactgtatgtttatacctcaacttttattgaggtataacttatacttcaataaatctgacttaaattttttccgtatcttttaaggatgtaactgaaatatttacaggaaaaaaaagtgatacaatacctgggatttgcttcaaaattatctggcagtagagatagggataaaataagattgatcatgaataaattatagttacattatggggtgggtacatggatgttcattttatttttctctctactttcatacatgcttgaaataagcaacattaaaacaaattacaggttatctggcagatgtgaaatgggatctcatgttttaaaattttattttcctgtttataatgagttttagcatcttttcttattggcaatttgggtttcctcatttatgaatttttgtttttgtcctgtgcccatcttcctactagcttgtttggcttttacttattgattttagacctttatatattctgaataccagtcctttgccaattacacaggttgtaaatcttttttcccagtctgttattggcttttcaattagtttatgttagcttttgttgtatataagttttaaatttttatgtagatgaattatgaacctatttatttatgcttttatatcttagaaattctcccataggaattttttttttttttttttttttttttgagatgggagtcttgctctgtcacccaggctggagcgcagtggtgcaatcttggctcactgcaacctctgcctctcaggttcaagcgattctcctgcctcagtctcctgagtagctggtactacaggcacgcaccaccatgcccagctaatttttgtatttttagtagagacggggtttcaccatgttggccagatggtctcgatctcttaacctcgtgatcgccctcctcagcctcccaaagtgctgggattacaggcgtgagccactgcgcccggcctgaaatatttttatatttctttgtttttcacatttctctaacccttctggaatttatctttttgtataggaattcaatatttttttcatattgattaccagttgtccttatactaacctttcctactgatttggaatgcaacctacagttctttaccactgggctccctactgatgttggatcccttcctggaccatgttcttgtttggcaagaggaatcctagcccctccttcctgcccatatgatcagaagttgctttttctcctctgggtttctttaggagtagttatagatttatgctgctttggctttgcttctcttccaggtttggaaatgggtcattttaaactttttctcaggaatatacttggtggaggttggggtagagaggagcaggcaggctcaagctacagattttatatgttgaactggtttggaatgagtcttttaaattatttttgttacttattaaaaaaaattgactattcatgaattataagttgtataaaaaattttgtgggttttgttttaatgggttttgtttaaaaatatagatgttttattggattctattttaatttgggttaagaaaccctgaaccttgggttgcttaaatttctgcaataataaacttgcatcctcttctctagccaaactaaattacattctattccttgttcatgccatgttcctctagtcctctgtacctttgcatttgctgtcctcacaagtgacctttttttttccttatctgcttgggaaacatgtacatgtttctgtttatcttcttcactagtctgtgagctcttactatgtcttatttatcttttaatcccattaactgtgcacagcacctaaaatgtagtcagtgccctgtaaatgtttatgtgcaaccttagattcactatgtttgtgatgttcttcatgtataaaagttttaaaccttttctataatttagtttgacatttggtcagtgtaaatttaccagtttcacacatgtggattgttattggtcaggctctaccatgtgtactcaacctgttggcccctaatttgctaaatccaccaagattcttatgaaaacagttttttgtccaattggcccgtatgtagatttttctacgcatccctttggcacaagctagttaggatgcttttctgttctaccaatgccctttcccctgtgtagggccttttcttatccaacattcaactgcacttctccttccttttttttttgtttttgagatggagtcttgctctgtcgcccaggctggagagcagtggcgcgatctccgctcactgcaagctctgcctcctgggttcacgccattctcctgcctcagcctcctgagtagctgggactacaggcgcccgccaccatgcccggctaattttttgtatgttttagtagagacaggatttcaccgtgttagccaggatggtctcgatttcctgacctcgtgatccgcctgcctcggcctcccaaagtgctgggattacaggcgtgagccaccgcgcccggcctgcacttctccttcttaccctggttatagttggtagaacatttcctgattacaccctgattattgtagctattgtgatgtcatgctcttagtttgaaaggctctcttctttttattcctactaatggagcggttgaagagggcacgcctgcacgtgtggtctgcagagcacatcctttctgaactgacaggaatggagatgccccctgcttttttttcctttttgtaaacaaatgttttcatattgatttagccattttatacagaaagcttctataaaatgttattattacttatttatggaataggctccataaatgaaaggttaaaaaaagctttgttatttcttagaagataaaagctttactttttttgtatctgatcttttatcacatatattttctaataatggaagatagtgagaactgagaaataggttctgagttgtgacccttcaattttttaaaagctctgttatgttgtcttggttctgcttttaatgtcacttagtattgtctaaactgtactgaaatagcaagaggtggcattatacctaactcagctggttcactgtgctgttataattactaatacttatgaaatctaaaaattgaaagtttaaagagatgcctgcagtgctgataaaacgtggctgaagtgccactagaaatgaatgcaagtagaagtgctatatataataattcaggaattaggtcagaaattgttaactataaacaatgtaaatatgcttggtttgctgaggattatagtttaatgcagccatatatatgttcatcaacactaagtgcaatcatttgtagaaccattattacaactgtaaatcttttggggggataagtgtaaatgaatgagttttataagtctcatctctatactcaagaggcaaataactctatcaaacttacaggaccctttgaagattaagagcaatacaagtctgagagaaggtacttgtataaatttgtgtgctgacattctggccttagaaaggatttttaaatcaccaaagaaaagatcaacatatattaactacgtaaaagtagaaaactttggtatatcaaataaaatccatagccaactaaaaaaaattaaagtcttggagtgaaaaggccttgttaaataagatagaaatgctcagaatctgtaaaagaaaagattgataaagcttgctacataaaaaaattcaaaactttctgcatggaaaaaataccataaagttttaaaaaaagacaaatcaactcaagactaagtgttcatttcctgtgtatataaaggatatctacaattaataagataaattataacccaattaaaaatgggcaaaggatataaacagactgtccacagaagtggaaactatgtatatataacttaaataaaaatatatcacatatacatttttgcttgcacatgcatagggtacatctagaacaagattgtccaacatgtgggccaggatggctttgaaagcagcctaacacaaatttgcaaactttctcaaattatgagattttttttttaaagctcatcagctatcgttaatgttagtgtattttatgtgtggcccaagacaattcttcttccaaggtggcccagggaagccaaaagattggatacccctgatctggaggctttataagaatttggtaaaatttcagtggttatccctagggaggggacctaggtggctggaggacagaaatgagaagaggatttactttctaaaatattttttaccttttgattctgtacatatgtattaaatattaaatagacactatatatgggtacacatgtatgtgtacatgtacgtacacatatatagtgttttatgtgtatatatgtatttttaatgttaaaaacctagaaacaatctttagagcacagaatgacaaatttttgttttaacaaagagctcacacaaattaaaagcagcaacttataaataagtaagcaaatgaacaaacagttcacaaaaagaatgaataaacagacatacagaagtatgttcaatctcagtagcaatcagaatgaagcttggacataaccttctcagaaagccatttccaagtacctagggtcatgaatggcttttatgaatcctgtctgtataaacgaggtggatgctaaggtcaaggttagcgccatttttggtgcatccctacagcatcttgtatttgctgtgttgtggcacttaatcataatcagtggcttttgttggttggttgttcttcttgttttctgtcttcagctctaaactacaagctctctgaggtcagagattatgtcttctgttattttttccaagtctgccatcacatctggcgtctgtttgttgaatgaataaatgaatagagtaaatagatagtaatcaaaggcatagaaattaaagtaaaatattttggtttatttaataagggaaattaaattttaatatattgtgtgttgataaaaatgtaatgaagttagtatgttcatttactgctggtgacatagcacactgtttttctaaaatgttttcttcatctgccagtatatatatcaagactaccctctaccgcagcacagtttctttttttttttttcttttttaattttttttttaattatactttaagttttagggtatatgtgcacattgtgcaggttagttacatatgtatacatgtgccatgctggtgagctgcacccactaactcgtcatctagcattaggtatatctcccaatgctatccctcccccctccccccaccccacaacagtccccagagtgtgatattccccttcctgtgtccaggtgatctcattgttcaattcccacctatgagtgagaatatgcggtgtttggttttttgttcttgcgatagtttactgagaatgatgatttccaatttcatccatgtccctacaaaggacgtgaactcatcattttttatggctgcatagtattccatggtgtatatgtgccacatttccttaatccaatctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtgtaaaagtgttcccgtttctccacatcctctccagcacctgttgtttcctgactttttaatgattgccattctaactggtgtgagatggtatctcagagtggttttgatttgcgtttctctgatggccagtgatgatgagcattttttcatgtgttttttggctgcataaatgtcttcttttgagaagtgtctgttcatgtccttcacccactttttgatggggttgtttttttcttgtaaatttgtttgagttcattgtagattctggatattagccctttgtcagatgagtaggttgccaaaattttctcccattttgtaggttgcctgttcactctgatggtagtttcttttgctgtgcagaagctctttattttaattagatcccatttgtcaattttgtcttttgttgccattgcttttggtgttttggacatgaagtccttgcccatgcctatgtcctgaatggaaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtaggtatgcggcgttatttctgagggctctgttctgttccattgatctatatctctgttttggtaccagtcccatgctgttttggttactgtagccctgtagtatagtttgaagtcaggtagtgtgatgcctccagctttgttcttttggcttaggattgacttggcgatgcaggctcttttttggttccatatgaactttaaagtagttttttccaattctgtgaagaaagtcattggtatcttgatggggatggcattgaatctgtaaattaccttgggcagtatggccattttcacaatattgattcttcctacccatgagcatggaatgttcttccatttgtttgtatcctcttttatttctttgagcagtggtttgtagttctccttgaagaggtccttcacatcccttgtaagttggattcctaggtattttattctctttgaagcaattgtgaatgggagttcacttatgatttagctctctgtttgtctgttgttggtgtataagaatgcttgtgatttttgcacactgattttgtatcctgagactttgctgaagttgcttatcagcttaaagagattttgggctgagacaatggggttttctagatatacaatcatgtcgtctgcaaacagggacaatttggcttcctcttttcctaattgaataccctttatttccttctcctgactaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttatcattttgaaatacgtcccatcaatacctaatttattgagagtttttagcatgaagggttggtgaattttgtcaaaggctttttctgcatctattgagataatcatgtggtttttgtctttggctctgtttatgtgctggattacatttattgatttgcgtatattgaaccagccttgcatcccagggatgaagcccacttgatcatggtggataagctttttgatgtgctgctggattcgttttgccagtattttattgaggatttttgcatcaatgttcatcaaagatattggtctaaaattctcttttttggttgtgtctctgcccggctttggtatcaggatgatgctggcttcataaaatgagttagggaggattccctctttttgtattgattggaatagtttcagaaggaatggtaccagttcctccttgtacctctggtagaattcggctgtgaatccatctggtcctggactctttttggttggtaaactattgataattgccacaatttcagctcctgttattggtctattcagagattcaacttcttcctggtttagtcttgggagagtgtatgtgtcgaggaatttatccatttcttgtagattttctagtttatttgcgtagaggtgtttgtagtattctctgatggtagtttgtatttctgtgggatcggtggtgatattccctttatcattttttattgtgtctatttgattcttctctctttttttctttattagtcttgctagtggtctatcaattttgttgatcctttcaaaaaaccagctcctggattcattgattttttgaatggttttttgtgtctctatttccttcagttctgctctgattttagttatttcttgctttctgctagcttttgaatgtgtttgctcttgcttctctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtatccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaagtatgtggtcaactttggaataggtgtggtgtggtgctgaaaaaaatgtatattctgttgatttggggtggagagttctgtagatgtctattaggtccgcttggtgcagagctgagttcaattcctgggtatccttgttgactttctgtctcattgatctgtctaatgttgacagtggggtgttaaagtctcccattattaatgtgtgggagtctaagtctctttgtaggtcactcaggacttgctttatgaatctgggtgctcctatattgggtgcatatatatttaggatagttagctcttcttgttgaattgatctctttaccattatgtaatggccttctttgtctcttttgatctttgttggtttaaagtctgttttatcagagactaggattgcaacccctgcctttttttgttttccatttgcttggtagatcttcctccatccttttattttgagcctgtgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcagtttcttcctagtctcaatggtctttacattttggcatgattttgcagcagctggtaccggttgttcctttccatgtttagtgcttccttcaggagctcttgtaaggcaggcctggtggtgacaaaatctctcagcatttgcttgtctgtaaagtatttaatttctccttcacttatgaagcttagtttggctggatatgaaattctgggttgaaaattcttttctttaagaatgttgaatattggcccccactctcttctggcttgtagggtttctgccgagagatctgctgttagtctgatgggcttccctttgagggtaacccgacctttctctctggctgcccttaacattttttcctttatttcaactttggtgaatctgacaattatgtgccttggagttgctcttctcgaggagtatctttgtggcgttctctgtatttcctgaatctgaacgttggcctgccttgctagattggggaagttctcctggataatatcctacagagtgttttccaacttggttccattctccccatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacatagttcttgagccttggttttcagctccatcagctcctttaagcacttctctgtattggttattctagttatacactcttctaaatttttttcaaagttttcaacttctttgcctttggtttgaatgtcctcccgtagctcagagtaatttgatcgtctgaagccttcttctctcagctcgtcaaagtcattctccatccagctttgttccgttgctggtgaggaactgcgttcctttggaggaggagaggcgctctgcgttttagagtttccagtttttctgttctgttttttccccatctttgtggttttatctactttttgtctttgatgatggtgatgtacagatgggttttcggtgtggatgtcctttctgtttgttagttttccttctaacaaacaggaccctcagctgcaggtctgttggaataccctgccttgtgaggtgtcagtgtgcccctgctggggggtgcctcccagttaggctgctcgggggtcaggggtcagggacccacttgaggaggcagtctgccggttctcagatctccagctgcgtgctgggagaaccactgctctcttcaaagctgtcagacagggacatttaagtctgcagaggttactgctgtctttttgtttgtctgtgccctgcccccagaggtgaagcctacagtggcaggcaggcctccttgaactgtggtgggctccacccagttcgagcttcctggctgctttgtttacctaagcaagcctgggcaatggcgggcgcccctcccccagcctcgctgctgccttgcagtttgatctcagactgctgtgctagcaatcagcgagactccgtggggtaggaccctccgagccaggtgtgggatatagtctcgtggtgcgccgttttttaagccggtctgaaaagcgcaatattcgggtgggagtgacccgattttccaggtgcgtccgtcacccctttctttgactcggaaagggaactccctgaccccttgcgcttcccaggtgaggcaatgccgcgccctgcttcggctcgcgcacggtgcgcgcacccactggcctgcgcccactgtctggcactccctagtgagatgaacccggtacctcagatggaaatgcagaaatcacccgtcttctgcgtcgctcacgctgggagctgtagaccggagctgttcctattcggccatcttggctcctcccccgccacagcacagtttctaacctttgacccaattctatttctccaaatctgtcttaagataatttaagatacaaaaaaaagtatacatttaaaaatgtctgtcacaatgttattcctaatagggataaagtggaagtattcataatgggcaacattaaagtaatggtttttacaaatcgttggttctatatgataggcattaaaaattataatcctaacaaaaaggtagcagtttgaaaaaaacgcttgtgctaaaataatgttaagacagcaaaattcagaatataagtatactttaataacaatgataaaatataaagaaagactagaagaaaatactttaaaaggagaaaacaggaaggtatatttatctgctgtaattggcataagtttaagtacagtggctaagactcctttctcaaaagtgctctaatgggcactactgcctttaacactctgattttttttttttttttttttgagacaaggtctcactctgttgccctgttgcccaggctggagtgcagtgatgccatcatggcttactgcagcctcaacctcctgtactcaagtgatcctcctgcctcaccttacagagtagctgagactataggcatgcaccacaatgcctggctaatgttttgtagagattgggtgtctctctgttgcccaggctagtctcaaactcctgcatcaagcaaccctcccaccttggcctcccaaagtgctgggattacaggcatgagccaccatgcctagccagatttctttttctttagatatatttaatacatccaaataacttattgtattatcttttatcttttggtaggagtctgggagatttctccaacagaacaatcatatgattatttttaaaataaaaatgtttacatattccagcaaacataatatccatattcttacgggttgctgcagttattgtattggtgatgttgcttacaaattttcaaggtattttggcagacaactcttgtgggcttttagggcctgaattgtgtctctgcccatattcatatgttgaagccctagcccacaaagtgatggtgtttggaagtgggggcctttgggaggtaattaggtttaggtgaagtcatgagagtggagcctgtgatgagattagtgcttttataagaacaggaagagagagaaatctctctcccttctcttggtgcatgcactgaagaaaggccatgtgtgagcacacagcaagaaggcagctgtctacaagccaggaagcaagccgtcaccagacactgaacctgccagtatcctgatctcagaactcccagcttccagaaatgtgagaaatgaaatatctgttgtttaagccaccctgtctctggtatttgttatggcagcttcaactgactaagatatgggctaacttttatgaatataggatgtgttgaaggcacatgatagctacttttatattttgcgcataatccattttactaacaaggaactgaacatgaaggccagtctctagctttttctttttttttttttggagacagagttttgctcttgtcacccaggctggagtgcaatggcacaatctcggctcactgcaacctccgcctcccaggttcaagtgattctcctgccacagccccccaatagctaggattacaagcacctgccaccaggcccagctaatttttgtatttttagtagagacagggtttcaccatgttagccaggctagtctcgaactcctgacctcaggtgatctgcccgcctcggcctcccaaagtgctggaattataagtgtgagccaccttgcctggcctctagcttttaactattaataaaattaaggttctgattgttagtgttctaagcatctgggggttttagaaagatactcgccaccagcctgaaaataacccaccaagaacttttatgatcttcaaaagtctagaacaagagaaacaaatttcacacagagttaaatggtaaaaatcaaagccaaggtatggaaagatctcccaaggagataagattgctcccaggctgagtcctgagaagtaaattgagataagtctgcagaaccttggaggttgtattgatgaatgcggtactccatgctatgaagtaagacagcattctgggccaagtcttactcaaagagaggtgctataaagctataaataatttttatactcttgttacccaggctgaagtgcaatgaagcagtctcggctccctgcaacctctgcctcctgggttcaagcaattctcccgcctcagcctcccgagtagctgagattacaggctcctgccaccatgccaggcctattttttatttttagtagagatggggttttaccatgttggccaggctggtcttgaactcctgatcggaggtgatctgctggccttggcctcccaaagtgctgggattacaggcatgagccactgtgtccagccatgtaaaggatttttatatgctccaaagttggagtattttgtaaaacactccatcgatttcattcatcccaaaatgtgtactggggaaggtgaggagggagttgagagaacctcactaggacacaggcttgttctgtgtccacagacccctgtcttaagaggtttcaggtcctagaatgtctttatgatttcttggctgtttatgatcttcaagtcttttatttagcaattaggtatgcaagtgtttatatacttcacccttcccacttctttgtaggtcatataaaagatttagtctttagcttgagagaaataggaagctattgaagaattctaagcaagggagtgacagagtcagttacgtttttacataaaaaaggtatctctcaaacaaagaaaaaaaatttttttaaaaggtatctctcacagtgttgtggagaagaggaagagtgggcaagaagatacatgaagcctacttaggaggctgttttagtaaataaagaagatgacagcttggactacaatggaatagatttatttaaaagatatttaagagcaaaaaccaatcggacttagtggtgttttagaagtgagggggggaaagagaagtgaaggaaaactttgaagtttctggtttatgcaactcaactgaaggtagcctcatttactgaagttagggactttagagacgagccaggcctggcagcaggcatgtgtgatgaccaccgccctggtgtcagacagtttgaattggaggtgtttttgagacactcaagcagggatgtcagttccacttgtcctcatttactatttaacaattagcccttctggttctttgaaggtcagagaaggctgtgctagagatatgatttgggactcacagatatttaaatagcaattgaaactgtggatctggtgaccatagcctgggggagggtaaaagaatgaacaagggaaagaggaggttgaagagaataagatcagagtaggcaaagaaggaactgccacatgtaggaggaaaactaggaaagggtgtgatcataaaagccaagacaaatgtttcacaaaggaagcagtggttaactatgttgaatattgccgatgctgataaaacatttagataaaaaaccaatttgttaattgctatgttaaatgaggagatgtggagtttttaaaatggcatagcaattagatagggaaatttggataatgagcagttaaagaaatgaattacgtttgctattatacttcttaagctgagtattaaactctttgtgttgcaaataacagaaacccaactcaggttcttttaaacaaagtaaataacttattccttcatggatttgaaatatccaggataggagtggcctccagcacaactgagtcaggggcttaaccaatattgttagctgtgtctctccctgtctctgcctctgcctctcagctccgttttcctctggaaggatctctctggtggttcctggccacatcaggcttttctgatccttacaataaataaccctaatggaaagagagctcctccttcctagttctagcaggagtcccaggatttacttaaattttactaatttaaatcacatcctttttcataacctaattactttggtcagaagtaattagatatgctgacaggccaggcctgaatcacctgctcacccctggaggtgggccaggtgaaaagtagccttgtctgaatcacatgggctctgaatagggggaggggtgatctcccaaaggaaaaccgaagaatgcatgctggggatacaaaaacaacagacagctattttagcggtaaaaagaagcctttggcccaatacatttgaataactgcttctgcaatatactttataggtaatcttttgacctaaaggatgaatggatgtatttgttgttataactttaaaagagctacagggtctgatttttaagactaaagaaaggttgtaattatttttgctgcatgtgctgctaccgtggggctgaatactaactaatcttaaagacacattgaggccaaaacaagcccatgaaaaatgttcagcatcagtaatcattagagaaatgcagatcaaaaccacaatgaattatcacctcacacccattaggatggctgctataaaacaacaaacaagcgaaacagaaagtaacaagtgttggtgctatggtctgaatgtttgtgtccccctaaaattcatatgttgaaacctaatcctcaatggaatagtattataagcattacatagtattaagcacccttaagaggtgattaggtcttgaggcctctgtcttcatgaatgggattaatgcccttataaaagagaccccagagagctagctagccccttccaccatgtaaggacacgatgagaaaatgtcatctttcaaccagagagcaagccctcatcagacactgaatctgccagcaccttgatcttggacttcccagccttcagaactgtgagcaataaatttccactgttcataaaccaccagtgtatgacacttttattatagcagctagaatggactaagacagttggcaaggatgtaaagaaactggaacccttatacactgttgatgggattgtgaaatggtgcaacctctctgaaaaacactatggcatttcctcaaataattaaaaatagaactactatctgattcagcaatcccacttctgcatctatatccaaaagaaggaaagcagggtctcaaagagatattcgtacactcatattcatcgcagattattcacagtaggcaaaaggtagaagcaactcaagtgtccatcagtgggtgaatgagtaaacaaaatgtggtatttacgtataatggaatattatttatccttacaaagcaaggctgtcctgtcatgctacatagatgagccttgaggacattacgctaagtgaaataagccagtctcaaaatgacaaatactgtatgattcctcttatatgagatgtctaaagtagcgaaactcatagaaacagagtagaacagtcatactaggggctgggggaaaggaaaaatggacagttgttatttgatgggtatagaatattagttttttttgcaagatgaaaaagttctggagatctgtcgtataacactgtgaatgcatatataatatcactgaactgtacagttaaatatggtaaagatagttttatatgtgtatcttaccacaatttaaaaaaattcatgacacattgactgattcaacaaattacataaatagatggtccttatggactaattgtatctcttttttttttcgttttgggttttttgtttgtttgtttgttttgagatgatccctgtagcccaggctggagtgcagtggcacagtcttggctcactgcaacctctgcctcccgggtttaagcaattctctgcctcagcctcctaagtagctgggattacaggcgtgtgccaccacacccggctaatttttgcatttttagcagagacggggtttcaccatgttggccaggctggtcttgaactcctgaccttgtgatccacccaccttggcccccaaagtgttgggattacaggtgtgagccactgtgcctggcctattgtatttcttaataaggattggtgcacgtatccaaaggcaaggggttttcaggggttgaatttgttagaagatgtacctagcaccccatcacgaacctccctgccccattttgccctggatatgcctctgaactatgtggttgttgtactttgcagtggtattaatagatttgtatgattaaccttatttttcctggttctcttttaaatagtccatttgtgttatcagtaactatcttttaaaagagtatttctaaatctttctaggagtttgcaactcattatatttgtttattagaaattaacccacactttcttttgccatagatgggattgctgttcttcattttttcattaattcatcaaacagacatgcctattgaatgtcattcttgagatacagaggtttgtgacatagactttgctctcaggaatctcacagacaaggcagatatgattcacaagacagggtaggaagtgctgtgacaaaggtgtgcacaagatgttacagggacatagaggatgagtatctctttcaggatgggccagagtataaagaaagtcttagcagaggtaatgactgggttaaactttattttagcattaaaaatacttaagaaacggacaaatccacaatcctggtgagagacttcaacacacccctctcaatagcaaatagaagagcagagaaaaatcagtaaagatgtagaagatgaaacaaaacaacaactgacatactgaacactgtacctagaatgacagaattcacattattttcaagtacacatagtatacataccaaaattgaataattgttggcctaagctatgcttgaggaaattctgtagttgtacaagcatattagaaaagatgtaagagtgaaaatcaaggatttaaacttctatctcagattgaaaaagaacagtaaatcaaacctaaggaaaatagaagaaataaagaagagaaataagtgaattagaaagcaaatgtataacaaaaaaaatcaagaaagcccaaaattggtactatggaaagattagtaaaattgatgaacccttacaaagactaatttcttgaaatagagaagatataatattaggaatgaaaagggggatatcactgtagagcctacaaacattaaaagaaggtatttttatcatctttatatcatgtatttgattggatgaaatgcacaaatttcttgaaaaatacaacttaccaaagctaacagaagaaagaatagaaaatctaagtagtaaaatgtatattaaggaaacttgtttctgttatttaaaacctttccacaaagaaaactgtaggcccatgtaacttgtctggtgaattccttcagatgtttaaggaagaactcagatttttctagataatagaaaaagggaatagttcctaactcaaattgaacacataaaatgaacagtacattacaatgaattgggtttctttaaagtatgctagggtagcttaatgtttaaaaatcaatgtgtttcaccacattgacaggaagtagaaaaagtagatgatcattttgatatgaatttttagcttagcagaaaaggcccttttcaaagaatctgcctgtcctccagcctcctctccttccctgtcatgtatacacacactccttcagccatatatggaatggtttgcacttctgaggcatggcatgttatttcttgcctctctgctttcacatgtatcatactacctgcttctttactcagtaacttacacttgtccttcaagtcagtttaggattcttggaagatgttgccagcatagtctttcctccccctttttccatctttattgagatataatttacatgcaacgaaaggcatctgggtaactaccaccaccacaatcaatatgtagaatatttgtattacccttaaaagggtgctccttctctataaatattccccacattgatctatctgctttccgttagtgtagattaaattcatattttgtgaggtttcatataatctgtattaactcttttgtgtctggcttttttcactcagtatgtttttgagattcacccatattgttgtttgtatctgtagttcattttctctaactgttgagttgtatatcactatatggatataccacaaattgtttatccaatacatattcatggacattagagtttcttctagtttttattaagaataaaacggttataaacattagtattcaagttttgtgtggacatattttcatttcccctaagtaagtacataagagttaaattgctcagtaatattgttggtatattcttaactatgtaagaaaccaccagactgttttccaaagtggttgtaccattgtacacaccaatcagcaatgcatgagtgttctgtttgcttcatatcctcagcaagacttgctattgtcagtctctttaattttagccattctgctgggtattggtggtatgtcatgattttaattgatgtttctctgatgaattatgttgagtatcttttaatgtgtttattggccattagtattatcttcctttgtgaagtgtctgttgaaatattttgcctattgagttgtctataagaggttatatatatatttatgtatatattctgaattcaagtccttcatcagatatgtgataaaagaaaaacttcagccgaattaaatttaaaggagtttaattgagcaatgaatgattcatgaatcaggcagcccctagaatcacagcagattcagagactccagcacagccacatgatggaagaagatttatagaccaaaaaaaaaaagggggaaatgaggtacagaaattggaagtgaggtacagaacagctggaatggttacagttcagcctgtgccttattggaacacagtttgaacacacagcagtgaatgaatggttgaagtctggccgctgggactggccaagacttagctattgttacaggtgcatactactaagttaggttttcagttttgtctgcctatgaagctaggttacagttcatccacaaggacacaaatgtagaagtatggagtccttctcaggccatatttagtttgctttaacgtatatatgttgtgaatactttttcttaatctgtggcttgctttttcattttcttaacgttgcctttggaagagctgatactttaaattttatgaagtctgatttatgaaatgtttcttttatggttcatactttttgtgtcctctgtttctaccccagggtggcaaagattctctcctatgttttattttagaaattttatagtttcagctagtacatttaggtctatgatttatttttagttaatctttgtgtatgatgtgaggtaagggtcaaggtccccttcttcccaactatggataatttgattgtcccagcaccattttttgaagagattgtacttccttcattgaattattgtggcacttttattgaaatcaattgaccttgtacaaggggtcttcaaaaagttcatagaaagtatattgtgaaaaatctatacaaggatttcattttttttgcaccaaaataaacatctactaacttgttataacatgtctgaacaggatctaatttgaggcactaagaaagaggagacatcagtttgaaaacaacccctattagagcaacatggattttgctaaaattgaagaaagaacaaacatcacatttatggtgaagcttggatggaagaagagtgaaatcaatgatgctttatgaaaagtttatgaggacagtgttcccaaagaaattggcagtttataaatggataaatcattttaagaaaggatgagacaatgttgaagataaagcccatagtggcagacaatccacatcagtttgcaaggagaaaatgaatcttgttcatgccctaattgaagaggatcaatgattaacagtacaaacaatagtcagcatcatagatatctcaattggttcagcttacacaattctgactgaaaaattaaagttgaacaaactttatgttgatgaataccaaaactcttgtgcccagatgaactgcagacaagaacggaggtttctttttatttttctttttttttggagacagagtctcactctgttgcccaggctggagtgcagtagtgtgatcttggctcactgcaactttcgcctcctggtttggagtaattcttgtgcctcagcctcctgagtagctgggactacaggcacccaccaccatgctaggctaatttttgtatttttgaatagaaatggggttttgccatgctggccagactggtcttgaactcctggcttcaattgatctgcctgcctcagcctcccaaagttctgggattacaggcatgagccactgtgcctggcccaaaagcagagctttcaatggaaatttttaacaagtgggatctagatcccaaagcatttcttcgaagaactgcaacagatgaaacatggctttaccagtatgatcctaaagacaaagcacaatcaaagcagtggctagaaagaggtggaagtggtccagtcagaggagatgtggatcagtcaagtgcaaaggtcatggcaatagttttttgggatgctcaaggcattttgcttgttgacttgctggagggccaaagtgcagggattacagacatgagccaagttgtactattcttactatctttttagtgcctgtgggatctgttgtgccatcttctcttttattcttgttgtgaatttgtgtcttctcactttttattcttgatcaatctagatagagattattattttttcaaagatctatatttttgtttcattaaattttctgttttctatttcatttacctaagctctatatttatttccttctacttatttctggtttagtttgttattttctgacttcatacagtggaagcttatattattattgctttttttctaagtatttaaaatcataagctttcctttgagtactattttcactatatatcccaatttttttctatgttgtattttcattttcattcagtttaaaatgttttattctgtgatttttttttacccatgggtaatttcacattgtgttatttaatttgtaaatatttggagattttccagttatctttatgtaatttttttctaatttaattcttttatgaccagaaagcctactctatagtatttcattcttcttttaaaaacctactctatattatttcagtctttatggaaggtatgcatatggtatatctttttgaatgttttgtgtgcatttgaaaataatgtatattctgctgctgatgataggtattctatgaatgtcagatcaagtaggttgattgtgttaagtgttccatattcctaatgttattcagtctacaagttctgtccattactgaaaaaggagttttgaggtttccaattctaattgtagatttatttctcctttcagttgtgtcagtttttgcttcatgtattttgaatagctgttattgggtacaagcacattcaggattgttacgttttcttgattaatttaaccctttatcataatgagatgttcctttttatctctggtaatgatccttgacctgacacatgtttgtctgagattgacatagccattccagttttcttattattagagtttaaatgctatatctttttatctctttttatctgtttctttacattcaaaatgaattttttctagatagaatatcgtctgatcttgcttttaaaatctattctgacaacctcttttcagggtttagaccctttgcatttaatgtgattttctgtgtaagtttaaatctgccatcttgttattttctgtttatcacatctatttttgtttgtttctttttccctcttttcgttacttttgggttaattcagtgtttttttaggattccatttcattttcacaattggtttattagctactcctcctttatcaccacccaccatggctgttgtagggtttacaatatacatctctaacttatcacagtctgtcttcaaatatatgctgcttcctgtgtaatgtatgaaacttaacaatagtgtacttccatttgtcccctggacaaatgtgctgctgttgtcatatagagcatattcatgaaatagcttcttcaatacccttttctgctaattttatcatctcttaaatttctgagtttgtttctgttgactcatttttctcaaggctactagtcattgttgctggtttttcatatatctagtactttttgatcagatgtcagatattgtgacttttacattgctgcatgctcacttttgttgtattcctttaaagagtacagaatttctttcaagcaagtagttaagttactaataatcagtttgacccttttgaagcttatttttaatctcttttaaggtagatctagagtagcttttactctaaggctgatttagcaatactcctgatgtattttttttttaaatagagatagggtctcattatgttgcccaggctagtcatgaacccttggcctcaagcaatcctcccatcttgggcttccaaagtactgggaccataggtgtaagctaccacatctggccctcatgtatgttttctactgaatgtcctgtgtattcaatgaagtctctctactctagctagttgtaacttaaacattcccagacctgtggaattctaggactgtttgacttacaattcctggtgattcttatttttccagaagttgttcttgctcagtcttatggtatttcgttctgcatatgtacagatagctattcagccagagattcaaggaacgcatatgcaggtttctaaagctcttcctctgtgttgtcttcctctcttaagtgccctgccctgaaaactgcagcatcttggcctacctgacctcccatctctttcttctcaactcactgggattgcaggctctgtttggatttccattctctgtgccaaagtctggaaattaattttaggaagaaagcctgggtgatggtagggctcactttgtctcccttttatcagatatcacagtcctgtactgtctattttctactgtctgaaaatagttgcttccaatagttttgtccagttttctagttgtttataataggagtataaattttgaccctcttattccctgttggtcagaaatgacatcacagcttttgtattttctcctatctccccataaaaatagacagttcaaacagggctgcaaaaccaaagacccatggataacatctacaactaaaactagatgactaggcattcctgtgaccttccaaatatgagtggatggagctacatcactgacagcttgaagacctgtgtgatgtcgttatctatacgggggggaaaaaaaggcatttcagcttctgataccttgagattgctaaggctatatcaaaaggacagggccaacttgaaaaggtcctcatagctaaagagaggcaatgtaaagatcagtaactgcaaaggatcgaaacagcaaatatatttaaatttgtaagtttcaaatgacacttttttaaaaaaaaaccctcattgtaatctttggaggatactagagaaccacctcattattttgaaagctgacaaatacaagaaatgagggtgagcatttatcccacctttcctatttttacctagtataacaaaatagttgatgaggcaaaattcctctttcgagatgtattctgtctcataaagaatgaatgaaaaaatttaaaaattaccattttgcaaccccagatgaattaatgagtgtaggcagtgattatcaatggctgctaatatcacaaaaagaataaaaaaccattatgtacctactatggaatcgaatacctgtcacttaggaagtaatcttataaaatctgagaaaaaaaaatccaacctgaatctgcaagcttcttgatctaccgctttttgagaattataagacagagttacatattaaaacacaccatggagatacaaaaacaaaatttagtgaggggactttagggcaggggttagcacacaatgcgtgggacacatctggcccattgcctgtttttgtatggcttttgagccaagaatagtttttacattattaaatggttgaaaaaattcagaatattttgtgaattatgaaaattgcagcgttcataaaaaggttttgttggaacacagccatgcttatttgtttatgtattgtttgtggctgctttcgtgctacaagggcagagttgagtaggtgcaggagtctgtacaatcaaaatgccaaaatatttactcactggcccttaacaacaaaaaaaattgtcaatccctaatctagaggactaatggcctggtttctttaacaaaaaaattccaagaaaaaggatgaaaggaaaaatcagtaagacttaagagacatgacaagtatcacaatatgtggaccttatttggatccctattcaaaacaccatgtttaaaaaaccaagatcatcaggaaaatgtgaacagcaacaaagatacttgatgatattacggaattgttaatttttaaaggtgtgataatgattttgtgattatattttaagaggtccttagctttttatttttattatttatttatttattttatttttttttttggagacagagtctcgctctgtcgcccaggctagagtgcagtggcgtgttctcagctcactgcaagctctgcctgccaggttcacgccatcctcctgcctcagcctcctgagtagctgggactacaggcgcccgccaccatgcccaactaattttttgtattttttagtaaagacggggtttcaccatgaaagccaggatggtcttgatctcctgacctcgtggtccacctgcctcggcctcccaaagtgctgggattacaggtgtgagccactgcgcctggctggtccttggctttttagagatagattctgaaatatatacagatacttggatttgcttcagaataatccagggagatgggagttgttgagtgtggatgtaagtaaaataagattggccatgttatgaaaattgtgactggaagatgggtgcgtagtgtgatggctcatcacactgttttactattttctctagctttgaatgtttgaaaacttagagtttaaaataaatcagttatttcaaaataagtttaaaaaatcagttcaaaggccatttcctctggacctagtaattgaatgcctcttttctgtgcttctgtagaatcatggaacttaccacattgattattgttgggtggttatttgtttaacttcccctagactcccagctccttgagggcagggaccatttgactttgatctgtagtgtcagttataggacatagcacgtaatctggtacatacttctggaacaaatataataacttttcatggcatatcatgatttctagatgataaaaattgtaaaacacagtcgtccttttttgttgacattatttatttttatttactttactccttccaaatagcctatagttcagcatgaaaccaaactggttatatagcttttataaatcaggaaaaatataactccaaaataaagtaagttatagaatgggcatcttagtttgagctatctcagtctgagatatgatattaagtgtggaataggtactttgaagtaaggcaggtattgcttctccaagcacaatattgtatgtttctgaatattgcagaaatatccatattcaaatctaagaccaaaatctaatcaaaccagctacaaattatttctatctatcttattattcccttttgttagcttaataccttaattattagcttaacctaacaactggttatgattattgaaaatttaatttttgcctgggtgtggtggcttatgcctataatcccatcactttgggaggcccaggctggaagattgcttgcgaccagcccgtacaacatagcgagaccccatctctacaaaaaaatttaaaattagctgggcatggtggtgcatgcctatggtcccagctattcaggaggctgaggtgggaggactgcttgagcccaggagatcaaggctgcagtgagttatcatcgtaccactgcactccatccttggcaacagagcaaaactctgtctccagaaaaaagaaaatgtaattttagaaatcccaatcttttgctttgttttccctcttcacatcgttgtcttcatatttgtagcaattctcttatcatggatttttttttttctgttttcagtgaaatttgatcctcacaaactgagctccaggatagtgagtcagaaacacaaccctgaagcttaagccagggtctaatttttaaataaatcacctggcaccaaaacaccttctcacattcatcaagaagcgcttttggtgttctgggcctggggacgaggtgcactgtgaaatgatcagtcatccagttacttttgtaacctgattctcctatgctgttttcctctgaatcagggttttaacagcaggtgtgaacatttagaattgtcattttcataaaaataaaatgctgttttcttcaaagcatttacaaaatcataatgggaagattttaaagctaatttacctagctaaatgccagtgacaccccatgatattctcctggcttccttgcccaaactggtaggtgaagtcagaactgaggggtgtctgaggtactaatggaactagctcaatggcagagtcaacagcaagggaaacagactcagtagggttaagggcacaggtagtttttcccaccatctttggacttcagattgtgtacatcttatctgtgcatccattttcttaggtacttttctccctttcgttgatggcttcctttttatctctatggcaagtcttcattatgtatgatagcaggggccacggagtgcatggatgaccacaatttagaaacgcacttcataatttataatgcatgaaaagcaaagcttgagattctctttatatgaagtgtagtgtggcgccccatcttggtggcattctggccactgcccctcaggctgtgccagaactgggcaaattaagggatgggtcaaagtgtgttaggaggaaatgggggtgtcaaccatgtgccagaaattggccctctttcattcaacagacatgctgggcacaaagatgaatgtaccccagttcttgatctcatgaagtttgcagtgaggtgtaggggctacaaaaagaagacagggtagaagcaacagccagccattgcagggcacagcacctcctgctgctagactccatgcagatttgacagcccttatttctactccatccctgtgcatcacctgacaccattgacaagtttctctgctggaaactctcacccctcttagcttccacattactctgtcctggacattaattcttggtattggctcttgttcttttgtctgatggtaaattagcatttcctagagttctccactcttttttttttttttttaatactttaagttttagggtacatgtgcacattgtgcaggttagttacatatgtatacatgtgccatgctggtgagctgcacccactaactcgtcatctagcattaggtatatctcccgatgctatccctcccccctcgccccaccccacaacagtccccagagtgtgatattccccttcctgtgtccatgtgatcttattgttcagttcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccaatctatcattgttggacatttgggttggttccaagtctttgctattgtgaatagtgccacagtaaacatacgtgtgcatgtgtctttatagcagcatgatttatagtcctttgggtatatacccagtaatgggatggctgggtcaaatggtatttccagttctagatccctgaggaatcgccacactgacttccacaatggttgaactagtttacagtcccaccaacagtgtaaaagtgttcctatttctccacatcctctccagcactagcaaggcaggccaacgttcagattcaggaaatacagagaatgccacaaagatactcctcgagaagagcaactccaaggcacataattgtcagattcaccaaagttgaaataaaggaaaaaatgttaagggcagccagagagaaaggtcgggttaccctcaaagggaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaattaaatactttacagacaagcaaatgctgagagattttgtcaccaccaggcctgccttacaagagctcctgaaggaagcactaaacatggaaaggaacaaccggtaccagctgctgcaaaatcatgccaaaatgtaaagaccattgagactaggaagaaactgcatcaactaacgagcaaaataaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccatctcacgtgcagagacacacacaggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagagatcaattcaacaagaagagctaactatcctaaatatatatgcacccaatacaggagcacccagattgataaagcaagtcctgagtgacctacaaagagacttagactcccacacattaataatgggagactttaacaccccaatgtcaacattagacagatcaatgagacagaaagtcaacaaggatacccaggaattgaactcagctctgcaccaagcggacctaatagacatctacagaactctccaccccaaatcaacagaatatacatttttttcagcaccacaccacacctattacaaaattgaccacatactgggaagtaaagctctcctcagcaaatgtaaaagaacagaaattataacaaactatctctcagaccacagtgcaatcaaactagaactcaggattaagaatctcactcaaaaccgctcaactacatggaaactgaacaacctgctcctgaatgactactgggtacataacgaaatgaaggcagaaataaagatgttctttgaaaccaacgagaacaaagacacaacataccagaatctctgggacgcattcaaagcagtgtgtagagggaaatttatagcactaaatgcccacaagagaaagcaggaaagatccaaaattgacaccctaacatcacaattaaaagaactagagaagcaagagcaaacacattcaaaagctagcagaaggcaagaaataactaaaatcagagcagaactgaaggaaatagagatacaaaaaacccttcaaaaaattaatccaggagctggttttttgaaaggatcaacaaaattgatagaccgctagcaagactaataaaaaaagagagaagaatcaaatagacacaataaaaaatgataaaggggatatcaccactgatcccacagaaatacaaactaccatcagggaatactacaatcacctctacgcaaataaactagaaaatctacaagaaatggataaattcctcgacacatacactctcccaagactaaaccaggaagaagttgaatctctgaatagaccagtaacaggagctgaaattgtggcaataatcaatagcttaccaaccaaaaagagtccaggaccagatggattcacagccgaattctaccagaggtacaaggaggaactggtaccattccttctgaaactattccaatcaatacaaaaagagggaatcctccctaactcattttatgaagccagcatcattctgataccaaagccaggcagagacacaacaaaaaagagaattttagaccaatatctttgatgaacattgatgcagaaatcctcaataaaatactggcaaaacgaatccagcagcacatcaaaaagcttatccaccatgatcaagtgggcttcatccctgggatgcaaggctggttcaatatacgcaaatcaataaatgtaatccagcacataaacagagccaaagacaaaaaccacatgattatctcaatagatgcagaaaaagcctttgacaaaattcaccaacccttcatgctaaaaactctcaataaattaggtattgatgggacgtatttcaaaatgataagagctatctatgacaaacccacagccaatatcatactgaatgggcaaaaactggaagcattccctttgaaaactggcacaagacagggatgccctctctcaccactcctattcaacatagtgttggaagttctggccagggcaattagtcaggagaaggaaataaagggtattcaattaggaaaagaggaagccaaattgtccctgtttgcagacgacgtgattgtatatctagaaaaccccattgtctcagcccaaaatctctttaagctgataagcaacttcagcaaagtctcaggatacaaaatcagtgtgcaaaaatcacatgcattcttatacaccagcaacagacaaacagccaaatcatgagtgaactccattcacaattgcttcaaagagaataaaatacctaggaatccaacttacaagggatgtgaaggacctcttcaaggagaagtacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcctgcatcgccaagtcaatcctaagccaaaagaacaaagctggaggcatcacactacctgacttcaaactatactacaaggctacagtaaccaaaacagcatgggactggtaccaaaacagagatatagatcaatggaacagaacagagccctcagagataacaccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctggaagaaaacctaggcattaccattcaggacataggcatgggcaaggacttcatgtctaaaacaccaaaagcaatggcaacaaaagacaaaattgacaaatgggatctaattaaactaaagagttctccactctttcctgtcccacccagtactatcaattctgaacctcaatttttctgcctcagcactttcctgggttatgacagactctcatcaattaacagtaacttcctttggcagtgattcttgacctggtgggggaacagtatccaaagctccagtagcagaagctcccttggtgattttgacacatttccccctcctcttggacagattctgtgtcttatattttaacccctagcacagtggccagctgtggtaggagctcagtgatgttaaccgcatgtttaatggcagtaagcacagcatgctatgagaacacagagcaggtcacttaattgtgagaaagtcaggaaaagctacagagaagctatcagttgagccaaactgaattctctagatggataagccttaaaagagattcaaacaggtggattttcacagcaaggcagatcagttattgaaatttatgtatggcaagtggttagacacacaggcttctttactaaatctcagcattaggaggaaagaactctttctgaattttgaacattagcataagtcaaataaaagtaagatgttctatatcattggataggtaatagatttgtggtcatcactgctcccaagaaatgatactggtcctggcatgaaatagtctaattaatttttaaaaataatttcaattttcattttagattcaggggtacatgtgcaggtttgttacctgaatatattgtgtgatgctgaggtttgggatacaaatgatcccatcacccaggtagtgagcatagtacccaatagatagtcttttaattaattgtaataaagtgtttcatttattcactcaataaacttattgaagcaccttctagtgttaagcactataataggtgctatatattcattagcgagcaaaacgaacttagccccttccctcttggggcttatagtctagtgaaaaaatagacattaaggaaatcactacaaacacacagacacaatgataaatgctatgagagaaagtggaatgttgagggaaagtacaacagagtcacctagttgagagactaggcaagaagtgaacaatgatcagaggttaattaggcaaaaaaattagggggaagaggcagaagagatataggaaactccatggcaaaatggtttgaacaaatcgatgaagagccataaagcagctcaactaagagttgctgttgaggaggaagggcacaccccttctcaggtcctgcttctgcctcttccttgagttcatgccatattgtagtgggtatccccccctgaatcaactccagcgacagtggtctccttgcaggttcccagacaggctatgctgtttcatgcctttttaaaattgtggtaaaaaacatgcgacatgaaatttaccctcattttaagtgatcagtacagtattgttaactataagcacagtgttgtccacaaatttaagcattatgcataagcattaagcataacattaaacaataatgttgtccagcacaaatgtttgcacaaattttctcatacatgcataagaagcttacacagctcaaaaatcagagcaatgtaaaaaggcatagagaaagcttttattcccacccctgccacatctgcactgttcgccttcactccctgcagataatatttttattagcctcttgtgtattagtcctctagttctttatgtaaagaatatacattgttatgttctctcttattaaaaaagtagcatatgatggacattgttatgtagcttgcttttttgcctaacaatacgtgttagagttcagtttatatagagctgcactgtccaagatcagtaggagtcatatgtggctgtggagcacttgaaatgtggcaggtgcaactaaaaatggaattttaaatttaatttaatttaaatttagatttaaaaaatgaaagcagtgaacaatattttcctattaatctcaactttattgttttagtaggactacatttcactttaactattgaaaatccaacatccaaattgagatgtggtataagtgtaaaacacacactggatttcaaagacagtataaaaaaaatgcaaactgtctcattaatgttttacatcatttacaatctagtcatcaatttgttcagtgttttttgatatagttggctaaataaaatattaaaaccaattctgccaatttatctttttttaaaagtgatactagagaactttaaattacatatgtggctcaaattctatttctttttttttttttttttttgagacagaggcttgctctttcgcccaggccagactgcagtggcgctatcttggctcactgcaagctttgcctcccgggttcacgcctttctcctacctcagcctcctgagtagctgggactacaggcacccgccaccgcacccagctaattttttgtatttttactagagacagggtttctctgtgttagccaagatggtctcgatctctgacctcgtgatccgcctgcctcggcctcccaaagtgctggaattacaggcgtgagccaccgcacctggctcaaattctatttctactggacagtgctgatacataacatttactactttttacacctgtatagtattccattgtatagagtaccacaatttacttaaccaatccacctttgatgcatacctgagttgtttccaatcttatgtttaaaaaaaaaaaaaagcagaaatgcttacccttctccatgcatcacttcatacatgggcaggttgatctgtaaaatgaattcccggcattgggattgctgggtccaaatgtaaatacatttgtaattttgatattgccaaattgccctccgtaagcattgtaccaatttgcactcccaccagcaatgtgtgtgagtgccagtttcctcatacattgccacttgaaactacaattaactgtatttttggatgtaataatcaacatttctttttgctaattctgagagggttttaagaagaaatcataaatggtttgtctaacttctctttccatttggaaaaaaaacctattgataaaatgcttagaggtagcatttcagaactgattttttttttttttttttttttttttgagacggaatctcactctgtcccccagactggagtgcagtggcgcaatctcggctcactgcaacctccgcctcctgggttcatgccattctcctgcgtcagcctctggagtagctaggactacaggcacctgccaccacgcccggctacttttttttttttttttttttttttaaggaaagcatcaaagaattaaccctcactgtttcccaggttgtaaatttctatgaaagttgcaactttcaccatactgagatttaggcagagggattttgtgagggttcaaatggataagggactacattttcttctgtttttttaagagttggggatttctcagattactccagcagccttccctggctgtggtggactaacatttaagggtagactggcagtttccatgcaatttttgcatattgtcagttaatctcctggattggttttactgtatgctaaacatattctaactcaatgggttgcttaactgaggaaaccagtgacaacataactggcgcttaagagctgccataatcatcagatagttcattccactgactttattagtaaatggcagagaaagtttatcttttcactttatggatccaactgttgtccctcatttgagacttgtgtgccctctactgccctctttgcctttttttgttttttcagatggaaatgaagaagtaaacattcagtatccaaaagaaaactgctttaaattttccattcataggaatatgaaaataagattcttatgaagagaattcttactatggagttagagacgtgccagataagttaataaatcagtataatggaacccttgatttgggggaatataaaatattttggcaaatcctagaggcatagaaaggcattttatatcaaatatgactatggacacttaactatctttagtattgtattgattttcaacataaaaagattaagaaaaaaaagttgtcttacgttcctcatgcaggaaaagcaccaggacattgaggacttagtataagggtcatccttggcaactggttttattgagtcattgctactatgtttgagttacacaataaacaaatatacaactttctaacaggaagtagctgcagccatagctattcttcatatttttgtttctgttgctaatttttgcctaattttgtttcaggaagggttttcactcattggtagcaaggactggttgaagattgtaagacgcgtggattgtctgttgtttggaacaacgataaaggcaagatttaagctaatgatcacactcttctcatcttctatgtgtgtatgttggggaggtatttgggggcatctcttggtaggtgacgggtactgggaagaatacaaatgtttaagaaaggtttgtactatgagaaaaacatgaaacaaggaccgtagagaggcagaagcctcattagcaggaggacattgctaaggagtcaggctctgatggatttctcagtatgcgtctgatggagctgtgcagccattctctatcccccaagcacaaattggaagtggagtacatcatttgtcttgcgatttggatgtttaaaaaggtgtataccttcaaatgattcagtgaatatgtattttcattttttctttttaatattaaaaaatttcccttttacttgctttctagctgtattaagtgtaaagaatgatcttcatcaaagaaacagtcatattaatcacctggatcattttccttcaaaaataactatgaaaaccaatctgttaacattcatggagtagataatattgaaatttaagtgaaagatactaatttttgagggactcagactctgagagttagacgattatctagtggaggggtattaacctggggtacacagaccccagagtctccatagaattcagggggtccatgaacttccatggattttcactgacctctaattgaaatgtatcatttccttccactatgaatgtaaggccagcagaccacagtagttttagaccttctcactaatggaaatcacagatactttcatatcacatttcagttgtttctgacatctcaaatgtttatgctcatcactacctcaaaattaaggtgtttattagtcctcctactagatctttattatcaaatacattaataaagaagcatatatattagttcacaaattagtgccttaatattgtaataaactaattcagtataattggtttctttgtaaacttgtgcattttgtgtgattaaaaacattgttctgagaaggggtccactggcttaccagattgccacagggatctggagcacacactccaaaatgttcaagaacccctgttttgtttcccatataaggaaattgacttaagccaatagcccaggttatgactagctatcagagaaccaggctgccctttgatctttggacttagctccagaccatatcatactgaatgaatgtatagatctctgaaaaagttatacatgctgtatgtttgatacttgagttttaaatttttctaaatatacattattactaaaattttaaactaactacaaagagcaaaataaaaatcaaccataatttgaccactcaaaaataattattaatattctgaaggttttactaagcatatatactatatcagttaggattgtgttcagatgcatgtaagagaaaaatcagctataatggcctaaaaaaccagatttctttttttttcacttaaaaggaaatctaggctgggcatggtggctcatgcctgtaatcccagcattttaggaggccaagacaggtggatcacctgaaatcaggagttcaagaccagcctggacaacgtgatgaaaccccatcttttttaaaaatacaaaaattagccaggggtggtggtagatgcctgtaatcccagctacttgggaagctgaggcaagataattgcttgaacctaggaggcagaggttgcagtgagccaagatcgcaccactacactccagcatgggcaacagagcaagactctgtctcaaaaaaaaaaaaagaaaaaaaaaaagaaaaaagaaatctagagacaggcccttgctagcatcctccagcaactcaacagtgtccaggttggcatctcggtaattctcctggcctctccctcttgggtgcagaatggttgctgcagctctactatatttccattgaaggaaggtcagcatcacctggcccttttataaggaaagcatccactttcctatatagctctccaccacccacaacccccagaagatgcctgcttatgtgtcatggaccagtgtaatatggctgtcccaaactgcaaagattaggaaaatgagcgtttgacatttccagcccctcttgtggattggcttgtgctaattgagtgtccaccatatagataatttataaaatggggattgtagtactttgtatcctgttctttttatcaggaacattataccaagtcattagatagtctctgaaagaaaacactcataatggcttggtagcgtgttattgtttggatgcactagggtttaactcatcgctaatttttcactattataaaaatgttctgattttcataaggatttatttacagggttcttgagatagaagtcctagaagtatacacttttttttttttttttatataaatttgccctcccgataggttgtccctgcttctactctactggcaatgtgtaagaatgttcatttatccaaatcctctccaacgtggtgatacaatttaaattcaaaaactagtttctaatttgacaggcagaaataagcatattcctttaatttgcatttcttgttaaaactgatgagaatggtaatgtaacatttgtatttcttctgttaatcacctgcttcttttgcctagtttttctcttcttcaaactacgtataatttgtgtagctatataattttatatatttgtgtatatactgtatgcacagactttttaaacatttaaaactaggaaccatttgcctgttattgtcaatggtttttttgtttgtttgtttttgagacggagtttcactcttgttgcccaggctggagtgcaatggcgtgatctcagctcactgcaacctcctcccgtgttcaagcgattctcctgcctcagcctcctgagtagctgggattacaggcatgcgctaccacacccagctaattttgtatttttaggagagacggggtttctccatgttggtcaggctggtctcaaactcccgacctcaggtgatctgcccgcctcggcctcccaaagtgctgggattacaggtgtgagccatcacacctagctgtaaatggtattctttatcccaaatatattttcagccagttattattggatttttttctgaattagtttaaatttaacctccttactaaacttttattaactgttttttaatttctaggaaagtgtttttataatttacagacaattgtatttctttccaatgatttatattttttattactttccccaccttaccgaattgtctagatctcccagaatgctgtaatcatagggttatagtatctttgacgtcttcctgacttgcatgggaagtagtgtttagacattaactccatctctgtctgttaactggcttttttttttttttttttttttttgagaagagtctaactctgtcccccaggctggagcagtgttgtgatctctgctcactgcagcctcaaccttcagggctcaaacaatccttccgccccatccttctgagtagttaggaccacaggagtgtgccaccatgcctagccaatggttcgatattctttatcatgtaaggcagattctctttcaattatagtttatttaatacctttatcaggattacatatcattttatcaaatgctttttgacaagtattaagatcatgggtttcttcctcctttgatctattgacttgatgtaatatgttgacattgaaccaacagattcttcttttgccctacctggcaaagagtatctgatgcatcttggcttggataacttttagttttcaagtattatgccaaaacactattatttaattgacaaatggaagaagtaaaattttcattccttttatagcaatttaatataaattctatgagtagtaaacattatatttcttttctctctgaactgaaataagtaggttgaataaattctgcctacttataaggtaggcttccctttttccagcaattctgatcaaatagggggctaacaatagacatataattccttatcttaagggcactttggctcaaagaaggaaacccaaacaaccactgtcctctttacttctcactcccagtaactcacggaggagtttttaaaatgatttcgtctagccaaggctttgagtattgccttttagtttcaaagcaaagaatcaaataaaatgctgaagtaccttctctgtttaagacctttttctgtacttccacattttctatagtagaggaattcacaattagcggtggggaaaactgcttcagttggggtcttagtggtaatggaaaatttcttaccaacctgggtgatgaatctaaaaccagcgggaaaacccactgggtttttatgaggcctctagtgtctccttggctctctatgtcatgttaactgggctccacattttccagggcatgacgatgccttggaacacctactgtggagcctgtggcctaagcatctctgtatggagatgctattcatacctgtgagccagcacttagtaggcctaatccctttgtgagtacacgtagataagtgaaaagagatgagcacttatccttaaatttgcttccttgagtctgtattagttgttataacttgaaattaagtgttctgaaggagggcaggtgcaactttacatgtaagccaccacttcagatacagtaattatgagcccatcttcttaggtgatagaaactagagactgtatatttggcgaagttcgtgattgttggtatacttgagaacttttcacttcacagcaagaagctctttctgacttttaattatggcataaaaataaatctcatcaagactttcaatctttagcagtccctctggttaacccagtggaaagttttccattatggtaacctatggcattgaggatataggatggagatacaactaattttcagatttttcctgatgtacctgggttttatcttggatccacatgcattgaagtggtatttctggctttagatgataagctcaaattctaaaatttttacagaagcaaacatggaacaagacttcagttaggctattagacatgtaaactactctgttgcttttttggaattatactccaaaaaaaaccctagctatccaaactgattattatatacattcacatatagatacctgtagacttatataactggtctcaggtttttgccctgcttgtatgcttagtgtctgcttgtgcatacagctttttaaagctagctatgaaatacagttgctgatgtcactgtcagaaagttaattgcagaatcctaatagctaatataagggtacttcatatagatgtcttcatatagagtctgttggaaacagctaaataactgtaaacaagaaatcagtttaatttcacaaaagaagattcatagtagtattatagattgaatgtataggtctcttatcagttcttttcccttcctcagggaaggtaggctttcaatgactcctgataatctggggattatccatccaagaggaaaatggctaagggcatgaataggtaatacactaaaagaaaaaatacaaatgaccaataagcataagaaagatagtcaacctcacttgtaatcaaagaaatgaaatttttaaaaaactatgttaacctagtatgttgacaaaaatttaaaaaaagaatcttcagtgtcggagggaaatgggcacatagattcttggtgggagtaaataagccctgtcttgccacaggggagttaggcattatgtaccaaaatatgaattacacacatcctttgacccagcaaatctgcttttaggcatgtatacacaaagatgtatgtataagagtgcttgttaaagctttgtggtttataataggaacaaaggctggaaataacctaaatgttcatccatagggggccagttaaataaaggaatactcttcagccattgaaagtaatgaggtatacttctatttttatatatttgatgttaaattaaaaattatgttatagaacagcaatgtattttacatatacacacacaatatatataacctataaaaatatatttatcagtgaactcatttttgataaaggttacaagaacataccctgagggaagagacagtctcttcaataaagagttctgggaaattgctgaggcaggagaatcgcttgaacccgggaagtggaggttgcggtgagccgagattgtgtcattgcactccagcctgggcaacaagagcaaaactctgtctcaggaaaaaaaaaaaaaaaaagagttctgggaaactgatatctatgtgcagaaggatgaaacaagactcctatctttcaccatatacaaaaatcaaataaaaatggattaaatacttaaatcgaagacctcaaactatgaaaactactacaagaaaacactgaggaaactctccaggatgttgatctgggcaaaaatttcttcagtaataccccacaagtgtagacaaccaaagcaaaaatggacaaaggggatcactttaagttaaaaagcttctgcacagcaaagtgaagagacaacccacagaaggggagaaaatatttgcaaactacccatataacaagggattagtaaccagaatgtataaggagctcagacaactcaatagggaaaaaaaatctaataatctgattaaaaaatgggcaaaagatttgaatagacatttctcaaaaagcaaatggtaaacaggtatatgaaaaggtgatcaacatcactgatcatcagagaaatgcaaatcacaactacaatgagataccatctcactccagttaaaatggcttttatccaaaagccaggcaataacaaatgcaggagaggatgtggtgaaaaggggaccctgttaaatggttggtgggaatgtaaactagtacaaccattatggagaacagtttggacgttcctcaaaaaactaaaaatagagctaccatatgatccagcaatactactgctggatatgtacccaaaagaaaggaaatcaatgtatcaggatatctgcacccccatgtttgttgcagcactattcactatagccaagatatggaagcaacctaagtgttcatcagcagataaatggacaaagaaaatgtggtacttatacacaatggagtactattcagccataaaatagccatacacagaatgggtataactggctagccatacacagaaatacaaaaattaattcaagatggattagagacttaaatgtaaaaccaaacgctataaaaatgctggaagacaacctaggcagtaccatccaggacacaggcacaggcaaagatttcgtgacaaagatgccaaaagcaattgcaacaaaagcaaaataggatctaattaaaccaaagagccatgcacagcaaaagaaactatcaacaaagtaaacacaaaacctatagaataggagaacatttttgcaaactatgcatatgacaaaggtctaatatccagcacctacaaggaacttaaatttacaagaaaaaaacaactccataagaaagtgggaaaaggacatgaatagacactttttttttcttttttgagatggagtcttgctgttgccaggctggagtgcagtggtgtgctctaggctcactgcaacctccacctcccgggttcaagtgattgttctgcctccgcctcccgaatagctgggactacaggcatgcgccaccatgcccagctaattattgtatttttactagagacagagtttcaccatgttggccaggatggcctcgatctcttgaccttgtgatcctcctgccttggccacccaaagagctgggattataggcatgagtcactgtgcccggcctgaatagacactttttaaaagtaagacatacatgcagccaacaactatatgaaaaaaagctcagtattactgatcattagagacatgaaaatcaaaaccagtgagataccatctcataccagtcagaatgactattactaaaaagtaaaaaaataacagatgctggcgagttgtacttatatactgttggtgggagtgtaaattaggtcagccattgtggaagacagtgtggcaattcctcaaagacctaaaacaccatctgacccagcaatcccgttacttggtatataatcaaaggaatataaatccttctgtaatattcacacatgcatgttctttgtggcactattcacaatagcaaagacatggaatcaacctaagtgcccatcaatgatagactagaaaaagaaaatatggtacatgcacaccatggagtactatgcagccataaaaacatgaaatattttttgtagagatggatggagctggaggccattatccctagcaaactaacacaggaacagaaaaccaaataccacaagttctcacttataagtgggagctaaatgatgagaacacatgaatacatagaggggaacaacacacactggggccttttggaggtagaggaaggagaggatcaggaaaaataacgaatgggtactaggcttaatacctgggtgacgcaataatctgtacaacaaactcccatgacacaagtttacctatgtaaaaaacctgcacttggacccttgaacttagaataaaagttaaaaaaaaaaattatgagatcttgttacttacaacaacatggatggaactgggggtcattacgttaagtgaaataaaccaggcacagaaagacaaacatcacatattctcacttatttgtgggatctaaaaatcaaaacaattgaactcgtggagataaagagtagaaggatggttgccagaggctgggaagggtagtggggatggttaatgggtccaaaaaaagaaagaatgaacaggacctagtatttgatagcacaacaggatgacgataatggaaatttttaaatacacgagtatggttggattgtttgtaacacaaaggataagtgcttgaggggatggataccccattttccatgatgtgattattactcattgaatgcctgtatcaaaacatctcatgtacctcataaatatatacacacctatgtacctaaaattttagaaattaaatatacatgagtgtttgtatatattcttttatacacccacagatatatatgactcttcatattttttccaatgttggataagataatgataatggatgacttttatattcagggggaaaaattaaatgaattaaaatataaagagtaccaaatactggcagtgaaaaggggcagtggtgcctattcttctaaacatgatagcttaccattatctcagccatgccaagagttttctgtaatctaaatatatggctttacttgatgggtttatttaaatagtgtaaattatgaacaggaaaatcaaggactatttatttgcttataggaacttacaggattttgttaactgtagttaggagtgttttcaaggaagcaacatggtatatatatttcatgagggaaaaggactgtcactgtgctaagcttagcatctacatttctttacagaagaaactgatgaaaggtatacaatatatacagtcctgtttcgggaggcttttatgtaggttgactcctctaaactaggcagagtagtagactagaaaaaagggaaactattctaaaatggttttatgttattgttataatctagatgtttttacacttagatgtttttatacttgtaatcaaataagtttgatgtagttgacagatttttaaaattttttaattgcatctgtcccacatttgctaatttgccaagggatgtgactcatacagcaaattaaagacagcctttcactatgcaacttgtatggtagtctggcctctttaaggataaagggtactacagatcattagcatgagatctattagctttgagcatctgcctgtcactcttccccagtattgtttaagctcactgccttgtttaacatagttatctacctggtttggtattactcagtttagaaaagttttgagcaggactatgcttgctgtattattatcctcacagatttttcacttagggaattagaagctatgaaatctttattccaaagcacgataaaacactgatctgcaatcagtatagtgatcttcctgtctttatgatatgagcttttccactgttgctgatgtcacttcccagagggaagtgaattttagtatgatgaacaactcccaaaagggggaagaaaatgaattattggcttttctatgcctgcatcaataagtgaagatgactgttcccttatctatacctcttcctccgccaagcaaaggaaacactcagtggaagaccccaaagtaaatagttatatgatgagggtctctcatgataacttttgatttgtcaaacaggacaagagtcgcctgtttcgagtacagttcagtggagagtcaaaggagcaggcgctggaacactgctgcagttgtgttcagaagctggcacaatacataaccgtgcaggtgcctgatggaaacatccaggagcttcagctgattcctggcccacccagggcaactgaaagtcaagggaaggattctgcaaagagtgtcccacggcagcctggagtaagtaggctgatgtgttggttatacaggaaacatgacaatgcagtgcacaatgagtggccaaaatgacagtggagtttgtcaagtctgttaggtttgtagtttaaaaaacatctatgttcggtgactttttaaaattgaggtcgatactcattgtagctccctattcagaaattaggcagggaggagttccagctgcattctgggtgtcactacagaacagtggttctcaaagtgtggtccacgaacccctccctaggactcttccagggggcccacaaggtcaaaattatttttcttaatatttaaagaaagagtatcacttgcctttttcactgtgtcaacatttgaattgatgacacaaaggcatcgtaaggctgctgtcatctcatacagatcaggcagtggcaccaaactgtactaatagtcatcatgttccaatcattcgcagtaagaacaaactaacgaaataaccctgcagtctgcagtaccatggctgtctcaagggaacgcacctgtgtgacatttgtattttgaactagcctcttttttcataaaataccatcattatgtgagagaacaacagactatggtaattcagatttgggtatttggcagacattttctcaaaaatcagtgaaatgaactatcacttcaggaaaacaactgatagtatttattgaaaatgataaaatttaagcttccaagtgaaaattagaatcttgaaaaacttgtatctgccacatgagcttcacaacttcccaacccggaagacttttctaaaggtgctattaataaatgtgatttacttgtttataagtaattacctgatgaaatgtgtcaatatttgaaagacagtatattcagtgaatcagtattgtccagatgaccgatgcctgaatgccacaaaattatacgtggataaagagctattcaaaagtgtaagataggctaaaagattgtaatataacagtataacaagtttattgccatggtttcagattctatattgcaacttaactttaagcaactcactcgttgagttttggtgttgtatcaaggaatatccacagttatctgaacaggctattctaaaatacccctcccttctccatctataatttgtgtgaggccagattttcttcatgtcttcaaccaaagcagcacattacagcaaactgaatgcagcagcaaatataagaatctagtcaccttctactaaactaggtagtaaagagatttgcaaaaatcattattttgttttagaaaagttattttccataaaatgttttcaacattaacgtaaagtgggtttattatttttaatgaacatttttaaattccgtgttagtttctaatatgataaataccagataaatgtaactcagatgaaagttctttgaaggcctcataaggggtcttgtgataaaaaagtttgagactcatgactatagaatttctcccagaaatatgtgttctgcatttctttggcagtttcaaatattattggaataagcacctacctctgttcttgagatgagatactactttcaagctgggttttgcatttgctttgagaagtgatttttccaaacctggttttccattacttcatcatgttagttttccttaaccaaaacacctcatttttgctgttttgtcactatgtttcttttttttgagacagagtttcgctcttgttgcccaggctgaagtgtgcaatggcacgatctcggctcactgcaacctggcctcccaggttcaagccattctcctgcctcagcctcccgagtagctgggattacagacatccaccaccatgcccagctaatttttgtatttttaatagagatggggtttcattatgttggccaagctggtctcgaactcctgacctcaggagatccaccctcctcggcctcccaaagtgctgggattacaagcatgagccaccgcacccagctgtcactaagtttcttgttactcataatttgtctaaggtgaacataaattttcattatttattatacaatctttttctttaagcaggtgctgcatgatttcctcttgaatgtatttagtttaccaaacagattttggtgttttccttcccttcgtttgatttttgtgaagatgtcttaatgctgaagctgcttgcctcacaaaccctggatctagtttcaaacaataatgcttcgtctatattcagctcctgctatattccttaagaatcccctccctacaaatgggttggttgttataaggtattttattgcttatgatcctttgccctttagtttttcatgtttcactgcctgttagattcagatgatagtatagtatacccagtgtatggagtgtaacaaaaaaacccaaaagggttccagattttgggaactcagtctggagttccttataaaggtaatgaagtcacatcacgctagaacctcatcaggctacacaattatctaagtattacaaatgcaaataaattgaagttgtaacatgcagtaacaaatgcaggctgagttgtgagctacagccccagatgaaggctccagctctctgatgttaaagactggtcccaaatgtctaggtaggaatacctgagaagtggttaggaaactttcatgcctttcttgattctattttcagggactcttctgaactgtaattgggtgatttgactaagatagcatgatgttgtgcaaagactacaggctttggtatcaaaatggatctaggttagaatcctggccctatttcttagtagctgtgtgatctcacggaagccaattagccccatctgtaaaatggtgagattaaaatgctgtatagaaagtacccaatacaatgcctggcaaatataatcacaaaatccatcattactattattgccaccaatgttaccctttcagatgtgccttcccttgcaaatgaacaaatcagcatcctagtcaattagcaaggatcagaacctccagagccaagagagggcatgataagacagtgtctgaagctgcagagcagatgataagttaaagccattggattaaattccaccagggtacagaccttgtgaggcaccacctagaacattctagttttcctaatggcaaaacataaggtttgcccttaactctgttgtacaaattttggtagcatgtgctctttctcagaatccgtcttaagcggcacaagccatggccaaggttctggtcattttgctgctctcttacattcaggtgtgtcatttttgtagtacctatatattttttagtataaaatagttatttccttctttgcaaatagagataattctatttcaagttcttgagtcatttactggctcatattttagtttttgcttttcctcagccttgtaattttgttaattgtggcttaaccaggcatttctcaaccttagcacttcaaaggcaaccagcccaccccagggagggggatgggaaagacagttaagaggatcgcagttcctatgtggactctttcctgttagcacaaaaagtccagaagaaagtagctaggggactccagctactgtgtgcacagactcttccatctctatgctgttgcagaggtggaccatctaatcctagagcccgctagcctcaggtgcttcagttccacttagctattttttagtgtttatggcagacaattttggttgacattagttctttgtgtgagctgaaatgataggtattctaggaaagcatcatatgtcatagctgaagaaacactaggcactagaggctgccttgtttttacagaggagaaaactgaagaaactgaacagagaaatggggcttgtctaaggactattgattatagagtcctttggccctttggccattttgctcgttttttgttttcttgtctttgttctttccttcctcactgtacctccacccctcttttttgttgttgtttgatgcttccaggtctggtttcctgctacctactgactagcaaccatcagattctctgtaggacagaagacagaatttggcatctcctgccttctggtagtcagacttgttgctgaaggacagaagcgccctccaaagagtgccctgtttcctccctgtattgcaccatgagctcatacctagtgtaggatcaccactgctcgtctggagattagcactgcagcaacctcaggtacccaaggcatattggggcctgcagacatgtggctaggaaggaacggaggtagggcccttcatgcctccagacctcctgcaccttgttcattccatttgcctggaaagcatcccatgtcctacccgagaacaacttattaccatagattctctccagatagcatggaccttagagcatccctgtacttcctgcttagcatacagccctccagtttacccacttctctgtgaacctctagcacttcctgagttgcaagataattcatggttttacttgttaggttctcactgggttgtgggcttccagagggcaggactatcttgttctttgtcgctcctatccccgtaccaccccagtgtctagtacgtaggaggtataaacagttgttgaaagaagatatctgtaagttttacttacagaagaactgattctttcagaatatctaaaatgagatttaaaaaaatcattttattgaaaacatcagttgtcttaaaattataggagtttccccccattttgcatttcttcaatgaacatgtattacttgagcaataatttttagagtgtgacaaatcatcagaagctggggtccgtccactgcatgtaggctgccatggtaacagcaccgggcccaccctccagcacctggtcctgaatcctaggctgggcctctaacaacagaggaatgccccagtgtctgacaggaagaagcactaacagcctgccaactgctgaggaacatcaaatagaggtcaggagccgcaaatttaaactcagtacttctgctgtggtaactcaagtaaccctccgtttaaaccaggacagacctatgctgacaaccatttttatcactcttagtggtattttctttctttgaacatgaatgcatatttctgctctttaatggcctttggtatttaagattacattcagctagtctccttattgcatgttgttttattccagtcccaccagcactcagaacaacagcaagtgtgtgtaacagcgggcacaggcgctccagacggaaggacctcactgacgcagttagctcaggtagagcttatttctgtgttcaattttcttgtcatgagaagcagtgacccctaagaatttgtatccctttgttcaattctttgttttaggagagaaacttctaaagcattactctaaaaggtgatagagacagagacgggccattttcatctaccccttgcagagttaagttttattacagtaagttgtgaggtgagacatgatggctgcaggcacatagtcaagatctaccctcctaaggaaataaaacggggaaaagtggttgaatgtccaatatagaaaatttaatcaccactttcccaaaaaagaataaatggaggactccattgtaattatggaaatgaaatttgggaactattttaagacaaatatcaaaatgaatgtggattcagatctacaacaatttctatatgggtagattgttagtactcagctaaggatgtgaaacccaggaggattcagctgttaactcagacttgctttcagacagccccttgccccctgctgcaaaacctcttcattcaaaactatggttgtgtgacgtccactctcctgggagctctgcaaggactttgtctccccctcactgcattcctcattgcaggtgttcaagccagcagcttctgcttgccacagaattctgtgtgaagttcatcaatcttcaagtatgatttttttttttttttttgaggcagggtctcaccatgcctcagcacccagcaggctggagtgcagtggtgcgatcttggctcactgcaacctctgtctcctgggttcaagtgattttcctgccttagcctcctgagtagctgggattacaggcgtgtgccaccacgcccagctaatttttgtatttttagtagagtcaggatttcactgtgttggccaggctggtcttgaaccccagacctcaagtgattcccccaccttgggctcccaaattgctaggattacaggtgttagccactatgcccggccacattttcttttaatccctccactaaactgtactatcagtagtttaaaaaaaaaaaaaaaaaaagaaaaaaagggttttctccatctggcttgccactaactcaaaataaatggacaatcatatagaataaaaaactcaagaggtaggaagactaagaattcatgtttatttcttttaataaacccctaactatgaaaaaaattatttgtccagcagcaggactaatgcccatatttgcattggggttaggggctaactgaatcagagaagctgaggaaaacagagctgcaataaaacaataagcaaggcagggtgtgatgtccttatttaggaaatatcaattgctagaaaaggcatacctttgcccagtttatttacgtagtatggaagaaccatatacaaatgagaaaaagcatgaagcttggagctcagatacattacttacttgctcttatcttttggacatgtcattctatgtaagttggtaaaaccttttggaaggcaatttagcagtacatatcaaatttaatattatgttagctataatttcatttcaactacacaaatatacatatgttcatcacaatgcttaagaaattggaaacaacataaatgttcatttaataggatattaagtgaggtataaccacagatgggatagaaatgcaattaatacaagggatgtaggctgcacatggtggctcacacctgtagtcccaagcactttggggggctgaggcaggaggatcatttaaggccaggagttcaagactagcctggcctaacatcatattgagacccccatctctaaaaataaacaaaacaagtgctgtatatcccaagtaagtttctgttacagagagttcctggagaaataccagttatgtacttacacactaaaacatgctatccacgtaaagaataaaaccacctacctcacagaattaatgtgaggagtcaataagatgaccaagtcaatgcaccaaagtaagtggaccacacagaactggagcccatcatcgtcatgtgggactgtggatccggtgttgccagatcttccaaattgtcaagatttttatttgaactctcctaatatttaaacgttgacaacttattcaactggttttaaaacactgcaggttaccaaagaaaacatacagatgacaaataagcatgtgaaaagatgctcaacattattagtcattaggcaaatgcaaattaagaccacgatgagacatcctgcaaacttattagaatgcctaaattaaaaacaaaaagaaaaactgacaataccaaaccctggatgggtgagcaactacaactctcatctacactgctagtggaatgtaaatgggacagccactatagatgacagtttggcagtttcttacaaagttaaatatacactcaccacatgactcaatcctaggtatttactgaagtgaaatgaaaacctgtgttcacacaaaaacctgtaagggaatgtttatagcatctttattcataattgcaaaaaaataaaacccaaatgtccttcaactggagcacagataaccaaactgtggcacatccatgcaatgtaatacttattcagcaataaaaatgaattactgctatactcaacatcatggattaatcccaaatgtattcattatgctaagtgtaagaagccagattcaacaacgtattatgatttcatttatatgacattctggaaaaggcaaaactatatggagaagagatcagtagttattaagggttaagggtttgacggtaatggttagcacaagggtcacataaaggaatttttttgggaagtgaaagaaatgttctgtattttgattgtggtgacagttacacgactatttgtcaaaactcacagatggccagaaaaagatgcgtgtgaactaatgtcctttgggagtctgtggcctctttcttacattcagaatgcagctagcacatagtaggctgctcacatccactctgccacctatgctgtggcgaagatgaactgagctagtggagctcattcattgatagcattgataggtttgttttcaatccacaggttatcagcacagtattcttcattaaagtagaatctcaactttgcaaacatttcatcagtacatttgaaattctttccttagggcaacaagattatctcacatgctatgtgtattcagaatacatattaatatacaaaattgtaaatgtaacagtaaaactatgtaaaggaagcctgtaaagctaattaacactaatttttttggtgtgtatttcgctaatctttccttaaagcactatttgcctgtgttctattagccaggtattgcttttacctgtaatctgtaacgacttttctggtatccctgcagactcttctggcatcggaggagctgccccatgtctatgaacaatctgcatggggtgcagaagagttaggccccttcctacgtttgtgccttatggatcagaatttcccagcatttgtggaagaggtagaaaaggaactgaaaaagctggcgggtttgagaaattaatgctctatatacatatataactaaggaacttcaaagtattgaaaaatgcttcctcctaaaattaaagaagatattagaataaagagtattatccaa

SEQ ID NO: 960 - DNA, 41723 bp, Homo sapiens; identical to SEQ ID NO: 957

SEQ ID NO: 961 - DNA, 48705 bp, Homo sapiens; identical to SEQ ID NO: 955

SEQ ID NO: 962 - DNA, 41723 bp, Homo sapiens; identical to SEQ ID NO: 957

SEQ ID NO: 963 - DNA, 48705 bp, Homo sapiens; identical to SEQ ID NO: 955

SEQ ID NO: 964 - DNA, 41723 bp, Homo sapiens; identical to SEQ ID NO: 957

SEQ ID NO: 965 - DNA, 73411 bp, Homo sapiens; identical to SEQ ID NO: 954

SEQ ID NO: 966 - DNA, 53143 bp, Homo sapiens
cctctccagaggcgggccctgagccggcacctcccctttcggacagctcaagggactcagccaactggctcacgcctccccttcagcttctcttcacgcactccaagatctaaaccgagaatcgaaactaagctggggtccatggagcctgcacccgcccgatctccgaggccccagcaggaccccgcccggccccaggagcccaccatgcctccccccgagaccccctctgaaggccgccagcccagccccagccccagccctacagaggtactattgggttaggggatgatggggttaagctttgttggtttgctgtggtggggagaggcgggaagagagggtctaacggaggatttggtcaagtaccctagagagtgacacaaagcgggaagtccagacaccagggtcctgaccgtctcgggtggggcagggaagggagggtaggatagagtagaaaagaggacacggaggagttggggcggcctcgctgggctgcggtttctccactgagcagttgggcaaggtgagaagggtcagtggcctccgggcctgggcccttccgcccaccctcgagccctgcctcaactttgcctcagatgcaggacttcagattagggaggatggaggtagtacccctgttgcgctggcctggagccaggggcatgtcccaggcacggcaaaactaaaaccaacttcccagatccgaggtgagaaactggctcagactgaagaggtatctttgccaaggcctcccagctcatgtggtttctgcttaaggaagcctccccaacgaacccttctcttgccacacctttcctgcccacctcccacctcccccgacaaaggaactacttgggtttcttgctctgctgcctttcaggcccttttactccccttcatgaaagtacagaggacaccgtattacagtaacttttataaacattattacaactaagaataacattacttaacaatactaggtaacatttatgagcacttcaaatgtgccaggtactgtattaagcactttggtttttttttgttgttgtttgtttgttttgctttgttttttgtttgtttgtttatctgtttgtttttgagacggagtctcacactgtcgcccaggctggagtgcaatggtgcgatctcggctcactgcaacctcctccttccgggttcacgccattctcctgcctcagcctcccgagtagctgggattacaggccacgccaccatacctggctattttttatatttttagtagagatggggtttcactatgttggccagattggtctctaactcctgacctcgtgatccacccacctcggcctcccaaagtgctgggattacaggcatgagccaccatgcccggcctgtttttgtattttacaaaatgtggtaaaatatacctaatggataagttcctatgttaaccatttataagtgtaccattcagtggcattaagtagattcacaatattgtgtaaccatcaccaccatctatttccagaactttttcattactccagaaactctgtactctttaaaccataggggagggaaagatggcttgcctccacccttctagtttccttggctgggctatgaattaaatagcctatgaattaaatagtcataaaatagattaccagcggaaaacccatatttaattacatatgtatactcaggagtcccacaatatatgagactcaaagaaaggtcagatgattgaagcctgtataacatcctgagctacggaaaagagcttggagcttctgggtgatggtgataacacaagttatgggagggtgaggagaggagctgtttggtgaatagaggttgtcttgctatgtagattaaaagttcttagataataaaagttgtctggagcagccctcttttaatatagatcattttactaatgtagattttcttttaagatataaatgcctttcttttttacaaaaggagagcttttcagagctattcctgtatcagcagtttctcagaataaccagcttaaaatatgccaaagaagtatatttcaagagcctcctgcagtcatactttgaagtggtgtgtcctgagccccagtaatgcaatagctcctcattttctccttcccctagcccttggtaacttctaatctaccttctgtccctatgaacttacttattctagatatttcatgtaagtggaattgttaccagtagaggatcttgactgcaaattgttcaggttcttggcattttgaacaaagaattggacaaaatgtacagcaaagcaaggaaagagtgaagcaatgaaagcagagatttattgaaaatgaaagtacaccccacagggtgggagcggctagagcagggctcaaggaccccagttacagaatcttctgggttccaaataccccctagaggtttcccattggccacttggtgttcaccccattggttgcagaaagcaaccaaccagacgtactttcaattttccatctgccctgcaggaaatggggtgatttgcaaagagagtagcctctcttccttttgttactgaggcatggagagttgcggttttcctttcgatttagttctaggaagtcagagggaatcggccttaggttccctgcctccagaccctattctcctgcctcagaatcatacagtgtttgaccttttgtgactggcttatttcacttagcataatgtcattgaggtctatctatgttgtagcatgtatcagaatttcatttctttctaacgctgagtaatattccattatatgtgtagaccacattttgtttatctattcatctgttgatggatacttggattgtttctacattttgtctattgtgaatagtgttgctgtggacattgttgtacaagtatctgtttgggccttgtttttacatcttttggttatatatctaagagtggaatttctgggtcatattgttgttccatgcttacctctttaatgaacccccaaactgtgcattaagcactttatatgaggttggtacttagtgtatctaccttccaaactgagttccttgaaggcagaatgtatcctacacctcttatatctcagagcctattactgtgggtgatgagaagtagatgctcaataaatggtgcagtgagagctggagggcctgaataaatgggggtattggggtgctgataagccagggttttgcatcatccaatgactggctggaatggaatatgaggtcctactccagggtccagctgtaagggtggttggccggtaggtgggggcttttgggacttctccaggcctcacctgcctctctggtcccccagcgagcccccgcttcggaggaggagttccagtttctgcgctgccagcaatgccaggcggaagccaagtgcccgaagctgctgccttgtctgcacacgctgtgctcaggatgcctggaggcgtcgggcatgcagtgccccatctgccaggcgccctggcccctaggtgcagacacacccgccctggataacgtctttttcgagagtctgcagcggcgcctgtcggtgtaccggcagattgtggatgcgcaggctgtgtgcacccgctgcaaagagtcggccgacttctggtgctttgagtgcgagcagctcctctgcgccaagtgcttcgaggcacaccagtggttcctcaagcacgaggcccggcccctagcagagctgcgcaaccagtcggtgcgtgagttcctggacggcacccgcaagaccaacaacatcttctgctccaaccccaaccaccgcacccctacgctgaccaggtgagtaggccggcacagggtggggtggtgcatccaagtaccaggtagagggcgagaggagcaaagatccaaagagtcacacagctgaggacaaggagcttctggggccttgcaactctaaatgtggtctgcagatatgcagtgtccgtgttgatgaccacaatttatgctgccagtccccacgcaggtggatagtaagtttccagtttcctcctgtaataaataatgctgcagaatcatctttgcatctttatccagtaacttctttaggataaatttttagaagtgccactgctgggtgtagggggacgggaattctacatttgatacatgttaccaaactgccctttagaatttagtggaattttccgagagcactgacacggaatctcagtaaggctggattctaggatcagagacaagtagttagtttctgtctgaaaagttgaaaccattaacaccaggcagcgctatctgagaatgtctgtatggggaaaaaaaatcacatccagttgtaattatttttattaaacagattttaactcagttttttaataggtaatacattcgtacagttcacgaacaaaatttgtaaagaggagagagagagtgcaatcttctgtccatgcccaactgcctaattcccaccacttctccctcttcccatccacaggtagccattgttactagttttgaatgtttcttctgagagtttctttacgaatatatatgcaggtaggagcaatcttatcaggtcctattttccctcttttagccaaaaaggtagcataactatgtgaacttttcaccattagcaatagattgttcatagaaggcgcttcttggttcttagagatccacttgcaaaatgaaagcatttttcgctggtttttgacaactcagaactatatatggctaaaccacatatttgctgaactacatatctgctaaactgactgtgatttgtttcctgctttaggataaacttcccacactatcagaataagctttcccctccgactcctcaacagctggtatcaccacgtttcttagcttattgtaaaggttgagtggctttccacttgtttattggccattgtgtttctgcatttgcgagtggcctgtttaggtcctttgcctgttgttgttgttgtttccgttgaggaattaagggactaattaaagaattcaggaacaaattcctcgaaagaaaaaaatgtatgcatttcttttgctcttacaatttatgcagttttaaaacttacatatttattggattttgattgaaattgcaataaattaggagaaattggctttatctctggttctatcttttggatttaaaaaattttttttaattttttttttttttttttgagatggagtctcgctgtgtcacccaggctggagtgcagtggcgcgatctcggctcactgcaacctccacctcccgggttcacgccattttcctgcctcagcctcccaagtagctgcgattacaggtgcacatcatcatgcctggctaattttttggcatttttagtagagacagggtttcactataatggtcaggctggtctcctgacctcaggtgatccacctgcctcggcctcccaaagttctgggattacaggcatgagccaccatgcccagccttatactaatttcttaatgaatttgtaagctttcatgttttgaacgtgataatgcagccatcccacgggatccatgggagtctgtttcaaattcatagatgctcaagtctctgatataaaatggcatagtatttgtatataacctctacacatcctcctgtatactttattttttattttatttttattttttgagacggggtcttgctctgtcgcccaggctggagtgcagtgctgcactcgtggctcactgcagcctcaatctcttgggttcaaacaatcctcccacctcagccaccagattatacaggactgcaggtgtgcaccaccacactcagctaatttttaaattttttgtagagacagggtttcacgacattgcccagactggtcttgagaactcttgggctcaggcagcaaccctccctaggcctctcaaagtgctgggattacaggtgtgagccactgtacccatcccctcctgtatactttaagtcatctctagattacttataatgcctaatacaatgtaaatgctatgtaaagagttgttttactatatttttgaatttgtatatttttttattgtggtacttttttaattgattttttttcgcctgaatatttttgatccaagatttgttgaatccacgggtgcgtaacctgcagatactgagggccaactgtacatataaattgtttagcgtagtgcctggcacatattaaatactcagtgaatgttaaaattctattataatttctctgctctagaacaatttgaagaatataagaaatttaggcttataaaagttttttgaaaaaccatcttggaactggtgccttttttatagtagatttttgggaacttttcccatttttgccatggcattaatctgttttggctcttgtgtcagatttttggaagattttccagttcatcctgagttatctttcattatttaaaaatctcctatatgcctgtaactataccccctttttttatttctgatgttgtatatttgtggtttagcagtcttttcaaagtactgtacttttagtctttccttagattgcttactgattttaatgttttccttctttctgtttgatcattttatttttgtcattttcttccttctaacttttgtcattattcattttctagcttcttgaacttataattcatttatttgcaatctttattgtttaataataataacttttttttttttgagaatctccctctgtcacccaggctggagtgcagtggtagatcttggctcactgcaacctgtgcctcctgggttcaagtgattctcctgcctcagcctccccagtagctgagactacaggtgcccaccaccatgcctggctaattttttttatttttagtagagacggggtttccccatgttgaccaggctggtctcgaactcctggcctcaagtgatccacccgcctcagtctcccaaagttctgggattacaggcgtgagctacaatgccctgcctaataataactcttttaaggcataagttctctgtatatggttttggctgtatgccataactttgataacttcattagtgttctcatagtcaatcatttctcaaatttcatttcagtcttttcttaaaaaggttctcttgcttaaggtcaagagttcgagatcagcctgggcaacatagcaagacctcatctttacaaaaaataaaaaaaattagccaggcatggtcggtggtacatgcttgtagtcccagttatttgggaggttgaggcaggagggttgcttgaacctaagaatttgagcctgcagtgagctgtgatggtgccacttcactccaaccagagcatcagaaccggaccctgactcgaaaaaaaaaaaaaagaaatttttttctcttgaaaagttttagagaatagtgttttctaaaattttcaagtggttttgatgtttggtttcttgttctgtcacccaggctggaatgtgatggtgcgatttcatacttgttaatttctgcactatggccagtttatacagtttgtatgagttctacatctaagactatattgagattttcttagcggcctaggatattccttggactcacatattcctagcaataatccttagagttgaaaagttgtatttgttgtacacacatatatatacatacacaaatatatgtatataatatatatgtgtatatatgcatatatctatatgtatatatccatatatatgtaagttctagtgcttgtgtgtgtgtgtgtatctccacgctattgaaactttctacctttctttcttttctttttttttttttttttttgatggagtcttgctctgtcatccaggttggagtgcagtggcatgatctcggctcactgcaacctcctcctcccgggttcaagtgtttctcctgcctcagcctcctgagtagctgggattacaggcgtgtgccaccatgcccggctaagttttttttttttttttgtatttttagtagagaaggggtttcattatgttggccaggatggtcttgatctcctgaccttgtgatccacccgcctcagcctcccaaagtgctgggattacaggcgtgagccaacatgtctggccgaaactttctacctttccttccattctgtttcaccagttctctaaatgataattacagagtggtaacttccccatcaaaacatatatataggccagatgtggtggcttccacctgtaatcccaacactttgggaggccaaggccggtggatattttgagcccaggagtttgaggccagcctgggcaatatggtgaaaccccgtctctacaaaaaaatacaaaattagctggacatggtggcacatgcctctcgtcccagctattcgggaggtggaggtattcctcagagaggatcacctgagcctgtccgttcaaggatgcagtgagccatgatcacgccactgcactccagcctgggtgacacaatgagactctgtcttaaaaaaagaaaaaaagtgggccaggcgcagtggctcacgcttgtaatcccagcactttgggaggctgaggcaggcggatcatgaggtcaggagttcaataccagcctcaccaacatggtgaaacctcgtctctattaaaaatacaaaaattagccgggcgtggtggcgggcgcctgtaatcccagctactcgggaggctgaggtaggagaattgcttgaaactggaaggcggaggttgcagtgagctgagattgtgccactgcactccagcctgggcaacaagagtgaaactccatctcagaaaaaaaaagtgtatacacacaccaacacacacatacatgcacactctagaacctatctcatctatcaccacaaagagtagaatataactattcttccagagaaaataaaacatttagcacacttttatagtttttcttcttccctcttccttctcactttcagatttagttgaaataatgtgaacttttagttccagattactaccaaattgttaatttttttttcttttgtaaacatcctttctgaacaggtattaagcttcatggtcatattacaacgcacttgttagccataccttatactttaattggtttcattgctcatgataagttttcctatagcttttcttctcctttcttgaattatttaaggtgattaattttccatttggcaggaatactccatcaagtaattaaaaaaattattccagagtttactttctgagaccttaagtgtctttacttgtatgtccttcttttgctgtcacatgtgagggaaagttgagctaggtgtaaaattctgaggtcataatcacagtgctttcacctcagaatatataaaccttgcttcataaatttctagtctctggtgttgtagatgagaagtccactaatggtctattttttctctgtgagtaatctgtttttgtttgttaaggatctttatttatttttatttattttactttttagagatggggtctcactctgtcacccaggttggaatgcagtggtgcaatcagagttcactgcagcctcaaactcctgggctcaagcaatcctcccaccttgacctcccaagtagccaggactacaggcacctgccaccgtgcctggctaataaatatagttggatggttttcatttgtttatttgtttgtttagagataagttcttgctctgttgcccaggctggtgtgcagtggtgtgatcatagctcactgtaacctcgaactcctagactcaagaggtctgctagccttagtctctgagtagctaggactataggtgcctgccaccatgcctggctaatttttaaaattttatgtagagatagggtctcactatattgcccaggctggtctaaactcctggcttcaagtgatcctcctgccttagccgcccaaagcactgggattacaggcttgagcccatgcccagcctgctaaagatctttatataattttttcttttttcaataatcttctatcgccattgttgatctgaaaaactcaagtctttcttcagctcttcatctcagggaaattgtattctgctttttaattttttttttttttttgagatagagtattgctcttggaatatagtggcatgatcttggctcattgcaacctttgcctcccaggctcaagcagttctcatgcctcagcctcccaagtagctggaactacaggaatgcgccactacacctggctaatttttgcattttctttttagtagacacaaggttttgccatattggccaggctggtcttgaattcctggcctcaagtgatctgcccgccttggcctcccaaagtgctgggattataggcgtgagccactgtgcctggccatactttttaatatactgatagcccttcatttgtttattttattttttatttttattttttgagacagggtctcactctcacccaggctggagtgcaatggcacgatctcggctcactgcaacctccacctcctgggttcaagtgattttcctgcctcagcctcccgagtagctgggactacaggtgcgcaccaccatgcccagctaatttttgtattattagtagagacggcgtttcaccatattggccaggctggtctcgaactcctgacctcgtgatccacccgcctcagcctcccaaagtgctgggattacaggtgtgagccactgcacccggcccatttgtttatttttaaaatttttactactgttgttatatggatattggaactccaagaacatattttacatcttttaaattttttccccattaattctgttgctttgcttttttccccgagattctcagagagctcctcgaattgtttttctaactcgccagctcatcttttcgccgctgactccattcttctatctgctacccctgtagagttgttgtgggtttttttccccccagcaatctttttttttttaattgccaaaagagcttaatgctctcaggatgctttttcttggcagcctgctcttgttttctcattgtagtgtgttcttaagtctccctgaaaaacacagttggcatttacagaggtgtatgtttcctacacgatccccttttcaatgggtacttgctcagtttggctgctgattctcttcataggtcctgcggtctgtgctatctgctcccatgtaaaagttgacatctagattgttcagtgtttgtagctagcgtgggctggcagcaattgtgtaaagcacaatttataccccacattcaatccctgcagtggaacagggccgctccccacgagccccagatggtgtcagcttgtaagtagtcccacctctgctgtgggggtcagaggtggatttctctccattagggatagaaaaaaaccttttgtctgtacccattttagatgtccagctaggtccctgtaaattagactaacaagatatagattaacacgagaaaagcaggctgggtgctgcggctcacacctgtaggcccagcgctttgggaggctgaggtgggtggatcacctgaggtcaggagttcgagaccagcctggccaacatggtgaaaccccatctctaccaaaaatataaaaattcgccaggcatggtgtcacacacctgtaatcccagctactcaggaggctgaggcaggagaattgcatgaaccctggaggtggaggctgcagtgagctgagatcacaccactgcactccagcctgggcgacagagcgagactccgtctcaaaaaaaaaaaaaaaaaaaagaaagaaaaacaggagctttttagcatgtgcatctagcatgggtatcacatctagcatgggaattgtgcatatacctgggagtatccagagatgagtaactcaaagcgttggttagaacttcagcttacatagcatcttaatgaaagagaaagaaatgtttagagaagtggcagggtaaaagaaaggggttttaggcttgcaaaggtggcaaactgttggaagttgtgtttctgttttgcattgctagaaggaatacctgaggctgggtaatttgtaaagaaaagaggtttatttggctcatgttctgcatgctgtacaatcatggcaccagaaacctgcttggcctcaggtgaggctgcaggtaggttttactcatggcggaaggtgaagggggaacaggcgtgtcgcatggcaagaggggagcaagagagagagaaggaggaagcaagagaaggagatgccaggcgcctttaaataaccagctctcccttgaactaccaaagagaggatttactctttaccacgggatggccccaagccattcataaggcatccaccctcatgacccaaacacctcccactagaccccaccttcaacattggaggtcacacttcaacatgagatttggtaaatatatgggaactctaatggagtaaggtttgtttgtgcgggcctacttggtgccagctttccatcttcgtggctgtaaaacttccctgagagaggagatttatggtagttcttgtttctcagaagtttctgttttttgtcataagagcaaagagcgtaagagtcaaaagagtttctgtttttagtcatgagagaagctcttagaaggctcctttctgcgtctgttggttttcatttgcctgcagctcaaaacaatcatatgccaaagtggcatattttggagtggcatatttttatcccttatgtcaggtacaatgggcagggaaggttcagccagcaagagggcaggattcctgttccttgagcacggtgcatggccttaacaaacctgaaaaatcatgtgctcccactcccatttcacattgtttcacaatttaccagtggttactggacaaactcaacttattttttctgcacaaaacttcaatgccataaataagagctcacaactttcctctggtcacaagtcagttagcagccacctcgctctttgaccctgggctgatttagagctcacactggggagcagccccagaggtggctttaaacctgggactcggggtgtctgccctggggtggctgccctggggtggctgccctggggccattggtatttgctccacatgcctgtggagtccattttttcatgttcatgtcacacctactgtgttgcatgttctttactagggggtggggtagaaatatgaatggacatagcccctccttgagatcacagcctggtaaacagatcagccattaacaattgaggcggcagggttccgtgcagaaggctgcatgactttgctgtctattgtgactgcgttttgatagttacctttgtcacactgtcttctgtattatgtttgccctcagcaacatgtcgtatctggcacagggctgacatcctgtttgtgctcagtcatttgtggaaggaagaagtcaggcaggcacaaaggtggctgagctcagaaaaggccacttaccctgctgggatcagctggggaaggtggcttccaagaggccatcacacttagtgtgatgtataaggaaatagaaaggccacagacaggagggactgcacgtgcaaggaaggggcactagtgagtttgcagcatctcaggaactgcaatagaaggttgatgtgagggcaggcactagaagggtgagttggggtcagatgtggcaggcttggaaggagtcaggactctatgctacaatttccagaacactcagtgttctcagctttctcctttgtcatgccttcataccacctaatcttctcaccagtgactatcctctggaagacaatgggaatgggaccctgtggagggctctgttgaaaacccattgatggggccgggcgtggtggctcacgcctgtaatcccagcactttgggaggctgaggtgggcagatcacgaggtcaggagattgagaccatcctggctaacatggtgaaaccccgtctctactaaaaatacaaaaaaattagccgggcgtggtggcgggtgcctgtagtcccagctacttaggaggctgaggcgggagaatggcgtgaacccaggaggcggagcttgcagtgagccaagattgcgccgatgcactccagcctgggtgacagagcgagactgtgtctcaaaaaaaaaaaaaaaaaggaaaacccattgatgggcattgaggagtggtgggatgatcagagcctctctctgcactctggtactttgacaagagtgggcaagtttgggaacagggatatcagtatttctttggctgcatacttatttatatttcaccccattccacggagaatttgaggggatttatcaccagatgtgggatacttatccaatagaaactgaagcaaagaatctggacaagggaaagggagcctcatgagtacactaggtcttaggtccaggtgggggtgaggcctgcaagaatgcagagatggaggggtgtggagacggctgtggtcccacactgccagcacttgcctgaccagacattctcaggagtgcttccacccaagcatggtgtgggtctagggctgcaggtggagctaagtcctgtctgcgtctgggtgtcagatcctaaaatttgctggatggagttggggaattaatccagctgaaagagcttgaattatcattgaatggaggaaacaaaaggcctattaatcaagtttaagaggtgtgattgaaggattggcacctatccctgcttggtgctctcttggtgccctctgtgaagttagcagtaaattgcattttattggggattgatattattgggattgcttcctggcctgcaaggagcattacatgggcagaagaaaggctgctgccaggagttgggcaacatgatgaaagatgtggacaataaatgacccatttcctagtttttctatgaacttatcttgaaggtagatttatagaataatatgtggataaaaggggttttcctcctggtctcctttgatgttttggagaaagaagcaaggactttatttatttatttgtttatttttgagacagtgtcttgatctgacacccaggctggagtgcagtggcacagtcatggcttgcggcagcctcaacctcccaggttcaagtgatcctcctaccttagccttcctagtttgtagagacgagttttcaccatgttgcccaggttggtctcgaactcctgggctccacccacctcggcttctcaaagtgctgtgattacaggcttgagccaccacgcccagccagaagcagggaatttaaagcagcgcaagccaagatcaggattagggctggtgctccggtctcacttctcctgaaggccaatcgcctctactttctgcagctatgggagtgggctttgctattcagggatggaggcctgggacattttagaacaatttgggttttttagttttgtttttttgagacagggacttgctctgtcacccaggctggagtgcagtgtgcgattatagcttactgaagccttgacctcccaggcccaagttatcctcccacctcagacccccaagtataatagctgggactacagacatgcaccaccatgcccagctaattttttttttttttttttttttttttttgtagagatgggctttcattatgttccctaggctggtctcaaactactgagctcaggcaatccacctgcctgggcctcccgaagtgctgggattacaggcgtgaaccactgtgcccagcctttagaacaatttttaacaagacttgaaattaacaagcttttggcatagtggtgcacgcctgtagtcccagctactagggagactgaggtgggaggatcacttgagcctcagaggttgaggctgcagtaagccataatcatgccattgcactccagcctgggcaacagagcgaggccttgtctctaaaaaaaaaaaaaaaaaaagaaattaacaagcttttctcattgattgctaactgataaaattaaaaactattaatagaaccaccgccagccagccagacagccattgagcaatcacttattgagcatttatttcatgactggtgttatgatagctattgccagatgaaaaagaatgcctgccttcgaagcttgaatttgtggagagtttcagcctatggataagttgcatgtgtgtgcagacttgtactctatggcaagaacccagaggtcccagaagatacgttcagatcaagtgctgtggcagttttcagaagggaaaacttgtatttatgtgggagggtcagggaaaccctgatattttagcatttgggctacaccttgaagggtttatttgtctctataagttgcatctaaaacaaactgtataaattagtgagtttttttagttagtagcttaagcaaaagctggattgatggctgatgtaagtgcataggggtcaagctggcctctgacctgaccaattagatattcagattgtgtcaccaggaggtactttctctgtatttcttgtgacctggctttcttccaagactggtccattcacagaagggtttactcctcatgggtgccagatgattgcaacagctccagaggttacaccctcagccccaaattcaaggggaaaagagtgtgaatctctcccagcattccaagctaaatctcagtgtgtctttgattgggtcaggttcctctccctgcaagggtggctcaggctaggggggttctcagattagcgtaagcctgagtcatatgctcccccaaagctcatggactgagaacaggaatgtgtggctacctaaaggcaaagtccagtttcatattggtacaagaagaaagaagaatgtgcctttaatacatcttagaaaaaatgtccaatagccaccgtaaatgaaagcaaagaagaaaaaaacactccaggtatatggaaggcagtggaacagaaactgaagtgcaggggacaggtttgaagccagcctcaagtgaaacaccctgaccccttggtgcctgggtaaactcttttcaatagaaagccatccttttccaaccaggttagggaatgggctgttcaggctgcatgcaacctttcctgttgacaaagtggagaactatcctgccatttgagatgtttttcctgtgctattctcctaactcccacaccctcctgtaagattatcaggaagagagaactgttccctttgtacaaacaaggcgagaggccagagagttaacaggagcttcccaaaagggagagcttgccagagccggggccagaacaggatgcagggtttcctgattgcagaatgggtgcccctttcctactcctgctggactctacattcaggcagcccacagctaatgactgcactgagttgcaaaaagaattctaaaagttgtttcttaagaatttagagtgtatcttaagtaagcatgcaatttaagcaatgttgaacttaattttcccttttacagaagataaagaaactaaagtgaaattagacttgctgaacttcaaagaaataattcttcatcttaaaatattttcctaaaaggtccctctaagattaagagaaaaaaaccccaagacattaagaggttggagccattttgttttttgaaacagagtctcgctctgttgcccaggctggagtgcagtggcgcaatcttggctcactgcaacctccgcctcccgggttcaagcaattctcctgcctcagcatcccgagtagctgggattacaagtgcctgccaccactcctggctaatttttgtgtttttagtagagacagggtttcaccatcttggccaggctggtcttgaactcctgacctcgtgatccacccaccttggcctcccaaagtgctgggattacaggcgtgagccaccgtgcctggccatttttttgtatttttagtagagatggggtttcgccatgttggccaggctggtctcgaactcctgatttcaggtaatccacccacctgggcctcccaaagtgcttggattacaggcagaagccaccatgcccagccccatatcgtttgtttttaatgaaatgcttctattttacatggtagtaactgagtctctgcaatgaaagatcaagatggttggcttccatccttctagttttggttccatgtcaataggactgtaaggttcaccactggtctttttactttaacatcacttttcccaagttttgtattttgattgagctcttaattggatagatattatcaaaaagcaattttttttttccaagaaggacttttttgttctgaattccttgagtctcttggtgttgagaatgtctttgggttactctgatacttgaataatatctcggctgggtataatattcttaggtcacaatcactttcacaattttgtagacactgctgcattatcttccagcatcaaatgttcattaggacagctctggggtcaaactgacttgctttttctgtctttatgcctaaagatattttttattcttgaaatttattaatttaaccaagctgtcttggtgtttaacattttgtatcaaattattctggaacctagcatgctccttcaatctaaaaattatctttatttcaattgcttaaattacttctcctccatcttccttttcttccttctcattttcttctttttcttgctctattactaataatatcacaatttgtaatttattaactttaggtgtgttcagtttagtaatataacagtactactaccatttagggtgggggaacttatttacttaatgacttaatgaatgagtaacaaagattagaaccaccatatacattcacttgatacatatttttataaaagtgcttgagaatatcagaattatttatgtcacacaaggagttactgcctgttttctgtgtcaccagattctattaacatttaatgattacctttactctttgaattttgaattttgtaacaaattcctgctgtggcatattttgcaatttggttatgttctgccaaagctgtaacagtaggtgaggtgtttcaaatttggcatgactgaatagaagagctgcccgttctcaccatatgttactcaactcatatattgctatgttatttttaccttactcatcaaattatcttttctcttatacatggctttaattaattgattattttaggtatttccatctctggacatttcatgtactgaaaatagatcagatttaaataaaatagctttataatcagtatttatgtgataaactctgtcttatttcttgcaacatttaccggcatgtaaatccaaattgaatattggttaatgttcagcaatattcaatactatataattgtagtgtattgttatgaaagtcaatgaatttccccccatgatgtactttgttccaaaatttgaatctcctttaataacatataacacataagttgcttaaaaaatttctcactgctgacactatttggattgtacttatgacaggcatactggccatcacctcagcatatgaggataaccatattttagaaataccatgctggtggcactggggagagctgattggagctggagagaccagaggcagggaggcctcttaggacatcgtgctcaaggagataagcaataattgaggcaagaacagaggcagtagcagtgggaactgctgggacaggtttaggagccagcattctgccttaatcatctttacacccttgccgcatgcctagacctagttggtacttagtaattttgggggggtttttttgagatagagtctcgctctgcctcccaggcagtagcgcagtggcgtgatctcagctcactgcaacctctgcctcctgggttcaagtgattctcttaccctcagcctcccaagtagctgggattacaggtgcccgccaccacactcagctaatttttgtatttttattagagacgggaggccgaggcgggtggatcacaaggtcaggagttcgagacgagcctgaccaatatggtgaaaacctgtctctactaaaaatacaaaaattagctgggcgtggtggcgggtgcctatagtcccagctactcagtaggctgaggcaggagaatcacttgaacctggaaggcagaggttgcagtgagccgagatcatgccactgcactctagcctgggtggcagagcgagactctttctcaaaaaaaagaaaaaaaagaaatcattgaagccatagaggacagggaggcatccaggagtggccattgaatggtggtgccattccccaccataaagatggcaggagaaacagggaacccacgtggcagtgtacccactgcctgttgaatgagtgacatgatccaggggaacactgcccactatggatacaccagccatatgccttgggagcaggtacctgtgtagaaaagagtggagaagaaaaagcacaaactttctcctccccattcctgggtgtggcaccagcatcagacaggagttcaaacagtgcttcctttcaccgctttccttgctgcttttctattctggtatcttcttctccaagacctcaggctttcccctctccaacactaccttctcagccaataaatcactggaggggaggtccataggaataatgcattcactctcttcaaatatcccaggctctagaattacccatctcctctcctggtttcagaaatcttgttttttcaatggtgagatagcaggaaactgatctggtaaaatgcattcatactactgtataaatgattgatggatccttttaactgtagttacttgaatttccaaaagagctctcttttaccactctaccaaagtgaaagtgccaagttgctgcatggaaatgggacaggtagaggagagtttttggtcaccattcaggcaagccaggtggtaccagctctccttcactggtcctatttcataacatttttgcttcttgcattttagagctaccagtttcctagaacagcagaagtagcatgctcccctggcccaaccaacaggtgcggctatagtggcctatctgtactggggaggggacaccccaaatctgacattgacaggttcacccaacagcagggatgtcctgtgccatgtgtaataccccctcttctttcatagctccagaatgtccaatgactacatagcactgtgctgagtccttcacatacaccagcctgtctttgtgcttgtaacagtctataagggaagcattattactcccattctacaggtggggaaattaagactcagagagaaaaggtaatttgctcaaggccttgtagctagaaatttggaagagctaacacataccactcttggcatagcagtttagacatggacagctttaggatggggagactgagaacccaggaaacacgttgaggcttctattaaaatacactactcggccaggcgagatggctcatgcctgtaatcccagcaatttgggaggccgaggtgggcagatcacgaggtcaagagattgagaccatcctggccaacatggtgaaaccctgtgtctactaaaaatacaaaaattagctgagtgtggtggtgcacgcctatagtcccagctactcaggaggctgaggcaggagaatcacttgaacccaggaggcagaggttgcaatgagccgagattgccccactttactccagcctggtaacagagcgagactccatctcaaaataaataaataaataaaaataaataaataaaataaaatacactactcaggaggctgaggtgagaagatcacatgagcccaagaattcaagtccagcctgggcaacatagcaagaccctgtctctgaaaaaaaaattaacagtgtggctatttcactgaataatcataaagggataaatgaaacaatacatcccagagacgagaaagagctttgttgtaatacctagatgggatgttctttgagtgttccccattgcttcctatttaaagtccaaactcctttacttagaattgattatagaaagtttaggaaaatctaaataggtgaaaaggagggatgagagaaagaggaaactactatcactctagaccttttcctttcctttttgctatctctgtgatcatctaaaacaaaatgaacaacatttagtgttgtataacttgcttttcttataaatagtcatgaagatctttcaaaaaaatatacagttttgaattttttaggcagtggcatcttttttttttttttttttttttgagatggagtctcgctctgtcgcccaggctggagtgcagtggtgcgatcttggctcactgcaagctccgcctcccgggttcatgccattctcctgcctcagcctcctgagtagctgggactacaggcacatgccaccatgcccggccaattttttgtattttttagtagagatggggtttcaccatgttagccaggatggtctcgatctcctgacctcgtgatccacccacctcggcctcccaaagtgctgggattacaggcatgagccgccgcgcccggccgggcagtggcatctattgattgtatggtttcttttatttcttcagtaattatagtgtctttactatggtgagagtaaatagtccactgtgttttctccttcgagatgtaattttacacatttaactttgtgattcattggaagcatatatgggtatgaaacaagaagcaaggctctaacttcattcctgccccctaccctcctccctagccaatttctctgattccaattgttgaaaacccctttaatgtccatcagtttgggctgctggctgggcgcagtggctcacgcctgtgatcccagcactttgggaggcaggggctggcggatcacctgaggtcaggagatcgagaccagcctggccggcatggtgaaaccctgtctctactgaaaatacaaaagaattagccaggtgtggtggcgtacacctgtagttccggctgcttgggaggctgaggcaggagaatcgcttgaacccaggaggtggaggttgcaatgagttgagatcacgccactgcactccagcttgggtgacacagtgagactctctcaaaaagaaaaaagagaaaaagatgggttgctttctttgttatataaaatattacatttctatagatgccagggactacatcaggcctatctggtctgttctactgatccttctcttgactcttgaactagtaccatattctcttaataatggcatttctataatgtgttatcccttccttacactgattcctcaaacatttcttagcagctggtcatagtggcttaggcctgaaatcgcagcacttttggggccaaggtggaaggatgacttgagcccaggagtttgagaccagcctgggcaaaatgttgagactctgtctctataaaattaaaaatttttttcttagctattttatctgtttgttccttcatatgaaatttagaaacctagccaggcgtggtggctcacgcctgtaatcccagcacttctgggaggctgaggcgggtggatcacctgagatcaggagttcgagaccagcctggccaacatggtgaaaccccagctctactaaaaatacaaaaaaaattagccaggcatggtggctcacacctgtagtcccagctacttgggaggctgaggcacaagaatcacttgaaccagggaggcagagattgcagtgagccaagattgtgccactgcactccagcctgggcaacagagtgagactcagtctcaaaaaaaaaaaaaaagaaaagaaaaagaaagaaaagaaatttagaatactttggttaagtttcaaaaataatttaaattgccttaaacctgtttattaactcaaggagaattaataatcttataatatttagtcttatctcttagtaggtttttgtcattttctaggtattttgtaccttcttttttttaatttaaaaaaagttttttagagatggagttcttgctgagttgcccaggctggcctggaactcctgggtgtaggcaatcctctcaccacagcctccctagtagctgggactataggcacacaatcatggctttgtagaattttttaaatagctgctgtgaatgggaagatggatttttttcccatatttcttctcatttgctttgctaagatagaattatgctatttttctttcttaattattatgtaatctagccactttggtgagcaatttcttattaagttagtggtgtttttgcttattgttttgagtattccagaagcaaatagatgttatttcgcctttctgaagatacggttaagtctgggttcttgtcacggagcccttctgggcagtttcccacttcacctctgcctcctccaaagtgccaagcacgcagcaggtactcagtgagtgtcctctgaatgaaggtaaaggaaccgcttggctaaggtcattcctggccctgggtggcagccctttgattcaggatctgcacctcagtcttaccagagggctgggggcttttagacccaggtgtctgattcaggctagccacctcacagacacttgccgcccatttccatctagagggaaagcaggggccagtcaccctagggagaccccattcaggacaaaagaagcttagaaaaaggacccagcggaggctatggccatccagaacgtcttgctctctatccagccaggctgcctgaggcgtgcccttccaggcttggaaccctgtctccaaggaaggggatccaacatcagacacagcccctctccccaagtgtccaagatccaaagggggaaaataacaactgtttcttattctcttccctttattcctataccctatagaattgcccacatttattagtattctgttttttaatttcaaaaaaaggaatacattcatacattcacaaggctcaaacataatctaaaaaggtatgcagtgaatgtcttactctaccctcattccacccatcccatagccacttttattaatttgcatgtccttttaatatttatttattcaaatacaatcaactatgaagatattcttatttttccccattcttacacaaaaggtagcatctgatacacacatttctgcaccttgatttctaacttaaaatatatatcataataatacaaatagttagcatttattgaacactcattgtatgccagtcatttttcaaacttttatccatatattaactcatttaatccttccagtactcctattattaacctcatttctccatggagaattttccttatcagtatataaagagcttcctcaatggcttacagctacatagtattccgttgtatgggtggatcataatttatgtaactaattgccttgtgagggacacgtgggtggcttctaattctttgctattgtggactgtgctgcagtgaatatattgtatggatatcatcttgttatgtgtagagatagagctgcagagcagatccaaagaaagaggattgctgggttaaatgcatttgtaattctgatgggtattgccaaattgccttctgtagagttattagttcttttcataattgcttagtatttctaattaaacgtagcattgatgagcactatgtatcagtctggctggctagtaggctctctgttggtggttccagaacaagttgatctcagtgtagtcccagatgagaccctttcttctggcctcaggtgggctgacttattccttttttttttttttttttttgagatggagtcttgctctgttggccaggctggagtacagtggtgcaattttggcttactgtaacctccacctcctgggttcaagcagttctcccacctcagcctcccaagtagctgggattacaggcgcacaccaccaagacttattcttatcactgccggtgagagtaaattacagcaatatttctggggaactaacagtattttccctggtaatatttgaagaagcagccttgtaatggttaagaacatggactctaagctggactgcctgggtttttatattttctttcgctgctgtaacaaactaccacaaatttaggggcttaaaacaatgtaaatgtattctgttatggttctggaggtaagaagtctgaaacaggtctcactgaggtatataaaggtgtcagcaggctttgctcctttgggaggctctcagggagaacgttttcttgcctttcccagcttctagaggctgcccacattccttggtgcatggcccctttctgtcttcaaagccggcaacatcacaacattcccacctctgcattcatcacatcacatctcctctcattctcctgcctccctgccctttcctttgaaaggattcacgtgattacgttgaacccacccagataatctagaataatctctttatctcaaagtccttaattgaataacacctgcaaagacccttttgccatagtaaggtgacatattcacaggtctcaggaatttgcacgtggacatctttagaggccactattctgctactacagtttgcatctagactctaccacttactaatcgtgtgatcttgaacaaattattttgcctcttgcaccagttttctcatccttaaaatggggataataatggtatctattccactggattgtcaggaggattgaatgagtaaatatttgccaatgcttataatagtatctgagacacaataaatgctatggaagtatctgctagctaaaatatattaaccaggccaggcacggtggctcacacctgtaatcccagcactttgggaggctggggcgggtggatcacctgaggtcgggagttcaagaccagcctgaccaacatggagaaacctcgtctctactaaaaatacaaaattagccggggtggtggcgcatgcttgtaatcccagctactcgggaggctgaggcaggagaattgcttgaacccgggaggcagaggttgcggtaagctgagatggtgccattgcactccagcctgggcaacaagagcgaaactccatctcaaaaaaaaaataaccaaataaaaatattaaaatacaaacactttgatctagcaggcctatatttataatctatttcataggaacaaaagcttccatgattaggctatataacttggatattactaaagtgttgtccatattggcaccaaaagaaaaaaaaaaggaaaggaaaacgaaagaaagaaaatgcacaaacaggaaattacctgaatgccagcaaaacgacagtgattgaatcaattgtggcccatctgggatataccagagctattaaagagaatacatctgatctgtgcctatgcacctagaggaatgctctgagtgaaagttcgttgagaggaggaagttcaaagtaattatatgacttgatttatttctttcttttttttgagacggagttttgctcttgttgcccaggctggagtgcaatggcaccatctgggctcaccgcagcctccgcctcccgggttcaagcaattctcctgcctcagcctcctgagtagctgggattacaggcatgcggcaacacacccggctaattttgtatttttagtagagacggggtttctccatgttggtcaggcaggtcttgaactcccgacctcaggtgatcctcccgccccggcctcccaaagtgctgggattacaggcgtgagccaccgcgcccggccgatttctttctttctttttttttgaacaaacatcagcccccaaaattattgtagatatctaggtcaatcatttaacatgttctgtttcttcctctgggaaatatgtataacgacaattctcactcaaggggctcttgcaaaggttaagtggcatggctgacatgtgtcaagtctgtaccatcctgcaagcagcagcccagtctggcatttgtgtaaggcggtttcagtggagagatgtgtggaagggtgcaccccacgatgctcacctggtgcttcctcggtggggaagggaaattcagaagtggtggaaagagatgattgtcgtttcgtatatctttgtattgtttcccggatgttgaaattgttactgtagtaactttttatactcatgtgttattggtagtttggatactatcaccataaccacaaacactgaattaggaaaagcagaaacctagaaacatgccatgattcaaagtctggtatttttggaagaggaatttaataacgaacgttttaagaggaaaaagtcaggagagtcctaacccaggccaaccttgtgtgtccacagcatctactgccgaggatgttccaagccgctgtgctgctcgtgcgcgctccttgacagcagccacagtgagctcaagtgcgacatcagcgcagagatccagcagcgacaggaggagctggacgccatgacgcaggcgctgcaggagcaggatagtgcctttggcgcggttcacgcgcagatgcacgcggccgtcggccagctgggccgcgcgcgtgccgagaccgaggagctgatccgcgagcgcgtgcgccaggtggtagctcacgtgcgggctcaggagcgcgagctgctggaggctgtggacgcgcggtaccagcgcgactacgaggagatggccagtcggctgggccgcctggatgctgtgctgcagcgcatccgcacgggcagcgcgctggtgcagaggatgaagtgctacgcctcggaccaggaggtgctggacatgcacggtttcctgcgccaggcgctctgccgcctgcgccaggaggagccccagagcctgcaagctgccgtgcgcaccgatggcttcgacgagttcaaggtgcgcctgcaggacctcagctcttgcatcacccaggggaaaggtaagcacgcacgccaccttcctgggcggcctgtgcctctgctgcaccctagggaaggcgagtcagaagagatcatctccatttgacagaaaagaaaactgggtgtttattcagtctttgggggttggtaaggtcttaggttccagggcacaggataagggggagatgaggccctgacaaagggctgcagccacccagaggggacacattttactaatttacaagactctgtggattgacctagcgatgactcatggggaacacgtgaaagttgaaaaactgcaaagctgagaatcagacccagtatcattttggcgccagagggaccaagcacttcaggaggttctcttaagccaccggtgtctcggaacagagaagtcaattgggacctggggttacggtagaagggggctaagaaaacctcctggggatggttggatgcttacccaaaaccatacagtggctcagtggaggagatcccttgtctgcaggatgacctgctgtctgccaacctttgcgcgccctgcctagtgttggacgcttgagaggtaaggagacacagactagtttctgatctcaaggagccagagccacttcacgtagctggagaatgagacagtgctcagctctgcaatccaaatccgggagatgtagcagctgtgtattagctggaacaggggggctttcaaaataaggggtagggggagtgtgccagagagtctccaggagtctttgactaaatctccaagctggaatgtgagctctgagcagctagtataggatgcccttactgggaaaggggagggaggctatggaatctgaaggcacctgggtagggtgccagtgacaaagagcttatttacttctcctggagctggacatgggtcatgaaggataatcttagagggcctggacctgtgccttctccacctaggtagtgaatgtcacccatattaaggaaatgaccccacagagtttacacagcttgccttgggtgttataactgggcaatagcagagagaagggttattttattctgaagcataagagatttagatttaataaaaaccaggctgcagataaggaagatcatggagctctcactatatgtagagagtcagtgagccggtagtgatggctttatgattgcgcacacttagccttgctgttggctcagagatggagagaggtacacttggggtttggagccaaaagcaagcactctaatgccacctccttttcccttctggctgggttcctgcccactgcattcgagagagctctccttccagctgcccctccagggagttgtccagtgctttgggatgccctggaaaataggtatcctggaaaagcaacagggacctcctctctatcactgtcccaggtcaggatgtcccttaccagcatgtccttgacctgcctgtgaccttctttgtgttctacagatgcagctgtatccaagaaagccagcccagaggctgccagcactcccagggaccctattgacgttgacctggtgagatgggtttgaggtctgaaggggtggtggtggggcccagcaggtcaggcaggttgtgagtcctgctgtccctgtgtgtgcagggagagcgtctgagtgagggacagcaagtggctggactggaaatttcagtgagaggaagtaaaggaagacattaaagaagggttggctggctagctggctctgactctaggctcctaaatgccaaagttgctcttgatgggccatgagccaggttcagtgggggttagatgtggggtagacagtcggccacagatcagggctgctgcagagggaattccagcattagatggcatattagtgccttccagccatgagaaactatggttgtcagatgtatggttagatatagggtcagcagtcctgagggatgtgcagatgtcctctcccctcctacaccctacccccaatgtgggagccttctcttggagtcagaataggtgggccttcccctgctctttccccacagatggttcttggaaaggaacggggaatggtgccaggagtcagatttcgatcccagttgcccgggttctgctggtgtgattccagggccaccatacatgtaacaaagcagactgtctcagggttcaaggtatccatgtcccatctaatgctggcattccttctgcagcacccctgacctgtggctgtccagctttcatgtacacatctccagggacaggaagcttgctcattctagaggcagctgctcccaactctggactgctctgacttagaaagtgcttttccgagtggaaatgcagtggtgtccctttgacttgccccctttggcattcacaagtatggctcctttccaccagaataagcatcctcggtttcttcctggacttggcatctggtctcttccctagcctagtcactcaggtttgcatgcgcctagcctatcaaggatctggcccaggactggccagtccttcatggacagcaggtcttctggtggtgggtaggggcctagcttttgccatggcatgacccataggagagagagagtgctgtaggttgaggcaatcaggagaggcttcctggaagagacaggacttaagagtctcagagttttagagccaggcaagagcatggagtctaaccccctttttttcacagaggacgaagctaagacccagaaaggatgtgacttacccaaggctacacacagcaaattaggggcaagattaaaagctgactctgttttttgtttgtttgtttgtttgttttttagatgaaggctcgctctgttgttcaggctggagtgtagtggcgtgatctcggctcactgcaccctccgcttccggggttcaagccattctcctgcctcagcctcccgagtagctgggactacaggcgcgcaccactacgcctggctaatttttgtattttttagtagagacggggtttcatcatattggccaggctggtcttgaactcctgacctcatgatctgcccgcctcggcctcccaaagtgctgggattacaggcgtgagccactgtgcccagcctaaaagctgactcttaactgccttgggtactgcattcctatatacacaacctcaagtaaaaagaggaattttttaatatatgtgtgcataatacaatcacatagtcagaaataaaaacatagaaagtgatcaatagtgtcttactcccactttagcccccagttcttatgcccatataactatcttttaaaaatttcttttgagacagtcttgctctgtcacccaggctggagtgcagtgacacaatctcggctcactgcaacttctgccccctgggttcaagcgattctcatgcctcagcctcctgagtagctgggattataggcacgcactaccacacccagctaattttttgcatttttaggagagatggggttttgctatgttagccaggatactctcaaactcctggcctcaagtgatctacccacctcagcctcccaaaagtgctgggattacaggcataagccaccgtgccccacctcttttttaaattcttatatatccttccagaatgtatgtaattacaagcaaatattattatagatatttgccttttgcattctgtgtttcacaaaggtaggataataccagatacacatggtatcataccagaattcttatcctatcaataggtagagagcttcccgatacctttttgcagctgcataatggaccattaaatggatatggcaggctttatttagccagttccttgttgctgcatatttaggttgttttgctattacaaacaatgctacaatgcatgatgtttgcaaataaataatataaaataataaggccaggtgtggtggctcacacctgcaaacccaggaccttgggacactgacgtgggcagattgcttgagcccaggaatttgagaccagcctcggcaacatggtgagaccctgtttctacaaaaagtgtaaaaatcagccaggtgtggtggcacatgcctataatcccaggtactcagcaggctaaggtgggaggatcacctgagcccagggagtttgaggttgcagtgagctgtgatcacaccactgcattgtagcgtgagtgacagagtgagaccctgtctcaaaaagcaaataaacaaataaaatcaaaataataatagggaaatgcccttggtccacagactcagctgtcttccagatgctagtcattggtgaatgaacaacaagagagcctgcactgtcttgtgtgaaggtctaggtattttgggtctttgtcttgataaaatcagaatagacgtggcctctcactatcagctaggaagcagtttgaacttggagtatcagagggttgctctttttgccaagcctctggcttcaatccttgcctggggatggcagtgctgctgagggaaggaagtggggaacactgtgagtgcaaggacaggtgaggcaggcacagacggctgtcccaagggaaagtgctccatcagctgtgccaggagagaagcagctcttgggtccgtgtttctgccttagaaggcaggagttgggcatctagctccagcactcatccctcttgaaactgctggtttgtttactttcattgcaactatatgcctggaagagatgaagagaaagctcaacaggcttcactaggattgtttgggtggggtggcagcagctcagatattttccctcctctgtttttcataggctttttgtaatcgtgttataatactttaatggaaaaaaataaatttattattttaaagctataaaaattataaatcagtcattatgatgtgtttttctctactgagccctctggtgtgttccctgttttattaacgtggatggagggtgtgtcagggaggttgggacagaggcagagaagaggccagcccggccttcggggagttcgtggcctgtctggaaagagggtcttttacataccagcagtttgcagagccagacacagaacgatagagcaggaccttttaaactcctttttcaaaaaaaaaaaaaaaatgtttaattttggtaaaatacacataatataaaatacatcatcttaaccatttcaaaatgttcagttcagtgtacactaagtgtacagttctttagcattgagtacattcacactgctgtgcagccattaccaccacccgttccagaaggattttcatcttcccaagctggaactctgttcctgttaaacagtcactccccatgctgcctccctcagccctggtgacccttgtctactttctgtctctatgattttcaatactctaggtacctcctataagtggaatcacacagtatttgtccttttgtgactggccactttcacttagtgcagtgttctcagggttcatccatgtagcatgtgtcagaatttcctttctttttaaagctgaataataatatcccattatgtgtatatgccacattttgttgatccattcgtctgttggacacttggcttgtttccattttttggctattgtgaatctgctactatgaacacgggtgtacagatatctccttgagaccttgctttcaattattttgcatgtttactcagaagtgggatcgctggatcatatggtaattctatttttaattttttttttgaggaatcaccatgctgttttccattttttattgcaccatttgacatttccaccagcaccgtgtaaaagtttcgacttctctacagcctcaccaacatttgttatattgtctctctctctttttttcttaaataatagtcattctaatgtgtgtgaggtgggttaaactcttttttgaccactatcctctattgaaaaaaaatatatattatatcttaacttatagtatatacatatgcacacacatactgtagctaaaggagttttataaaataggctgggtccagtggctcacgcctgtaatcctagcactttgggaggcggaggcaagtggatcacctgaggtcaggagttcaagaccagcctgaccaacatgatgaaacctcgtctcttctaaaaatacaaacattagccgggcgtgatggcaggcacctgtaatcccagctactcaggaggctgaggcaggagaatcacttgaacctgggaggcagaggttgcagtgagccaagattatgccactatactccagccggagcaacaagagcaagactctgcctcaaaaaaaaagaaagaaagaaaaaagttttacagaataaattatgattgttacatgggatgtactctgataatttctattctatactattatttttgacataaaaatgttggtcatgccccactaaattgctttcatggttggatccactaatgggtcacaagctgcagtttgaaaaccactggccttaagagtgactagactttcctagaggcctggcagagacagatcctgggagataatctgttctctctccttcccaagacaggctcacactctctaatccagagaggtcatcctccttctttttaaagatttggagaaaaagaaaggaaggaaggaagggaggagggaaggaggtcaatccatcatggccaatggtgtggagcccatgagaaggacccaccgcggggttctggtacctggcacacccaggagccagcactgtgctggggccatccctgccttaactcacatgcccagcagcctctgtcgggagcctccttgcccagccccagcttgcctgggtggttctcagaaggcccacacaggagggacagagcttgtccctgtgaggaaggtgtatccctgccactcactcattttcaataatcggtccagtggacgcttaaagttcacaaaagagagaaagatggtggggagggacataaaagactcatcaagtaaagaaaatgaagagcacgccggggcaggaagaggcctccatttcaagacactggatttggccaggtgtggtggctcatgcctgtaatcccagcactttgggaggccgaggcgggtggatcacctgaggtcaggagtttgagaccagcctggccaacatggtgaaaccccatctctactaaaaatacaaaaattagctgggcgtggggctgtgcgcctgtaatcctagctacttaggaggctaaggcaggagaatcgcttgaacccagaaagccgaggttgcagtgagccgagatagtgccactgcactccatctcctgggcaacagagcaagactctgtctcaaaacaaacaaacaaacaaacgaacaaaaaacactagattcaagtcaggccaggggtcccgaggtatgtgaccttgggaaatcacttcacctctctctgcctccgtttccttctctgaagattggcaataatcatagtacggtacctactttttttttaactataatttttatggcgataaaattcatataaaattcaccattttaactcttgaagtgtgcaatttagtggtatttattacattcataatattttttaaattttttaattttttttctttgcagctccagctcaaatgattaaatttttttctttttaattttcagagatgaggtcttgctatgttgcctaggtgggaggctcaggtgattctcccacctcagcctcctgtactttcataatcttgcacagccattgccacctatctagccccagaatatttttatgcccccaaaaggaaaccccttacccatgaagcagtcagtcccatttccccctcccccatctcctggcaaccaccaatctgctttctgtgtctatggatttatccattctgggcattgcatgtaaataggatcatacaatgtgtattttgtgtctggtttctttttttaaaaaaatttattattattattagtgtttgagacagagtctcactctgtgccccaggctggagtgcagtgacacaatctcggctcactgcaatgtctgcctcagggctcaagcgattctcatgcctcagcctcccaagtagctgggactacaggtgtgcaccaccacgtctggctggtgtctttcatttaatgtaatacattcaaggctcatccatgttgtacatctcagtcctcattgctttttatggctgaataatattccatcacgtggctataccacattttgtttattcagtcatcagttgatgcacatttagtttgttttaccttttggctattgtgagtagtgctgctctgaacattcacgtgcaagcttttgtttaaccgtctgttttcccttcttttgggtgcacacctggggtagaattgctaggtcatatggtaattctacatttaattttttaagaaactgcctctatttcattttgagataggtacatgaagcacttagcactgtgcctggcacagagtagtaataagaacaatatttatcatcatcaatgacattttctaagtgccaggtattttatattttacttgtattaacacatttcatccacattaccatatgaggtagatgttattattcccactttatagagggggactgaggcctgaggagttttaagcaattcatccaacttgtgtagtagctgacccaggtagagttaaggctgagagggcagaggcaaggtcccagggaggccagtttcagctcaatgggaggattttctcactgttaaaggagctgctttcgccagtagtgagcactttgtccctggaggtgtgtgtctaagtagggctaattactgagcatgtcctgagttgggcagtgtgattcctggggtatcttccagccctgttaggacacacaacaaccaaagtggtccctgggctccagtaactcagagtcagaaggaggtgatgccagtcgcggtggctcgtgcctgtaatcccagcactctgggagactgaaacaggagaattgctcaagcccaggagttcaagaccagcgtgggcaacatagtgagaccctgtctctacaaaaaaatttttttaaaaaaaggaggtgatgtgatggagagtttggaggacttcttgtccccagtgagctcggagctttgagtcagggagcctggacctgtgacttggtgaggccccagggattaggccaaccacaggtctggggtacctggccctggggctgctgcctagtcatttctgactcaattttcccaactttgcagcccgaggaggcagagagagtgaaggcccaggttcaggccctggggctggctgaagcccagcctatggctgtggtacagtcagtgcccggggcacaccccgtgccagtgtacgccttctccatcaaaggcccttcctatggagaggtaaggttctccccagccccagccttccctcctgaaggcctgagttccaccaggaaagtgagctggcactggggtgggaatccaggccttcatcagatcagctctttgtgggaaagtgtttgctcaacgccttctctgtgctctcccctgttcttggctgcatggtcagggagcttcccataagcatggcccactcccagcccagcaggggtgctgagacactcagggttgtcagaggccagcagagactggtggacagcagatagtaccagcttgggaaggcttcctgtctgaagagagacgtaatctgcgtggttgagagcagaggagaggggacagcaggagcaaaagggtggccacaagtccctggcagtcagggcaggctctgcccactcacccctgcaggcacctgacctggctctgtgactccctctatgcaggatgtctccaatacaacgacagcccagaagaggaagtgcagccagacccagtgccccaggaaggtcatcaagatggagtctgaggaggggaaggaggcaaggttggctcggagctccccggagcagcccaggcccagcacctccaaggcagtctcaccaccccacctggatggaccgcctagccccaggagccccgtcataggaagtgaggtcttcctgcccaacagcaaccacgtggccagtggcgccggggaggcaggtagggaggtgggtagggcagtggcctgggtgctgcccgccagggtctgggcggtgcccctcttctgtattttggccccatccagaaagcccaaagccaacaggagtcccttattcccactgaataagatagggaaagttcacagtgtgcgtgggggtgagagtggacacagtttaccatgtgttttgccatgattgaggtgtggggagcctgacaggctaaaatgcacagttctatgagtcctttctcccaaacactactgtgcctttgcacagggcaggtctccacaagaagtttgttggctgatgcctagcatactcccagagagggcttgggcataccataacaggaaactggactccccatgaccttaactctgctctctcagtctacacccatcatttccccaagtgtttctgcaaaggccacctacctaagtatctcatttgtcagagttatcttctatgaacactgccaggcaggtagtcagttgggcaggagttgaggtcaacccagaggaatctggaacaagagagttctaaggatctgcttcacccagagtacagctttgttcctcattctgactgagccctagccttggtcacacactgagcactgactgatattccttacccacaaatgctattggtaatcgatgggttttgattaactaaatgaagcgtcttttaactctagacatcccagctcatggagctgagaatggggacagtgtgcttctttaggattgcagaaggttccagaccaggtagcagttgtcaggcctcctgtacagggggcaaattctgaattctgggcagataacttaattgaatattcatagataaggcacagcaagaaattatggaaacccatttgtgaattactcaaatccaaatgcaaagcagagtcacattggcacacacagtggctgttcccgtccccctgcagggcatccgtttcccccagccgactggcctgcaaggattcccataggtgcacacccacacccctcccagcatgcatcctaggcagttcataatgcatctccccttccccgtttcagaggaacgcgttgtggtgatcagcagctcggaagactcagatgccgaaaactcggtgagtggcccagaagttcagcccaggactcctgcctccccccatttcaggtcccagggggcacagccacagcaggtgactctcagacttgccttgcgcctggggaattttccagtgaggcattgagtcccaagctgtgctgaggacagtctccaaatgacagctgcatgcctggaccaccccagccctcccactacaccagggccaggagctcttctgaaatgctgatagcatgtgtccagagccctgtctcttttctggaatgtccaagacctttgtctggagcttccttatgcattttctgtcctctaagtcctcagtgaggagggctggacaagaatccattccttggtttattacagccagtgggggccagtgaaggggtgtcaggccacagggcagctatataggggccaaacaagtgaggtttgactccatccatgtagaaagatatataaatccattccacagtgaaacaggtggcctcgtgggtagtgacccttctgtccctagaggtttattactagaggctggactatcacctgtccaggggaaaaggggatctgaatagagtgaaaggttggactgggtggcccctgaggtctcttccagccctcagtctgaggttctgtattggaaagtgcatggagcccatggagaccgccgagccacagtcctcgccagcccactcctcgccagcccactcctcgccagcccactcctcgccagtccagtctctgctgagagcacaaggagcctccagcctgccctgtggcacataccaccccccagcttggcctccccaccagcccgctgagcaggctgccacccccgatgctgagcctcacagcgagcctcctgatcaccaggagcgccctgccgtccaccgtgggatccgctacctgttgtacagagcacagagagccatccgccttcgccatgccctccgcttgcaccctcaattgcatcgggcccctattcggacttggtctccccatgtggtccaagccagcactcctgccatcacagggcccctcaaccatcctgccaatgcccaggaacatcctgcccagctgcaaaggggcatcagcccaccccaccggatacgaggggctgtgcgatcccgcagccgctccctccggggctcctcccatttatcccagtggctcaacaacttttttgccctccccttctcctccatggcttcccagcttgacatgtcttccgtggtgggggcaggggaaagcagagcccagactcttggagcaggtgttccccctggggactctgtcagaggctccatggaggcctctcaagtccaagtgcctctggaagcctctccaattacattcccaccaccctgtgccccagaaaggccccccatcagcccagtcccaggcgcccgtcaagcaggcctctgagagtgctacccttctcttgtaaccttgcagccaacacccctgcccggcccctgagctgcctcctccagcccatgctcttacaggccctgcacagagtagcactcattaattcttggttaaggaatgaatcaacgaatgaatggctatgcatggacctctgggcagggagacctgggtcttctctggctgagaggggaaggctaaggcatggctgagattcaagccaccattccaggcctctttgcccaagaaagaaacttctgtcacccttgcactctcctgtattctgagtccctggccaatagcacagccttccatgccccgacccccaccccaagcctctccactaggcctctgccaggatctaagcccatgagcacagggactggctatcccaagacctggcagatgtggctgctcaataaacacttgttgaaccatcacccttgcgaacccttattccacgaccatcgcgttctccgatggatccagctcctccctgcaggctgttctctcttccctatgctggaactcagttctcctctggggataccatgtcccctcttcctcccacactcatgggcatcagaggtgggaggtagggtcaaggccccctgcttcctggactgttccagccccttcctggccgtctggtaagatcctctgtccctctcagggtgggccccatgctccccagctcatcccagacacccacctgcccaccctcattgagggcagacgtgagcattcacctcccagatttcttctccctgctcaggtcctgccttcctcctgagtgacttctatttccacccacctgcccgccactccttaacctctcaggggttgtcaccccattcccccagacagctgcctgccccgtggccgtgccctgcaccttgccatcaccgagcactgtcggtccctcagccggtcctctcagactctgaccgcagcctcctgttccttgagctctcagtcctaccttcgcctccctccagccccgcgcactccccatttcatcccatctttcatcagaattgcagctccctgcccagcagaaaatcctggaaggactcaggagcttgtcgcctctgtgctgccacctggagaccgagatctgcaggagaaaggcctgggaaaactatgagtggttgcctgtgactgctaagggctccttggtgctccgcccagcatgtccttttgctctgcagggcagcccccgcctgcctttcttcactgggcccttgtcccagcctcaccctcagctgatggcggcaccttctgctccagggagaaaacaggagctctccaatggcatagggacagttgacatcttgctatttacagatccccatcgcaccccttccctgccctcgttagggtggaagggatgtccacctgcctccaggactcaccctgtgtcctggccccagcccttgaccccctgggagcctcactcctcctcctcatctctcttgcatcttctaatgtatccactgccttctgaactaaacaccctgaatgaggtctttctcatctcagaaaactccacccacttctctctccagctgtcggctccccttcctctgctctccttgtttacacttcagccccctccttgccccttcttcaccccacctcctgcgcttccccgccagtaccagggtggcctctgtgcctctaggtgcagtgtcgcgtttagtcgttattattcttgaccggcgctgggcccggtctttcctggaaagatcgcctgctcggatgcagctctgggcactcctccctctcctctgcaggctctgttttttcttggttgtggtgctcctgcaggtttgctgctgggccctttcctcttttcagtctgtgtattctcccaggtgctctcagccacgcccctgacttcagttactgcccaggggtagctgatacccaacactcgcacctgcctgccagaccagcatggccagtgaccttccaacagctccgcatggatgcccataggtacctcaaactcagcaccttctcctcccgtctcactggctcgccccactctctgcccggttgcacaagccaagaccccatagccacccagggcaccccccttttgattattcctcacatccaaccagttattgagtcttgtctttctagggtgtaaattcctctgaaatctgggcacttctttccatcccataatcttggtaaaattaaagctaccactgaccctgggtagaggcagaagcctgggaaggaaaggtggagaacaggtttggagtgccaacagtgtccccagatgtcatggagaatcaagtagagggaccccagcaatattgggggtggggcggggagtatgtaatgctcagctatcagcaaggagtcattaggggctatacagtgaattaagggagggggtaaaagcacatttcaggtgatgatgaattaaatacctaggagctcacattagagagcaggcctagagacgtggggagagagccagaggaccgctgcttttgtgtatgtagctttaagacacaggttttaaaaattgttataggagtcccaaactttagaaaatatatattttaaaaccccaacaaattaggtcccccctatgcatttctcacccaacttctgggccctttccagacccctggtgcccccagagtacacccagcaccaccactgcaaattcctactccccagcttggagggggtggggtgatattcccaaggtgatcccggctcccacctaacccatcctccccagctctgcagcttatatccagctttgcagtgaggaaagttgcagaatactggtctgctacattactactttccaagtgtatcagggcatttaggaacccctcccttgagcttcacctgtgtcctagggattcagtgagagactgtttgtgcaagaaggagcgagaggcagcagggcatagtcatggggtggagcagtgagtcccccaggcctggttgtggagtacctggggtgaggactttgcttaaaaactgccagagtgggtcagcagtgcgcctgccctggggcccctgctttaggatccaaagtggaaaagataggtgttttcacccactcttgtgacagattactggctccggtgccttggtggcagcagcaacaggagggggccaaggtgagggggcagcctgtggcagaagtggcagtggtgacggcggaggaagggaggcctgtggggaatggctgatccaggggaggggccgtggcactggtgagtgtgcatctgagaaaatgaaacggaggtgctggccaagaggctggagctaggcagaagggcagcagaggccacaggctggccgagtttatggtccagttcactcataacatgtgcagtattcctggggtctttgaggctttgcaagagctggggttttgtgtctgcagaaagatagcaatgcatgtgtcttgccaaactgatcccagctgtagctgatgcttaagtgctcagaaagttcttcaggagcttgagggctcttgataagcatgaatgtcagatgttctgtatcttccagaggctggatgctgactatcagagtttggcttgtgtttggctgatgagcaaacctggaatgaatcagtgataaggacaattgttctcaagctggctgtacactggggagttttcccaactacagattcctaggtcctacgccctgagattctaatcgaatcagtcttgggtgcagcctgggcctcagttttttcttaaagctatgaatgcctaaccaaagtcaagaaccactgaatcgggggattcattgcatgtctgtggtagaggaatgctgctcatttgtttatagatgtggcagtcttgaatgcaggtgacattttcataccagggtgtaataccgcagaggaggggagaggctggatcttccctgatgtacctcctggacttttggagtgtgattacaatgccaatccagccacttcctctgagcatgcttgggacgactgttagacctgctgtgttgagttagaatgcacttgacctgctcaggccgtgaaatctatgaggaaggggagtgagatggatgtagctcatgagccagattgcaggtgtatccaagttgcatgtatatcctgaaaaaatcctggctctcacgaggctcagcctgaacacagttttgcattcaaagaaacaatgtccattaaccaagtataataaagaaataaatcccagtatttacttgcatcttttgaaagaacattaaagggaatccagctcataaccccagcagcacttcttcagtccttcttccccttttctttggcgcctggcatctctcactgcatagcaaagctttcccccttgattcccggtcctcacacgcaggctcaaggctctgtttcccatcttctttcttctgtcccccttccttttctcttccaagcaaatctaagtcttttccagtgactgtccctctctatgctcccccgacacccagttatcctaatttgcggaataaggccaaggtgtggggcctgggggcagaatgggagagtctcccctagtgagcagggaggggagtatgttctgcaccaggccactatgtctgatggccctgctggcaaacctgagtctttcagaaagtcttgtttaaatgcgtcagcactccccagctgtgatgctggagtttaaggcggagcaggggagaattctgggtttacagctggctggagttccagtgagaccagctccatgggtggccatactttatggaagtccccaagggcaagaggaattttggaggaagtgagtcagggctgaaaggtccagcctctcctccattaacaagcttggtggaaagggggtgtccttttattaaaggagacagtagaggtttcttagagaaggcagctcgagtaagtttaggacaaaggacatttccctggccccgggacaatggaaggctctaaaaacgaggttctagtggctgccataaatgaccctgctgtaacgatgggaggggtggcctaaagagacagtactgtggctctccagggagctctcctcttggaagagcagatctgaaggcgggaagactggttctaaggccgaggacattgccccgagctttgtggaggcactcaggaacacaaaggggcatttccagttgggtttggagcaggaagaagaacgaaaaagagaaagtcctgtgtgccatgtcagtgggtggcagcatggactcagcctcagctattggcaccaaggatctgaaccagggaggacccagaaggggagcccagcccctccaccagcttgtgggagagcgctgctgcccagtgaagcctggagagaggaaacaactggattctcccaaagcgggagaaggtggagtctccagccacccagctacaagctaggaagacgccttgtagaaggctccttacagggaggaaaccgagttggaaaggcgagacagcagtgtgggctcacccggagcaagacgtgtgaaatcagcttttgacagcgtggctgaatgaggatctggagatgcgaggcgctgggcagactctctgactagatccctggatatgaagaggcaaagccagctctagatggattcatagtgagtgtctgcttctgacaataactggcagaaagctgatgagcctggagcagggctgtgaaatgcaaatccagtgaaatccagccactcctacaaaaacccaccacatcttaggttacttgtgggtggaaacgctttttctctcagttgaagcttggttggaagcagatgtttcacttgggcattggaagggtctggggaaatgtgctgcctcctaggccagggacattagccagaggccagaattaactgaggctttagcaccaggtgacaccaacttcattgagaagccagcggcagtccataaagaggaaaaacccaaggcctgccctggactctgtcccagccatgctcccaattggccctgtgatcctgtccatgtctcttccttgctggtctctggctaacgtccacaggtggcattcatgggaggttccaagttggtcatcaaagactaaacatctgggcttggcagctgagcagatgataagcaattaactctgtattaccatcagaggctccacctccctctgtagtcccagtcccttgggaaaatctcagagctggagcccttccctcatcctctggctccccaccccatggcttctcgaacagtgttcccaccaggaccttgggacaggagagaacgcctcacctgaaggactcccaaaactcaggtttctctaagctgctggggcagatgccaagagcctccactgctctctcactgccaaggacctgggtgtccacctagatgtggccttcaggaggccaagcagtccttcccctcgcctttgtgtaggacactggcacctcggctgacttcggggacaagaaaaggcaggctcccgaccccttccaaagaatcatctggggttcaagatgaggcttctttctcccgtcccaagttttggtgtttcttctgagtctgctcagaaagatgaaattaggagcagacatctcaggtcctgcctgccatagcagatggctccttccctgagcctccataagcagcacagcacactcatgcacacacccactggcattttctctcacactttcatacacttgtgtcaacgcaggttcacagctcacacttaactgtgcatgcacacacagatttagcacttggattcattcccacacatgcacgttcacaacctgtgtgtgtcacccttcctcccctactcatgagggtgtatgccctggttcatacatgtaaccctcacatgtgacacacccagttcacacccattcatgcacacataccttctcttgtgcacacgtcccctttcccagtggtacaccctccttcatgtgcacgcagatgctcccagctataccagcttgctagtgttctgcacaggtgcttgccttggccctctgaatccctgacgcttggtttttctgtgttgcagtcctcccgagagctggatgacagcagcagtgagtccagtgacctccagctggaaggccccagcaccctcagggtcctggacgagaaccttgctgacccccaagcagaagacagacctctggttttctttgacctcaagattgacaatgaaagtgggttctcctggggctacccccacccctttctaatttagtctctgagtcccaaaaagaagtgcaggcagagccatctgccaggcccaggagagctctgagctctggccaacaactgcagccaggctgggcagagcactccggctcacctgggctcctggcgtgtcatttgctggcttgaataaagatgtccgccttatccagtgcctgagtgtgcgagagaggcagatgcctccacaagtgcacctctgaccagttcttctctcagacagagagcctggggaacacactcctagacagaaacacaatgcgtgagctcattgccgtgagccctgtcatccaagtaaggcctctggctgtgctacacgtttctgagtagagggccaatcccacaggtggctgcacagggctgcccacagatccaaggtcacagagggatcagaccccttatcctggaagcccctctacttcctccagtgcttgccctggctctgcaaatgcccctccttgagccagagccccaggccctaccctgtggcatggactcaacattggggctagcccagccagacagaaacagcaagtgttttcatggtacagaaaagtcatttgcagacctcagtgggaggctcttggccttgctctgagtggagtgctttctatgtcccagggctctgactgggctggggtccttgaggggattggaggaaggagcatgggatggagagctaagttcaagcagcctgggatctctagtataggtggctgaggctgatagaagacaggagggacctgtatccatggggtttggccaactctggggccggtagtggaggaggggagagctggatccccagctggtgaacaaagtgtttggagggcagccgagcctccccttctgactgctatcccaccacaaccaggatcagagctgcatttgggggctgatgtgtggctactgccagcagaccccaaggtgaggtctctagatggtgagtcagcagccctagaggaccccctgctcccaccccagagctctctgtgaccctgggtcctcaccctgcccttctctcctgcccagcccagaagattagccagctggctgcggtgaaccgggaaagcaagttccgcgtggtcatccagcctgaagccttcttcagcatctactccaaggccgtgtccctggaggtggggctgcagcacttcctcagctttctgagctccatgcgccgccctatcttggcctgctacaagctgtgggggcctggcctcccaaacttcttccgggccctggaggacattaacaggctgtgggaattccaggaggccatctcgggcttcctggctgccctgcctctcatccgggagcgtgtgcccggggccagcagcttcaaactcaagaacctggcccagacctacctggcgagaaacatgagcgagcgcagcgccatggctgccgtgctggccatgcgtgacctgtgccgcctcctcgaggtctccccgggcccccagctggcccagcatgtctaccccttcagtagcctgcagtgctttgcctccctgcagcccctggtgcaggcagctgtgctgccccgggctgaggcccgcctcctggccctacacaacgtgagcttcatggagctgctgagtgcacaccgccgtgaccggcaggggggcctgaagaagtacagccgctatctaagcctgcagaccaccacgttgccccctgcccagcctgctttcaacctgcaggctctgggcacctactttgaaggcctgttggagggtccggcgctggcacgggcagaaggagtctccaccccacttgctggccgtggcttggcagagagggcctcccagcagagctgagaggagggggtgaccagcttggagtctctggtgggcagagagggatggggtccctgagccaggccccacccatcacagcattcccaggtcctggtacccagccctcagttgtcatttggttcagaatcagttccctttctctgggaccaaatttcccttctctaaacatcctacagagaaggttccaaagctgagcacccatcaccctaggtgtgcaccagactcctattagcccctccttccaggagctagaaccagggaggtcctgagtgaggaaggcatgacctctgggctctctaggtggccctggtcttgccccatccatcccacctgccactaccttgggtgtccttacagctctgccctgaccccagcccctgcccctggacacctgctgacagctcccacacagaacagtctgaggtgatgctggctacagccctggcagcccatggcaactcaaagtgccttccaaaccaaactgcccctcatgaggttagggtcccccaccctccacctgcccagaggccaactctgttcccttctcctttcatcccagaggggcctcatcagcaaagacagaaactgatgttccatgcatgtccctgcttccaaagcctgaccttccaaagcttgcttccttcctcctggctgcacagacacctctgcttggccacagctttgctctttggtcctcaggccaccagacccctcacagcatggcccttggctcttcctgcactgccctcaccctcagccgtcccaaggagtgcccagcactactcagcatgtagtccaggacctgcggcatcagcatcccctgggagcttcttagaaatgcagacctgtgggctctaccacaggcctctggaatcagaatcttcagggtggggcccagcagtctgtgttttaacaggttctcccggtgatgctggtgcatgctcaagtttgagaaccgctgctctcatagactgctcctccaaggggaagcagtgtggaacagcagagaaagtcccgtccctatctctgactgtgcagtgagtgtggcctaggaacaggtcccttcctaagctctagtgtccccatctgtaaaatgggctgattggcctccacggtcagagcggccatctggctgtgccatcctgcatttttaggaatggaaagcaggcctctgaggcagtggacaggaagacttctcatccttgaattctagctcccattccaaactgttagtccccaaccttgtggtcacatcagaggtcaacagcagaacagaggcaggtcagggttgtccgctctgattagcagaacgacagccccttcctcctcctccctccttcccatccctactcattagctccctgctcctgggatgcttcccaagcagcccaggcctctagcctccatggctgatgacctcagctttcacactggtgaagtctgtgtacccatactgcagccccatcccatggggcccctgaagacccactgaggaattccgtagggtcttgttcccacgaccggagtgctggctctcacagtgaattttgatgcatttaaaataagattctgatgccagactgttaaaacaggcgctggttctgaagcaccgatggaaacagattgatgcagatggaaggaggaagggagactgggcccactgatttccagccccaccatgtgtgctgttttcagatgtgattgaggggtgttctgccctgcctccactgtcacagcctttaataaagatgtgaatcttgaaagcctgatgctccaatcacagactctgctcagcatccccagaggaaccactgagaagccttttgcctggataggagggggctctcccaggcataggcttgtggccacttgcccagcacaactgtgttttgtggggcgtcttttaggacttagcagagctgagagccctttgttgctcaatgctgtgagccttaagcatgtgaatccccccacatgacaagtggggagacccagggtaggctttcctttggatcatctccaaatgggagtgccatgtggcaggaaagaagcaccgatttcaagaattacttcctagagaaagtcaggaactagagaccagagtctgcaggaactttgccactgcccttcactggctaatcctgtacttctctctgtgttccttgagtgacaggtggtaaaacccttaaaaagggaggtgtgggaggcccaggactttggtaacaggtgatgaatgtgttgtcttggccatcacaggtggagcttcagttagtacccgagggattcccctggcacaagcattataggaattagtccaccactggcgtgggtgagcagccaggtaatgggaattgatcagtgccaccacccttgaccccaactaccatcccagatgcccagattccagtcctggagttttattctctcagcttgatcctttgaccaagaagatccagtcccaatatgtcacctgtgcttcatctttggactatatctcaggtgtttacgtgtcaactaatgggagcttactgggttagaagtcaggacactgagtttcaatcctcacttagtagtctgtggccctctttggcacattaacctccctccttgatcctcaggctgcacctctggcaaatgggagaatgcggctccttttgacttcaagggatctttgtgggaaccaatgagaaaatgtgtgtgaagatagctttttggtatattttaaaagtgcacaaatttaagatcttactgctttataaagtgctttatgaattataggaaaataaacacattttagatcttagaa

SEQ ID NO: 967 - DNA, 73411 bp, Homo sapiens; identical to SEQ ID NO: 954

SEQ ID NO: 968 - DNA, 73411 bp, Homo sapiens; identical to SEQ ID NO: 954

SEQ ID NO: 969 - DNA, 49407 bp, Homo sapiens
ctgctggaattttttttatttaaataaaatatacaatacggcgcatttaccggtttctgttttaaaagtggatttgaaaattccttgtaggtgactgggtgtgggagggcccattgcctgcacctgtctgtcccagtctctgcagagtggccaggttgggtcagagctattataaaatgcatgtgtgtgtaagtagagaagagggtggttaggccaggctctgatggcaagggggctcctcatggccctggaccctccaccttcacccctgctgcctccaggacaagactgtgggtttggatcaagtcctgctgcctctcagagctgccttccttaaggggaaggggtgtgtgcagaactcaggttgaggctaagtccttccagttctcagaactcctgagccagcacagtagagaccagtactaggcggcgtctagtctttacctaagatcccaggaaccttcacccacttctctcctggagtactgcctcccactccctgcagcccatctatggagaaatcggtttgtctcacatcccaggatagctcaaggcaaaacccgatcttgccaacattctggcttggagcatggaaggttctggatggataatgtgggaccagcccttctcattacttggggattgcagccatacctgctctggccctataggcaggggcagacccctgaccttggctctggcaagatcccatctgggaggagggaggatggtgcctccaaaggcatctgagctgctttctcgttcccgcaatctggaacctgcttatggctcctagttgccaggactaagcccagacaatcccttaccctatcacccaaggccgtccctctgacccctcagcctggggatcccctcccaaagccctgatccaccactccacatccacctcaggaatctccccaccatacactccatcccacccaccattccctccctctctccctgttgaagtcttcccacttctcaaggcctggctcccacccacctctggccacacaccttccttgggcccttagggaggcccagccacctcctgagtcctgagattttaagtcttggagccctcagccaaagctccctgggctctcacatagtttgctggagcaataggctgggcatatgaggggcagaagaaatgtgattttttattgagcacctaccatggtatgtgccaggcgctgggctgggcatttcacatatagatttttctcatctggtcctcataggtccttgtgaggcagtaccataattattcccattttacaaatgaggtgacagaaaggtcagataacttgcccaagatcatacagctaagaagtggcagggctgggattcaaacccaggcctgactgctgccaaaatctggtgtcttccttctgtaccatgcttggggaccatctacctcagcccccctcaacacagttttctgatggaaggaacacagacttgggcctcaaggaggcgtggactcgaacctcaaatcagtccccactctgccactcctagttacatgattctggaaaaattacccaaaactgtttcttcctctgctaaatggggagaatcaaagtacccaccccatggtctttgtgaaactgaaggagttaatgtgtgtaaagtgcgaaaccagtgcttggcacagagcagactcaataaacagaagttccgctcacctcccactgtacagatgggcaaactgacggccccagaggtggcggtgtgtgcttgaggccctaggaaaggggagtcttccacttccgtgtggtgagaggtcaggctgggactggctttgagaccagagatggggagagagggggcctgctgcgaagtcctggggtcctcttccctgaggactggagagagaacgtccctagaccatgcagtgcacagcctgtgggccaaggcgggttgctgggtgtaaggtgacctgggcatcctgtcaacatgggattaaactagaccgcacacgtgtgcgcacatgtgagtggctatctacatggctctacagagcgctacatagctatacatatacacatcttacatacatatacatatacatattcatatacagatcttgctacgtttacagtagaaaaaatgctaggccctcagggccctggcccttttctcccaaggtcgcaggcttctgaggctccccagggcacaccccagggcagcccctttctgggggcagagtggagctccaagttacagctaacgggctgatggcagctgtttctctaaatgaacacaatgacacatctgctctaagaaccgccaacactggccactcccacccctgcccagccccggagaccccatctgcctttctctggcttttgcatttgggacctgcctgctccctcctccctccccctccctccctctagtgctgagtattaaaatagtctataaaagcaagtgaccaaaaatctatagctctaagaatacctggttattttctgctgtcttttgtttttctggtgtgtgtggttttttaaataattattactgttattggtatatctcctaatcacagttaaacctgaaggaagaaggaagggagagaaaagaagaaagaagagggaaggaagggcccagctcatagattggatggcagtttggagcgcactggctcaggcctggccccaggttccctctggggtccagcagtcagagggggccccccagaagaggtggctcttgccccaaacaaagacagagggggtggcaaagaacctgaggatgtcttccgaggcagagtgacgtgctggccggggatggcaccatagggcctcccagggggaccgaggcccccgctgctcccactgcccccgctgccacccccagccctggggaagagcgggaaggcagccatggactcccctgaggagtgcggggaggctctgcggagagtctgcgccccgtcctgaggcagggctggctgagacgcggagatgagcttgaggtcctgggtgaggcggccgggggtgagcgggggtgtgccccggcgctgggggacctggggtggtggggggctggatgcaggtggcaggagcaaggatccgtgggagccagaggcccggggcggggcactcgggaaggttcttggggggcctgggctgtggccaggggggctgagacctcctcggggagtaaagcctacaggggaagcccccccagaggcccctgccacaagggacggcggctcaggctgccgtgggggtgtctctggcgtgctcagtgggccagtggccagacctagggacaactccccgggaggctggcccagctgcccggggctagatgacggggatctggatgagggtgggggtggcaggaagtgctccgggagtcccaggcctccccgggccccgggtggcgcgggagatggctgggcagcctgcggggagcgggcgcctggctgcagcggggtgagcaggggagagtcggaggaggacagggagccacccagcgccttgtggaagtggccaaacccggctatggtggtggcggctacgccagctgatggtgtgggagccgagggggagccacaggccccggggggtggggaggagctggatgagggcaggagtgggctcagtccagcgggggcagagaatccagccagctgttggatgtggaaggaggatgaagacggtgtgtccacctgggacgggctgctggcgggcgaggcggagcccagcgcagaagggatcagggactgcagccgtttcaggtgccttggcgtctgcccggcaccgaggttgcccagcccagatcctgggggagggcggaagatggcagcaggcaggcgagggtggtgggtgagggctatggccacagaagtggtggcagcggcagcctgcagtggtgcctggatcagcggggtccagatgacgggcgtgggggttggggtggcagaggcagcagcctggacgcggtgcgcgcagtgggccatctcccggtcatgctgcacaatctgctggatgatctcattctcctggtagttgaagacgccggagttgaggtcgtgctggactttgtggaggaggatggagttcttcttgcctgggccacagaacaagaacaggcactcagggcagagcggggaaggagatcaggtgcagacctggcttaggcataaaggagccctgccctcctcccccaacaccccccacctgccccgcctgtggcccctccccctcaccaatgcggtccaggcggtccagcgccacggtctcgaaggcccttcgcatcatggggtactcctccagcacctcattgaagttgtccacgctcagcgagtagaggcggcagtaggtgtcggccctcacgctggctgtgcgccggccccgggtcagcaggcagatctctgccagagcatcaggactcaggatgaggcatgcacagcctgcccaggccagggggactgcccaccctgaccttggccctgactgcctggcacagaagccttggcaggctcacaaggccctgcccccagactgcggccacactggatgcctcttccccaccaaatgggggctggacagactttcccatctttgggacataccctctgctctggactgaatgtgttcccccaaaatttatatgttgaacccctaatcccagcatgatggtatttggaggtggggcctagggaggtgattagatcacgagggtggagccctcgtggatggaattagtgcctttttaggaggaggccggggagctggctcatcctccttctgccacatgaggacacagcgagaagtcagcagtgcagcccagaagagggccctcaccagccccaaccatgctggccccctcagctcagatggccagcctccagaaccatgacacatacatttctgcagtttacaagccacccagtctgcggcacttttgttacaagaacccagactgactaagacacccctaccctgggctcacagacacctccctccaggctgtggccaagaagggtgctcactgcctctgtcccctcggtatctccccaaaccagcccctgggagcagctgccctgtcccccagggcccagggctgcctcacctccaaagtaggagccgtcggccagcttggtctccttgttgcccttggtgagcacgctgaccacgccatgctggatgaagtacatcttcttgccaatggtgccttcccggatgatgtagtccccaggctggaagacctcgaaacgcagcttggtcagcatggacgtcacgaagttggggtccgcattggcaaacagtggcatggaggccaccagcttccgacagttaaagttgatgatctcctgccggacagggtggattgggacacgggaaggaggtggtgaggggagctggctgccaggaaggcctggctcccctccacgccgggccgccacacagctcacctcccgcaggggctcgcttagctcgcccaggatgctctcctcgtcgaacatcttgccctggtagcggtgctcgtagtagtcgtggatgcgctgccgggtgtcgggcgggagcttgtgaaaggacatgtactgctccacctgcttgtactgaggccgggagaagggggcgtcagctccaccccaccagggggcgtcagcagccagccccaccacctcggcaggcaccacatccgggcacccaccccgggggatttcctggctaaacttggttccttgagatctgaggtctacagtgtggaaatgacctcactgtgctcaaaacaactgcccgggctcccagctgcttggcatggaggaggggcccccaccagcatctgctcctcgctgtgttcaatactaaggaggtgggtgagggcggcagggaatgtccaaagcccagtgacaggacatcaactgtatctccagggaggtcgatcacatttccttggaatgttacactggggacagggaggcctcaccgactctgcggggaaagaagctgtttcctcccagcagtgacaactggcacagtcaggaggcaagggtgcgatggatcagaacgctcagaggcagaagcaaggatgcctggctgctcgatgctatgaatccaaacgtggcctcagctgagaccccgggtcatttcgttgagagcaactccaggtaagggaaaagcagggtagactaatttgaggggaccttcaaatagaggctcgggtacaaaagatttgtgagcctcagaccctggggctcaaacaaataagaaacgatcctgcccgccctcactgagaggagtggacattgctcccaccatcctagattgtgggtggacagtgggattcccaagagcaggatgagggatgggaggtattgattaggcaacaacacagactcctcccggatgggaagtagaggaagtccctatcaccccagcagcaatcagaaacggggcagcctgtttgcatctatgtgtgctccaaagaggtgggaacgcacaactgctgcacagaaacacccacgggcaaatgagggctgagaaatgacatttcctaaacttcttccagccaccctggcctctgactgctccaagttatgcaaagtcccaggggacagtgacttcctggctggttacagagatggaggcagctggaaaacctggagctgtgttttagagagtccctcccctgacccccagagaacaggtaggggtagggaggcagggtctggacatggggcaggagttaaaaggttgaagtggtccaggtgagagacagacgtggggatggagaggagggaagacatttaagagaaatttattgggcagacttagatattagccaaaggacaaacattttaaagtctcaaatgaaaagccacagacgccttgactctggccctaaaataaactctgatgcattttcttttctttttttctttttatttatttatttatttatttattttttttgttaagacagggtctcgttgtgttgcctagactggagtgcagtgatatgaacacagctcactgcagcctcaacctcctgggctcaagcgattctcccatctcagcctcctaaacagctggcactataggcacatgccaccacgcctggctaatttttgtatttttagtacagacagggttttgccacgttgcccaggctgctcttgaactcctgggctcaagaaatcagctcgcttcagcctctcaaagtgctgggattgcaggcatgagccatcatgcccagcctcccagacgctttttctttttcttttttttttttttttgagatggagtctccctctgttgcccaggctggggtgcagtggtgcaatcttagctcactgcaacctccgcctcctaggttcaagtgattctcctgcctcagcctccctgagtagctgggactacaggtgtgcaccaccacgcccagctaattttttttttacttttagtagggatgaagtttcaccatgttggccaggctggtcatgaactcttgacctcaggtgatctgcccgccttggcctcccaaagtgctgggattacaggcgtgagccacagcgcccggccccagatgctttttctaaactaatccctgatcttgaccccagactaaaacctagccttgatcacacactgagccctgaccccactcacatgctgagccccaccccagtcacaggctgggcactggtgctggctccagaaggatccctcacctggctgagccccaccccagtcacaggctgggtcctggtgctggctccagaatgatccctcatctgggcccggactaagccctgacctttgtagcttgatgccttctctacctccctaggaggtagagaagggtcctctaacctaggaccctgtgttctagccaggctaatttctctgccaccacccctatgctcatcctcatcctgatgcctggcctagaattctcttccaccttctccttcctctgcttccccacagtgagctctccttgcctcccagctctgtaggctctcctgagctctcttcttggcatcatgggacctggacctccacacctgggtggcccccacctgtcagtcaccccaccaaaggacagtgcctgggacaggcaggcaggcagtgaatccacaaatgctgaccctactgtgtgccaggcatggggcataaaacagaaaacgacatactgggtcctcccctcatggagccgtggcctggagagggaaggtgggtttgttaaacagatggctgcctatggttaattacatcaccacagagtgccgagtgtggtgaaggaggagagggtgccatggggtcacatgacaggtgaggggctggccaggtcacagacggcttctctaagtggtgaggctggacgtggagagggtgtcaggtggacacctggggaggagagttgagggtgaaagcccgtgtctgggtcccatggcaggagcaggcatggggagagaagtctggccaggctgaaataaagggtgcaaggcccagggcaggagctgagcatgagggcagatccctggttatgctcctcaaatgccaggctgggaaaacatgctgaggagttaatctacatcttcagagcaacgtgaagtccctgaagagtttcaagcagaggatgaggctgacgtgttttagatgccgctccaactgctgtgtgaggtgtgcagtggaaggtgccagggcagaacctgcttagctgataaacacaggggagcttacttgcaacccccacagcctgatgcccagtaccacccccgccctgcagatgaggaaacggggcctcacgctgtggaggcacaggcccacgctcaaacagagctcggcagcagagaagctggggtagggcccaggtggcctgactccaggccacaggactcattctctgtggtgagggggctgctgttgagaccccagggagagatgaagctggggacgggggaaggtggttgggatgcagagaaggagctgtggctttgaggtaggcattgatgacagagagaggccagggatggctcctagtctctggcctgggcatctgggaagagcagagacttggagtagagagaacagggcagccttctcattacagacatgaggggcgtggggtgtccagagagggatgaaataaaccacctggagctgagagatgaggtggggctgctgatgctgtgcaggccccactgtgcaaagatgggcacagagcctgtgggcctgggtggtgaaaccacagcaccggggccccagacagagggagggtcaggggcgaggcccgggccactggggactccagtggcagtgactgggaagagaagccagcaaatgggggcaggggactggccagaggggcaggagcaacaccgcgagagtgcggtcctggagaacgagtgagcagccaggaagggcgtggtgactgtcaaatgcctactggagcagcacggagggcacagggcctcagccaggagccacaggccccagtgacactggagacggggaaggtgggaacagaaaaaaagacatgtggaggggccaggccagggagctgaaactcagattctcatctcagaggtgtctccctcctcctgctcttccctcacactgggagttccgatcctgtggggtgggagcagggggcggttcctgctgggggcccactggctggtggcctgtgctccctcttgggagggaccaatgtgcgggtgctccctgggtagacctaccttttcctggtactggcgccgggaggagtccagggactggatgagggcagtggcgtggccaatgaacatggcgtagcaggtggcacccacgatcatgctgagcatggtgagccagacgtcggacatgcccacgggcgcctgccgcccgtagccgatgcacagcatgtggctcatggccttgaagagcgcgtaggagtactgcttcccccaggagttgttctgtggacagacggatgggtggggacagtggatgagagggaaggcccttctcactagcaagaaaaggccctgccacctcctcacctcaacctaactttctcagtggctgggcccagggctccctaaccttgctgttggctgaaagccttgggtgagaagcagcctgtgctgccagcgagtcctcctcttgtgccttcctcttgcaatgggggcagagatcagactggaagccccagtaaaggtacgggagccagcgtggcccagcccccatggggcagcttggagcctcctggctgggtagcaaaggccccgggctgagccaccgtgctgtccttcccttgctaaaacagctccaccccccaaccccctaaacagctgccaagtgaagcccatttccccactgacctcaattataaaaccagatatgcttcccttggggggacaagctctggcggactgagccgaaaaacactgtcctcattttggatgagcaaaagttaaagctgtgagctaacgggcctcctgcatgaaccctgcccgcctctgctagggctgcggccaccagttctcctcccactacccccaaggcagactctccggaacacacaaggcgtggggacaggaggagggaagctcttggctatttttgtctacaaagccagtcggtgtctcaaggaaggctcagcgtgggaacactgggatcggaagggccatctcttgaatttagtgcatgtgtgggcctgccaccctcacatagagaggacactgccccagatgagggcccattgaacctgacgaatgccagcactggccacctccctggtgtctttctgctcacagggcagatgcatgagccacagtgcagaaacctacccaggcccacagagcacctgccagaggcccagcccccaggggaaggcgcaggagcccgtgagcttcgagccatattcaaggtcagccagactgccctgaacagagctgagctggctccttgggtctgatggctcagtctagactggagtggggaccaggagggctcatccccaggggtggaagagacctgggttcccagccttggggaacaggggtaggcccccagcggcctttactgctgagcctctgggaacagggaattcaatccatatggctgattcatttacacttagctcatcaaaaggctgttttgtaaaggcctgtttgatgctgaaagatgcctcagggtctctttcacctctttcaaagccaatttttcctcccctggggccctgggaatttgccttcagaacaaaccaaactgactgggaggaagcctgggagaggcaggggttcaccagagacacagaaaggctcacagatccagggtgtcttctgtcctgcctggaacccacctcatccacagggggactggaaactctgccctatggcttccgaggccccaagttcaacttctctcacccaccctgacccacttgcaaggttggagggatagggtggggtcaggcttcatcctgcctgccctccctatcgggactccacctcggatcaggatatgttggcgagtgggggcagcccagctctgctgttggagtagaaagtgaccacatatgacctgggagtctgcgtgggctgcaaatagtacccttgaaggcgtctgttttcttgggctcagctttttgttttttatttttatttatttattccttttgagacaggatcttgctctgtcacccaggctgaagtacaagcgagctcaagggatccccctgtacagccgggacacatgtgcttgccaccacaccagctagttttttaaaaataaattttatttatttgttgaagtcaggggtctccctatgccgctcaggctggtttacaattcctgggctgaagggatccccctgcctcggcctcctaaagcactgggattactggtatgagccactgcacccagcctcaggctcagcttttaaggacttggcttctaaggggcagaggcaggaggccaggagctgccagcccagcattgccatgcctgggggaggccgcccaggtcttagtctccctgggtaaaatcaagatgaaatactgaggctcccagttgcaatggaggctgtgagaagatggaggtaccagctcccaacccagagctgtgaatggatccctggactggcagcaagcgattgggcctgtactgggtagagctatgtgccccctcagccccaggcagcactcagggtcctacatgctggaactcagaagttccaagtccacatctcgccaccctacctctggagagcccgcctatggcccagagagaggaccgggctgggcgcactcaccaccatgttgttgatggacacccagcagtcgtcagggaagtcctgtagcatgggtaccaggaactgcaggcagccgtcccagtggcagagcaggagcatcatgccgatgaggttcacgatgcgcaccacggcgctggccaggtcgtaggtcatgtggaagatctgccagcagaggaggagaaattggctgggataggtgagtggccaggagggccagcggccactttccctgccctggagctgctggtgggcactgctctgcctggactctgcagggcgcccactcagtgcaaatccaggctgggggtgggatgggaaggcgtcagtctaggtcttggaagaggaagactgtaggctgcagggtcccagagggacatctcctggcatctatacagatggggggtcttcctgaaaggtctagccatccaggacatgtggaaggacacctggagccccatgcagcccagaagtgggcagagaagccactttctcagctttcctggggtgtgaggataccagggagaaaagcctgccagcctgaggctcctcagggaaccaaaagtctacagacatgccaggggcgtgtttccctaaatctatcactaaattctcaagactcacacacggtagccacggaactgcagaggaagcggcacaggctcacaggccccaagttcaggcagaccttgatcccaagcccaggtcctacccagttcctagctgtgtaaccttgaacctctctgatcatgttttctcatctggaaaatggtgataaaaattcttatctgagtgggctgtcaaaaggactaaattatacatataaagtgcttagtaatgggtagaggagtgttcaataaattacaaaccattattaattgataagctgttattaataattaatcttcctgattggttaatacgtatttggggtaatgttctcctttacagcacccttgaccccagcccactggcaccagcccctctctactcctgcagctcggagtggggggctgcagtgtagctggacagggccaaggtgggcatatcccagcccctcctcctcccaaagctgccatgctggggtccccttgctgacagggcagtgggggatggagaggtggaggcaagtctagaggaaagtctctggaagctctggccttgcttctgtggcctgggagactttgaagtgggtctagccacccagcccccattctcatccctccatactattcccaggcaaagacacccctcttggaggggggcttgggtcaaatgccacagagacctagtttaagcccatttcagatgtggaaactaggcccaaacagacagagcctagatatgtcagcccctgtctactggtcttccagctacagccctgtagctagtggcaagctgttctgatactagtgaccgaagatgagtactttttgtccacagctcatcacctgcagtcacccccacctgtggcccccatcaagggcatgaccctgaaggttccagctacaaagctgggagtctttccaggatgaagtggacagcgaaaggttcatggggtccggtagcttaagcttgccccatcatttccctgtggccctggtgacagaggggacaatagtgccacacctgactgtggacatgaaattccacagccatcctctatttaaactcacaaaaatcctttgctgaagatattgttcatctgttttataccaaggctcagagaagtacaggaacttgcccaagatcacggtggcagtggaaaggccagatgttgtagccaggtctgcctgattctgaggcctgtagccaccatattagattgttagattgacctagtgaggaaagggtagctctcagcagttccattttgtggataaaacaactcaaacccaaagtggctgaatgaggtgcccagattcacacagcaagctgggtcctaggccaggtgggaattgccagcttctcgcctccccagcccctgcacacagtgtgatggtgtagacggtgctgtgtgccctgcagcccagtaccactggggcacagaccagctctggggctgtcagcgtttgagctcctggctaagctgacactgctcagcatctgccatggcctggaaggaatggtgggccctggagagcaggccggtctgtggctgggctggggcctgggtctgggacacagagcagatctgattatgaatttggggtctctggtccattttctgtggctggtcatgttcaggcacctgtatcctaagaccgtgaggctctccccagcaggtccctgagcaccagagcccccagcaccagccggggggaagatcccacttttgcctccttaattaacacttaggtgaatgtgacatgtctatgaccctgggcaaatcctaacctttctatgtcttggttgaccaggatgccactagctccccagctcacccaaccccctggtgtctgagctaagacaccaggggtttggggagggcgagtgacacagcaccattcacggtctcagagccggccatcctccacacctgcctccccaccaccacaactcagcctccccctcaaacaagctagacatctgccccctgttttacaagattgcttgtgaattaaactagctagcaaagtgctctctgcacacccgtcatagacgcaagggtggggccattattattaagctccttctcttcccagctgctagggactgcacctttgtgtccctctcaaattcctacgttgaattcctaaccctcgaggtgatggcatttggaaatgaggccttcggaaggtcatcaggtcatgaagttggcaccctcatgagtgggatgagtgcccttataaaaagagaccagacagagacgatctctttgtcctgtgagggcacagggagaaggcggccgtctacaagtcagaaaaaaaaaaggccttaccagaagcccccgtgctggcactctcaacccagactgccagcctccagagctgtgggaagtagtgtttgttatttcagcgcccccagcctctgttgtttatgttgtcacagcctgagctgactgagacaccaaccttcagaacccagccctctgccacagacaggaaagctgcgcaggaggccaagggtactggaggcacagacgggggcccgtgggggcaggacagcagcctccccgaggcacatggctgagtgctgagctggggtaatgaggcaggcctgccccagggttggagagtccaggacaaggggcaaatcaggttccacaagccacagatttggatatttaaagtcgtaactcaagccaacaaactgttaaagaaaatatattctattctcctaccttgacagaaggcaccatcgtaatgccctggagggccagacttgaaatgagaactcttacaaaaccacaccagagcacagcccacctcccttctcttccctgactgtgccccccagcagaggaccctggcccacagccaagccacatccatgccactcctgcgaacagccacttgtaagtgggtcaaggggtgggcacagaggcagaatggtcccctcaggacatcctgggaacggccctgcacaggccttgacagcaagcttagaggtgtctgtgccaggaatgctgggtacccaagtgtggtcaagaaagagttgcaaagagcccccagactcctcactgtggggagaggagccttccggagtgggggccagtggggcccttctttcctgggtctcggggcagtacccttagaaagacccaaatgtctatgccatgtcccctggaagtcagcctgtgtcagtgcccaagaaagcccccctccctatgggggtcagggaggaaagtcttgcccttgcttgcccagagctcatagtctggctggggaaggaagccgcacccaggaaagggacttgggaacatgtatatagaaacccagcaacagaggaaggcaagcagggcacaatggggaggtgagtagagaggctggtccaggctctgagcacccccagcccagatgctgctgtggggctggacagcacggctggtagcagagcccacagccacaagcatgccgttctcctcccacccctggcttgtcaaggcagcaggaattctgctgaaagtttctttagttgaggagggtatcaaagtctagggcatctctggaagcaccctgagtggggtctccctggctaaagggctccccaggatgcaactgtgttgccgccatcacaaggggctgtggagaccggcaatgctcctcctctgatgaaggcaaccttccctgtgctcctctttcaagccctgggatacccccagttccttgcttctgtcatgcctaagacacacaggtggactcagagtaacacaaattggctcgtatgtccagctgtctcggtctatctctacgtggacacatccaaaacctgtttccatctcacaattggtgtcgctgttcgtgaggctgagcaacaaaaacccaccagccagccgtgagtgagtctctcatccctccccacatcccatcaatccaggtggttttggctctactgcctaagtggacatctcaaagccatttacttccctccaatcccaatatgaccccaatctaaacacccgcaagatgacagccccaacctcttgatgaggctccccgcccctccaagccactctcaaccaagcagctagaaagacctcttggagacataaatcagaccatgtcactctcttaccataaaccttccaatgacttcccactgcacccatgaatacactccaaatgccaactgtggccctcggcatctcggctcccaactaccggcctccctgactctgcccaaagccatctctggccacagcggccttccttcatgtccttgaatgccccaggccagttcgtgcttgccccaggccctcagtactgggcttgctcttccatctgcctgcgtgctgcctccagctccttcttgtcatcctgtcttggctcaaaagccacttccatggaaaggaaggacactggatccctgtgtgtgacacagccaagggctctcccttcccattctcactgtgactctttgccctgatgaatttccttcctggagttctcactatctgaaatgacattcactgacttgcgtgctgctgcacgaggcagggctcctctctacttctcacttctgtgttcctccatgcttagcacaagcaggcatcaaaaatatctgctgattgcctgaataaatgcgcgtacatctaaatgaatgagtgggtaccatatgggagctcaaggaagcctccgggcatggctagaaagagtcccagactgtcacaggccacagtaactgctcctttggacagatcacgctgggccttaaagacagagcatcgaaggtggcatgttttcctgcaatgacctcctttccttctgtatcgcctttatcttttcattactccttttcttctaagatcaggtccttgtctaattgtgcctttatcgtgatctcagcaatgaacacggcacagagcatgtggtaaggtttcaggaactgagaagggcttcgtgatgaaggtgaaggcaatggtgacagtgacgagaatggtggtcagcagggctcctgctagtgtagacagtggaagaacaaaaaggtacccgctctgggcagatgcagcccacagggaacctacccttgtccctgtgggaagaaccaaggtgccttctcctgcaggggacacagacttccgtgtcctactgagagcatggtggtggtgaagcctggaactgcggtgaggaggactgtgggcactggggtggtgggtgcaggtggcagggctggagaggtgtgtttcaggtggtttttagacaccacaaagctggagcgccaacaacgcacagtctgagctgcctgggaagagctggtgggggcacatccattcaggttagggggtgccctagatttgaggacactcacctcacctgcaccactctccagcacctgggaagtggttgccgagaacaaggctggacgttgctgggagaggctgctaaacactggtgtgtccccactgttggctggggccacaggccaccggagagtcagttgcaccaggcaaatatttgccttgctctttatatttcattagaactccctcttacgatgttggttctgactgcaggggttgagcaccttcatttccaggccactacaagccttgcccgtcaggcggtccaggcagctcactctgccacacatggaacttggggaagccctgctctcactccttctgcagtttctcaactgcagtgcaaggacagagccactgccttttccaccccgagcctcagtttcctcatctgtggaatgggtaattgccagatctcagggctatcatgggggtcaggtgagatcatatccaccactagcacatggtaggcactcaggacatgttggttcctttccttccctctctttcccagccctcccaacaaagagttgatttctcagtcccaaggagaggccagaaattggaggtctggctgctgctgtttccaccaaggcctcttcctggggcctgattgaatcctctcctgtggattcattttctcctcatggaagaacaacttccacctgtgtctcaagaacaagtgtctgcgttgaagacagcaaccccaggcctggcagaacaggctgctgcatatgcatgctgggtgcagtttgaaggcagctgcactgagggtcatgccgggtcccatcctgggtgcaggagacagggccagtacccacgccccaggacctctccttgtgtcatctccacttctcgcagatgccaagcacctgattctgagatgaggcaatcaaggtctacaggatgaggggactcatcagaggccacacagcagccccagctggccttctgcctccagcccctctttggccacttcaggctgccaagggagaggagagacttctgggatgggtcactggagtgctgagccttgcagggtaacgtccaaagaagggtaaccatggtttctaacaatagcctccatgcctggaacaagctcacacctcggagggagggaggaggcatggctggagaggctcgggagggagtctgctgacccagatcgcccaggatggaggcaagaggcttgcatcctccaagatggtggcccacctgcgctgactcacaagactgcctgactgccaccaacacttaggagatctcctgggggcctggtctgggcccggctgggggaggcagtagaagcctggggtcaggagtctagcttcttgcagtgccaggcagcctggggcaagctttccccagtctgtgggaggcaagctccctagccccaaccgagggcatcctccttcacgttccgtgagctacaacaaggtcttcagaatcagctaacataaaccttgccaaggcagatgggagctggggactgggccccagggagccacagcttcagagaacatcattatgtgcctcacaagtggggaaactgaggcccaaaggaggaaagagactcatagagggacttgaaagaggagattagggcagggttttctgtactaaatactctcctcagctctcatgtggacctagggctccaaagggtctttctgctgctgcctctgggccaagcagaggtgggagaagcccccgggctggagtggcctgctatggtcctggagacagggttcctggggccagctgggaaaccccagtccaatctcaggggtccagtgagagccctaggctggccagtgtgcccggcagaaactagctcaaagcaattttcttcccagctggtaggagagataaaggtttgtgtgtggaagggtgagagtcatccatctggcctcctgggatcttcttcctccccacgagatggggcggcacgtctagttcagaggcctgactcaaggcctcctggggcctctgcctcccccagagaaaggccaggaccagcgcctgaccagttctgggtgcccaagagggtggcctggccagggtggcagtggggacaggagccctgggcctgagctcccaggatgcataatgtggggacgtgaaagacaagcttagctccaacccacgactcaccctgtccagccactggcatctctgccaactcctacaaaagaccacagccctcaggccctggaggagtaaggtcagcccctgggaggctgaggcctggagacacgaatggatgctggaggagggaaagagctggcgtgtctctgcttttcatggcagtctagctgtgggtccaagacatgcagaaggttgggggtttctcagggtctgagggagccaacctggtcctacatttccacctgcgacggaaaccaggagacaagtgtgtcagagcatgaggggaaacacgcctccatctttccttcacagcccctcagagtggacccagccgcaccctccagagtcactgtcccctctcagccctcagctcagaccacctgccacatctctgcacatctctgtctcacaggcacctccaactcaacctgttgcacagatctcctcccctgccactgccctcccactctctgccaacagtcgtcctagtcctttgatcccagcgcccacccaggccagcacaggtgggtgcccggcaagcacttgctggactgaatgaagtccagtcccccatggaggggccccagccatgaaaggaaacaatcgtagaatcaaagtcattccctttccatctgagaaggcgggaagtgcatggaacaggaagacaggaggcctaggccaaaagccctaccactggggcggctggcctttctgatcttcagtttcctcacttgacacatgaggatcataaatcttgccctgtttctcttgacagctaagtatggggaaccaaggaaatgttactaagacaacttggtggggagggaggtaggtgtgtgtgtgtgtgtgtgtgtgtgtgtgtgtgtataaatatatatatattataaatataaataacatctatttatttatttttttgagacggagtttcactcttgttgcccaggctggagtacagtggtgcgatcttggctcactctgcaacctctgcctcctgggttcaagcaattctcttatttcagcctcccgagtagctgggattacaggcgcccaccaccacgcctggctaattttttgtatttttagtagagacggggtttcaccacgttggccaggctggttttgaactcctggcctcaagcaatccacccatctcggcctcccaaagtgctaggattacaggcgtgagccaccgcgcccggccaggagggacacatattaaacagttcttctgcaccaggcttcatgctaaggctttataaacatcaggtacaacttatacctattttgcagataaagagactgaggcacagagaggcaaagtggacccaaagctacatgctaggcagtgtggagccgggattttaacttgggtcttaaatgcgccattccactacaccggggtgggacagcccacactatgtgctgggggccaagagggctagctggattctgtcccagttctaccagaggtctaactgcatgaccttgggagagtcacggcccctctctgtcagcataagtaatgtgaattttccaagccaaagagaatttctgccatggagggacgctgccaaactggtgcacacacttctcctatggcacatgcgttcatgacgcctctgaccatcagccataggtgctgccagtcgaggcccaggctgctgctgggggtgagcatggggggcttcatgtcctgaacatgggaacttctgccaggcaagcagggggtcctggaggctgggaagtcagccacgcggcacagggatggagcgggaaatggccctccatggaagcttgtcccgcccacaggtggcagggatccaaggtgggctgtctcacagagagagtaggccctccaggctggcctgcctgccgctgctgccaagttgtgtaacttgggtgggtggcagacacagaccgaagcacttggcaaggtcagctgctcttcctcccagcaaagcccttagctcctctgctgcagatgactgcttcagcccatggatgagtgaggtttgttcacaatgcagttggtccgcccagttctttttcaatgttttattttcctcctgtagccagtgttcacagcccctaggatccctttacagtttctgagcacaagactccaacttgcccgcgtgatttcactctctacagccagcggccgcaccttttgtcagaggcctgcccgggctgctggaaactgctttggctgtgagtgctgagggctggcagtgccttgaaccaatgactgacaggtaaggggatataaacattccaactcccttgccctgactgggacaactccaaggtgtggcgcacactatcctcagatcccatagggctgaggcaaacagccatccacaggacaccctccaatgtccaaccattgcttggcttcctgcctttccctgtccctctccccagtccccttaccagattttcctgggaatgcatccccaaaacatccctttcatgcaaatctttgtctcaggttctgctcaggaagaacccaaactaagagagttgccaacaaaatttgtataaaaatccagatttccatttctcataatgctatagatctagcaaccctgggcccattcccacttgacaaaaattagctggagctgcatagaggccacccaatataacggagatgttctctagttcttctcatccaccacactgtctactgtcccccaactggcccttttcacccatccctattccctgcctgtccccaacaagtttatgggtttacaaaccctacaacataacgcagtggttaataatgtgggctctagaggtgatcggcttaagttcacattccaggttcacaaattactaatcatgcaaccttgtataagtcacttaatatttctgtctgtttcttcaggtgaaaaatgagtatatacatgtacctatatggttccctctatagctgttacacacttcattgagatactgcatgtaaagtatccagcacatgataagaggtcaagaacttactagtatttgtcctcttggagcaggtgtgcctgccacaatctgacagcctatgttcaattatctgaggttccctgccagttcctcactccctctgtggggagtggcctttcccccaagaggtttgcactgaccacttacctcttcccactggtgaatatatcgaatgaggcgggagaggcgtaacaggcgtaagaggctgaggatcttcgtgaagcggacaatgcgcagggcccgggcagtcttgtagacctccgagtcgatgcgtgtctccacaatgaggaagatgtagtccacggggatggaggaaatgaaatctaccatgaaccagcttttcaggtacttcattttaatccgctgcgggtccaggatgatctctgtgttgtcctccaccacgatccctgtgcggaagttgaggaccaagtcgatgaggaagaatgtgtctgacaccacattgaagacaatccagggtgtggtgttctcatccttgaagaaggtgatgcccacaggaatgataatcaggtttcccaccatcagcagcagcatggtcaggtcccagtaaaatctgcccagagacacaggggtcagtcgccaggaagagagagaggacaagttacagactaagggaggaagatctgagggacagcatctgggacagagaagtcttgggaggttctgagacaggaagacaggcacatgggtaccagggcaagatgtggagattggcacagggaatgacacaataagaggctcttcattcactaaggataccctccgtgctgcccttctgtgagtttccccgagccccaacaacaagcttcctcctcccatccccagcccgcagtaagagtcaggctgaaaagcaaatcagtgacactcagagagaagcaagaggctgttttagcaaaaggagcagctcaccccacaccaccccaggctcaggctaggctgccccatcctccctgagggtcagctgtggcttgagatgggctgtcagggagacattccacagaccatgaccaaagagcaggggaggtacagacatgactcaggtgcctggaaggcaggaggcccaggctccggccccagctttgtcatcaacatgctatgtgacatccggaagggcctccctattctgggcctcagtttcctcactgtgtaatgagtcctatcattctgatctggccctctcccaaactggttctctggcatccacctttagtccatcccctataatcagaaaatgtctgaccatctccttccctcagaggtttgcatcctaacatgggggtgtggagggggagagatagcttcaaaacaagaataattaatggggggatttcaggcaccagtgagataccactcaatgtgatagaaagagaccagcccagggcttccagaatcatttctcctaaggcctcaggcaccttcaagtcgtttgtagagggagcctcagggcaaagccttggagaagttgagcagcatgaggaggaggcacaacaccaactcacaggtctgtggtgggtttctcccaactcaccaagcagggggccttctggagtgtggaaacaacacaggtggccaagaccccaatccagaaggcatggccagttattcccagggaccctgcccaagcaccagccatcccagggctggccccaagaccaaaaacttgcactgcagagctgtttccctctgctattaatttagacatttacacaataacagataaaggtattaagtgaggcagaaataagcatgtcttctcccaggagaaataacctttccaccatctttgattctttactgcagggaagccaggaggaaggaagtgggaaagaaagagataagctttcctcgagtcttcagagggtctcactgtaaaccaaagtgcccctgcctgcagagttccaggttgcaaagaaattacttcatagcaaattgtttgtttgtttgccagactcaaaatggggctgtgattcaaggagagggtagggcctgttttgctgaaggtgggtgagatggctgtcctacatcacactgtgtggcaaagggcagtttccagagagtcagctttctgcagctcctttgaaagccaagctcttcagggcctcaagacagggccttatgggggataaggccggatgccaagaggccaacttcagctcctctctaccccatgacccaccactccttcctgtggccccagtacccatatgccagctgagagaacccaactaaggcctgaggacccatcctcagcttcacactttactacaaagaatgcagcacacctgctaatgagtcatgggccccaggaggatggtttcagcatctatggggtgccctagagccgtgcatgctctacccagccacatagacctcactcaaagacagctgtgtacactcattagatgccacacgcaggtatccccattcacacacacagtgcacaaacacccctctatacactctgctgtcatccctcttcatttaatctcctgggaaaaacaaaagaaaacaaattttttaactgtgcatagaaaggccactgagggctatgtggccctctgtacataaagctaataatacacccaggctggaggagtttctaaaattaacagagcgggtgcaaggcggctgggaatgctgactcgggcgggcctgccactccaacgggtttctacactctccccagctctagttccctcaattacagtccaaatttgagagagtaattaacaggagaatgtttgcattttgtggtcttcataaaaccaaattgcataaggcaaaaacacccatttcctcgcactctgactaatggtttcaatcttgagcttccagatgctcagggatatttccagcactcgatctgggctggggtcgggatcctggatcattctttcccacaaaccactaccctggaacatcacagagctgctggagagacagtataatatggtgggaggagggatgggcctgaagtcagggttcgattcctgctccatggtttactagcaagtcactttaccatgccacacctcagttttgttatctgctcaatgaggataaccacagtacctgactagcagcactgtcataaggaggaaatcaattgatttctgtcaaatgctctgacctatgcccagctacattatgaaatgagtaaataaatcatcaaaatcaataaatttgcaggaaagaggtaagagggaggatcaaatctcccagagaagagccaaagcaaaacatctgctgggagtgggatcacagaggagcctgtaatagacccaggaaagccagtagcaggaggtccctccagcaatcagatgacagacctatttgcctcagtacacagatgccctcacctccagagactcatggtctggtcagagcgcaaggcttggatagaaggcaattggcaatggtgtaagaaaccatccctatgagcccaggtatccgtaaaaagcccaggtatccataaaaatgggatcccggtggcctagaagggtgaggccgggaaactgcttctggaggaggtgagaggagttgggttttgggaactgccgttggcttctggactacctttccttactccttgccagatgcttgcacaggtctccgaaagccaggccctgccagagctagatatgacgttcagcaccacggacagcgcccagcacacctgccagccccgttcagtgggtttagccaggggaaggtggcaacagcttctacactggcatcctcagcttgctggcccctcttcatttccaatcctgctggtcgaagcatctcaagtgatgccttaatatctctgagcatttttactggggctccttggtgactgaaaagtctttattcataaagaccccaaaacacttcacatgtatagagaacttacttgggttttccatgcattacttcatttatccctcacactagcactgtggctgctgttattttacagatgatgatcttgaggctgacagagaagtgtctgccctagactacacagctagtgagggacagacacaagattaggagaagtctctgggactccagagtttgagttcttggggttgtgggtaccctagagggatgtgggaggcagatatgcctttctgacacctttacatcacagtggaaaggcagcctaccacagcaggtgtggcccctgccccagagaaagaagagaagactgcaaagaggatttggggggcccatgctcctgatgctagggctgtctgaggtagaggaagtagcacacctctcaagtgctgaaggcaccctggccatcagcaatcactcggtcacggtcacacatgtcctatagaagggaaaacgaaggctcacaaaggaaggaagagtaacatttccgaagcctcaagctggatgcccaatgctcccttatcatctggccaccccgagaatcactcatgaataaatctcacaatccagggtgtgaatccagggtggtgggtgtaatgccctgacaggaaagcaaggggcagtcaggctcagatatcctggagttggcacgtgcctgaattaggggccctagtctctccaaatccagaggatcctcctccagcccagtgccctttaagttaacaggagtcctggccagcaagacaccaactgggctctgggagccccagcagccccaggcttccagacctgtcttatctcaatccttacttcctacctggaccaatgggtccacccaggcaggcaggtggcctctcagcaggaagaggcaacttataggctgacactggaggggcaggtcccatatgcagaaagaatgggggatggtaaaaagccaagcagcccattacaccgatatctggaaatttcatgttttggtgtgagaggaagttcatagcctcaagggagctgaggaagacatgacaggaggtggctgatactgaactcggggactcaaggacaagactaagggccctctccttccctggaggccaaagaggatgggaagggtgacagaatgaaagtaggaaaagtggaggtcccagctagggatgacctccttcagcctcttcttgtccacacacacccacgcttgcctttgaggacatatgcacatatatacacgcatgcacatgtgcacatgcacagacacgaacatgcgtgcacacacgcacacacacatgcacacccacatgcaataccatgaatacattttttgtaaacacgctcttgccttttgccctcctacatgcatccatttttacacatgcatactttcttgcatacattttggcacaaatgatatccactgggaatcctgtcagctggaagaagaatgtcattgttttgtcattaaaatattttccacctttcaagctagctcttcaactctgaccactgaagcctctgcacagcctgagtcttggttttagctcctaaaacaccatgggttcatggaggacagggaccttgtctcagacacccatgtccctgcagtgctgactgtagcccgtgggtctccacgctttctcccaggtgagcagcacactcagtgccccatctgttaccctctccaactttgcagacagctcccactcagtgccactcccagcaccagacctgcattcttacctgcctgcaaaatgcatccacctggagggcctgctgtctcctacagccaacgactccagagctgaactcagcatcatcctcctcaaagctgaatggcacagtttgcatttcaataatctaggctcaaaacctcccagccatcccttactgctgcctcttacctcccacccacccctacagcaacacccccagcagtcaccatgtctagtctagctgcttccatgatggcttctgcatctgtctctcagctggacccttgccccacctccttcctggtctccagcctccattctcattctctccaactcatatgccctctgggttatctttcccattcccttggttttccagacccagcaaagatcctgacactgaaaacagtgagaatggaggaggatggcagtcaatactttttggacacttaccatttgccaggcactaatctgagtaccttatctggactactttatttaatcttcattaaaaaaaaacccctatgaggtagatactatgattatgcccattttacagatgaggagactgaggtacaaggagttgagagatttgccatatatggtgggccaagtattcaaacccaaagagtctgactccagaggcctgctttctaaccactccacagaaatatcaatctggctggtggtattttattactcccaaactctgtccctccccaagctccttgtctccctcccagctctctctcctgtgctctcttccatggcacctgcatccttaacttcttcactcccagaccccactgcctccccgcttaagtgaaccctagttgtgtcctaaggacatcactcttccaaatccctcatgcctcagaatcaggggtgagtcagcatcctcccctctccctactgctgctacctcctgcctgtggcagaaacgtctacaagatcttttgggtatccttgtcatttgctggccatccttccagcacccatctgccatcctcaaggactttggcaatgctggcacctggttcacaacctcccgttccactccaaatcctgtgattgtcctgggtgacttctactccatatcattgacccagacaacaccttggcctcttggtagcttgccaccctgactctaacaatcccacctcaatggtccattccaaagcacacacttgaccacgtcaccacctccggtgctgcatctctgcagtcctcttgtacaccctgcccttctttcctgccggctcttctattcagttgtgctgcacctgtttttcagagtcctgggaatatccagtctgctgactcctctgatcctctcatcagaaccctcctacatcctcccaaccacccttcaccccagacacgatggtccagctcattcgcctctctaaaaccaacgcctttaactcccatgcccctcctcctggcaccgtcatgaaatcccagccccaggcaaggaccaccatcaacccttttcatgttcacatgggagctgtgtagagaatcccacaacctcagaccagtcctactaaatatccaagtttcttagctcctcatgcctcaatgtcatcatcatggcctcattcacagccctcatctctgtcccctgatccttccaggagaacctagtaaactttcctgcccattccccatagctgctatttcaaattaattcctctctcctcaaagctctgaaaccaccactttttctctcagagtcagcagataacaccactttctacgtcacagagaaaagcaaagccgccagtgtccccttcctctttctgccaccttgaagcatctccccaatcccatctcctcttcccagtcacaggggaatcagcggctcttctacctgcccttttgataccatccccattttcctccccagggaccttaatctacagaagattccctctctctcttccatctgtctctctccactgatcctttcccatcagcttttccttttaagctctctaaacttaaaaaaaaatccctccctgaacccctgctgtcttatctcttaccaagctccttgaaggaggtgtcaccgtccccacactctcgctttcgtgcccctcacccagcgctcctctccactccacttgatcttagccaaaaggccgagaagcgatgctgctctccactcctcagcacgtcaccaatatgcatcctgctgctaaatccaatggtcactttccagtccatttcctccctggcctttagcatcatctggtcctgtagaccattcttacctgcagacagtctcctccttggcttccaaggtggcccactccactgacttttctctgttctcactgcctctcctttcccttcccttgaacggcctcctttccctcggcatgacctttccatgtttttgctccttggggccctcatctcttcccgctctgtgcactctttccaggtgatttcactgactcccatggccttgttattctgctgccttgtaaaccatacccctctcttgaactgtaaacccatgcatccacttgctgactacatgtctacaactggatgtcccacgggaacctcacccttgccatattcagacagagcttcacagcttcctccacactcttgtgctcccagaaaatggtaccaccaggcatccaaaagtatatcccagaaacctcagagctatcctcaactcttctatctcccttgccttccaacacttcatcacactggatccaacgtgtcccatcaacccaccatggggactactccaacagcttcccagctgagctcctggccagtccaggacctcacatacctcagggtcagggctggggccagcaccctcctccaatcgactctccacactttgctaagccccaaatccttctgcgcttcccatcacctcttaagtgaaatccaaattcctcactgttgtccccaaggcctttcctggcctggactctgcctccttctcctgccttgatgctccccattcctctccttgcacactctgctgcagacagactcagcagccttcggtgtccccaacgcatggtgctttctttgcctctgggctttcccacatgctgtcatctctgcctggaactcttctccccacttgtacccacctaccccccttggttcacaggaggcatcacttctcctgggaagccttctttgtatcctaggaaatctggttaactgcccctcacaggcgctgccctggcatagtacttatcatgttataagaaactgtgtgtgtgacagtctaacttgccatcactgactctctgaagtcggcgcagtaccttttatacggtaggtcctcataaatacgtgaatgggtggaaacatacgaatgagtggatgggggatgggtgaacagatgagtgcatgccatgcatgcctcaggagtgcgtgccaaaggctgagtggcagggagcccagcagaagccacatgatgcgggcagccctcagaaacagactccttcccaccaggcttccacaagcctccgacaatcagggaagaacttagcacatccaaacccccaagactcacagcaacagccctcggcaggtggtcccacccagtgctgaggatcatggtggaaaagtgacagaaaaagagcggagacattgaaagtgggggagaaggcaggtgaacagacatgggacagaagaaacagggggcctggggtctctgacaggatgggatgagagagagctggtcgggggaccttgtggctaaagactgccaaccagggccctgactgtgtttccagcctgagctgtgcaggcggtgggagcagaaccaaccacccataataagcctctcattatgggcacacccccttggccctcctctaccccacctccaccacaggggattttagaagttctcccttcttcccaaataggcctagcagtgagactcaggagccctgaggaggggatgaaggaggcaactccactgctctcccggaatcccctccattccccaaccagacagacccaggaggagtcttagggcttcccctactgtgagctccccaagggcagaaatgatttctcttccttttccaagatgggaacacacagttgggcaagggatggggaggaatctcagtaacattatcttattgttaaatggatggatggacagatggatggatggatggatggatggatggatggatggatggatggacggacggacgggagactgttgccagaagaagaaaagactgccaaagataaaacaaaaaaagaattcactaaatcattaacattgatgatttctaagggtgggaatatatcgtgactctgagtttctccatttcacctttctacattttccaccttccccaaaacaggcagatgttacctttataatcagaaacattcatctacctttaaacaatggccagcgccctgtgctgtaaggggtcctctaacatgtgtcaggggaaagacacgatcctggtccccagatggctcctaagtggtcagcagaaatatgtggcaaagtcattgccgtgcccgggaggtcaggatgagaagatgttttggagatcaatgatgaaggtggagagagggtggttgtctgaagagcaggtgtaataggcaaaggaggacagcttaacatcacacgcatgtcagtccatgacacagacacgtgacacgcatgaggatgcctttcctgcctcccctcctcacaccttgataactgtctgaaagcacctattactccccctccacaccccctatctgtctagctcctctttaccattctctgaggcagagccactgtcaccaccttcaccatcccataccctagaaggagctgcctctctggtggtgggggagtgttttgtcccagggtgagcaggagtcctccctgcctgtgtcctggggctggcatcttagcctccccctgtaccctcagggttgaaatcacctcccacagccttcttgagccaggctgggtgctcagctcaggtctctggagggaaatatagccccacccactgcccaaccttcctgcccaacctcccctcactgttgttcttccctgaccccagggtctccccaccacaatagataaattgctgtcttcctcccacccccgcctggccactagggctctatttttaacccacctcaaaaactctgactcagaatcacagggctcccaggtaagctgctcccttgcctgcctagggctgcctcagacacagtccgatttagagccaagggcatctggggcttggtttacaggcgggttgtttggatttgggtgtacatttattttccaatttttctatgtttatcaatatttgaggaacaaagtttgtttcgttttgtttttcttaaaacccaatgatgaccctttacccctgcctcttctaaggtacctccccatcctgggctgaggtcctgcctgtcatgatgcaatgagagctggcctcagcctctccccaagaaggtgagctgtgtgagggcaacagctaacccagtcttctcttcttggcctgtgatccttcagccatacagcacggcgcccctcacacaggaatgtgcacacacatcacctggggactttctgagctgcagacctggtggacttcagtcggctgtggggtggggccaacatctgcactgttaacaagcacccaggtgatgctgagactgctggtgcagggaccacatttctgtgtggccaggctattgtagatgtacggtggctaggtgctctgctgtgaggccttgggcaaatcacttaacctctctgagcctgttttctaatgtgcaggatgagaacattaatccccacctcacaggagtctaggaagaccaaatgagataatatttacaatatgctatatggcataaatactcaattcaagtgggccattatccccatcatcatcatccccatcatcatcatcatcatcatcattctatggccattaagatgcaggtcctggcctgagagctaggaggatcctgagggacacaaatggtcccacctcaagaagccctcaatatagaggatggacagacccaccccacagcggagctgaaaatccaggccagctccatgggcagatggggccatgagccaagggaagggagtaagagggttgatgcagaatctctgactctgtatccctcaggctggggatggccagaggggaggagaaattcagccaggcttgctccagaaaggagcagggggcagcatgccctgttgggtactaaagcctcaaagaggatgcaggcgcccaagtaggtccgctggtcaggagacagcactgtggctagaggccaggggttacaggaaggaggcccatgctatgcgatggaaggtgtctgggtcaggggcctgagattctcaagttctagtcccgtccctgtctctaacttgctatgtgaccttgaataagtcccttcctctcactgtctcttcctcagtttccccattggcacaacacgaggatggagctagacatctctaaagatatgctgagttccatgaatctctgcagtgcagaggctaaagaggtcagccaagggcagctggccagattgacagctcactcacggaagaacgcgcacctcagggaaccctgacacctcagctcccagctctgaagagaatgtggaagacatcctgaacgccagcttgagaactcagggctcttccagggtacatgaggggctgggaaagttatagaggaagagaattccttgagaaagggactgcaaccgcaccttctcaacagcacagtgagaacaggcctgggcaaaagaaacactttgagatgaaaacccattgtttatctgatgggctaattcctcctctgcagaccctatgttgcatatgcagaaacacaccagtgaatatgtacatgcgcacacacacacacacacacaccgccaaactgcacagcaggggacatctgcttcacagtgctccaagttgcccagatgcatgttccctcaggccagggcctaacctctctgtgcttcacccagtggacaagaccactggggaagatgggggaggtaacaagcagttggagaacctctcagtcaagcttacaagaatcaaagaaggctccaacaccactcccccaggaaccttctgtcctcccactcaggagattggagcaaaaatagaacattgttgtggagtagcacgggagcacaccctctggggaaattaggtgggagagctcacctgctcacacaggaaggcactgccagcagcgggaggaaacaggcttgaggggcaacatgaagcactggaaatggatttggggcagaacgtctttgttttttgctttttttttttttttgagatagggtctcactctgtagcccaggctggagtgtggtggtgcaatcttggctcactgcagcctcgacctccctgggctcaagccacgctcctgcttgagtctctggagtggctgggactacaggcacacactaccatgcccagctaatttttctttcttttcttttctttttttttttttttttttgtagaggtagggtctctccatgttgcccaggctggtctttaactcctgggctcgagtgatcctcctgcctcagcctccaaaaatgctgggattacaggagtgagccacagtgcctgacccggggcagaacttcttaaggcaggcagcattggtcatagaaggggctaacaaggaggccataggaaggcttccctataaagagtagctaaatactgactctgcaagggtctacaccacccctttttgatgggatggagcttggggccaaacaacaaggattctctggggcatctggggacacagagctggagggaacgggctgccttctctccaggaaaacacagtctaacaaggaagatgagtggggccatgttctctgaggtcccttctggcctcagaattttatgattttgactcctcacaacccacaaggaaaaaaaaggtataaaagctccctggagagggaggcctattaccaatggggttggatattgtgctaagaaggcaggattttaccccaagctctggggagccaccgtaggactaaggcaaatgcagagcaatcagagaactgcaggctgttagtgcagatgggggcttggggatgcccagctcattggctcccaaagtgatggaggcagaatcacctgagtgcttcctgaaactctacctgcccggcctcacccagggagcccaaacatccatgatcacataagcacccagatgactcttcagcggctgccaattcaggctttgggatcttgctaacacccaacccctctctggtcccattttcagaggaggaaagcaagactcagagaggtgaggcctcagttaagtccacacagctgggcagcacagagccaagtcttctactggtaggattcacaggcttgtcccctagactctgtccccaggagctacagagcaacccaacaggatgatgatgccccagagcctctgggacacgttgaacggcttttcctgtttccttcctctgccaatcccagagtagatgatcccgctggcctgtcccacagggcccctccacccacagtcatctggtgtgccctgcagtctgcatgggtcctcacactctgagctcttctgaggccaggtctgagcttccaggaggggactgctccctaggaggggaggctgggaggagagcgtggttgaggccctttcccggatggcatttcagttcattttcattaagctcctgctgcatcacttcccgggaaggatgccccggaaacaaagaaaagaaagcctggcctccatccacggaggccatgacctaatggagggagggccttcaagaggcctcaccaatatgacacaacgtgccaggaagacccccagccccgctccccaggacaagggccgacaaagcctccacaaaacaaggcccctaggtaagagatcttccacgtgtccctggcccccagggactgcagaactctaggatcatgactggctggacctcggtgacagagccagaaagagggagggagattctcaaaagctctactggtcggcagcactgtccctgccctgctggctctatttgtgctaatggggtcaggattcagggctcaatacctatttggccaattagctctgctctcttcagcctcatactgaggcccgaccctggacactgagagaagagaggagcttgctgaggtcacccagcagaacaggatgagggtcaggaggggaagctgagggtgggagaggtgggcagttctgggcaggctggctcaagatagaggacccagggctctggggcgggccggcccccacactgcaggaagccaggccccaggggcagtctcccctgctggaccaagtttcttctaaaaggtgctaatggcatgaacgggacctgtggacctgagggtctttcctgtctttggggaaaggaacaagtgccctcacatcctctgaagatactggaggtgggagaagcccatggctgactttggcatacagtggctggggactcacattaatcattaacaggggctgctctagcctccaacggggaactgcagggtaattacttctgggctccaggccacacgctcagtgacattattgcaggcaacacctgccttctgggcctagtaaggcaggagaagcgagtcttctcaaaggctgtgcacctaggaccagggtgcacacatacacacaggcaaacacaccacacgtactcagatggcagcacaggcagcccgctcagagtcctcaagggtgaagggcagggactaaggagtacaggttaaaggaggcaggttctgaataagcagcccccagcacctgccaacacccaccccagccaggcggcccttagcttaagcttccaagaaagtgcacagagtggttctctctttccttcagatccagctcagagtcacttgctccaggatgccttccctgaccatcaatccatattgatctattgctcatctgccctcccataaaccagaagtggaaccctactctccattttgccacctccagcacccttaatagtgaaagcagtcttggaatgggtgatatggtattctggagggcatgactcccttagcttgcctctctccaagcccagaggataatgtattagccagcccccattatgtattaatttctgaaagcctcgttcacgcagacataacacatccacccacacagataaatgcttagacagacacaaaatcatcagcagccaattatcaggcccccgcagctgccgtgatcagacctggaggccccgctgcttgctctgcaatttgtggtagcccagagctgggggagcagtgggtggagggagtccccctatccagccggcacggctcgaggtccagccctgaccctgagggcacctgagcttgctgcctggctgagaacaccaaacaccagccccaaacgatgaagagagcagagttgggtggggagctgtcacgtgtgagatttggtggctctggcgtcggcagtggtggctctgttgtttatttataatttgtactttacctcccagagaggaccagaggcagctggctcagatactaagaggtgtaggagctcagggaacttagggagagcttcctaaaggggggcggggcacgaaggtagagtcctgagccttggtacctcagcaagggcaccgaaattggctcaaaggctttgcacaaggatgccagttcctgaccctagaccaaacccttcccttggccacagacttagccctgaccccagccacggactgaaccccaatcctggttacacactgagccccgaccattgtcagaagctgagttctagccatggtcacagaataagccctgattctggtcacacactgagtcctaaaccacagatcaaccccacttcttgacttttctgaagtctagcatgaatagatcacgtgaccatttctctggtggatcagagaaagataccactggacacttgccccttctcctctgaaccccaatcaccgccatccatgaacaggggcattaatggcacccggatatggtccccaaaccccaaaggtctctagcagtcaggacctgcccaggaagaggaggtgagctggcatcccagcccagcatcctcagaaacagcatccccagatctggggtcaggacagcatgtcccagccaccagactctgcatcttcagaaaggggaaggctcccttctcatgggagcagcctaattttgatgggatcctgaaaatatctatcatcccagaaagacaggtatgaagctagagtgacaagaaaaagctccaactgacaggaccattcaggaaaagccttccctgtgaaccctctggctgggaagctgggggtggacttaagcttgaaggcctttgcagacaagacgttacacaacccacttggtctctggtttcgcctctgacatactctgtgaccttgagccagctgctccccctctttgctcctctactccccatctatgaaacaaaggctccaggccagcggcttgctaaggcctctccagatctgatattccgacacctgatccattttctgtgcctgctgactatccctttctgagcccctcctcgacgttttaattctcaggagaatgttttcttgaactacttgtgtaattaaattttttaaacactaacataaaagaaggaggaatgtcaaattccagttctgatattcatggctgcatgatttgggggacctctctctctctctctctcctttcctcgtcggaggcttatctgtaagttggggatataaaactatttggaggccatcgtgaagaataaatgaaatgggagatatagagctcctagcacagcctggcacatggtaggtgctttgtaaatggtggttactgatctgtgaacccacctggctttagtctctgttgatttgagtctagggctataaaatccaaagcctacaggggtcaggcagctaaatggcatgaatgacgtggctgggtgtaagacagtggccttagcgacagctggggacctgcacaactgcagagcaaaagccaatgtaaaggaggcagcctctagtgtctccttcagctccccgctgtggagtgggaatgtggggccagggctgccagggtttccagtttttcaagagaagcccgagagccatattttcatgttgtatctttccatttaaaaacattggctcagatttgttatgacccactatgctggccaaacagagcacatctggatgctgtatttggtgcatgggatgctgcttggcaacctctgatcgaagtactgcccagtcttatcttgagcgcccacggtgacggggagctcaccacctctctgtgctgcctcccacctcagatccgagtgggtgctgatggtacagtgtctcccagtggcttcctagcccttgggactgcagacttctagggccctggcaatgcctcctcagtaaagaagcctagctggcagagaacatcctctccaaagccaacacaatgcccctgcccgcccatggccctctctgtctgggaaacgtgaattcttcagcatcccctgggcgaaagcaagactgtctggccggcctcagtagcccttctattaattagcaactggcagtcgcagctttgtaagagcccttgagccaagtgagtctgtgcaggagccggctgcctcctcggttctaagacaagcccccaggggactggggctggaccttctgctctgagtgaattcctccatggtggtcagtgttgtggcaggcacaagggccactcaggctgctatgacacttgtcagccccatcatttgtatgaaagctaatgcctttcagggtaggagggggcagggagaagtgacaagcaagcccagcccccaggggcggctgctggccatagcctggggcagggaagaaggatataagattgggaagaaggcctggatgcctctgtcctcctctcagctggcccctgtcagagccactggctcccctgctcagtcacctctgcgctcataccgacatctgctcctttccagaaatctcattgcaatgcagcagtcacagtactccctgcgccttctccccagccaggcccacccctctggccctttggatgggagaaaagctgcaaaagtggtgggacaggatggattaatgagggtcctctgaccacccagcttcttcctgttcacacccatcccaaaagccagcatgcgggaccagcagcgtccaagcagcagtgcaggaaaggaggaagagcaagctatgaatcccacatccccacactggcaggcagacctctgtgacttggctcagcccagttcacagacttcaccctgccacgctgagcttggggatagaggccacaggctctgaggccaaagagataaaacggagctctgccctcagggagctcagtttgggagcttgggctaagcatggaacaagcgcatgaacagtaacctcaatactccaagcatggtcctggtctggacaccagccacattagcaatctttgggcgcttaatgagaaatacagcatctcaggccccatccagacctactgaatcagaatctgtattgaacaagatcgccgggtgagtcggatgacattacagcaggacaagctgcattgtaacaaacacagagctccgtccaaatgccacaaggtggtcagccaggaagagatggatggtggccagggtggcctgagagagcatcccacaaggccctggggacactgggccctaaagcatgggagagaagggtggatggacagggagacaggtcagcacagttggaaactccctatgtgaggcaggcagctacctggcagcccaaaaccctcgaagctcacagcagctaagggaaccagtgtggcagggccaagcaggggagaaggtaacccccatccttaccatgtagccaccagaccaggaacttgagccttgcagcagggagaacctggagccgaggcctctctagccaggcagtatggggatcctggccctctgcccctatcgggtttttgtgcacccagcatcctggaagcacctcggtcctgagctccagcagcccctgccttgtcaggtgggacacatctcatccccagagagagccctgctgcccactgtgccagctgatagcacagcccaggcagctcaccttggaattcccctctgcaactaggcacccttccccctccaacacagcctgcggctcctttccgcctggctttgcacactgagagtcctaacaacattcctgggtaatggccccaggaaagcccagcaaagaaggggcctcggaacccccagacccagagtcaggctgctgcctcttcctccttgccacctcctgccagaacagtcctttccaggattcaaagtgagaaaggtgggagcgggtaggactgaggaaatagaaaagaaaccagtcccaagggagaacccctttcccccctcaggcatctaactctgagccctgtttttgtttccatcctgctggcaatgggaggcccaagccccagattgcagagggacccccactgccaggctccagagaaggtgagtgtctgcctctcaccaggcccaggctctcttctgggatggcctagagaggggttcacaaccttgagctcccagatggtcctcaacttagggggccacagacaccagaaattaagtgccacactctatgtgtctggacacccaggtatccttctggatggagtaaaatgtctgaccccaagaaggttcacaacccctgcttgagccaaggacagaggcccttgtgatcttcccaaaaccaaggaaaggaagttgtgaggacaggggaggtgtggttcacaacagcatcacggctcctctgacagctcactgcagcttctcacctcggcagggcgaccacagttgtacaatttgtgcttgacatggcaacaggcaacaagattcccattttctaaatgggaaaactggggctcaaataaggctcataacccacacagggctccacagcagtcagggttggggaggtgatgggaggtgagtaatggcagtgacggggtgccagtgaccagcagcaggaagtcggctcaggacacccctgggacctgctaggccactggcccagtttccaagattttggagcccagctctttctgccccaaggaaaggacactttaagcacccccgtcttcccttcctcatggcttcaggaggctcagtctaggagagggtagggacagggggatgagaaaggccaagcttctgcctgcctccattattaaggctgagccagctttgggggcgcagcagcaatcccagaactgacgttccacacagggacttccccaccagcttccacatccacccacacagcccccagacacccactcagacagacacctagatacacacacccaggctgactccctgagcctgaccagcttccaggaacacaaccagctacatctgcacttggggttccatttcctttctctcctcttagaaaaacaagattagccagtacctatgttttttgttgttgttgttgttccaggttctccaggacacagcttgtgtggaaggaaggacccatccaggacccaagagcccagccagcctcggggaggagcccggggagctatgtcctgaggggctgcagcatcctggcctcttcccttaacacaccacaaatacaagtttcaaaaggcagatggggagttggaggggaggggaagccagaaaagcccagggagcctggggaagccatggcggtggccagggcatggtttcttttctattggggggtgggatcgggggcaggtagagtaatgagaagcagaggtagcccagaaaagcctatgattagccatggcccaggttatgctggtccctcaaagcacagcccacccttgccctggaaaaggcacccagccttcctcccccagcaatgggagatgctggaagcagcccatcacagccagccctgaactccaaaccgcaaactcaatctatcattgtttgctggcaattctttattaaaccagttctgctggatcaatgcttcctgcccgtcaaaatgatgaataaatcctcgactagcctgagcaatgcttgcagaagctcttgcgaagcctgaggtgggcaatggcgattggctacacatagaggcccaaggccaatggctaaaactctagagaccaaggctgggggtgctggtcggggtgcggtgggttaggtggggttgggtggtgggttttcgaagcttagaagaattagctaggctcttgcctgtttgacattctaaggatgacactagctgttttggcctagaagcaggaaaggtatggccaccgctcctccagacacactcagatggtctttcttggatttctttccttacaccccacccagctccagacagctacaaggctgtgcaaagaggacgtgccacttgcagctaccagtccctgttgcttgttgcacaaacccaaattcaaagcccactctgacccttttcctgttgcccatttcacaattctgctgtatccccgcttccctatccccacaccctctcctgcagccatgtcccaggcagcctgcagttagtgggagattctgcagcagggggactgcagacagacataccagaatggggtaagaccaggaaggggaaaaggatcctatctgatgaaatcaacccagtcctcactctccaacttctaaggtaagggagataggaagggccaggcccagcatccagaaggtccccggccaatgcttgctgctgagggaggctgggcatgcctggggttggcctcttgtaggctccccaggcaatgggcttggtgatgagaaccctgaacagatgctttctgacaacaaaaacagcagggacctgggcaagggaggggagggcccttcagcaatctcgaggggttggtactggaactgcctatcaccaccactgaagagttgagagacaggaggaaaaacccaggacacccatgggggtggaggagacatagcccctgctcactcctctctagctcggcccaggatcctcagggcccagtactggccagaggcaagcccactcttcaggaacctggcactgggaacccagacaccgttcctgatgggagggtcccacatttgctcacacaatttgatgactatggctgtctgtttagcctgccctctggtctccctagtcttctgggaatgggaaccctggagatattagggttaggaagagcagtctgtcaaaggaaaaaaggggggaggggctctgttcactacctattttaagccaccgagtgttgtctgactggtcattcccagtgcgagaaatctctctcattggatggaaaatggctttgctctcattacaaacccagcttccctggagtttgcaaagagggctctgggttggcaaaatgctcatttttataggcaggcaactaaggtaggcaaggaagggagataagtaggcggcagggcccagagaaagagagaatgagagaattaaacccagcttgaaaagtgtttcccagaccttcatcacaatctcatgcatcacgaaagcccagaggggcactagggaaccttaggaccttgacttaggtaaaggcatccctgatcccaaccctagaaacaaccaacaatccctctttttgcacaaatatgcccacaagctcccagtggtatctgctgttcagtggcatccgactcaagtgatgtggaagggggcagggtccctctccctgactggcagtcataccttgtttggggacccacgagtggcccatgagagaccaagcagatgctggagcttgggtctctggggtatggatgggccactggacaagcatgggacacaggacagctgctcatcagtcagaacaccaggcatcttcacccatcactatgagcaaggtcattcagccctgccgctctggatgccagctgcccagggtgcctgctcttggcccaccactcagcatgaggagctgagctcagggttacggtgggtgcagggggttttcatcccggcctgaggccccagtgacttcggtcctccagggacccggccgcagcttcccagggcaccagaaagcagacataaatgcctgctgtcagcacccaaggagctggcccgttgctaagaggtctgtctctcttcacggccctgctctgcaggctgaatgacccggagctgcctctaggatggccatcctgactctgcagccttgaagggggaggaggaatatgtggcttaaggtggcagagccctatcctggctgccggcaggggtaggccaggctcagaacaccttttcattctgtctccaatgcagcccagacccgagaagaccagtgactgaacccagaggaaagttcccccagcgcggtgcaggagggggcctgggggtgtctcggagcctagaggcgccctgcctctcttggagctcccagcgcaaggcaggaaagttaactccggctgggaggcagggtcaggaggaggcatgcctgccaccgcgcagggcacccacaggatcatcgctgtggccccttacctgaagtcactgtaggggtggataatccaaaatccggccgacttgaccctctcctgttcgcgctccacggctttctggctgccgaacatccttagggagaatttgttgaccccgggttggagcatggccccgaactggcgctgcatgaagccggcctggcccaggcgcacctcggcctccgggaggatctggtcgccggcagccgcgcctccctccactttgatagcggtgtccaccgagggctgctcgcaggaggcggaggccggctgcggtggctgctggggcggcggcggcgaggctgcgggctgcgccgaggcgccggggcgctcgggctcggccgccaggcctgggggcgtcctgtcctcgccgggggacgcgtcgccctcggcgatgagccgccgctcctccgcggagtcatgcaggtgtccgtgactgctgccgctccccgtgccgccgctgccgccgccccggctgcccagcgaggccaggctcccgcggaagcgcctgcagtcgccgttcgtgctggacttgcccgcgccgcgggccggcccttcgctgtccgctgccccgagggccgagctccgggactccgtgccacccgcggccgccgagggggagggcgagggcagtggccgcagccggatgctcctgcggctggggtcttggcggcccccggccccctcctcctcggcgtcctcttcctcgtccatgatccacgccttggcccccacctgctgcgggaggctgtagagccgcttgcgcatggacggcggcagcttgtccatggcgccaggggccggggtcggaccgggccgggggcaggagcgcggcgccgcggacgggctccaggtccgcccgccggtcagtccgcccgtggggacgcgtcctttgccgccggcgtgggggcagcctcaggcgcccatgcttgggcaggctgcgcgccgcggggaggatcctagtcccgctccgagtccccgggctcgccgcgctacacctcctcccgggcccggctgggcgcggggaccccgcgctcccttcttgcctccctccctccctctggcgttcaggggcgcggcgcgccgcccggctccaggcgccccgcccccgcggggaacaatgggcgccggccggagaggctctgcggccgcggcgctcagggaaccgctccggagtgcagagcgcacggcccgcgcgggtcccgggcgtgcgtcccgcgggagggctggctgtccgtctgtctcgccgcccgggctttgtggctggccacccgcgagctcgcctcgcctcctctgccccggcccgtccggcccgtcccggggctcccgccgcaaccgagcggagcccagcgacccgccgggcttacatcagcggccgcctcccccgaagcgccctccggcagcgctcgggctcccgcgccccggaatattcatgaagccgccgcagctcgcgggttgccataggagcggctccagcagccgggcctgcctacctgggcttcttaaaggggcagcggcgcacgggccgggggctggaaaggggcggggggcgggcctggcaaggggcccaggttagaccctcgctagaccttcggggccggggtgagaggtatccacactgctgcgcccttaaatctctttcctgggctaagctgggagtgcgccccaagtctgaagctccggcttcagttgcgaattccccatcctaagattgaagggtggggggtggcttcccaatttctccatcaccaagctctgggctcgcctttccctggcatttttg

SEQ ID NO: 970 - DNA, 11677 bp, Homo sapiens
cttagcatttttaaattttattatgacttcatttgtttaaatatatatatatatatatatatatatatatttatttatagctctatgtgcccaccgcccccggccccctccccggcccctagtttttccccctggctttctgtctagtggctgtgtagggcagaaccgtctgcgtgctcttgtctgacactgtctgggtgctgctgttcctcgtgacccttcgagtctgttcaggggccaaggtagagcctgagtggcggctggtcagtggagagcgccgtgacttgtagggggctggggagggcttgtgggggcctgcatgggcctctgtatgggcaggctcagggggcaagcccacttcttcctcctccacctcctgctcaccgtccccctcctcatcgtcacagcacagagcatggtagagcactttgtcactgaaccgcaccctctcccgtgtccctggggtccgctggggcagctggctcttcaccgtggggccagcaccaaaggcctcctcactggaggagtctggggtctccactcgtggcccattggggatgggcgtgccaccattcatgaggcggtagtcagggccagcccctggccgagtcgactcgggaccatccacggagtccgagggggtagagacgtccaggaaggagcagaactcccagctgtctgagaggatatcggctgtcatgaagtccaggtggcccaggtcaaaggggccacccatgcccgccttgtcactgctagaggtgctgctcacagtggccgtggtccagtcgtccggctccagttcaaagtcgaagtccgaggttagcttatcgatctggctcaccacctgaccagggaaggggagaggagatgagaggggccaggtgggtccctgcatcagccaggtgtgagtgtgtctccaccccatccctgtagacccctggctgatgagcgtactggacaggggagagcctgtaggatggtgactggcctggaggtcacaggttggtttgccctgtggagggcccaaatcagatcaggctggacagagcttgttccggcccttcccaaaggtctgtttaccactgttcagtgccctgggggagagggaactgctttccagccctgcacaccatccattcactcacccctgtctctcaaacacagcagctgctctgggggcagccctggtgatcagggatgaatcttccttagtttgagagggggccacttcagaggggctgagggcctccagcaagcccattccacaaagagctgagcagcccatgcaccctcagagaggaaatgatgtgggtgatcacaaggaagaccctgtgtgggctttctaaagcatcctggaccagtccttgcagctgactggtgactgtcgcccctgggtctccaccatccctcacggcaagaacaccaggtgtacagcactggctgggtcaccccacccccatctccatctcccggagcctcctcattccttccccttccctgcccactgacaagtggagatcaatcctggcttgttgagagaaggaataaagcaagcattatttgataagcaataaagaagccatctattctgggcccagagctgcttgttcaatgcactcagggggcagctcagctgtggaggtcactccaccctggcctgcctcgcataaagtgaagcccttggcttctatacagaaggccctggcttgggacactcccttgcctgggtggccactgtcagcacataaatcagggaggaagacagtgagggaaagagggagatccagtcagagacacagggatgggacagggcaagagaagggagagagaagattccaaccaaaaacaaaacagaaaaacaatgaaaacaaagcagcgaggccaagagtcagagtaacagagaccaagagatccacagtgagtcatccagatcagaatccagcccccagcacctctctggcgcccttcaacctggggtcagagcaggcaattaattaattaactcattaagtccttaattcaacaaacagttgctaagggctgctgctgtccagggatgtgctagtatttggcaaggagtgggggtagtgagtgccccaaagtgagaggaaagcaaggacaaaagtgatggccagagtggcttgggccagtgggaagactacttgatcaggagtcaggggctggatgcaggagacctggtcaaccatttttcctctgtaggtctcagttgcccagtctgtaagcgaagagggtgggtgaactagtttatttccaaggttccttccatgtctgagattctaggactctgtttataggaatgactctgagaggctgcttgggtgctgatgcctagggatggcccctcaaccattgcccaggccaggagtggggaaaccacttggctgaggcctccagaagagctggaggaatcaggacatctggattccagacttagctttgacattgttctgtgtgtcttttggaagatcacagaacctctctggacctcaacctcattcacctccaagtgggtatgacaatcccagaccaccaagtgagtatgacaatcccagccaaccttatgagagcttcatgaaggacagtgagaagggcagcaaaaggactctgcaaagcactggggatgaaaatgacaccacctcccatctctgagcacctaccatgcaccatgctttcgagtgctcacctccacccatgagatcattatctcctgtgtctacagatgaggagtcttgggcactagtccctggaaagctgagaatctccccctgcggccccctgcaaaactgcacaccatcatgaagtgctgctgtgactgctgggcttgggcaggcggcagggatagggccctaccctccaatctggctacttcttcttgtgcttctcccaggatgatgccttcctgccccaaaggaacctcagagaaactcctatctcccagaagcccttgctcaacccaagctccacccaagggctggtgggagcactggcctagcgtagggacactcagacttgagtgtccctcagctcactccccagagtttctggttctgctggtctggggtggtgctggagaaggtgcctacctagtgtgcctccaggtgctgttgctgctggtccagagacctgctttgaaaaccactagcctagggcactgggagatttaagctgggtgaagaccagcaattcaaggcattgatggcctcaggagaggcccaccacctctggggcagctatgccctcaaatgagactcccctgatcaagccagagctgtggagtttgctgctgcctgagggcggggcagaatgccagtaggaattggagttgcatgacttggctgtgacctcacagggtcagctgaggccaggctgggcccagaagctgggtctcctgatgcttagtgaggacaagcaccattgggcctcaggcagggaagatccagggtacacatggcaggagcccaagccttcaggctggaacactcccccaacccaagaagcccttcctcttctttattagtacactcctctctggttccaacctggggggatggaggaaagagaaagagggaggcctgcattcccgagtcccacgtctgccacctcttggctgagagaccttaggcagatgattatccccctctggggcttgatttcctgtcctataaaaggaagtaacactcccctcctcacccagggtgatgaaaatttaacagatatgggccgggtgtggtggctcatgcctgtaatcccagcactttgggaggccgaggcgggcagatcatgaggtcaggagattgagaccatcctggccaacatggtgaaatcccgtctctactaaaaaataaaaataaattaaaaaaattagctgggcgtggtggtgcgtgcatagagtcccagctactcgggaggctgaggcagaggaatctcttgaacccaggaggcggagattgcagtgagccgagatcgcgccactgcactccagcctggcaacagagagagactctgtctcaaaaaaaaaaaaaaaaaaaaaaaaaaaaaagaaagaaaaagaaaatttaacagatatgaatgtgtcacagagtcaagatagctaaatacttaagaacctgggctctggagccagacatggagtcctaccctggcttcactgcttaccagctgtgtgaccttggccaagttactcaacgtctctgtgcctaagttcatcatcaaaggagaattctagtaatacctacttgatagggctgttgtgaggatttaatggcttaatgcgctttggacagcatatggaacaaggcagactaccaacatctacaatgcaccgttgggggctaacatgtgatcatgcccccgcaccaggcctaagagcagtgggaattagttctgcaccaaaggaatgaccctctgatgtgggtccagtgactgtggcagaatttccagtgcctgtggcagaataatgggacatgccaggcctttcaaaacctagcacatggacagtacctattttgcccaaagttagggctgtctccagaaagaacagaaccagaagaagttctaaaaaccaactggctatgaggcccacaggcaaatctggcccaacctattaggtgagacaggtcacaccacttgatgaatgacatagtgaggatgtgaaagggaagccatgtgcccaagggtatgcagcttctctgtggggggcctgggtcagttcacaatccccactgctcttccctggtgcctcgtttcctgggccaatggtgagggcaggtgtggagcagaccccagtcttgtcttgctctctgctttggatgtcttgaaatctgtgatttttccctgaggtttaataatcattttgcctacatgtaatttgggattgtcttggagtgcatggaaataattatatacacagaaggaaagagagggggagagagagagtggagagagaaattgaaccataaaattacagaatcagacaacccccaagccagaagggactgcaggcactgttgagtccacctgtctcaatgtgtttgccgaggggggcaatgaggctcagagactgggaggagctgagctgggaccagagggtgagtcttgactcctgggcattgcaccttaagaccaagaatgacttgctctgaagagaccaagagggagccctagagagcaagggcaggactgagggctgtggcagaacctgcaaacctcgtgccagaggtgtccccaacctctgtcctggtcacagccttagcgcccctcgctgaaaaactgcacccatctagtctttccaccgatagcaacttcctcccagctcttgcttcatgctgcacctagggaactttcttatcagccaacaggtccacgttgcccctgtgcttccagcccttccatactccccaaactcctaagcctcccaaacataactccctacccaccccctttcctctccagcaagcagcctccaccctgccaggcctgcctcctcaccacccctacacactcacactccatcgagctcacttctgcctctgggcctcacctgacacgccctccctcctttcctactcactccgtcttcacttcgagaaggaagccttccctgatccccagctgaggtcaggttccctatgaaaggctctcaaagcaccctgcacctctcctgaaaatgttacacaatatttaacactgctacaattttgcacctatatgttataacgtggttgatgtctgtctccccactacacagtaaaccccatgaggagcaggactaggtctcttgctcaccgctacatccccagctcggcacagggatcggcacattctgcaaacacagctgttggatgagtgatgagttgagacagatggcttaataaaaactactcgggaggctgaggcaggagaatggtgtgaacccaggaggcagagcttgcagtgagccgagatcacaccactgcactccagcctgggcgacagagcgagactccgtctcaaaaaacaaaacaaaacaaaacaaaacaaaaaaactgctgggggcttcttttctgaggaagagttccatagacctggacaatcctatattgccagacgccaaccctctctccagccctggctgagccccctctccagtggaagctttgctgtgttccttaaggccttagagctaggactgaggacctgtagtcccagaaccagcatcctgtacccccggaccccccaccacaccccccaccctgccccacctcacctcccctgacaagctgccacctccttccctctctcccagctccccaaggcagctggttacataactggggattctgcattatttatgaccactgattattttttaattctgtgattacgttattatcttcttggggggctgtggagttggaggggcagcgagctgatcgtgattcatggctctcatcctgcaatttggcctaattggccagggagctttggtaaatctgtccggaggaggagaaggcaaagggaaaagggaggaaaggaaggcgtgaacaaaaataataagaaaaaaatccacgcaattcttgctgagctgcaggtgatggagctgacccactttggcgcagctccgtggtccccagcctctcctgctccagctgcttcctggctgggccccatttatctcacacttgcatggcctatggctttccctgccaccttcagacaaagccccttgccgatgggactgcacaatggaatggccaggaaacagaatgccaggatgactgcttcctaggcaaatccggtgggggatcctccactgccacccaaggctggggaaacgttgtgccaacccctccatcttcctgaggtgtttgggccaaagtgagcaactgtgcccttaagttatatcccacccaagagtcaccgatgatgtgggagacactggtgttaatgcaaggatcactattgagcccccatgttgagtgacgcctgggggagggggaaaccaaggatgaggaggccaagtacctgctcaaggtaagctcaatacctgggggccaaggacaggggcccttaaccctgcctttgggagcttctggtgggtgggtaacaggggagcagtggggaggcagattcccacccagaaacatgaccagcagattcctggagagtgtgtgggattctcactgagaacgaatccaaattccgtgcatgctgtgcatggctcgacggaatctgactccctgctccctctttgacctttcctctactcttctccttgttcactgccctccagctgctctggcttccttagctgaacctgcatatgccaagcacacttcctcttcgagaccttggcaccggctgcaccctcagccgggaatgctcttcccctagatagccatgtgacttgtatcctcacttctgtggggtctctgttcaaaggccaccttattggagacccccttcctgcccccatccctgtcactctctatctgcttttcccactggcagggagtgagactgctgactgcaggagaaactaaagggccccagccaggaggccaggatgtggtcctgacctccctggtcatggctaagaaactgatgtgattccagaaaacaaggccgtacgtggagctgaggagcaggccagttttagaataattcattaaaaacatcaaacagatacggagtgagctttgtgcctctcattgtgctaagtgctttatatatgtctcatttaattctcgcaacaaccctggggcaggggtaggggaggatgcctaaaatgtagtctccccatttttaccaatgggaaaacagaagcacagagaggtaaagtaactttcgcaagttcacacagctaaggagagggtggagctcagatttgaactacaggcatctagctgcagagcccatgctcatagcccctgagctgttctgcatctcttacttaagatctacagaactttgaggagcttagagaacctgctgggactggcccggtatcctggagtactggggagcctgggagagataagggctaattaacgattgaccgtcatatccctctgcagcacaattttagctttcaaagcacttttacatcctcacctcacttaatcctttaaaagactttccccaccaatgggatagaacttgctcatcgcccagggagccagtggcagagctatagtaggggtttgcgagggcgagggaggtgtgggagagggaacttcaactcttctaggagtgtgagtaggtgttgatccccgcgcccccagcccactgcatgccaagcccctaataaatccttataagatcaccgtgcagtgcaaatcaccacatcccaatttcagagatgagcaaactgaggctgagggacctggggaggaagtgctttggtgtggctcatctttcagtgaatttcaggccatatgctcgagaggatgaggagagtctgccatgatcagtggcatcagggggctggggaaggggagcagcaggcagaggaggaagatggctgaggggaataaagctaagcccttccactccgctggccttgttctttcaccaagcatatgtgcagccccccacccccaacagtcttgtatgtgactctcatctccacttctaagtgcttggcctgagacaagaacacagctggtgggctctaagctggtgctgcccaggtcatggggtgaggtgagggaacaagtgagtgcctctcaaccttgagcctacccatgcccccgataaaaaaatgctacacaaagggactgaggagagccaggcagattcagctttacagctcccttggagagccaagagccaagaccacaggttccagagagcagggagattccaacccttttctccaaaccggggtctggcacccccccttggtaaccccatccctggcaaatcccatctcacaggaagacggtgatggcatctcttcttttgcttgggcctcccagagcttcacctgccttcctccacactcccctctgcctgtcaccctgtgtctagaccctgcctgggggacgagagagttctgaggcttacccactcccccagctgggtgccattggcagcgggcaggcagtggcatacggggtaggctctggttgccgtagcaacctgccaaagtcttgggtggaggcacatggcctacagggtgtgtggggggaggggactcattttctctgtcctggctgaggcctctgggctgcatagcctgtgaacctggagctctgctattggagacatgggagtgggtgagtgtgaaagggaaggagagggcatctaaacgatctgcaaataaatcctagagctattgcatcacagatgagcataagagatcatctctggaaggcccctgtcaaaatgcaaagagatcgcccagtagctcacctgctgaaaccccagaaaaggcatcaggaacccgagttctaggcatacttctgccactggtaggctgtgtaaccttggacaagcccctattgctctctgggcctcagtttcttcaatagtaaatggacagagctggtctggattacctatgagatcctttgaagctctgggtggctatgcggtggggagagggaacacagatgcctggaagatgcccaactgggaaaaggctgggagttgtatcagagttgactcccaggcctagagtcaatcctggctctttgtgggtacctgccggggcataggtctcatgtccctggccaagactgagactttggacagttcccatggccctgatctaaaataagatggaggcagggggaaaactgtagtgccttggacccaagagtttggaggaggaagcgttccgcaggggcatctggcgcttgatctccaaattgtactgtccaaagatgtgcaacccagactatggccggcccagtccatgggcagaagcaccaccacctcagtctgcctgaagcaacagtcattctcatcttctgagatgggatttcctggtaggctccacgaggctgaccctggacagctcttgtcctggcatctctatgcccactccctatcccattctgaacacagtgcccttcaaacaacccctcctccttggctctcaggccaggctgcaatgccactttgccagcctggagttggtacctaccatcaccccacctcttcagccttcctagagcccctatcctccctgcacagctggccagggagagcttgagcccataactccaattcaatcactctccctgccatctctgcaggggccctgattacaaggagttgaaatttgcctaaagcccacctggctggtataatggcacccagtgggcaaattcaggctagcagctcagaacgctggtcatgcattttggactcgaacgcagcacagggggcagggctgaagacatgtgtacctcattaccctagcgatgtgagaagcagtaattaaaccaggctccacttagaaagacagagagggacacacacatcccagcatttctcagtggcttttcagccttggcaaaaatatttagaacagtgggatggagactcgcatccccttagggaagactcctgcccctgccaaaatatgcaaggaactctgttatccactacagcacccccagacccattcttacccccggacaaagaggacatagctggcttaaatttttccaagatcaagggttctcagtatctgtgtgatttctagggatatgctttgagctgggcctcaagcagtggaaaccacctcagcacaactatctgcactctcccagggtcccttgtgaccagatcagagtctgggagacagatggtgggttcaagggtcagcttgggtcccagaaggttgtcttccactaagaagctgtggcgggattcagtccttactggccatcttggcagccctttgtgctaacccagagctccaggcccactgacatgctgctcaagtaacctctacaacaccgaggcccctccagccttggggtctgatgagatttttagcaaagcagatttgcggaaaggagagcaaggagaaagaaggtccccagtagagtgacacatgtgcacgcagctttgcacactccaacgtatttatgagtacgtttttgtgccaaacccaagaaggttggcttagggtctgtctggtccctcctcacccctcacttacctccctcagctccttggccacctccttgagctcgcgaaggatgccctcaagctgcccgatgaccatcttcatgcgctgtcgaatccgctcccgctcaccaccactgctggggtcgtcactgggctgcccgaggtccggggcgccccgaatgttcatcgtttaccacgtggccgcaggcctgcccatactccccccagctgggcacacactgcgtctgcctccacggagcccccctcggctgggcagagctccacattttaacggccccccagcccaccctggccctgggcggccctcaaccagcccctgccccctgccacccagcctcctctgcctctgggtggagagtgggacacccagagggagacagagtctagcagagggggtcaaggtgaggacacaggagaggagggggagggaccttgggtcccaggagtggcctccaggtcttgaagtgcctgtgggtgtgcagagctgatctctgcctgagcttgaacacag

SEQ ID NO: 971 - DNA, 21116 bp, Homo sapiens
tccgggccgcgcttcctctcgccaggcctgcgagcttcctcccagcggagccctgggcgagccgaggttggccgccgccgccgccgagcccgctgccgccctcccgctcctgccccacccgcgccttgcccgggggcttctgccggggtggggtccgagccgggcgaccgcccggctgcgccgccgtcggggccgtaacccggcccgccgtccctcccgccccagccagcctctggccgccggagcccgcggggcgtggagcgcgaggagccccgcggccccgatcgagcgtccggggcggcccccggcagccagcgcgacgttccaaaatcgaacctcagtggcggcgctcggaagcggaactctgccggggccgcgccggctacattgtttcctccccccgactccctcccgcccccttcccccgcctttcttccctccgcgacccgggccgtgcgtccgtccccctgcctctgcctggcggtccctcctcccctctccttgcacccatacctctttgtaccgcaccccctggggacccctgcgcccctcccctcccccctgaccgcatggaccgtcccgcaggccgctgatgccgcccgcggcgaggtggcccggaccgcagtgccccaagagaggtgagtgcctggccgtcccggagtgtcccctggagggaagagggtggaggtcgcgcgtctagtctctgttgctgccactgtcgcgtccactcccattcccctcttctcccacttctcccttctctcctttactcccttgcacgggttcgaattctcccaggagccactgtcagaacccaaattggaagggagtgcatgagggaggtactgccctgcagctccacggactcgtcttctcgggtcatcccgagtccccccctctgtggagctcagagtaggaggtggctggagtctggaggaagaggatccgtatgggccaggtccctagagagagtgctggactcccctgcccttccctgtacagggcctccccgcaggtgccctggcttgcttggttctgacccctccctcattaccccaccatgaccctgcgggctgcaagcaagcccagggcccagccacctcgggtgagcagttagaagcccaggtcctaggactgagcctgtcacccttggcctctcagaagaccaggcctaagccaagggatctttgggtgggaaactgggcaggccttctgcccggggggaggtaacggagcattagcaccatgcccccaccttctggcaccctgggcagcccattctcctaggctctttgtggcccagaccaggtgtcaggaaggggtgtgtccagccagcagattttttggagcttaactaccagttcacttccccgcccattttgtacacccgggaaccgaggctcaaagggagaagttgctaccccaggcctctagtggagttaggctggctgtcctttcatccccagctatacagggctggatggctgtgggtggaaggaaaccaggcaggcaccttcacccactggggacacaggcccccagcccggccccagagggaccttgttggttgagcacgtgcttccctgcagagggctggagggagtgaaagggcttccggctccagctgtggctgggtcagctagcaggagatgtggggaatgtgtggtgtatggccatctgtgtggtgtggcaggaaggtccggtcctggccccggctctgagttgaaacaacctggtggtcagtcctgacccagcactcgccacacctatggcccagctggcacaggagcagccaagttcaggatataaatggggtcacatgggaaccgtggaagctctgtctccactggcagcaggctacagactggggacatgggagcattgtgagagtggggacacccagggggcctgtttcaagctcctagtaccctggcggttccagtgtctttcttggttgtggccacagcaggaacagggcaaggacagcaggggtgaggttgaggcctggcaggatcctctggcccaggagagcaggcattgccctggtgggtgctgagcagtgtctgggctcccttggagctgctggcagttttgtcctgctgggtccctgctcacgatttagggtttttttgttttttcacttttttttctggctgtcctgacatgcacagtggaggggacccagatgtcctgggcctgtgagactcccctcacatggccccacacccagccctaacttcctttccagcctgagggactggggctggagcctgacatggttagctccctcccaccccagtcagcctttttaatttttattttattttattttatttttttaccaactgtgagctgtgaaggtgtgatccagggtcccagggcctttgaagaaaggagtctggcttctggctggcacgtgtgcagggatgtgcttttcattggtgagcttggtgccctccaccctctcagaagcagctgctcttctctctgcattgggtcaggggcaaggaaaaagcagaaaatgttcccattcaccaccgcaggggggccagaccccaaaaggctgagccacacagagtggccctcggcaagggttggaaatttcggggacagaatgcagcttcctccaaacaagtataggtaggggttgagacccaggatccacagtgtgacatggctgccccccaaagggggcagacccacctgggtgcggttctgggctccatcttttgaaggattttaaaaccttgacaggtcatcttcaaagagccagggatgttgactgagtctgggaaagagaaagtagggacagattctcatatgtctgagggactgtcccaaatgagaaaggcatcccatggcagaaattgtcccagacacgtgggccagagctagggagcaggtgggtcccagggaagtgaatctgagctcattatagggaaaccatgaatgtactcattttcttgatttagaaaataacaaaacagcgctacaggaaatttagaaaatgaaacaaaaatcacccactatttcttcagcaggcagtgactgtgttagcattttggagttcactgccagtcttttccccatccttttccttcattgtcgttgtcactggagtgtgtgtgccgtgacaccttttttcatttaatactgcgtctgtgggcattttctcatggtgctacgcggtctaagtaacgttgcttctaaaaagctacagaacattctaggctggcctgctgcagcgccatcacccatacactggagcgtgtgcatttttcccctctgttgctgttgtggttgtcgttactatgagtcccaaaagcagccagggtgttggagggcacaagcaacttggcacccaactgaatgtgggttccaggcccagacatgccacttaggcccagggtagagggaccttagacaggtcactgacctgctgagcctcgttgatataaataacaggatggtaacacctacttcagaggaaggtgtaaggacagtgtcaactaactaaccaagggactctaaagtgcctggcacagccctttcttcactccctctgtgagtaggattggcattgttgaaggagtgcccactgctggctgcctcaacctgtggggaaggtgcctgagccacgggccaatgttgactgaccactcacctggcaaagaggtggtctccgcctgaggagcccctgtgaaaccccctggccctgaggttctagaatactatggccagtgcccttgcctgccttcccttctccccattaccatatgattggctggcctaggacatggggctggccctgggaagatgggctgctggttagggtccgggacctgactccacccattccccttccggtctcccagcatcagagctaaatagacaaggcctcttctctctctctctctctcttttttttttttgtgtgtgtgtgtgtgtgtgtgtgtgtgtgagatggagttttgctcttgttgcccagtctggagtgcaatggcgcgatcttggctcaccacaacctccggctcccggtttaagcgattctcctgcctcagccttccaagttgggattagaggcatgtgccatcacgcctggctaattttgtatttttagtagcgatggggtttctccgtgttggtcaggctggtctcaaactcctgacctcaggtgatccacccacctcggcctcctgaagtgctgggattataggcgtgagccactgcgcctcttctgtaagagcctggctgcctcctgcctcccagctctggctaggtcagcccagcttggcattttcccagaggaaatagaggcctgcttagcctgagacttagacaaggaacccaggcatcctgagccccagcccaagaacagccatgccagcctcatcttcgcaccctgttccagtagccaaggaagggaaagaagctgggagattaagggtagggggattctggagcctcccagagcttcccaggagggagttggacacatcgggaaactcatgttagcctccccctcctcagcaggtgttccccaggtctaacctgagtgtgtatcactgtgacacacctgcttcctcttgttctacttttgtggagaccagggtaactgggagtgccctcctacagccaccccgtgggcagtagcaggacaccagtctcctcctggcaaccctgggcctaagagactgtagccccagatgaccctagggtggcccaggactaacctaaggaaggggtcctcccccaggtggcccattcagtgcagaggtcccttgggcacacgacttcagactccagctgccaaactttggcctgtggagtatctcctcctccctggtcttagtgtaagggaagtgggcatgacaactgccctcctgtcccacagcttgggatgggatgaggtcacagggtggggtccgccccaagatgctggcctggcctggctcagatgagagccctttgggtgtttctcagtttcccccgcccttggttggggacaggatgggtggaggagcaggccacccccaacgcccggcagggagcactgcctcccttccccctctcctctgggtcccttcatccaagggctggaaatagaatccgctaagtaatgattaaagtcaaattcagacctaaaaataaagagctggtgaaggaagagctggtgctccctgcatggctgaggggagaagtgagcagggagaggctggctttgggtggctgagcccctgctcctcgggatcagaagtactccaccagttgggggggtgctcttttatctgccatgatgtggcccattaagtgtagacggcaccactcagggcagactggcaggacccattagaaaaaaaatcccatttttcccatggggaaactgaggcccagaaaggagaagtggtttgtcaagcgactatttgagagctcccctcagcaggcccccagggactggagggccctgtgcagcccagcctgccctttctgcctgctcagtttctcttcctggttttgaggtgctaagatgaagtcagcttctcatcacacactagctgtgcacacaccctccaaccgcagcttccctccacccctccttctgtggtctgggcccagagtcgaaggaacaagtagaagagaggctgcttggtgcccccctggctgtcctgatcatggcatggttgtaagcctcgtgggcaggcgaaaacctgggcatcatctgccccccttggaccctggctgctgcttctcagcccagcctgacacctggtcctcatgcagactcgcgcatctatctatctgcagcttgtgctgtccgtgctgcagggagacaggagggaaggatgaagagcaaaccctgagagcgcctctgctggcgggtagaggagacgaggagtcagtgaggggaggcctgtggttctcacttcctggcagagctggtaggagctctgaagctggggctctgcgtgggctggggcagcctggagggcctcctggaggggaaggtcctgtgaaagttgagaagtgtttgaagaagaagcgtggtaggaggagaggtccttgtttgaagcttctgccctctctagggctgctggctcttttctgtgtgtccctcgacaggctcttggcctctctgagaggctggggtatgcagacaagcaagaagtgggcacagaagtacctctgcttcccagagcagaacagccaagctctgggcagacctcccctcggtgccccccacctgtccattttcagggtgtcgtctgtcctgcacaaggaaaggtgggaagaaaggtcccctaaccaaggttcagacaactctgagctcaagtacccacacagctagttcctcctctgtcagagatcaccagtccttgccctatggggtgtttgaaggattaagtaactaatgcagtgccccaaacccggttgggtcagtcagctgtaattcccgtgttctcattctgcagcccatcctgctggaggagtgtactggtaacacccccatctcccttaagtagtagcaagtctgtcctttgtgttgatccccacagctttaccttctgagctgtgtgttctgcagatcctggttctgaagtggggagaccagaaatctgggggccgaagttttagacagcttatgggcctccagccgtcagtctccccacctagaatgtggccaggagacttccgggtgagggacaagaacatgactttgaagggtccattgaaggctagtgctgagaggctatatgcaaatgcaggcaaatgaagatgcaaagaccacatcctgtgctaagggggtgggggagcagaggcctgggttagggccctggggaggcccagagtccccattgcccagcgcacataggtaattaggctcctgagcggtaattagaaacctttctgggccaggaatggcagcctcaagccgcagcggtgcctggggagtaggctccccattagcctgctctaaccccagcccccacctctcccaaaccactagacgggatttccggtcccactgaaccattgggggcaggggaaaaaaagccagtgtgttgctataatttggtatttatccattaaatccgcccttctccttaggtcagggtgctgacgggagccccgggatgggggtagggcagcgtgccctggagccagagcaggcattcttctgttccttcgtaaccgccccgggaggtgtaggcatctccaagaccctggcgcccaattctgctgctgctcaccctgagacacctgtgcagtgggggtgctgagggaccaccagcgcaggctgcgggggtcagtggaagccctcgggcacccttccttgcctgatgtgtggtggggaatgtcacagtgcctcagcctggtgtcctctgcagaaccagaggtggagctgattttattgctgccaaacttgcccaactgctggtgggtgccccgccctcctcaggtgcactgccctttggaggggcgggcccaaatctgaaacttaattctgcctgtatctgtactatgacctgtaggccctgctcggaggttccctgggcccccatcctgaaccttcttcagtcttcattaactcgctctgtaccacagtttgcagtcttaatcctggtttacttcaaggcgcccctctctcagtcactttcccctaaaatccttctagctcctgctcccctcacccatcttcctggaagccttcccgggtggcccctgtctcacaatctattgaggcactgaacataccaggccatggctgaccatccagtaaccaggaggacaggagccgggtctgcattttgtggtggttcccagcatccagccctggcttgtgcacagaggagaggtgtgtgagtggtgaccttgggtccccaaaggcaggacctcttgagtcctttccttctccacccggatatcctggcctaccaagcatggctctgggcacacaggaaggcttctaaaacactggctcaaagaatgagaaggcaaggtggaccttgctgttgcctgttttgcctccagtggctgtccccatcccccagagcatccagctaggtcctgtggcagcaccagaatctccgggggccagggccctgagttcccccaggtcttttgtgcacttcccttttcagtgggtatttttagctgggcgtaaacagttactgaaggctcccacgccccattaggcagcagagttttggcaagggggaagggcaagggagccccttgacctcccctggccctcagcacgtgcctggccttgggggtctacagctgcttccagggtaggaaaagggcagcctgggagtttctgggctcccagttctttctccccactccttgtcagcctgggctcacaagaaaggctgcctgaggctgcagccactgacctcagcgcttgggcacaatgccagcctgttcccgggaccccagcacaagggctgctgggagccgggtttagggcaggaagtcagagtgaagcactggtcctgccacatcccaagccccttgtcccctagccctgcgggaatggggtgacagctgctgtccctttggggttaactatagtcctattggttatgagacctcggtgtggtacagccagcctggcgtcccctttttttcattcgttcattcattcattcattcagcactcatttactgagcagccgctttgggcccagcccatgcagacgtgagtcagaccctcactttccccctgcagagctcccagtccaccctaaaccacaggccacaaccagtgaggttctcactggagcacggggatgtgtgagaggccttggaggcctcggcagccaacacagctggggacccaaggaattctccagagagaggtgatttacaaaaagtttcttatttccagttttaagggggaaggtaatagatgcatgtggctttaaaaaaataataataatttttttaaaagcccaaaaggacaaaatagcaaatgaacagtaaaaagtaagtttctcttgaacttgatctcactttcccttctcatcctagaggcaacctctgttaccagtttcctctgtctttccaaagataatcgaggcatatttgagtttagggaggtgttgcattaatacctctttaaaaacacaacttgtagtattccatagagaacctgcacctggctttttttttcacagccttttattttgagtatttgaaacctaccaaaaagttgaagtaatagtataatgaatattcatatatccttcatgcagatttgccagttcttaacattttgccacatttactctatctcttcttttatctacatagacatatgtgtgtatgtattttttgctgatttgagtgttagttgtaggcattgcatctttcaccctaagaactttagcgtgtatctcttatataatcacaatgtcatgatcacacttaagaaaattgacattaattccatattatctactatgtccatttcccctctccccaagtgatttttatagctgtccccccgaccaccccttgatatagaattcaattcaagatcatttattgaatcttgtcatgtttctctagtgtcctgttcaatctagaacattctccagccctttttttgttttgctcttttatgacattgacatgaagagtccgggccagttgttctggatttgtctgattgcttctccctggttggagtcaggtggaacagctctggcaggaacgcccccccgggcaatgcagagtcctcctccaggaggcacttagtgtccatgcgtcaccttgctggtgatgcttcactggatcacttggttccggggttgtccgcacgtctccctgtagtgcaggtgctccttcctgtttccaattagcctgtgggatgggacttggaagctgtgtctgttctgctcccctggcaactttttcttcaatgacttgagctggtgttttgccattttccatactctatcatggggagtgttcagtatcggcatctagagatctcccctggccccatcacagctagagctatgctgtcccctttcagggacatcttgtaatttatccacccagcccccaactgatggacataaaggctgtctccccatcatctcctgctactacagacagcactgcagggactgtcctgctgtgtttttttaaggcatgggtactccagaagcagttgctcagctgcacccccaaggttgagtggaagtccctcggtaaaggaggaggagagagtgtgaagggaatggcaaggcggggagggagacagggcacaggtgtcctggcaacagcagatgggaaacaggtctggctaaggtaccagaagccaacaagtcccagaaaggtcaagtgactttcccaaggtcacacagcaagttgatggcagagctgggtacaggactcagagcatctgacacccaggacgatgttcctgcactgttccatagagtagcccgactcttaagtttaaataaccccaggaaggaccccctctctgtgcctgacccccgctgggttgtagaggcctaagtttgcagtagctcctcccagccactctggctgtcagcctctgacctgcagtgggagggtctcaccttctggagatgttttaaggaggggaccccggcctaggcactagctgggaagccactgagccatcttgtctgcggccactgacgtcagtgcttgggcacaatgccagcctgttcccgggaccccagcacaagggctactgggagccgggtttggggcaggaagtcagcgtgaagcactggtcctgccacatcccaagccccttgtcccctagctctgtgggggtggggtgacagctgctatcgctttggggttaactatagtccctttggggttaactatagtcccattggttatgggacctcagtgtgatgtagccaggctggattcccccttttgtttgttcatttattcattcattcaggggtctcatgaccccaccagggaggagccgtccaagagagttagcagctcccacttgcaagatgtctgtggcaaggcaggcactgttctggtgctgagagctcaactccagtcctcacagcagcccccagagccaaggagtatcaccagtccattgcacagatggggaagctgggttctagagtcacagccagcagagtaaaggtgatgagtttagccctcttccctgtttccagaccctctgaggccttcagagcccagctccttgaggcagcccaccccgaccgctcctaggcttacccttccctgagcaccgcccctgtgcccctcatagctgcttctgcctcctccctcctccctcctctcccttgcccctaggctagtgtggtccccatggcaactcctggggcctgtccggcagggaggcacggggctatggggagggctggctcagcagctcaggagtttgacacctgagggggacagaatgctcactcaaggtgtggccctagggacccccgccttgcccctgtgggcctcacttggggttctcatctgcaaaatggggataataatagcttctctgtctcagagttgttagaggatgtgatgagccataacgtgccaaggacagggcctggcacagaataagtgctcagaaaacagggcctgttattatttttattattataatcaaggcagtggggaggcggcggtggcagtagctgtaggccaggaagggagtgtttgcaaactgacagctggaagggtgactaacagcgcagcagcctccgcgcccccctgtggtggcagggagtttggggaggaagggggaggcatggggatgtggaatgctagcagggcccctattcagaaggacctaaaggttgggggcccagccagccctagtgggaccctaattcaagctctgtcacccctaactagctatgtgacttcaggcaaattgttcaaccagttgagcctcagtttccgcttctgtgaaatgggggtaagagggttagaagagctcacaatcctccttccctccccgccacccccacccccacagcttacagtccacaggaggcaggggcaaggggtcctcaccacccccaccctcacagcttacagtccacaggaggcaggggcaaggggtccccgccacccccaccctcacagcttacagtccacaggaggcaggggcaaggggtccccgccacccccacccccacagcttacagtccacaggaggcaggggtaaggggtccccgccacccccacccccacagcttacagtccacaggaggcaggggcaaggggtccccgccacccccaccctcacagcttacagtccacaggaggcaggggcaagggatggttcctgtacttagtggtgactgagtcatgtggatggaggcaggtttcaggctcatcctccttgggcctcagtgtccctgcctaaacagcaggattgatggcctggcctctggggatagaaagggccctgtattctgggaggaacggaagctctttcatccaggggatggggcaggggcgcaccagacatttccaagttcagggtttcattccagcccctcctcagccagcttgcaggagatacctgtcctccccttcagggtaagcaagacttagaagggttgagtcactcaccccaagtcgcacagtcaacagagccaggtattaagcccaggcctgactatagagccaggtgtgcggcctggaagtgttggttctccctggccgtctcctccccagctccttctgctctccatgatcacatgcccccctgctgaggccccatcgcccttggagtcaaaccctggttcctcacattggcagtggaagtccccctgctgcctggcagagtttatgccaggcccacttgaaaccatcccctacagtgtcccctgagcagcggtgctcaaggtggactctggaagtgtgtggggtcctagagccccagatgggcagggtctgccttcccgcttccctcaccatcggcttccacctgggccagtttctcatactatgccagtcccctgcctgacacctttgctcagactgctgcatcaacctggggtgccttccctggcccgccctctgcctgtgtaagccctgcaatcttcagggctcagccccagagctccctcctccagggagcctgtctgagctctgcagtccgtgcctacttcacacccccagcactttgcactaaaatgtcttctcccgcgccactgcactccagcctgggcaacagagcaagactccgtcgcaataataacaataataataaaataaaatgtctccttccactggggtaggtagcaatatttgtgactgtcagcctagcccccagacctcatccactgtatcaaagagcccagcaaagaggctcatggaggagtttctcttctaacacactgtgaccacgaagatgccactggccctttctcaccctcagtttcctcacccgtagaaaggaaacagtagttccagcccctctgcttcctgagacaggtccaagggggctctgggctgggattacaaagtatgtgtgtgcagacgggtgggttgctgctctcagggaatggggttggctagggtagcttttttggggagtcaactttattgaagtaaatatacggttgacccttgaacaacacaggggttgagggcatcaacctcctccctgcagtcaaaaaatcatatattaacttttgactcctcaaaaacttaactactaatagcctattgttgtcagaaagccttgtagataaagttgattgacactcattttgtttgttatatatattatatactgtattcttacaataaagtaagctagtgaaaataaaataagaaaatcatatggccgggtgcagtggctcacacctgtaatctcagcacattgggaggctggggcaggcggatcacttgaggccaggagttcaagaccagcatggccaatatggtgaaaccctgtatctactaaaaatacaaaaattggtctgctgtgttggcgcacgcctatgatcccagctactcaggtggtcaaggcatgagaatcacttgaacctgggaggcggaggtagttgcagtaagccgtgagtcaccccaccactgcgttccagcctgggcgacagagtcttgctgtctcaaaaaaaaaaagaaagaaaatcataaggaagaggaaatatatctactattctttaagtcgaaggggatcattatgaaggtcttcatccttcacattgagtaggctgaggaggaagaggaagagttggtcttgccgtcacagaggtggcagaggtggaggcggaggaggtggaaaggaaggcagaaaaggcaggcacactcagtgtaacttactgaaaaacatccagccacgtgtggtggcgcatgcctgtggtaatcgctacttaggaggctgaggcaggaggattggctgaacccaggggtttgaggctgctgtgagctatgatcacgtcactgcactcctgcctgggcaacagagtgagaccctttctcaaaaaaaaaaaaaaaagaaaagaaaaagaaaaaatccatgtgtaactggacctgcgcagttcagacccgagttgttcaagtgtgcactatacaccaaaaagtgtgccgatcgcaatggtacagctcagtgaattgtcacagagtggacccacttcatgattgggctcagacagtctgaaaaccaaccccagaggtccccttgcattccttccagtctccctgtcccaagagcagctatcctgacagcatggattagtttggccagattttgaactttattcaaatggaattacataatatgtactttcctgtgtctggcttcttggttaacattttatttatttatttatttattcattcatttagaggcagggtctcactctgtcgcccaggctggagtgcagtggtgtgaccttggctcactgtagccttgacctccccaggctcaagcgatcctcccacctcagcctcctgagtagctgggagtacaagcacgcagtaccacccccggctaatttttgtatctttagtagagaccgggtttcgccatgttgccgagactggtcttgaactcctcctgggtttaagccatctgtctgcctcagcttcccaaagtgctgagattacaggtgtgagccactgtgcctagccatcattatgttttgaaatttatcgggattggccaggcacggtgactggcacctgtaatcccagcattttgggaggccgaggtgggtggatcacctgaggtcaggagttcgagaccagcctggccaacatggtgaaaccccatctctactgaaaatacaaaaattagctggttgtggtggtgcatgcctgtaatcccagctactcaggaggtggaggttgcaatgagccgagattgtgctactgcactccagcctgggtgacagagccagactccatctcaaaaaaagaaaagaaaagaaattcatcagtgttatttaatggttggagtttgtgttggagtttatttaatggttggtgtttactgctgtacgtagtcccttttgtgaatatgccactgtttatccattttcctctggatcggcatctgggcagctcccagtttgaggtttattacaaagcatgccacttgtagccctcctgtgcctgtctaggcagacacatgtcctgtgtcctctcggtgtgtacctagaagtggggttggtatatgtttagagatgctacctgggcgggattttgcaggtgaaggacccaaggacccacagagcataagggactttctcagatcacatagccccttctcagagctgctccggggcccctttccccacagaacagtagctggaaccaggcctggggctgacggtcaggtgtccattgtcccactagccccctttgctcctttctatcagtcctggaaggccccctgtggccttagggttggtggctccctctgcccctgggggtcctcagccctcatgctcctctacccagtaccgtcagcctgccaggactggagagaatggcccatgtgtcaaatcccagcgcaggacactcttggcacctgttcatgcccagtgaggagccagatctcagcagttggggggcatttcttcacacccctcctcagtcttcatgctcttccccacagctctaatggtaccaagtgacaggttggctttactgtgactcggggacgccagagctcctgagaagatgtcagcaatacaggtaccacaggggtgagggtctgggacatgcaagcattcccaccagccccagcggggtgcttagcagaggagagaggatgcagcttagatcaacccactcccctttttcccagcactcagtcaggtacaggcctggggaagtgggggagtctcaacaggaagggacccagggctcgttctccgggcagagcacctcacccaggctcacagaggccagctcagaggctgtgaccacgagggtgcgccagcaggtggctggagggggcccaggctgcacccgcccacgtgtcacctgccttgcaggccgcctggccatccggtacagaatgtattgccaagtacaacttccacggcactgccgagcaggacctgcccttctgcaaaggagacgtgctcaccattgtggccgtcaccaaggtaatcaggtgacgcccaccccaccatcccactgctgggccttccctctgcagggggaggtgggcctgagagcatgtctgggctgccctctccccaggaccccaactggtacaaagccaaaaacaaggtgggccgtgagggcatcatcccagccaactacgtccagaagcgggagggcgtgaaggcgggtaccaaactcagcctcatgccgtgagtaccacgaggaggggttggggagggaaggggccttggtcctcctgaaggagcatcaggagcaagcagggaggccagagtgaggggcttgggtgttggggagggcctcaggaggaggtgcagggtgcgggtgcgggacctcacagagcagggctgggggcagaggcaggagggtggcaaagaagggacagggagcagaagaagagggcctcaaatgcctgactgagcgagtgcgagccacgggtgccaagcagagggaaccccttcagaaaggggagccagggtcagtacctttgggccaccatgacctccagccctgctgctccccagttggttccacggcaagatcacacgggagcaggctgagcggcttctgtacccgccggagacaggcctgttcctggtgcgggagagcaccaactaccccggagactacacgctgtgcgtgagctgcgacggcaaggtggagcactaccgcatcatgtaccatgccagcaagctcagcatcgacgaggaggtgtactttgagaacctcatgcagctggtggaggtgagctggggggtacagagccttgctcccaccctcacacaccctaaacccatctggggccctggcttctagctccagccccactgcttctgcgtggtgaccagccatgtggggcaacttctgtgagcccttgtttcctcacaccttggtggagcagctgctgcgtgccaggactcacctctgaccccacagtgccaccatgaggaggggagccttatcctcattttatagaccaggagttgaaggttcagagcagttaggggacccacctgaggtcccacagatataatttggtgccaggactagaatctgagtctgtctgatcccagagctaactttcctccagccactcacagacctgcatgctcagaagcgtgtgcagaaacatgagccatgcgccttgatcgccagggcccctgaggctctcgcacctgcacggacatgcccacaggtccctgcagcttcccaggccagctctgccagccctggccaggccacacctggcatccggtagccacaggaagcctcccgtgtccctctgtattcactcttatctccctcccctactggcctggcttggcctgtggcaggtgagggtggggtcctgggcactcctggctagaggctggtttcaggactgagccatgggttgccctctgcatcagatacccatggggcccagagtggtagcagcagctgagtgtccagcaaccgcatgtagggtggcatgggaaatgggccatacgtcataatctgggacttccctaacccctgccctaccagaaatggggagccctccccactcagtgactccaggctaggcggggctggcctctgccgccctctggtggtcaggcctggacggtgcatatggggcaccttgggctgtctctgagcaccctgccccccacaccctgcagcactacacctcagacgcagatggactctgtacgcgcctcattaaaccaaaggtcatggagggcacagtggcggcccaggatgagttctaccgcagtgagtgcaccccaccccagacctcttgcccacccacctcctcccacgcaggcttcctggcactgccccatccaggaacctccagagaaccccagtgcctgatagtccagtcagcctctgtcatcccagccatgtccctagtggcctccaggccctcactggcccctccccacaggcggctgggccctgaacatgaaggagctgaagctgctgcagaccatcgggaagggggagttcggaggtgagctgggccgggccccctgggggggttctgagggactccgaacttgggaacaagaccacctctctgcccccagacgtgatgctgggcgattaccgagggaacaaagtcgccgtcaagtgcattaagaacgacgccactgcccaggccttcctggctgaagcctcagtcatgacgtgagtgggggcggggtaggggggaggttggcctaggttaggagtgaggcaccagcttcccctttctgaccactctcgtcctgccccaggcaactgcggcatagcaacctggtgcagctcctgggcgtgatcgtggaggagaagggcgggctctacatcgtcactgagtacatggccaaggtgggcacctgccgagacccggcactcaggccttccaactgccccgaaacccccactgtgctctagggcccctgctccctcagtcccccgaccccaagtgagcttttaggtcaccagggctgggcttttgtcctggtttaccattcattgactgtaacattggacaaatcatgtcacctccaagcctcagcatcacatctgggaaatggagataataacaacttagagatttgtgagagtcaagggataaggcatgaataacacagagcagtgtccggcatggatgttctggcccctccccactccttccctgtctcacacctccctggagtgtcaacacccacccggccccagcgtgctgtgtgagagggctgcagggcacgtctgacctcggcctggtctgtccttcctgcccccaggggagccttgtggactacctgcggtctaggggtcggtcagtgctgggcggagactgtctcctcaagttctcgctgtgagtgaagcagcctcttggatgggtagggtttgaggggtaccctgccctgctatgggagccccagtctgaggggacatgtggctggcctacccccagagatgtctgcgaggccatggaatacctggagggcaacaatttcgtgcatcgagacctggctgcccgcaatgtgctggtgtctgaggacaacgtggccaaggtcagcgactttggtctcaccaaggaggcgtccagcacccaggacacgggcaagctgccagtcaagtggacagcccctgaggccctgagagagaaggtggggctggcctcccctggggcctacagaggtgggcaggagtcctgggtcactccccaccctggagtcccaggatctgacgctgcttcttccatccacatggcagaaattctccactaagtctgacgtgtggagtttcggaatccttctctgggaaatctactcctttgggcgagtgccttatccaagaattgtgagtatgggtactgggatcagggtggctcttggagcaccggaggggttggcaggggcgtgagcctccttgggccctgcctccccaatcaaggcctagaagcctcaggcctgccctggggagctcacaggccactctccgggcctgggtctgcggcaaagctgatgggcatccctgagaggctgctgggtaggtgtcctctctgaggccagggcctggactgactcctgcctccccctggccacagcccctgaaggacgtcgtccctcgggtggagaagggctacaagatggatgcccccgacggctgcccgcccgcagtctatgaagtcatgaagaactgctggcacctggacgccgccatgcggccctccttcctacagctccgagagcagcttgagcacatcaaaacccacgagctgcacctgtgacggctggcctccgcctgggtcatgggcctgtggggactgaacctggaagatcatggacctggtgcccctgctcactgggcccgagcctgaactgagccccagcgggctggcgggcctttttcctgcgtcccagcctgcacccctccggccccgtctctcttggacccacctgtggggcctggggagcccactgaggggccagggaggaaggaggccacggagcgggaggcagcgccccaccacgtcgggcttccctggcctcccgccactcgccttcttagagttttattcctttccttttttgagattttttttccgtgtgtttattttttattatttttcaagataaggagaaagaaagtacccagcaaatgggcattttacaagaagtacgaatcttatttttcctgtcctgcccgtgagggtgggggggaccgggcccctctctagggacccctcgccccagcctcattccccattctgtgtcccatgtcccgtgtctcctcggtcgccccgtgtttgcgcttgaccatgttgcactgtttgcatgcgcccgaggcagacgtctgtcaggggcttggatttcgtgtgccgctgccacccgcccacccgccttgtgagatggaattgtaataaaccacgccatgaggacaccgccgcccgcctcggcgcttcctccaccgag

SEQ ID NO: 972 - DNA, 17880 bp, Homo sapiens
tttcagttcaaactcatttcccttttattaaagtccaagttaccattacatggcttggtactcaataaaggaaaacttgttcaaataaggtaatatgttatcatcagtatttccaggtaactgttcacactcaagtagcaatgtcaataaatccttggggaagcccatctgtaagagaaaacacaaagaattagccaggaaagaataaagaaaaagtagaaatcttttaaaaataacccttagtgctacaaccagggaaatcactgtctctctgtaccctttactgctcttacttaatcctgcctactgtcaacccacaagcgactagctttgtggcttttttgttgtttatacactggtacttccttcccaatcagaaaagtgtccagtagctgccatttaacaaaagaaattttttttgggccggacacggtgactcatgcctgtaacgctagccctttggaaagccgaggcgaatggattgcctgagcatagaagttcaagaccaccctgggcaacacggtgaaaccccgtctccactaaaatacaaaaaattagcctggtgtggtggcccatgcctgcagtcccagctactcgggaggctaaggcacgagaatctcttcaaccgggaggcggaggttggagtgggccgagatcgcttcattgcacttcagcatggatgacagagcaagactctgtctcccaacaaaaaaaagaaaaaaagaaaaaaagttagtatagctagaatatatcctacataaaaaagatcttctggaccccttggaataatacttgataaaatgaaaactaaaaccatcttttaggagttcattatagaatatgaaccacagggctgggcgcggtggctcacgcctgtaatcccagcactttgggaggccgaggcaggcagatcgcgaagtcaggagatttgagaccatcctggctaacacggtgaaaccccgtctctactaaaaatacaaaaaattagccgggcatggtggcgggtgcctgtagtcccagctactcgggaggctgaggcagaagaatggcgtgaacctggaaaacggagcttgcagtgagccgagatcatgccactgcactccagcctgggtgacagagccagactccgtctcaaaaaaaaaaaaaaaaaaagaaaaagaatatcaatcacagggccagacgcggtggctcacacctgtaagcccagcactttgggaggctgaggcgggtggatcacctgaggtcaggagttcaagaccagcctggccaacatggcgaaacccggtctctactaaaaatacaaaaatgaaccgggcatggtggtgggcacttgtaatcccagctactagggaggctgaggcatgagaattgtttgaacccaacaggcagaggttacagtgagcagaggtcgtgccactgtactccagcctgggcgacagagtgagactccgtctcaaaacaacaacaaaaaacaaacaagagcttcaaaagtataactaggaaaatttccattctgaacaactagttttctttaagtactcacagaagtcaaaaccattgcatatattataaagatgagctacttcagggaggttgtgctggtgagggggtggacaaagataaaatgaaaagaccattgcttttggctcacacctgaaacccaaataatttggaaggccaaggtggaaggatcacttgagcccaggagttcaagaacagcctgggcaacatagtgagactctgtctctataacaaaattaaaaataaataaattaaacaaaaacaaacaaaaagaccactccgttaaagcaagctttaaaacgagatcccacctgggcgtggtggctcatgcctgtaatcccagcactttgggaggctgaggcgggtggatcacctgaaatcaggagttcaagaccagcctggccaacatggtgaaaccgtctctactaaaaatacaaaaattagccgggcatggtggtgcatgcctgtaatctcagctacttaggaggctgaggtacaagaatcggcttgaacccgggaggcggaagttcagtgagccgagatcatgccattgcactccagcctaggtgacagagtgagactccgtctcaaaaaaaaaaaaaaaaatcttaaaagtagattacaaagttttcagcattttctgttcagtttctcaacaggaagactgaatataaaaattccttgaattctgaatatttttctttctatgtatgtatgtatttaattaactaaaggagacagggtctcactatgttgctcaagccagtctcaaactcctgatactcctgaactcaagcaatccttccaccttagcctcccaaagtgctgagcttacaggcatgagccattgctgccagccaagttgagtctttttttttttttttttttgagacagagtctcactctgtcacccaggctggagtacagtgacacagtctcggctcactgcaacctctgcctcctgggttcaagtgattctcccgcctcagcctcccgagtagctgggactacaggcacatgccaccacacccagctaatttttgtatttttagtagagacaaggtttcaccatgctggtctcgaactcctgaccttgtgatccacccgcctcggcctcccaaagtcctgggattacaggcgtgagccactgtgcccagcccaaatagaaatactttaaacacaccaaagcaaatgtggcaacaataaaagtatctgaaaatctggatatgtgtacacagactcactatattatcatctatgctactgtttatgcctagaatattgtatgaagatttttctttaattaaggtggcttttatttgtctttctaccagtaagaaaataatgatgccgggcgcggtggctcaagcctgtaatcccagcactttgggaggccaaggcaggtggatcatgaggtcaggggtttgagaccagcctggccgacaggatgaaatcccgtctttactaaaaatacaaaaattagccagttgtggtggcatgtggcctgtagtcccagctacttgggaggctgaggcttgaatccaggatgcggaggctgcagcgagcctagattgcaccactgcactccagcctgggcaacagaataagactccatctcaaaaaaaaaaagacgaaagaaagaaaagaaggaaagaaagaaaataatgacaacaactagaaatcatttcagttctttaaatttaccattactggtattctcaaaatctcttcatgctcacggccattacctctaacaagaacactgaaaggtcttactatagcacactgaaatgtcatccacccacacctctctggattgttttcctgccttcttcagtggtttgtcgcttacccatgcggtttacactttgtcaaggcccagttcctccggagtggagattcccagttcatttaaagttggtctaagttcctggatgacataggggtagatttccttatgaggtcctgctttgtcctgatggcaaagagaatattcacatttaactctctcaaaagccatgtctattaattcatgaaatgaacttaaaaatgcctttaattacttatgcagaggcaggtaggacagaataatacaggtgatcagctgggcatggtggctcacacctgtaatcccagcactttgggaggctgaggcgggcggatcacttgaggtcaggagttcgagaccagcctggacaacatggtgaaatcccgtctctactaaaaatacaaaaatcagccaggtgtagtggcacatgcctgtaatctcagctactcgggaggctgaggcaggagaatcggcttgaacccgggaagcggaggttgcagtgagccaagatcacgccactgcactccagcctgggtgacagaacaagattctatctcaaaaaacgaaacaaaacaaaacaaaacaggtcatctacttttaagttaacacatttgttcggtaagtagggcaacttgctgggtgccgtggctcatgcctgtaattccagcactttgggaggccaaggcgggtggatcacaaggtcaggagttcgagaccatcctgaccaacatggtgaaaccccgtctctactaaaaatacaaaaatttgctgggtgtggtggcacgcccctgtaatcccagctactcgggaatgcttgaactagggaggcggaggttgcagtgagctgagatcatgacactacactccagcctaggggacagagcgagactctgtctcaaaaaaataataataattaaataaaaataaagagggcaacttatatatgtactgttcaaggtaggcttttgaaataccttgagaataactgcaattggactaaatccagaacatcttaaagtctagaattactggaaaagaaggtagtgatgacagaattttgtgaaggcaattagacatgcccagcaggcaacacgaataattaagttaacgggaaaagttttttcatttgcctccaatttgagaccttaactgaattaactaccagtgctgaatggattgatagcctacagaacccttaattatcttacccattatagataaagtaatgtcacacttttgctgttaacggaccttaagtttctttcttacagaccacagtatcttttcatggagagctgtactttgagaatacatatgtccagggctggagacttttcactgtaatatatagttacacctgtgctgtcacaaggttccttaggaacgaataagaagtcaaaagaactaagaaagtgccggccgggcgtggtggctcacgcctgtaatcccagcactttgggaggctgaggcgggcggatcaactgaggtcaggagtttgagatcagcctgaccaacatggagaaaccccgtctcttaaaatacaaaattagcctgtaatcccagctactcgggaggctgaggcagaagaattgcttgaacccaggagacctcggaggttgcagtgagctgagatcacgcaatgattgcactccagcttgggcgacagagtgagactctgtctcgaaaaaataaataaactcagaaattatgaccaaataagaaggaggaaaattagtatatatcctcctatgttttcatataatgtatatatatattttttgagatggagtttctctctcttgttgcccaggctggagtgcaatggtgccatcttggctcactgtaacctctgcctcccgggttcaagcaattcccctgcctcagcctcccgactagctgggattacaggcatgcacccccacgcccggctaattttttattttcagtagagatggggtttctccatcttggtcaggctggtctcgaactcttgacctcaggtgatccacctgcctcagtctcccaaagtgctgggattacaggcgtgagccaccgtgcccagccgacacaaatatgtttaaagtcaaacacatttctacagtatcaacagttgtgtagtataaccagttctgggaagctccctcttaagaattcctaacatttcgtatgacaaatagcaagaagatgaatacactttgtagttaaatctttatatatcctttattatttccttgataaattcctttctttttttttttagagacggagtttctctcttgttgcccaggctggagtgcaatggtgcgatctcagctcactgctacctccgcctcccgggttcaagcaattctcctgcctgggcctcccaagtagctgggattacaggcatgtgccaccatgcccagctaatttttttttttttttttttttttttgagacagagtcttgctctgtcacccaggctggagtgcagtggcgctgtcttggctcactgcaagctttgcctcccgggttcacgccattctcccgcctcagcctcctgagtagctgggactacaggcgcctgccaccacacccggctaatttttttgtatttttagtagagacagggtttcaccgtgttagccaggatggtttcgatctcctgacctcgtgatccgcccgcctcggcctcccaaagagctgggattacaggcgtgagccaccgcgcctggcctaatttttatatttttagtagagacagggtttcaccatgttggccaggctggtctcaaactcctgacattgcatgatccacccgccttagcctcctaaagtgctgggattacaggcatgagccatcacacacggccaagataaattcttaaaaaagaaagaaaaaaaaaaaagagagaaaaaagaaaaaagataaattcttaaatggaattgctgaacaaaagtgtatcatgtacaatttgtaaggccttgaataaatgctgccaaagtagcctctagaaagattttaactgcaatgtacattccttctagttatataaggactcattttaggcattttaacaaattcaaaaatacagaatattctgatacctcagcaatagcccactcatttacagaacaattttagcattattatttcactgaccttaacaacctctaggatacgaactgtactagcaaaatcatttaaccgtctgcatgcccgcaaagcagcatcaatgattttgggctctggaaccatatcataggtaacaagtgtgtttatccctgcaaaattaaaaagaagggccatgtcaacctcgaagagcctcacttaaactatgagttatttatatttttactgaatcactgatgtatgatcttatctgtctgggtctccattctcttacctataaaatgagagaaacctacctttaacaaattctagataataagatcacagtggatctcccttagtgaatcagtggaaagaaagaactatgcaacagcacgcagattgaaggaaaaaatcctgagttttttttttcccctttgagaacaagagggtcattttcaactcctaactttttttttggagatggagtcttgctctgtcacccaggctggagtacagtggtgccacctcagcttactgcaaccgctgccacctgggttcaagtgattctcctgcctcagcctaccaagtagctgggattacaggcgggtgccaccaagcccagctaattttagtatttttagtagagacggggtttcagcatcttggcctggctggccttgaactcctgacctcgtgatccacctgcctcggcctcccaaagtgctgggattacaggcatgagccaccacatccggccctcctatctttaactcttagtacaatgaacacattttggatgctttaaaagagattcaaggctgggctcaggtggatcacctgaggtcaggggttcaagaccagcctggtcaacatggagaaaccctgtctctattaaagatacaaaattggccgggcgtggtggcacatgcctgtaattccagctactctcgaggctgaggcaggagaatcacttgaacccaggtggtggaggttgcagtgagctgagatcgcgccattgcactctagcctgggcaataagagagaaactccatctcaaacaaaacaaaacaaacaaacaaaaaaaccaaaataaaagagattcaactggaaaacagcctaaaaacagccagagaaatgcgtagagttaatgaagcctaaatgaggacattaaggagatattatagagaaacattagtacacagactcataaacattcaaccagaaaatgattgggcatgattactttcagatctgcacaaaatgacacataataaaatttaagattctcttaatgggaatacataattgttctttttattacttctactccagattgttcagtaagaattctattggttgtagcaaaagggaatcattacatttctgcagagaagtttaaagcacttaggtttcttgcttttattactttaaaatatttaaacaaaggataccagtgaatacgatagtcattgagattgaatttttggtatgagataaattaccctacacctaattctattttttcatgttaagtgtgcatctgcaaatttaggaaagacaagttctaacttacttagatacttattcatggcaaaacaatgcaaaaataacaaaaaacccaaaccatcacccaaaggggaagggaaccaaatgactgctttgtgtaaattcttttttttttttctgagacagagtctcactctgttgcccaggctggagtgcagtggcgcgatctcggctcactgcaagctctgcctcccgggttcacgccattctcctgcctcagcctcccgagtagctgtgactacaggcgcccgccaccacgtccggctaatttttttgtatttttagtagagacggggtttcaccatgttagccagaatggtcttgatctcctgacctcgtgatccgcccaccctggcctcctaaagtgctgggattacaggcgtgagccaccgcgcccgtgctatgtaaattgtttgaaatgtacaaaactgttaccttttgctcatctagccttattgctatagcagtggttttcaattaagggtgacttcatccctcaggagacactgggtaatgcctagaaacatttttggttgtcatgatacgaatgtgtgcatactggctcctagcaggtagaggccaaaggtgatgctaaacaccctacagtgtaaaggacagtcccctacaacaaagaattatctggcccaaaatgtcaatagtgcctgccttaaaatcctgctttataggtagccataaactttcctaactgcaagttgcatgaagtaaccagtttaaacaacgcatgttttcgaaacagttgctctcaataaaggagcagaagcagttcatatttacacaccaaaatagacaaatatgtttatgttccaattacctttacgcaattcccaggcatctatatctggcttgttgaagtatgttacccagcgagcatcaaactcctcatctgtctcctgtgacccatgggaatagcagcgaactgactggatagctataatgtgaaagaaccataacttcaatgtacacaaatagtacttgatatattttgttcaatgcattaaattttgagttgactatatatgttgtggcagcaaaaatattgaacaggtcaaatgaaatacatcgtatacattgatacagaaagatatattttaaattaagcaaataaaatcaagtagaacaaaaagtattacataggcatgtttatacttttctccctaatgtataatactcgcttgaaattattaacagtggttccctctgattttaaattaacagtgattatcatgggacgtaaaaactactttatatacttccatattgtttgaatttttacacataaccagagtattaattcctaagtaaaaatgtcccaggtgggcatagtggggcacacacctgtagtgccagctactcagaggctgaggcaggaagattacccgagcccaggagttcaaggtcgtagggtgctaacaatatgacagaacctgataagatagccattgcattccagcctgggcaacacagcgacaccccacttctaaaaactaagaataggccaggcgcagtggctcacgcctgtaatcccagcactttgggaggccgaggcaggcggatcacgaggtcaggagatcaagaccatcctggctaacacggtgaaaccccgtctctactaaaaatacaaaaaattagccaggtgtggtggcgggcggctgtagtcccagctactcgggaggctgaggcaggagaatggcgtgaacctggacggcggaggttgcagtgagctgagatcacaccactgcactccagcctgggcgacagagcaagactccaactcaaaaaacaaacaaacaaacaaaaacaaaaacaaaaacaaaaactaaaaaactaagactaggccgggcgcagtggctcacgcctgtaatcccagcactttgggaggctgaggcgggtggatcaagaggtcaagagatcaaggccatcctggccaacatggtgaaaccccatctctactaaaagtataaaaattagctgggtgtggtggcgcgtgcctgtagtcccagcaactcgggaggatgaagcaggggaattgcttgaacccaggaggcggaggttgcagtgagccaagattgtgccactgcactccagcctggcgacagagcgagactccgcctcaaaaaaaaaaaaaaagacaataaacaacaacaacaaaaaaaaccaaaaaagcaacaaaaaaaaaaaactaagagcaatactaatgtccattcaagttcttttttttgagacaggctctcgctctgttgttgcctaggctggagtgtagtggcgcaatcacagctcactgcagcctcaaattctttgggctcaagcattccttcctcccttggctcccaaagtgctgggattacaggtgtgagccaccagccctggcaccattcaagttcttaaataaacttatatacttcattcacacattaaaaaaaaaaaaatctcgggccgggcttggtggctcacgcctgtaatcccagcactttgggaggccgagatgggcagatcaccaggtcaggatatcgaaaccatcctggctaacacggtgaaaccccgtctctactaaaaatacaaaaaattagccaggtgtggtggcgggcgcctgtggtcccacctagttgggaggctgaggcaggagaatggcgtgaacccaggaggcggagcttgcagtgagcagagatcacgccactgcactccagcctgggcaacagagcgagactctgtctcaaaaaaaaaaaaaaaaaaaaaaaaaaaaaattctcatgttattatattccaaaataaattacacatcctgacaaattacacatacaaattgctttatcaaactacagccccttcccaaaatattctgataaatcccctaagggaacgtacactctaatctacacctaatgcaaaataatactgttttactaggaatattttgggctgggcgcagtggctcacacctgtaatgccagcactttgggaggctgagactggtggatcacctgagttcaggagtttgtgaccagcctgatcaacattgtgaaactccgtctctactaaaaatacaaaaattagctgggcgtgatgacgggcgcctgtaatctcagctacgcgagagactgaggcaggagaatcactcgaacccaggaggcggaggttgaggtgaggtgagatgatgccattgtactccagcctgggcgacacagcaagactctgtctcaaagaaaaaaagaaatgatgtttacatagagtactgtatgaaaagcatttccattttttttttttttttttgagatcgagtctcactctgtcacccaggctgaaatgcagtggaacaatctcagctcactgcaacctctgcctcctggattcaagtgattctcctgcctcagccttctgagtagctgagactacaggcgagcgccactaagcttggctaagttttgtattttgagtagagacgggatttcaccacattgcccaggctggtctcgaactcctgacctccagtgatctgcccacctcagcctcccaaagtgctgggattacagacgcgagccactgcacccagccccattttttctttcttcttgtcaaatggacactgaattgagtttggaaatctgaattccttctgaacagcctctggaacaggtagggggataggcggaggcagaaaattttatctttgggtattgaatgcagcacaacctagcactcagatacctctaggctcttcgctctctctgtttgaccctggaaaattaacttaagtttattttccttatctgtaaaatggggacgctaccccccttagcagattatgaagattaaatgtgaaaacaggtaggttaacactatgcactggtaagtattaaacaaatggtagctataaactaacccttatctaaaaacgtcttagttgtctatttatagaaatcataacttaaagaaatgaaacctatctcaaatcacatttcctactacctgtattagataagtgtggtgtaacttccagttgtttaaggcttaacatatttttatttatttacttttagagatgggggtcttgatatgttgcccagggtggtcttaaactcctagcctcaagcaatcctaccactcccaaaatactagaattacaggtgtgagccaccatgcccagccttaacatacatatatatatatttttaaaaacttcacccagaaacctctcaacattgttgttctaagaacactgaaatttaaacattagtaatatcctatatatctttaatgcagtaactggcaggaggaagagtagcaaaaaaacgaagcagaaaagatcttcccagagacctaaattacctacataatccaagcccagaatgaagtggaacatgtacataaatggactagaagtgaacacgttttaatttctttttttttttttttgagacagagtctcaccctgtcgcccaggctggagtgcaatggcacgatttcggctcactgcaacctccacctcccgggttcaagtgattctcctgccttagcctcccaagtagctgggattacaggcatgcgccaccatgtcaggctaattttttgtatctttagtagacacaaagtttcaccatgttagtcaggctggtctcgaactcttgacctcatgatctgcctgcctcggcctcccaaagtgctgggataacaggcatgagccacggtgcccagccttaatttctacaacaagaaaaaaatggatctctacacctaaatatgtctggtaagtatgaacatttaatcaaaactacgtggatatttaataagtcttacaagactaatattcaaatttaatatatcagaaaacaaggccaggtgcggtggctcacacctgtaatcccagcactttgggaggctgaggcaggcagatcacttgaggccaggagttcaagaccagcctggccaacatggtgaaaccctgtctctactaaaatacaaaaaattagccaggcgtggtggcacacccctgtagtcccagctacttggaatgctgaaggaggagaatagcttgaacccagggaggttgcagtgagccaagatcgtgccactgcattccagcctgggcgacagagcaagactccgtctcaaaaaaaaaaatatctatctatctatctatctatctatctatctatctatctatctatgtaaaaacatagattagaacaaccatctaatgcactattatcaagaacttagggccagatgcagtggcactagcctcggagacagagtgagaccctgtctcaaaaaagaaaaaattataagccacctcttcaaaaactaaagctagccttaactgaatactgaaagtgcaagtataaaatgatacaatcactttggaagacggtttaagcagtttcttatcaagttaaacacaaacctaccatataacacagtaattccactcctaagtatttacccaatgaaaggtctatgtactccttccccagaggtaattacctgtcccatccacaacagtgcttcatgataagcaattcgttttgttcactgctgggcatggatttgactacatgagtgctaggctttgtttcctaactgtgaataagatgaccaccaacagcaaatccaagtcaaggagatcaccaccttcaaggatttgatcatatgtcttctggaagccaaattacaaactggttgtattccaaaaagtcttttataaaacagaactagaactttgagaggccaaggcaggatcgcttgatgccaggactgagagaccagcttgggcaacaaagacagacctccattctccacaaaaaacttaaaaaattagcggggtttggtggtcccagctactcaggaggctgaggcgggaggatcccttgagcccagggcaacaaggctgcagtgagctatgactgcgccactgcactctagcctaggtgatagagcaacactctatatcaaacaaattaaaataaataaaaatttaaaaacccatacatccctttctgaagggctaaaacagactctccccacgtgatttaaattttttttttttttttgagatggagtctcactctgtcgcccaggcgggagtgcagtggcgcaatctcagctcactgcaagctccgcctcccaggttcacgccattctcctatctcagccttcccagcagctgggactacaggcactcgccaccacgcccggctaatttttttgtatttttagtagagacggggtttcaccgcgttagccaggatggtctcgatctcctgacattgtgatccgcccgcctcagcctaccaaagtgctgggattacaggcgtgagccaccatgcccggccatgatttaaattatattgttaaatccaataatgggtaaagcaggatctattctattagctatggacacatcccccacatgcttaactttttttaggtaaactctactagcattctctgccccacacaccccaccccacttaagaacaggatctccacctagtattgaagcttgaaaggcaaattattttggaaaacaattactcagagcttttacgtaacctgaaagtcccaaagtaagaaaaaagaagcagctgtgaaaaatgaggacatttttagggcttcatcctaaaaagctatttctaacactgctttttggcattcagttaagcactccatttaaaaacaaaaaaggctaacatatatagaaaaataaaagggctcattgatcctttgggtttaaatttagttaaatcggatagttttccatttaataaataatcaaccctgacaggcccaaagaatgaacactttggtggtggtaactgtaggaatgagggcacattaacgagttactgaggctgggtgcagtggctctcgcttgtaatcccagcactttgggaggctgaggtggaaggatggcttgagcccaggaggttaaggctgcagtgagctgtgccaactgcactgcagcctgcatgacagagcgagaccctgtctcaaaaacaaaaacaaaaacaaaacaaaaccacaacaacagaagaagaaaaagaaaaatttggctgggcatggtggctcacacctgtaatcccagcactttggaaggtgggaggagggaggcactcctgagcccaggagtccccagaccagcctgtttctacggaaaataaaactggtggcgcacccttgtggtcccagctacttggaaggtggaggcaggaggatcagttgagtcccaggaggtcaaggctgcagtgagctgtgatggtgccactgcactccagcctaggcaacacagtgagactatcaccaaaaaaaaaaaataaataaataaataaataaaaaattttttttttgagatggcatgatttcggctcactgcaaacctctgcctcccgggttcaagcaattctaatgcctcagcctcccaagaagctgggaccacgtgtgcgtgccaccacacccggctaatttttgtatttttagtagatactgggtttcgccatgttcaggctggtctggaacttctgatctcaggtaatctacccgccacaacctcccaaagtgctgggattacaggcgtgagccaccgtgtccggctgaaaaatgtaaattgtactgttactttagcaaaacacaaaatctaaacaaacatcaggatggcccaaacataactataagaaacaaaaatggttccaccattaaaaaggagtcagtttcggccaggtgtggtgtctcacgcctgtaatcccagcactttgggaggctgaggcagacggatcacctgacctcacgagctcgaaaccagcatggccaacatggtgaaaccccatctctactaaaaacacaaaaagtagccgggcatggtggcaggtgcctgtaaccccagctactccggaggctgaggcaggagaatcgcttgagccaagaccgtgctattgcactccagcctgggcaacaagaacgaaactctgtctcaagaaaaaacaaaacaaaacaaaacaaaacaaaaacaaacaaacaaacaaaaaaaaacaaggagtcagtttcccaagatggactttggtttccttttctataaaataaaatggcttccacgatctctaaagtacactctaggttggctgcagtggctcatgcctataatcccaaactttgggaggctgaggtgggaggatcacctgagcccaggagttcaagcccagcctgggcaacatagggacactccgtctctaatttaaaaataaataaataaacaaaaataaagtaccctccagccttatggttctacgacaaatgataaaagtctaaaatgaatgaagcaaaacatattcttttttttttttttttttttttgagacggagtctcgctctgtcggccaggctggagtgcaatggcgcgatttcggctcactgcaacctccgcctctcaggttcaagcgattcttgtgcttcagcctcccgagtagctgggattacaggcgcccaccaccacacccagctaaattttttgtatttttagtacagacagggtttcaccatgttggccaggctggtcttgaactcctgacctcaggtgatccgcccgcctcggcctaccaaagtgctgggattacaggcatgagccaccgcgcccggctgagttctttttttaatttttaacttcagcataccctgaaacgagtttctgagttcttatgtttaaatacgcatgcatagttgccagtgatgcaggttcaaaaataaaatataatatgcatgcatagaagctaaatttcacggaccaagatcgaagtgcaattactgtaattattctatggtggtggactcaaaacctcccagcacacatataaagggaaggaaaatagacaaaaatcagaagcacgtctcatactccagcaatcaggcttctattacaaaggggaaaaaacacgaagcgttcctatgcttgtaaaacccagtattcctgtgtctgtgacattcagttttcaaaagagtgatatttttatcataagccctatcaaaactctggctatcttccggagatcaggaaacaaccacacacttccatctattttaaacgtggaagaattagaacgtggcacagcagaccctaaaaatgatggaaaaggctgtgaaggtgacacactaatcgctaaccgagaaatgcctgattgaaaagtataatcgtgtgtcccatacggaagtatattgtgtcctcggaccccaagcggcgtgcccggaggctcaatgtcaccttcgccgaggcgctgcaggccggcggcggccactctcggtcaggtggccgcagggtcggcgctggggcagggtcatggcccgggaaccgaaggggagcgctgcgtcccctcctcggcgcccacagcaggtccacatctgacctgtccgcggtggcacagccaggaagttgcgcggggggaggccccgggggcgcgctttcaggtcctccactactcgaggcggcgggcagggcggcccgcggtcaccgggttcagtaaccagggtagggcaagggctaggccggggagagcccgccccggagtggcagcggggacccaggtcaccgcaaggacacgagggcgcgggcagtggcaagcaggggccttacccacggcggggccgggggtccgggcggagtgcaggaggcctcgagggtcggcccgggtggttgcggccacagcgcagcggcggagagcggcgcccagcatgacggcgatggcggcgcgcgggctgaggacagagagaagccggtgtaagctcgcgggttgctccggagcgggcgggggccggacaggctcacagcgggcggagcacgtaggcccgcccactgcgactctggcgcgtgggc

SEQ ID NO: 973 - DNA, 65489 bp, Homo sapiens
ctcagtcagtcattcagctttatttcagtgctggtttttggttccctaagagctgcatgagtgctaggcttcaccacgtgactgggggccccttgggaactgggtactatgggcaggatgcccctgaaaagaactgaagacagaggaatcatacttctctttaatacctctggggaaggcccaggctaaggatgagggcagggaccagtcccagtgccccctggggagagaagagggagaagcttgggcacaaactcccagtggccctgcaaggctatcatccctggatcttgctggagtggacagtcttctgggccagggttgttctagcttgtttctcactgtacctaatcagggggcctaactgcattaacaggcagccagaacctacctaccaaaaagcctgtaacctagactgctcctcagattttggccaagagagggccccggcttgggagctgcttggccctgagagtgagcagaggctcagagaatacacagcacaagggttacagtccctggcctcttcccatcgctggagacaatttaagactgaagggaagatgagaggaggggccagccctctaccctggctcatctgcttctggctatgttcctacaagggaagtgataacagcctgaaacccgtggtaccagggcctaccctatgtccacaatccttggtgagcccttctgtccacccatccacccgctcagccagcctgggcagacacagagcagaagcagcctgaagccctgaagcaggcttaaacacaagtccttgacaggaatccctgccaggattccaggcatagatcctgttctaccagcctccagggcctagagcttggcaccttaggatttgagcatcagtgtgttcctatggttggaacccacaccagctagctcatccagaactagcctcattttgccatctttgagacagggtgctggccccaagcctactcatctagactggacaaatgtaaaaggttcaaagcccagatgatgtaagagctggggtggagctcaagcacgggagcccatctgcctgctctgggatgacagctgcaaaggaccgtttcaggggaagggcagaggggatgaaagagtaggtggggcatgtatgtgcgggcaaagggctggaggagtggtggcctaggacagaagcaccaggaagcctcttctggttcagcaccaggctcccccagggatatccccatctgaggggtctggccccagactaggcaaaggctcaacctgctcagctttgagggtgggggcgggcactgctggcaagatgggcactgtggttctacagtaatataaccttatactacctgtgctgaagacgacagaacaacataaaatcccaatacagtaacaccatcctaatgccgcccccttccctacctctgagtgatggagggaaaaggagggagagatccttggaaaaatcagcataaaacttggatcagctcaggagtaagggtcaaaaccccccaaatcaacttgtggggctaggggaaggcctggtctgtcacagccctggacatgaatggagagtgcaggtctgccctctggtggacagctgccgtgcagctggttctacagaggaagggctgtctgcgtggggaaagcaggggagacacaaagccacaagctctgaaatagagcaggtacaggcccccagacaggacctggcccactcttcaatgtgtgtgcccaggcccagtggctgtaaacctgaaacacagtcttgagagctgcctacggctgtaaacaaaggcccacctggccgtgcagggggctgagggtagagatgcctggagttgctgcacgctcagcctgccacccagcccggaacccagtgggaaagacttccctggctaagagcaagtgacaggtcagttttaagtaagttctgttctctcacagaagaaacaaacccaaaagagaaaaaactttaacaaggtccatgaagcttcatatccttaaggcgtttgttatcaggagcagcaggggacagcagagtcctgcctgcgcaggaaccctctaagcagagtgcagtgggataacaaacttgcagccaaagggcgagtggtagttgatgcccacctcctggaagacctgctggggaatgccaatgtcgcacaaatagatacggcctgcgtgctcccccagtggcagaggcaggcccagtgccagtgaccatttggcatcaatgccctgttcgacttcatgcacaggagggtctatgctgagtactggtgcccggttctggttggcccaggccacagctgccttgtaccagggttgatcgcgcaggaagacgttctcagggcaatccaggcagttgatgaccaggtccacagggctagtgggcagatctgcaggtggaaagagtgccatctgaaagtccctatgagcagagagcagcccaggctgggactagggcccaggtcaccccaagggtgtctttgttttccagacaccactcgaatgcctctccaaaggctggccttcttaaagctgggccagggcacaggccctaggagttgcaagctggctgggctgagtgctagagaccaagtgcatgtcagcccagcagaccactgccctcctggagttctcaggatgaaccattgtcgtcctgagtgtgcagagcttctcagggcacaaagccctcacctcctctgccttctcaggcatgcctctgtatatccaactaatgccctgggcaccttatgacctctgggaaggcagagtccactgtcaaggtggccatcacagggaaaccccactcaggtccagcaaaaacaggagctgactgctatctgctgacccaagaagggtgagcaggtgagagcatgcttattctattccagctggcctactcattctactctagcaagcctgtcccctctcgtactcattatctcacaggaatgggtcctccactcagcccaaccttaattaagaattaagagggaacctattactattctcccaggctcctctgctctaaccaggcttctgggacagtattagaaaaggatgtctcaacaagtatgtagatcctgtactggcctaagaagttaaactgagaatagcataaatcagaccaaacttaatggtcgttgagacttgtgtcctggagcagctgggataggaaaacttttgggcagcaagaggaagaactgcctggaagggggcatcatgttaaaaattacaaggggaacccacaccaggcccccttcccagctctcagcctagagtattagcatttctcagctagagactcacaacttccttgcttagaatgtgccaccggggggagtccctgtgggtgatgaggctctcaagagtgagagtggcatcctatcttctgtgtgcccacaggagcctggcccgagacttagcaggtgaagtttctggtccaggctttgcccttgactcactatgtgacctctggtggagtcccttctctgggccatatttgctctctccaattcttctccctgctgttctcatttaaacccattccagtcagactctgtccctaccactccacttaagaccactcatcaagctcaccaggagcctccacagagatgctaaatccagtggtcgattctgtcttcctttgaccttaacctagaacggggcttgctgacacactgaccacatgctcctttcttcacttggctttcagctaccatactctcctggttttcttcctccctcactgaccattcctgtcccatctccttggttaggctctttactccctgacttctaaataaagagctcagttttccaacttctgtatctactctcttcctatgtgacagcatatccaggctcctcatggcttaaatattccctatggcttgtaactctaggctgaatcctttcacttcagattcatataactcgttccctatcaacatttccacctgcatatccaataggtgtctcaagctgagcttctgctgttcctccccaaaccttctctatcaagttttcccatctcagtgatcgcacctcagttactgaggccaaaaactttggagccattgccaactcttctctttctcccaccccccatacatccagtctgtggattctatctccaaaactgatttagaaactaactaccttcaccacctctggcactaccactcttgtcttagccaccataatctctctctcccatgatcacaacagcatcttgacacttctctgtactcctctgtgtagtctactctcaaacagcacccagaatgatcatctggaacctaaatttgattatatcatttctctacttattccttcaatgactgcccatctcaccagagtaaaagcccaaatccttgtggtcatccccaaggcccatcatgacctgaccctgaaatgtccaagtctcctactctccacccagtcctccaacatgcctcctttccctgctttgtttttatccacatcacttactacaactacacaagtatgttacatgtctttttgttcctcctaaccagaatataagctccacagaagaatggatttaaaaaaatctgttgccatatccctagcatcaggaagagtgcctgttcaacgaatatttgtggaatggaccaatgggtccccagctcttcatgtgagtagttggagagggagaagcataaggggatgggaagtagtatattactgttctaagactccttagaggcgaagcaccatccttacacacgtagtgcctttccacctgtcgccactgggtggcatgacgagaccatcaaactgctaaggagggaggaggccttcagcccagccctgcctaagtgctcacctttgaggctagacacttgttggccttgggtcttgctgaagagcgacagctcattggtgatagattccaacatcttgacaaaattgggcaggaaaaggatgacctggacatcatggttggctaggtgccttccacagctgataccctgagcccccttcacatgaggtccacacagtagagccactgtaggcctctggtgaacatttttgggattcaacctggaaaagaaggtgaagaagcagtatcagctacatacttgccaatcccttgcaccctataccagacaattgcctgtagcacctattggtctcagatctcttacccactgctcaccaagtcccaggctccagagggggacaaaatccactgcaggccaggtctatagggtggcactcctgttgtcccaaaccccaacctcacatcattgctgggtcctcccactaagtggttcacccagatcttgctccacacaacactgttgccacaacaccgctttgctgacccatgaacacttaatagttcctctgcagccttgtctgctcttcttccccaacgtgtctgcttcactccagcagggctggtctcatcctctcctgcacttgtaaggctctttcctgcttatgctcaaactacatcccctgcccagaaagcctttcactttccaaactctgaaccgccttttcttggagatccagttcaagacttacctctgctgggattactctggctcatgcctttacctctcctcaactcctaataagctcacagcaagtaccatagctctccattctcctcagtcagttgccaatggttctctttactgagcttagtagcttactgaagttaatgaaagcaatgctgcaggcattaacagtatctatttcataggatgctgtgcagattatcggatgcccagcacttagcagtgcctaacacaaagaaggtaaggtactcagtcagtgctgaccatggcggaggcagcaggccaagggttacctggcctcctaggctagcagctgccttggatgaagttgtcacttccagttttctgctattcaaagctgagactcctctagactcagagaagccacaaataaggagataaagaggattagccccagagctgtgcccaactcataggcagcacagttggctcacggggcagcaatgtagggaggagatggacggcaaggccataggtccctgcctagtggcagagcaatgatagtcacttaccggtttcccaaagggaggaagatgacaagatgttgtcaagctaagaggagcttcataactgcccccattcccaaacacattttggagaatttaacaatctactctatattccagacaccaaaccattcgccttcccatttctgcatttagaggaaatatgatgagaattgctcccttcagaggatgctgcagagttgtggaatctgactcactttgttctctaaaagggttcttcctctcagggagaacctctcccacccccaatcaaaagaagcagagcatggcattcacacacccagcggcaaggtgtagagtatatgggcactggaaatggacctatgtggattagaggcctggctggactgtgtaccagcagtatcatgtgggcaagtccctcagctctctgagccacagtgtgcttatccaaaaacacagggctattatttagctttgaggtgaagttatgaggaccacattaaattatgttgtgaaagcactgtggaacactgcatggcacctgacatacattaaacttcaagattactaaccacgggtctgatttctcaacatcagcaactgctacaaaggacaggagatggacctttggatagttcagacactaagagaaaagactggcacaaggacagccagccccaagaagctggctagagaggagtgtgatttggtaaggacattcagctcctgctccaaaactaatgtttctgggaagccacttaatggtctcaaagtgcccccaacagtggctctgggaggaggtgcaggagacaccagacacacgggcctgatgctctttcagagggcacctcacactaccccctcctgtaggcatttccctggctcttccctggcacaggagagcccaaggatctaacagctaggaagcaggcctaaatcaaagaaaaaggaaaaactaacactccaacccccaactcaaataggatgagggaggtggaaatcttacatctggcttggagtaagcctgcttgaattaagatcacttcagaatcaggagatgccttccatccaaacacattatcaggcccagagaatgaaaataggctggagtgaggagctacaggatttatctgcaatatcagttttctggcaagcactcccaaacaccatggctggaagcacaagccaaggaccaggttccattttgcaaatagggaaggggccctgtgggaagcaacatcctatcatgtgaggctttggatctgtgagtgctgctcagggaaaggaggctttccttgccccagtgaacccagatctgccctgctctttggaagtggcctccccactccagacaccactctcccacaaggttgcctacatcctcctctttaccgaaaaatccaacaggcacttgtcaactctaattttgattgatctctcagcactaccattgccggccgttccttttttcttcaaagactatttccttggttcttacacgctaccctcttggtttcttacctctcctgccttcttcttcatccttctaactgtgccttacatgccgacgttccccagaatcccaccctaggccctttctgttcacaccttctccttatatgatctcatctactcttacaccatctacaagctgacaactcctaaatctctagcatcagctaagacccttttctgaacttcagatcttttttttttttttttttttttttgagatggagtcttgctcttgttgcccaggctggagtgcagtggtgtgatctcagctcactgcaacctcctcctcccagattcaagcatttctcttgcctcagcctcctgagtagctgggactacaggcacctgccaccatgcctggctaatttttatatttttagtagagacagggtttcgccatgttggccaggctggttttgacctcctgacctcaagtgatctgcccgccttggcctcccgaagtatagggattacaggtgtgagtcactgcgcctggcctaagtttcagatccttatagctaagagactatttggatatctcacaggtattccaaactcaacacatccaaaacaaaacccaccatctctcccaaacctgctcttcttcccatgtttcctatcacagtgaatgtaaccaccatccaatcagatgtccaggctagaaaacttgaagttcactgatttctgacattatactttccattacctctaaaatccattcaattaccttgccctgctgaatttaccttaaaaacaacaacaacaacaacaacaacaacaacacccatctgtccacttctctttctaagagacaaaaaaaaaaaaaagagacagacaaagtctcactacgttgcccaggctggcctcgaactcctgggctcaagcagtcctcccactgcagcctctggagtaactgggattataggcatgcctcaccaaacctggtttgtccacttttctgatccctgcttccctagttgggccaccatcacttgggccctggctcagttttctaagttttgcagttttctacctgatctcactgccttcagtcttgcctccattgaattgactgtcctcattgtagctaaaaatcatctttttaaaacacaagactaactatgtcatagctctactgaaatgtcttcagcagctccctaccactcagctgtactgaggccctactttccagccacatagtgacttacggattgccaacaaccatgtgccatggtctctcgattctctctgcccttggcacatgctactccctgtacttagaataccttcttcttggccaggtgcaatggctcacacctgtaatcccagcactttgggaggcagaggcacgcagattacctgaggccaagagtttgggaccagcctggacaacatggcgaaaccctgtctctaccagaaacacaaaaaattagctgtgcatggtggcacatgcctgcagtctcagctacttcatgaggctgaggtgggagaattgctcaagctcaggaggtggaagttgcagtgagctgagattgtgccactgtgctccagcctgggtgacagagtgagaacctgtctcaaaaaaaaaaaaaaaaagaatgccttcttctttcttgcttgcccctgttaatcaccacttgttcgtcagggctcagcttggatgccactgctccagaagggtgactggtttctccagcctggggcaataatatggcttactggagaattttgtttcctctactacagcactatactttctagagacctcattgggctactagaggaaaggcacagtattttattcttcgtgtccccggtgtctagcagaaggtctggcacctggtatcagtctgtctacaaataaaataaggcactgcccttgatatatgagcataaggggcaggtgggaaggtgccaaactccagctcccctactcagttgtcagtgtggttctggaagctctcaggtatggagactgatttgcatcccagccacgtaaagtaaatgatgagtgccaaaggccaggtctccgaaggttcctagaaggaaggcttctgatagttagcaggagtctcaggcccgatggctgctatcaggagagagtcaaaaggcagcttgccagaagaataatgaggacatctaggagatgggtctgaggaggggcaaagaaacctcacagcatccaggaaagtgacttcagagagacactcccatcagatgagcagaaactgcctaatgaactcgtatgtgtgtatgggaggcactgtggtggtggccaggcagagcatccttactccacattgagtccctgccagtttatagacatttacctgttaggtcctccgaggagggtcagtgccatctgactggcacacacacctgtcatctccagtctccgctcaagggtcagcccatgcttctcagccacggacaacagctttttatgcagctcataggaaatacttgggacaaccaggccagagtctgcagttcaaaaggagaagagaaagggaaagtgactacagaaaccaagtccaaaccgggtatactctatccaagattctgcaaatgccaacattttaccatggatcacccctggcccatcctcttcatcttccgggactaaggcacgctctgcagctctgcagagctcaagtagtgactggtgaaccaagtaacaacttgttccaggtcaccacagagtggggacaaacttaagctcccttagcaatttagctttagaccacaaaggccaaatctaccaggatatatttagtgctatcgagaccagcacacagcctgtaacagcaacctatcaggcacatgagaagagaacatgattttcccaaagtgggggaaatgccatcttgggcagcggggcttcctcacaagcaggccccttgtccttcctgagaagtggaacagacactagctaaccctaatggccctctggtccctgctgttctcctcaactgtagggcaggaggacttgttccatctgcttccctcttcctcttccttctctcttctatttaccccttcctttttgattaagaaacttagctagcaaagttgttttctcaaataatttatcattttctccccatctgagttgggtgtaacccagtactcacgaaacagggaagcagtacaagttaagtaagctatggctggctttaaaaaagggtaacttttataaaagttggggagaattagtcactgaaagtacactgtggaaaatacttggtttttcaaggctcaaagccaacatctacagcagctggtgtatgtgaagaagtctatagtattattatatgcaccagtgtcaacataccaggaaagaaacagcaaacccaaaaatttggatctgcaatggacagctcttaccttgacaaccaaggtattgctccctccaagaagccaatgccatcttacaaatgccaaagccactgggctaaccagcagaccctttcccaaagagccccacttggcttcaccggccagtggaccaaccaacgcagattccaatcagcaagccactgtgggactgcacgtcactcactttgtccagctagatcaggtacctttttagatcctgtgtcctcaattatactggactgtcaactgcctgaggtaaggaaattaatcttttacttcttcagccttcgccttctcaacttgttccagctacacttatcaacggagttgagttcttatcaggtcctcagacatataaatgatgcaaacctagtgccatttctggtctggcctaactctaaggtagaagagttagggaataaaagttaataaaagttttcagtacatttatctccttccattgttccagagccttgtctagaaaaatctgttttcttcactggtcctgtcgggagaaatctcttgaggttatctatcaggtccagtcctacctgcatattcctaaagccacagagaatgaggctatagcttcatgttttaacaacaggaaaccaagcacaaagactgaaactataggacccaggtctgtatcctctcagggaaggcagaataacaatgtcatgtaatgatgatgataaaaaaggtctaacgtatcaaataaacactaacactatcctgttggctaactgagcccctctacctgcccaagtcctattcctgggctggggagaggcaacaaacagtgccattaggagcactgagtctctcctcccacctctttctgaaatgtcagtcattggtatctcaggtgccagtgctggaggctgcagactgaccttgcatgtcaacagctgattaaaacagccatttttatggcctgcttcagacacgcacatattatcagaactaattaggctgaacaattttcaaaagtcctaagccacgaacaactcaaacctgtcagacaagtcatgcacctgactacttcaaacaccctctttacctgcagagtcacgcaaggcagagctttcactcgtctatgcatttcttcacctatttatcaggactctttctgttagatttgaaatgggtcagggcagtgagtcttgggcctgctactccacaaatcaagcattctttctaggtctggctcttgtgctacgtgtacaggcaggcagcccctcccctgccccctcattctgagggctctctgggagcaggcagaagcattttctgctagctgtgccctcacagtccttaagagtacaaaacttaatggtacaggagaggagacatcaccccccaccggctggctagatgctgctgctggaagctgtgagtctcttaccacctcctcactgatctttgttgggggaaggggcactgttggtgaatcagcatatttttgcagcctagagaaagacaaagccaagagcctttctgctcagagtctggcagttatggggtctagaactctactctgactgttcctctgaaaggaacgtacaaacaccacaaaatgttccttttaaacatttatacacgtaagtccaacaagttggactggcttatcagaaacagaccaagggaataaaataaattccaaaggaaaggaaccaagaacatagcgtgtaaattgcaaacaacaacactgccactgccaaagcctgaacatgggccaagtctaattatgtttgagttggaaggtagatctttattgttcgggaatcaaggcagtaaaatcagttggtagggtttctttgagcattaatatgtattttacagctgctggtgaaacaagaaagggagagataattataaccagatcgtgacaagcagagaacttcttaggatctgattgaccttagggtatcaaggaagacaacaagtacactcagtacaggccaggaaagaaaactcctccttgcacacctgatttccactgcatgaggctgaggctgtctcttcggaccatgggacgcagtggtccagcagtgcccgtgccggctgcagtctgccccttgtcaggtcatcactttggcactgctcattccagcacacagcatttcaggcctttccctcccttatggacacatatatgcgtccccactccccctgacacagacacccttcagtagtaccatgtccaaggttcctctctccttcagacctgcccagtctttctgttgtgtaacaaagatcccacaacaaagtgttatctcagatctaactcaatcctctcactgattggccctttaattggaaaggctgcatgtgtcccaagtcttatcaataaggagcacagctcatttacaggcatgggatttctccaggactatgacttctgattctcttctgtggcagtcaacaaaactgagtgctgatgtcacactggttcctttagggatataaatccactggtaaatttataccccctgaccagcaatgtacagagtccctggagatctacactaaagctaccacaaactggtagtaatgcaatttagtgtcaagtgttctctgaaggaaggatttgttataagaaacctaactacacattcacgatactctttattatgacccacaagacctgctgtgatctggcctgtctacctcactacctttacctggtacccaacatgtaccccagaccccttggccaccttctggttcctaaattctccaagttccttctggcctcaagagacagttcgcttcacatgctttctccatcccaacactttattctctcttctggggctctattctctcttccaatgctacccctacacagcgggctcctcatctgtcaggtgtcagcacgctgcttacttcccttcattgcattcaatacatctgactccactcttaagtggtagttgaacaatgagaacacatggacacagggaggggaacatcacacaccggggcctgtcagggtgtgggggagggatagcattaggagaaatacctaatgtagatgacgggttgttgggtgcagcaaaccaccatggcacgtgtgtatacctatgtaacaaacctgcacattctgcacatgtatctcagaacttaaagtgtacatatatatatatatatatataaataaatctgactccccacctcttcccttccccacttacaactagaccagccccatgtccacagtggacctcattccttcatactaaagctccactggaacaagctttgaactttaagaggcaaagaactgctcaacaaaaacctactaattatgaagggaaaaattatctttacgaggaagaaatctggtggtcaacaccttaccaagtggtcaaacagccccagtgatgggacaaggggatacaatgtactccctgatgtgacgtactccctgatgtgacgtactccctgatgtgacgccttgagaaagacacagccctaccaaaatcctagaaaacatgtttaacatgaatcagatcaaaaggaaacaaacaatacatcaaaactaagacattctgcaaatcaattggcctagattcttcactaatatcagtatcacaaaggacaacaaaagttgtaggaactgttctagtttaaaggaaacagaagagatatgacagctgaatgtaatgtgcaatggatgattaaaaatacagctataaaggatattactgggataattgggaagttttgcatacggagtatattagatagtatttttgtaataatttaaattttgctgagagcaatcttgtagtgtggttgtgtagagcaatatatatcacactgaatttatgtgctgtggaagtatttagggatgaaatctaatgatgagtacaactaaatctcaaatggttcagaaatatgtgtgtgtgctcgtatgtattttacataaaacaaatatgtcacaatgttaactggtgaatctaaatgaagggtatatggttgttcattatactattctagcaatttttctgtaagtttgaaatttttttcaataaaaaaagttgggggggggggggtgccaggcaggtggctcatgcccggccaaagagtaatcccagcactttgggaagccaagggtgggcagattacttgagctcaggagttcgagatcatcctgggcaacatggtgaaaccctatctctactaaaaatacaaaaaaaaaaaaaaaattagctgtgggtggcagcgcatatctgtggtaccagctactagggaggctgaggtcaggggagcccaggaggcagaggctgcagtgagctgagattgtgccactgcactctatctagcctgggcgatagagagagacctgtctcaaaaaagagttgggaaggaaaaagggaaacaaagttaagtgcttccaaatatgatttaaaaatgtttatagagtaacagtacatcaagcaagtcagtggtgaagtggggaacagccggggaaacagagaaaataaaacgagtagaaatacagagaccgttcccagtctttttgttgttgttgttgttttgttttttttttttttttttgagacagagttcagagtttcactcttgttatccaggctggagtgcaatggtatgatctcggctcactgcaacctccgcctcccgggttcaagtgattctcctgcctcagcctccccagtagctggaattacagacgtgcaccaccacgcccagctaatttttgtattattagtagagacaggatttcaccatattggccaggctgggcttgaactcctgaccccaggtgatccacccgcctcgacctcccaaagtgttgggattacgggcgtgagccactgtgtccggccccccagtcttataatctaactagaaacaaaaaaatacataggtgcaaacttcagaaaataacacaacagccttaaactgtgttatcctgagcacgagtgcaaagtatcaatttcaaatcaggagctacaggtaggagatgtcaggtctcaatttgaactatgccttgaaagacaggcaggactgtagtcacaatgaatagaagagggactccaggtaggagtggagaaccatgaacttctcagaggccagaatgcatgtgacatgtgcagatgaatatgtccctgcctgaagcccagagggtggtatgaaggctcagtgtagagcagtgggcagggccaaggtcagaaggttttaaaagctgagctgttttatgcaggataaagttgacaggggtagaaagtaagaacagaaagaccaaggagaattgatttcaagggacatagggaagctataggatagcataaggaactaaaaggtcatgaaaatttcaaatgaaattttgaaggaaggagagactctggggccagaatgaatactactgaggataaagaaaaatctgttgccaaggctgctacagaacacagtgtctgcatattaaattagaaaaaatgacctccctagtcctttccagacctttttttttttttttttttaagaaaggagtctcgttctgtcgcccaggctggagtgcagtggtgcgatctcggcttactgcaaactccacctcctgggttcaagtgattctcctgcctcagcctcctaagtagctggaactacaggcatgtgccaccacggatagctaatttttatatttttagtagagacagggtttcaacatgttggtcaggctggtctcaaactcctgacctcaagtgatccatctgcctcagcctgattgctaaatttcaagagaatggtatatacatagaaatcaaactcctttctcactctgtctaggcacttgtggctctggaatggcaagagggcacatattagcaaagcagtcacattagcagggaccagtgcatttctggaatgaccaatgggcagtttcataaaaactcaggtgtcaggctttaatgcactaggctccagatcctctagcccttggtttgagcttaaactcttggaaaacatgtaagaagcacaatggttcattactggggtaggagtccagccaagacacctatcttaacagtactgctctaaaacctcatgagatcaccaatgatcataaccaagcccttcaggcctatgacaaccatccacccgattatccaggcccaggaactctgaaggattccaaggtaaagaaagggactgatacattcttccacacctggcactgaaggatctgctagagcctgaggttccccaactcaaccaagtcactggcagggaagtctgcctgctggagacacaaatttagaaactaggctcattagctgtgttcagtgaaaagttgtgacacttcgcagaggagcacaggtttatccagtgcaggtgttctgtccagaacaccacccagaatttatttcctgatgtctcccagaataacatccttgtggcacctgatctaatccatacacataccgttggggaatgaagttggggagggggttatggggagacaaggcaggaccctgcatgggttgggtctatgggtgagaaggcaatgagatgctgaccagctccatggtggtagacacttgattctctcaatgggaagaattatctgcaagagtacaacagctgccaaaggagacctcactacctccaggtaaaattcttcagtggcacttctaaactccaagatttatttcttcctgaattccttttgaacacacatgcaaaaaaatcaaaacagatttcttgactacctatttttgaggagataaaaacactgctggtcttgaaagccttagattacttctagagggactcttggtgacaagaagcagaggaaggcagctacggctcagaggcaggaatggaatgccagctgtgaaagagacaactgctagcctggaattttctgaaagccaaacttgtcctaagagctagatacatccccaccaaggctcaaagacttagccggccagcgtgagaagagtagagtcacaaagccacaggaacaaatcatttgtggcttcaccagctgcctcccttcctagcagaaaccagaactgccttttccaaaagaaatgagtattggtaaaaggtgctggagctcagaccagagcacctcactcaagcttaactggatcctttttaaggaaataaataggaactctagttcgggtcatcctcacacacttcctgttccctaaatctcagcgcacagtgtggaagtggatcatccttcaggcaaagctgcagagatgcctgcaccaagagcaccctactgcctcccatctgggcttttacatacttgaggacagaagagggctgcacagtagaaaacaaatggtggaggttaaagaagtctacccagaaggaaaggctcatgaatagagaatttattacaacagagggaaggaagaattctagtcattttttttaaacgttgagataggatcttgctatgttgcccaggctggtcttgaattcctggcctcaagcaatcccccaacctgtgcctcccgagtagctgggaccacaggcacataccatcacaccctggctaattttttttttttttttttttttgagacagagtctcactctgtcgcccaggctggagtgcagtggcacaatctcagctcactgcaagctccgcctcccaggttcacgccattctcctgcctcagcctcccaagtagctgggactacaggcacctgccaccacgcccggctaattttttttttgttatttttagtagagacggggtttcaccgtgttagcaccctggctaattttttatttttatttttttgtagagatggggtctcattatgttgcttaggccaggctcaagcgagccagcctcctgcctcagcctcccaaagtggtgggattacaggtgtgagccactgcagccaactacacttctgttattagtatatttacatatttggttcagttatactcagaggcccctaaggtgatgaactatgacttacccagagtatttaaaacagtgtctggcacatagtaggtattctataaatgctgatgctttgaaataatcttactgaggtggcctttgcaaattcacatttgaagtcaaatatttactgaataataattacagattgggtattgtgctagctacttttccacataatctcatttaatccacagtattagcccactttatagataaggaaaccagcttagtagcctctctttggctatataacttttaactcctcattaaagctcttaataaccaataactcccacatctccctatccctcattgtagcaactcttgcctttgctttctctgggctcaggcacaaagcattgcaggagggaaaaaaagggggggggggtcacaaaaccatgtaggcttggcccactataaattcgtgcaatctcatgataacttgacttgctgccattcttcctgcctcacaggttcaatacctccaaatcctcctgttcactcaaccctgttttcaatcatcatagcctatcaaattgccctctgttgcttccctcatatctttgtgttcctttccattcaatggtctaaatccctagtatgtaaactacatcatgagcatgactggtcctgctctggtctcttctctcccctctcgttccacctggaatcctaccacaagaccagtcttcctaaaagagatttggatcatgtcattttcctatccaaaagccttcagttgttccctatgactacaggacaaggatagcactggcacacaaggccctctatgctctggtccaaagctatattttagttccttctactccccagcacaaactctctgccctggccaagccagctaatgaccagtctcccacacagccctttactcatactattcacctgcacctgcctagcctacccatgaatatcttcctctttctctctgcctggtgaaatcctgcccatgtttcaaggcttccatcatgaagccttccttgatgcagcctacaggacctctcctgcctctcaacacctagtgcacttaatgtccacactttcactggactctgggcatatatggaatctttccatctcctattacattttcataacttaaaggcaaggactatcttagagtcagttacacataataaacataataaacacagtgttttgactgacccaaactgtcttaaagtatttcctttagaataccatgagtgttaggccaggcgcggtggctcatgcctgtaatcccagcactttggaaggacaaggtgggcagatcacctgagatcaggaattcgagaccagcctggccaatatggtgaaaccccatctctactaaaaatacaaaaatttgccaggtgtggtggtgtgtgcctgtaatcccagctacatgggaggctaaggcaggagaatcacttgaactcagtaggtggaggttgcagtgagctgatactgcactactgcactccagcctgggtgccagagtaagactctgtctcaaaaaataataataaaatttaaaaaaaaattaaaaaaagaatcttatgagtgttgaataaagattcttctctgaagccttaccactttactaagcagtattctttggggagttctcaccactgaacacagagtgctcacacacatctagtgttttatatttaaacttaacacatgcacgtagaatcagtcttcaaagaatttcaaattacaagtctggatccagaaagaccctggccaatccagagtgtgatcactggacaccattatttagcagggcaggcccaagctagagaaatgtctgatgatccgtgactgcgggagacagaagccctgccaaagaacctgaaaggaatttccagagagaaaaaattggggttaaacaaagagctaaatttagttgcttcctgaatgtgttttcccaatcaatagacctaaaacaacactgttccccatcacaacacacacagctggcaaagagtactgccaagaggagtatgagcaattagtgaataatagcttatgtactgttggttgacaccacttagcatgaagtcaatatatagggcaccagcagcaagctgtcagaatcctaaatcccaagccatcaccaaatgggtaataaatatgttgttcttttgctaccatggggattagtacaaaagtacttggtattctaggacatgaatgccacaaggccagactgcgggagctctccaagttacttctgtaaactgctggtccattcctgagagactgcagtactaaagaaaagactacagagatgtccctcaacttacaatgagtgttatcccaataaacccatcataaattgaaaatatctaagttgaaaatgcatttaatacacctaacctaccaaacaaacatcatagttcagcctagcctaccttaaacctgctcagaacacttacactagcctacagttgggcaaaatcatctggcaaaacagtacactgtagaatactggttgtttactctcatgactgcacggctgactgctttgactcctgctgctgcccagcattagagaatatcatacctgcatatcgctagctcaggaaaagatctaaattaataatttcaactacagtttctactgactattgctttcacatcatcctagaatcaaaaaatgataagtctaaccattgtaagttggaggatcatctgtagtctatttgccattaaactgcccttctcttcttatatttttccttttttttttttttgagacagagtctcgctctgtcacccaggctggagtgcagtgctgcgatctccgctcactgcaagctccgcctcccaggttcacgccattctcccgcctcagcctcccaagtagctgggactacaggcgcccaccaccatgcccggctcatttttttgtatttttagtagagacggggtttcaccgtgttagccaggatggtctccatctcctgacctcgtgatccacacgcctcagccccccaaagtgctgggattacaggcatgagccactgcgcctggccttttcctcatttttattcacatttagaagagaaaaggagatgtgatgggtaaggtttttgtgttttttttttgagacagggtctgactctgtcacccaggctggagtacagtggcatgactttggctcattgcagccgcaacctcatgggctcagacgctcctacttcagcctcctgagtagctgggactacaggcacatgccaccgtgcccagctaatgttttctattgtttgtagagacagggtctcactttgttgcccaggctggtcttgaactcctgagttcaagcaatcctcccaccttggcctcccgaagtgctgggattacaggcatgagtcactgcacctggccaatggaaaaccctttaccagctgggcgtggtggctgacgcctgtaatcccagcactttgggaggccaaggcaggcagatcacttgaggccaggagtttgagaccagcctggccaacacggtgaaacctcgtctctactaaacatacaaaaattagccaggcatggtggcaggtgcctgtaatcccagctactcaggaggctgaggcaggagaatcgcttgaacctgggaggtagaggttgcggtgcgctgagagctgagatcacgccactgcactgcagcctggatgacaaaacaagactctgtctccaaaaaaaaaaaaaaaacctttacctctctgggcctcatgtcctcatctgtaaaatgaaaaaatcatactaggtgatcaactaacctaacactaacattttatgcttttagactgtttccctatatattctagtttgccttttttgatccaaacatttggatagcagatccaatggagaaagtgtccccagctctgcactgactgcccctcagtgaaaacctgcttgaggattgtgccttggaactcgaacacagagaaaacccccctgtagaagaagttgctcagtaagataactgcctgcttgctctatttccagcacagacgctgcttggcaaaagggcttcctttccactccttgtcactgttaagaacaaagagaaaaaccagatggcatgaagctgctgggcttctttccccctcattgtcatgaaccagtggagtgcaactggtcactacataccacaagacgccacacccaagtttctggctaaggaccagcacatgtggtttgtggtatgtttattgataggaaaataattttatatgacagaacttttcacttcagtcattaaaaacaaaagaagtgtgaagatcaagttggggagccagagtgtgtagcagaaaaaaatttctacctctgcttttgtccatgttagtaaatattttctcatgctctgttagttctgagaattctccctgattctcactgttattctcactcttagccacttgactccagggcagatcataatcttcccaagttaaaaaaatcctgcagtgtagggctgggcgcggtggctcacacctgtaatcccagcgctttgggaggccaaagcaggtggatcacgaggtcaggagttcaagaccagcctggccaacatagtgaaaccccatctctactaaaaatacaaaaaaattagccaggcatggtggtgtgtacctgtagtcccagctactcaggaggctgaggcaggagaatcgcttgaacccaggaggtggaggttggcagtgagcagagattgcgccattgcactccagcttgggcaacagagtgagacttcgtctcaaaaaaaaaaaaaaaaaatcctgcagtgtaaatagttccagggaaatcacacgctgcataaaccaacagcctcagcagcagcacttggactacagatatagagagctagcagcaggagcagcttcttttacaaagagggcagtaaaaaaggaagcagtcagaggtagatagttggctgatctggaggagtaccagacttaacagatgataactgcctttgaaaggcttaaaacctagcaatttaaattaaacccgattctgagctaggctgtttgcctttacacaggtgttaaaaatcgaaggacttcggcaagttacagtgtcactgtcactgccacttaaggaaaccaccttaataaacaggcatgcctaccagaatctgccagcaaaagactgacacagttcagcagcttgttttttttttagcagtctttcttagcctgacagttggcctatttttttttttcacatggaaagcacatgcaagctactatactcagcgaaaccaaatacaacagagtcctactattatctataaaaaaaaagccatgtctggctttcctccaaatgcaattagctgcgtccacagttctccttatagcagctaccagcattcaagatttatattccttatattccaaacttcaaaccaaaataaaaatattatactcaattccttctctacttactaaaatgattatgacttcccctttagctcttaggatcattcaataacaatggttttcaaaccatattccaagaggcccagttagtaatgtggtttgaggggaagggatgggacacggatgtgatgaattacctctctcacactgctttaatctgttttatatgccataggtttgaagaaaaggttctaatgctaaaaaaagaaacaataatcactgaggtaatagaactagattatcatctacaatgacctacataaggcactacactgttacatgaaattagccaactttcaatgtcctgggctaacaggagataagaacagcatagtaaagaaatgtaatttattaaaactctatttttagccaatgattccaatcatccatcttcaactgtttttttgcaacaacaaataattagtaaaacagagttgaagtctggtgaaatgtatgggcagtaatagagaagccaaagtgaaaatagatctgaatatttgaatctacatagcaggccctttgcctttagttgttactcacagcatactaaataagtggcaggccatatcctaccagatacaggatatacacagacatctacagaaattacccctccaccatggcagaatgctgttattggctgcaatccccaagagacaataataccgggccagccaccaagccacttaaattaattcctagtgtgagattctgactcagaagccaggtctttctgtttcaagcataatagaaaggcaacagcaaccagcaggatgtgggacctgatgcaactcacccgtgcagaactccttgctcacgttgtggggcactatgatccgtcgatagacaatgggctcggactccaagatgttctcatcatggcggtaccgagtgggcctttcatttgggatgccccgggaacgggtaccacttctcctttcataggtatcaatctcctcaaacacagctgccttgtcaaaaagagccaggttcccttcaaaatcaaaatctgtgtctgggatctcctcaatatcatccccgaagcactcgtcatctttattcttcatctggccattctttaaaccacttttcttgggagttgcctgatttgggtgcctgctactagatgaccctggagaaaaaatagggactaaagtcagtgtatccacagaaagcgctcagtgaacgtggaaaatacattagtcttttgtggagagtgttacaggaaccaatgtgaaaatggtaaaggtaactattgcaaactcatattaagtagcacaaacaacaaatctcatgtgcaataataggtttcaaacatcacccaatctgggcacagtggctcacgcctataatcccacattgggaggctgaggcaggaggatcgcttgtgcctaggagttcaaggctgcagtgagtgatgatcacgacactgcaccccagcctgggcaaagagcaagaatctgtctcaaaacacacacacacacacacacacacacacacacacaaacaacaacaaatattacccaagtaacttgttaatgaatatgaaataagcagtactcctggaaatcttaaccagttatccccttcataaggaaactggtaatgacaaaagtttttctgacaacttactattagcaaacaagaggaagagtaagaatatagcatggtggttttgacataatgacagaggcaggaggcagagaaattctagaggcgggtccctggcgaagccccacctttgaagctgaaaaggctgagactgtggcccaaagtgagaacttatatccctgttttcccactagaatgttgtcttttcttaaaccacccatggctctgcccccaccctatcctgtgcctataaagaccccagactcagtcagcagagatgagaaacagctggatgttggagactatggctggatgtcagagagaagtggcttgacttcagagggatagcttgactgtgtaactatggagaagaatttggctggagacagccagacttaaggggaaaattacctacccaccactgactgtccccttttcagctccccttcccacataaataaaaataaaatcacccacatttaccatcctttaattcattcatgtgacctcatttttcctggacactggacaaaagctcagaagccatgagtgcagatacaaaagactgtcacactgatcctttgccctcactggcagagggcagctgcaggcccactgagctgttaacacttaagccatctgtggatggcagagctaaaagagcaccataacacatcctctggggcttcaggagttgtagacaccccacctagatgctgccatatggcctgcacagagttcgctcctgctggtgcccagaagcgctcattctggctcctgcaccggctcacatgtgcactccctcccacaatgggtagaacacagtgggtctgagtgagtggagtttgatcccactggcactgaaacagacagccaggttccagtgcttgtgcactccagttcctgccttgttctctcgcacactcccttctgcaaggagttgagagcagtgcgtggagtaaacggggcacccctgtcatgagtcctgtgaataggtcagggaagggaaatatcctgcttcagtttgagtctgagtgtctggcagttgtttaagagagaaatacccccagagtaaaagaaggcctggtcttatagcctgaagcttgtaggaaaatactattcagctagtccttaaatctatgcttacccagcaagcaatcttctgatttttaatttggtcttaggctagatcccagcagcagggaatccctggtttgctcaaaaaattctacattctgagccaggtatacacctaccactacaaattgctattctgacttacaaacctttctttagacctttcggttaacgtgatctcttttctcagaattttatctcttgtgggtaagcagtttctgaaacaccaaataatgacagggtccatactgaactgatcctgtagaggccacactaatgcacatccacaacagagtagccagccacaccctgtctctgacaccttatttggctactacacatcagtcaacaactactctagcagccaaggcagaaggtctcacagaattctccaaaccacccacccccagagaatcaagctctggtctccatctgactaccctgaaaacgtgaatcaggtgactggtatgccagactgaacctctatcacagtctaaataaatggaatgtacttccttctgaaagactgggctcttcaattactgaaaacactcaagtcacggttagaatgatcccaagcaaagcccctcacatatactaaaccaactatgctgccctaactcttctcattgcaacctccttcaacccaaaggaccaagagtttggagagctaggatctagttctctcaccaaaatattatataatcttataccatcatctaacttctcagggtcttaacttcctgtatatagaatgctcactgtggttatctccagtagagtttctagcattaacaaattaatatcagcaagatcaattacaataattattctgaaaggtatacactatgcaaatacaatttatgcccaagtattcctaatgccttgtactggtgtggaaaaagtggtgatggcagtgaagatgcaatttacgtctctgaaaaaaaaaaaaaaaaaaaaaaaaaaaaaaccaaggccaggcgcgggggctcatgcctgtaatcccagcactttgggaggccgaggcaggcagatcatgaggtcaggagatcgagaccatcctggctaacacggtgaaaccttgtctctactaaaaatacaaaaaattagccaggcatggtggcatgcgcctgtagtcccagctactcaggaggctgaggcaggagaattgcttgaacccaggaggcggaggttgcagtgagctgagatgcaccactgcactccagcctgggtgacagagtgagactctgtccctaaaaaacaaaacaaaaacaaaacactaaggctgaccaaaattatgaaggtaaggcagagtggttgagacaccacagccagctagatgatgaaccactatgaagctagccacagtttgggttaagttctagttccaataatttgatgaagcactctgtgagagcacacttatgccatagctaggtgctaggatgataaaatacaaccaagacatgctgctcaacaaggagagagaagaaatatgttgggcacagtggctcaggcctgtaatcccagcactttgggaggccgaggtgggtgtatcacctgaggtcaggagttcaagaccagcctgatcaacatggtgaaatgccatctctactaaatacaaaaaattagccaggtgtggtggcgcatgcctgtaatcccagctacacgggaggctggggaaagaattgcttgaacccaggaaacggaggttacagtgagccaagattgtgccattccactccagcctgggcaacaagagcaaaacttcgactcaaaaaaataaataaataaaaaatagaaatatatatatatatatatatatataggcaaataatgaaaatatgatgtgattagagttagaaagaagtttatataaagtgccatagaaatatggatgagatgggctgggtacagtggctcatgcccaaatctcagcactttgggaggccaaggtgggcagatcacttgagcccaggagtttgagaccagcttgggcaacatagtgggacccctgtctttataaaaaaataaaaaaccacatgagaacacatcctggctaaaaaataaaataaaagagggctgggagcggtggctcatgcctgtaatcccagcactttgggaggctgaggtgggcggatcatgaggtcaggagatcgagaccatcctggccaacatggtgaaaccccgtctctactaaaaatacaaaaattagctgggcatggtggcgcgcacatgtagtcccagctacttggaaagctgaagcaggagaatcgcttgaacccaggaggcagagattgcagtgagccgagatcacgccactgcactccagcctggtgacagagcgagactctgtctcaaaagaaaaaaaaataaaataaaataaagagaaagaaatatggatgagactactcaggaggctgagatgggaggatcacttgagcccaggaggtcatggctgcagtgagccacagtccacaccacttgcactccggcctgagcaatatatatatgtatatgaccagcctgaccaacatggcaaaaccccgtctctactaaaaatacaaaaactagccaggcatggtggtgtgcacctgtaatcccagctacttgggaggctgaggtaggagaatcgctggaacccaggaggtggaggttgcagtgagctgagatcaagattgcgccactgcactccagccttggggacagagtgagactccgtctccaaaaatatatatatatatatatatgtgtgtgtgtgtgtgtgtatatgaaaatatatgcatatataatgatatttatatatatgaaaatatatacatatattttacatatgtgggtgaaaaagcagagctggatcaggaagacagaatgggtatgaaaatacaaggtcaggataacaccattagcaatatacacagacaagggaagaacaaaagaataaggattatcaacgtactgcctcaatattaaatcaaaacatcctattagaaataggtctcttgcccagtggtcactcttcagtgggtatgtgtttccccaggggtggacagaacgattcaccaggatgtaggaagaagatacggaatattctatttatttttattttaactaaaaacagtagaaattaaactttatgaattttaatgtattgatgaaaaccaggacccttatgaagttccatgccagccaattgctgcccatatttgagatatctgaggaaaatgtgacattccataacaagaagtctatccatgcaagtggttatacatcaattttttaaaattgcagtaaaatatacattacataaaatttaccattttaaccatttttaagtgtacagttcagtggcattaagtgcattcacactatacaaccatgccaatttttaactaaagcatacgaaaatgagtatgtggcttaaaaagatacttgtaaagaaactatatgttaaataacgataatactaatgtaatcataagtaaacaagaaaatggcagaacactttccctattcctcttacaggccttctttagctagaatgaggttgtcaaaaattaattaaatctatgaagatggtctcccaaattataaagtatcaagaaggtcattccaaacatgaatccacattaactattatgaattaacttcaccctaagtatatactctacatcaaaactctgcaaactatagctcatgggccaaatccaacccactgcctgtttctgtaaataaagttttattggcgcacagtcatggtctaggcaaagtgaaaagaacacagaggataatgtctagaaaatgtacacacggccaggggtggtgactcacacctgtaatcccaatactttgggaggccgaggtgggcagattacctgaggtcagaagttcgagaccagcactgggcgtggtggaatacacctgtaatcccagctactcaggaggctgaggcacgagaatcgcttgaacccgggaggtggagcttgcagtgagccaagatcgcgccactgcactccagcctgggcgacagggcgagactctgtctcaaaaaaaaaaaaagaaaaagaaaaagaaaaagaaaaaatgtacacacaatgcaaaaatgaaaaacaattcagtacagcacaatggtcaaataaataattcaaaggtaataggaaaggagtattcctttttaaaaataatgtttgttaacagatgttcataccaaatatgcagaaaattctaaatattcacataatattttgattttcttttagtaaaaaatttgcatccatcttataaagttttgtatcctgctttctcgcttaggagcatcctcgagtttcatgaaaaaattcttcaaatactgtatcttactttttatggccacataaatcatagatcataccatattgatatacagcacatggatcatacctactgattaacttttaagttatttctcatttttgctattacagactcggcccaaacacactatctttgactacccttgctaaaaaaatcactcccatctgaccacttacaacagtgtgcgttaccactgacctagcacttatgctacattacctactttgttctgtagttaatctgtgttcttgctctaacttcccaaggagtttataagccaacagagggcaggaatgatgtcattcatacctgtcacccaacactatgcccagttcagcgtaagtacacaaaactctgctgaattaagaaataaaaacagcaatatatatatatatatattttttttttaaaaagcaaacactagccaatcaaaagttagaagtctaaaaagaggttataaaaaaagggcaacttgagattaactacaagaaaaagcaataaaaatcatgccaactttgttacatgactgaaaaggccaggaagataaagttgttgacaataatataatataaaagagttacgaagcaagggcttcagtggaaaaacttcagtcatgtccaatatgaactgaaaatgaactatcctggaactattacaatgactgatgaaaataagcagttgatcagtgaaggagaagacagggttaaggaagcaaaatgggaaatcactcccattcagataaaacccaaagctcctgaaaccaggtgaccaagaataaagctcagaggaaacaggatacagacactgctaaagaggaacaggtagaggcacaaaaacagttataggagaaaacaggaaagaatctagaatccaaagacccaaatactctgaaggcaggtcagacttgccaaatgacactggtagaaggccagttatcctggaactaaagtttgaaaagcatgagctggcctggcgcagtggctcaacacctgtaatcccagcactgtgggaggccaaggcgggtggatcacctgagctcaggagttcgagaccaacctggccaacatggtgaaaccctgtctctgctaaaaatacaaaaattagccaggtgtggtggcaggcacctgtaatcccagctactccagaggctgaggcaggagaattcgcttgaagccaggaggtggaggttgcagtgagccgagatggcgccactgcactccagcctgggtgacagagcaagactccgtctcaaaaaataaataaataaataaaaaataaaatgtaaagaaaaagaaaaagaaaagcataagttgcttctctaaccactagcccagtatttgttagccctaagcagtgcgctaaccactgaacaccaatatgaatgttcaaaagcacaagctgagcatccctaatccaaacatccaaaatccaaaaatttctgagcgccaacgtgatgttcaaagaaaatgctgattggagcattttggatttctggattagggatgctcaactggtatgtattccagaaatactccaaaatcctttttaaaaaatccaaaatctgaaacacttctggtcccaagcgttttgcgttaagagatacgcaacttttatttgggaggagagagtgcagcatagaaagaaaacttttgttcagtttcaaaaaaaaaaaaaaaaaagctaataaatagtacccacttcatatcatgccacatgatgaggagctattgaaatgcaaagtagaaaagtaaagaaaacaaacatgactagctgtaaagttcgttcacagcatgttgacaaagtgccccactataaagactaacagggtccacagtgggagacgccttaattctgccttaatgatgctgggcactggtcatcattttctggctcaactgtaggactctacaaacataacttacaacaaaacccagagatgttgtatgaagaaggtttcaggtgttttcctgtactcctctaaatgcagagttgattcattcatttgagacatagacactaaggactagctatgttctaaacactgtcaggaaagcagagtgtgaaaaatatttcccaagaggaaatactgacatcacaggtcagtaagagaaagataagagaacataaaataaatgcaaggcaggctaatgtgctcagttgtctcttattcttccctttcctcatactttaatacaaatattaggaagtcctgagtgaacaagctgtctcagtacttggcttactcatcccaaagggcctggctctgcattaaactggcctttggccactgcgagagaaaagcacttcccttggaaaagacaaacagtcttcccagatttctttacctttcaattacaagggccatgcaagtactgcaggctggctgccttcctgtgccgtttttctgccaccctttggcacagaggccctttggccaggacaacttgtaacaaacccattgttgtgtaaccctcagtgccacttatttattggtttttgtcacacacacactgtaagtgggaactttgtcctgcacttatcacactaaagggtacctgaatgttaaactacaaatgttttactgccagattaaacaggcatcatgagaaggtgcctgagaatatatgggaccttcttctcaactctcaaattctaggccctgggttttcaagcctattagatatatgaagcacatccaaggaagtttaaaagtcaagaaaacctcagtagaaccatgaaaacctggcaaaattcacttcctgcctcaggtggtgggatgactgttaaaatgaacagaccgttaaagcccaaccatactgcaacaagataatatcgaccatctttccatttaaaaggttcaattccatccctcatttctctccacctccagtaacaaagagaaaaagggaaatcagcactaaacagaggcactgtcatgcctataggaccacctctctctaaatataaatgagttaaaggccagctatctactttgtttgttttgagatgcagtttcactcttgttgcccaagctggagtgcaatggcacgatctcggctcactgcagcctccacctcccgggttcaagcaattctccctgcctcagcctcccaagtagttgggattacaggcatgcaccaccaggcccagctaattttttgtatttttagtagagacagggtttcgtcatgttggccagtctggtctcgaactcctggcctcaggtgatctgcccacctcagtctcccaaagtgctgggattagagacatcagccatcatgcccagcctcagctatctactttcatgttctacaggcaaaagagccttaacttaactgttaaatttttattcaactgcatgttacaatgactattcaagctcatagactaagatttcagagagggatgcctttcatctgcccctcatggtcaccattttcagctgtgacatgggatttgataaatatgaattatacccatacacagagctgcaccctaaacaaggcttggtttccctctgctccctgggactgatgttatgtctatttgacaaacattctgaatggtcacagaaaaactattctttacatgattctttaaacccactcccacccgaaaagagattaaaatctgcttgtgctaaatcatcagtgttggattagctaactattataaaccaacaaattcctcaactccttattgcaatcctgaaagaacacttaaaagccagaactgaagacagattatatttctttctttcctttttttttttttttttgagacagagttttgctttgttgcccaggctggagggcagtggcacaatctcagctcactgcaacctccgactcccaggttcaggcaattcttgtgcctcagtctcctgagtagctggcattacaggcacccaccaccacacccagctgattttttgtatttgtgtacagacggggtttcaccatgttgcctaggctggtctcaaactcctgagctcaggcaacctgcccgtcccagcctccgaaagtgttaagattacaggcataagccaccacacccggccgacagattatatttctatagcttcatcaatctactagtctcaatatcaatgtacataaactggagaaaattctaaggcagacctttttacttacagggctcaatgagtggaaaaataattataactctaccttctatcagaaacctattctgagccacgtcttattgccattcccaggccacaaacattttccaaactaatctggattctacataagtttcttgaaaaatagtaacattttactgccctatgatctctttacctcatttatgtacagttaacaatctagaaaaaggaaactgacaaaacagcaaaagcagaataaccaaaacctggaagccaccaagatgtcctgcaataggtgaatgggtaaacaaattgatatatccacacaatggaacattatccgtcaattaaagaaatgacctatcaagtcacaaaacgacatgaatgaatcttaaatgcatcttgctaagtgaaagaagccagtctgaaaagggctacatactgtatgattttaattatgtgatattctggaaaaatgcaaaactgcagggatggtataataaaaagatcagtagttgccagggggaagtgggggaagttgaacaggtaaggcacaagagattgtttaggacaatgaaactattctgtttaatactgtaatgacagatacatgatgctatgtatttgtcaaaacccacagaattttacagcacaaagagtgagccttagtgtttgcaaatttttaaaaatcatttaggaggttagaagatcccaggatggaatgcagaatgtgataaaacaaattaattgtattatgaatatatgaaacaagtcaatgaaggaaatgggagacctaaataactctagaaatgaatggagtcagatgaaaggcaaaagaaacagtacgtaagcaccacattctgtttgatagtctcccacaggaatggcgatacaagttaataattctgataccactatacatgtatactggaattgaataattatgtaaagaatgaatgacaataggagacaggtttctcactgttggagtgagaagtaacagacaagcaaaaggagaaggctagaaggatccatgtggtaatggattaaagttggagacatcagtatgaactcatacttagtatagtacaatatacatagttacatatagaaatatttaaatatgtatatatatgctggttaaatatacacacatatattttcttttctgtgaactctgcagagaagtatacacattttcttgctgtcagctataagggtgacacccaggagcaatgagcatccctagtgaagaagaaagaaaggagaaggggggaggagggagggggagagggagggggtggagggaggaggagggaggaggaggaggaggagaagcagcagcagcagcagtagtagtagtagtagtggtagtagtaagcatctttcagtgtgagaaagtacctaagtactaaaaaaaaaaaaaaataaaatccacaatgattggagtatgtcaaagggacatgagatccaagtgaaagattggagactagccaaaactgaaataatttgagtaccaaaataaagtaatattgaattataagccaaagtataaaataaatacccatgagtacatgctgatataaataaatgactgaataaataaacaaatgggggagaagagaggaatctctggcataaaagaattccaagtaatgtctgaagatgctgtgtcctcaaggagaggggacataacttctcactccctgggtgtgggctgcacatagtgatttccttccaaagagtacatatgtaaaggggaagaaagagtcactttacagaggagaaactagatatatcctactttagccaggtgatcaaggtgaacatcaaaagttataaaccatggtgataatatatacacttgacacaaggtgatgaaaatggtactttacctctgttgtcttccacccccaaacatataaccccagtctaatcatgatttaaacatcaagtaccaactgagagacattctacaaaatacctgaccagtattcatcaaaatgtctaggtcatcaaaaacaaggaaggtctgagaaactgtaagagccaagcagagaaatgactaccaaatatgatgtgatatgctggacaggatcctgaaacaagggcatccgggtaaaaactaaggcaatctgaataaaatatggactttgtttaatgataatgcatcaacattggttcaataattataacaagtataccatacaaatgtaagacgttaataacggggaaaaatgtgtagaaaaaaataatatgaattgctaataagggtcatcttcaagtgcacggaagattataaactgcctatttgaacttctaacaaatcaacaatttctgctaaaagaaaaaagattttcagacagggcaacatagtgagaccttgtctctactaaaagtaaaaagactagccaggtatggtggcacacacctgtagtcccagctactcaggaggctgaggtgggaggatcatttgagcctgggagttcaaggctgtagtgagctgtgatcgtatcactgcattccaacctgagtgacaaagcaagaccctgtctcaaaaatgaatgaaagaaagaaagaaagaaagaaagaaagaaagaaaaaggttaaagtctaaatggaaagaatcattttctatccaagcattctacagtttttctaaggatacagaagtcacaactgaatttcagtctcatatttgcaaacatcgtcatttcagatagttgtttcatatgcaccaaaggaaactaccttgaaactgtatattacatacattaaaacatttttttaggccaggtgcagtggctcacgtctgtaatcccagcacttggggaggccgaggcaggcagatcaactgaggtcatgagttcgaaatcagcttgggcaacatggcattatcccatctctactaaaaatacaaaaattagccgggcgcagtggcttatgcctgtaatctcagcactttgggaggccgagagtttgagaccagcctgaccaacatggagccccgtttctactaaaaatacaaaattagccagacgtggtggcacatgcctgtaatcccagctactcgggaggctgaggcaggagaatcttttgaacccaggaggcggaagttgcggtgagccaagatcacgccattgcactccagcctgggcaataagagcgaaactctgtctcaaaaaaaaaaaaaaaaaaattagccgggcatggcagcaagtgcctgtagtaccagcttctagggaggctgaggcaggagaatcacctgaacatgggaggtggaggttgcagtgagccaagatcacaccactgcactccagcccgggcaacagagcaaggctccatctcaaaaaaaaaaaaaaattagttttaatttagttgtttattcacttgaatcaggcatctccaaaacttaaaatgttggcccctgacacaggtgtcacaccacaagctactaatagaattcacccagcacactaaaaccttactacattgccaccaggaccacagtgtgaggagcaacaatggtagcaagaagtatccggaattttatgtaataaactttctgagtggggtctagagagacctagctcactctaaattgtgccttttagaaggtattgccatagcatgactctagcttataattttaaatgagttaatgaatactcatttaaaatttcttttggttgttcattttgagacagtctcacactgtcacccaggctgaagtgcagtggcatgatcttggctaatcacaacctccgcctccctggctcaagccatccttccacctcagcctcctgagtagctgggaccacaggtgcacgctgccacgcccagctaattttttttttttttttttttttttttttgtagggatggggttttgccatgttgctcaggctggtctcgaactcctgggctcaagcgatccacctgccccagcctcctgaagtagtgagattacaggtgtgagccacttgcacccagcctctcacttaaaatttctaatacattctgctaccatctgtgagtacaaaaccatctaagtaaaataagaatagtttggcatttggaagtaattttttaaaacaacattcatattaatttaaggagcataacagattccagtgaatgttatgattcgctattgtaacattattctagtaaatatgttggagaagaacagttctagtgaattaactatggttttggaaggcagctatgctcaccatcataccaccaacacaactatggttttattttatattatttattttatttttgagacagagtctcgctctatcgcccaggctggagtggcacaatatcagctcactgcaacctctgcctcctgggttcaagggattctcctgcctcagcctccaaagtagctgggattacaggcatgcacctccacgtccggataatttttgtatttttagcagagacgaggtttcaacatgttggccaggctggcctcaaacgcctgacctcaggtgatctgcccgcctcagcctcccaaagtgctaggattacaggtgtgagccaccgtgcctggtcacaactatggttttataatcagcaaatggcatttaataatgtgttagtatcaaacaaaactgggcagcaacagagaccaatgcacattcttcttggtgtgtcagtaggaacaaatacagcaaattaaaaattgtctgctagaaaatcaaagatcacagagatgtttggatcagtcccctcctctcttctgaggatgagactcaaatcacaggaagaaaagttactcaagaatcctctggaacagcccaagtgcaggttcaactcaaacactactaccaacatcagtaacaggatttaagtttttttttttttctttttcagaaacagaatctcactattttgcccagactagccttgaactcctgggctcaaacaatcctcctgcctcaacctctcaagtagctgggactatagatgcgtgccaccacgcccagtagttcctggatttaaaacatcactgttagtaaactctgggcagacttttcctgaaggaagtggtaagagagggcaggaagctcacaggcatccctaacagcttatttcctttcccttaacatcttgaggaatgaggcctggaggaagagaaccatgttgtatttctgtgacgctcagccagcatccattttattggaataacaaaggatttgtttaaagagcagcagtgcttatggcttatagccctgaaacaccagattgagaagaaatatcaacttgaccctacttacaggagttgtgccgacgacggaaacttttggactgactcaaggattccatgtgcctgtcgacatagctctttgagcactgttgctgctgcggggaaacggcaacatcctggctcttcacatctgtcctcttagggatattctgaggggcactgctggaagaggctggcttcttgacaaacttgcctgtgccattctgattgatgcccacttggcagccagcaccagaggggcctaattctgtttgatgaaggtctccaaaatgttggttgtctccaggtcctggtatctccagaatttttaactccgtaatgtcacctgccctgaaatacacaaaaaagccaagtctcaaaattataatagtggtaagaatgatgaaactgagatcattagcaaacagctacccctttgcaggactgcattttattgagttatcagaggctaggaaagggggctgtgtgcttaaggacaggggtcagccaccaactatccaactgacacaatgctagcctttaaaaagaggctattggccgggcacggtggctcacgcctgtaatcccagcactttgggaggccgaggcgggcggatcacgaggtcaggagatcgagaccatcccggctaaaacggtgaaaccccgtctctactaaaaatacaaaaaaaaaaaaaattagccgggcatagtggcgggcacctgtagtcccagctacttgggaggctgaggcaggagaatggcgtgaacccgggaggcggagcttgcagtgagccgagatcccgccactgcactccagcctgggcgacagagcgagactctgtctcaaaaaaaaaaaaaaaaaaaagagaggctattgctaacaacaaaactgtattaatcttacattcccacaatgtttaatggcttttgttcattcattcactccctcgctcattcaacaggagtatataaaatacttactatgtggtaagccctgcactatgaactattttgatctggtatatagagatgaaaaccactacgtgcccacaggaactcagtctggtcagtggaaaagacaagtacatattcaatcaaaagtgttaaatggactgggcaccatggctcatgcctataatcccagcattttgggaggccgaggcaggcgaatcacttgaggccaggagttcgagaccagcctggtcaacatggcaaaaccctgtctcaactaaatagaaatgattagtcgggtgtggtggtacgcacctgcaatcctagctacccaggaggctgaggcatgagaatcgtttcaccctgggaggcaaaggttacagtgagcagagatcgcaccactgcactccagcctgggcaacaaagtgagactctgtctcaaaaaaaaaaaatttttttttttaagtgttaaatgttatgacagaggtgtgcataggagactagagagcctaaaagcaaaatatttaagtcagtctggtggagatgaatgcaatacttaagctaaatctggccagggcagggggaatgagtggctaagcaaagaacagcagggagaaaggcatctcaggtaggggctcagagactgaggaaatgtagaaaatatggcccacgtgaggaactgcaagtgttatggtgatactaaagggacggatgttgtggaaggccatcaggaagtaaggttgcagaggtaaccaaggaccacatcatgatcacaatggattttcctggtggctatagggaaggagaagaaaaaagaggcagtggtaccagttagaagaccaagcaagaaataagaggggatgaaccaagcaagcggtaatacaaagggagaagggatcaagagacatttcgaatccatacgattttggcaactaactgaacacgaggattaaagagaaagaagagtttattatgactcctaagtttctaacataggggaaaggtgttattagtcataaataatgggtatgcccttggaaaaacaaatctacaggaaaacataacgagattagctccgaaaatcttgcatttaagatatcttgtgggatgtccaatggaaatgaccagcagacaaggtgtctgtctcataatgggactaaattaaagatttgaggtcttggctggggcatggtggctcacacctgtaatcccagcactttgggaggccgagaagggcagattacaaggtcaggagatcgagaccatcctggctaacacggtgaaaccccgtctctactaaaaatataaaaacaaaattagtcgggcatggtggcgggcacctgcagtcccagctactcgggaggctgaggcaggagaatggcatgaacccgggagatggagtttgcagtgagccaagatcgtgccactgcactccggcctgggtgacagagtgagactccatcaaaaaaaaaaaaaaaaaaaagatttgaggtctcattaacatatagagtacacaagagtttgtctagagaataaaagctgagaaaagaaccaaagatagaaccctgagtaattcaatcttaacaggtgagtagaagaaaaggaacataaaaaacaacaaaaaaagtaaaggaatggaggaatatgtggaatacatgcaaagaaaaaccaaagaggtgacagggaaactaaaggacagtactgtactttaaaagatagggagcattttatttttatttatttttttacagacagggtcttgctctattacccaggctggagtgcagtggtgctatcatagctcactgcagtctccaactcctaggctcaagtgatcttcctgtctgagccccaggagtagctgcgattacaggcacatgccaccacacccagctaatttttaaaatttttcttttgtaaagacgaggtctcactatgttgactagccagttttgaaatcctagcctcaagtgatactgctgccttggcctcccaaagtgctggaattacaggtataagccactgcacccatcagggagcattcaaatgagattgggattgagatactgtcagtgaatttggccattaggttatttgtaaccttggcaaaaactaattcagcaagatgacaaagttagaaaaaaagataatggtagggtacggaggttctagagaatgaagccacaaaagatagagaaagcagattatttggctctgacaaggattatgggttaaagggaagggaaatgacacaacaatacctagtggcaaatgcaagatctaagggagagggttgtttttaataaaggggaggccaaggaatgaatatcggaatgcaaagaggaaataaacagtataggccgggcatggtggttcacacctgaaatcccagcacttcgggaggccacaacgggcagattacttgaggccagtagttcgagaccagcctggccaacacagtgaaaccccatctctactaaaaatacaaaaagcggccatatgccaagagaatactagcaatcagacctaggttcaagctccacagaccaccaggttggattcagaagagtcagtcaggacactcacctgaaggtgacttctggaacaagacacttcactccattatggaaaggccgggtgagagaaatggtctggctgacctgatccacagctgacactcttccctgatagacacccaagctatctccacaattgatggacacaatacttcccagccaatctgtagccatgtttcacacgtgagaccactgtgaagagaaggaactattcagtgtgccttggtgaaaagacaaacttttaattaaattcagcaaatatatcaggctctgtaccaagtgttggttaataaaacatattctatcacattgttaactgaggtaataaatcttaaaaaaattaaaattttttttcaggagtatgaatattaaaaaataatattatttaatacatataaagatcttataattgctttaaagcgcatacattggataaagatatttattacacatcaaatcacacaaactataatctgtttatattgtattttaataaatctgctgtcaaaatgttttcaaagagagtatgttgctgagaaataatatattaaaaaaacaaattactgataatgccactcttgctgatgatgataataataataataattaataataatagtaaattctggatagttgttttttttttttttgagacggagtttcactattgttgcccaggctggagtgcaatggtgcgaggcgggcagatcacgaggtcacgagatcaagaccatcctggctaacacggtgaaaccccgtctctactaaaatatacaaaaaattagccaggcgtggtggcgggtgcctgtagtcccagctacccgggaagctgaggcaggagaatggcgtcaacccaggaggcggaggttgcagtgagccgagatcacaccactgcactccagcctgggcgacagagagagactctgcctcaaaaaaaaaaaaaagaaatttttttaaagccaattgaaggtactatagaacactaaacctaacgactacagaatatatatccttttcaagtctacatagaatgttcacgcatatatgctgggccttaaacaagtatgaataaatttaaaaagactgagatcacataaaatatattctctacccacaacagaattaaatttgaaattgataaaaatagatatttagaatattcccaaatatttggaaattaagcaagacatttccaaataacctatgggtaaaagaagaaatcaaaagggcagtcagaaaatagttctaactcaacgataatgaaaacacaacatcaacttttgtatgacatgcttaatatagtgcgtaaaagggggaatttataactttaagtgcttgttaggaaagaaaggtctaaaatcaattgtctaagcttccatcttaagtattagtaaaaaaagaacagattaacctgatgttaatagaaaggaaatcaagagcagaaaccaatgaaacaagaaacaactaagaaaaataaaacaaaaattagctctttgaaaatattaataaagttggtaaacacctaataaagaaaaaagataaaacacatattattaatatcagaaatgaacaaagagacatcatagacattaaaaaataaccttatgccagcaaatttgacaactagacaaaatggggaacttcttagacaaaagttatcaaaactgacacaagaaattaaaaatctgagtagctgcatgtctattttaaaaactgaatttatcaagagaataagacaagacacaaattaggagaaaatatttgtgaaagacatatttgataaaggtctgttatccataacataccaagaactcttaaaactcaacaataagaaaatgaacaacctgatgaaacaatgagcaagagacccaaaaggatacttcaccaaagaagacatggacacggcaggcaagcatatgaaaagatgctctacatcatatcatcagggaattaatggaaattaaaacaacaataagatgccactacacacctgtcagaatggccgaaatccaaaacactgacaacaccaaatgctgacgaggatgtggagcaacaaaaaccgtcattcattgctgacaggaatgcaaaatgatgcagccactttgagtatgcatttttctttttttttttgagatggagtcttactctgccgcccaggctggagtgcggtggcacaatctcagctcactgcaacctccacctcccgggttcaagcaattctcctgcctcagcctcctgagtagctgggattacaggcatgcaccaccacacctggctaatttttgtatttttagtagagacggggtttcaccatgttggtcaggctagtcttgaactcctgacctcatgatccacccgcctcacctcccaaagtgctgggattacaggcgtgagccaccatgcccagccttttttttttttttttttttggagactgagtctcactctatctttatcgcccaggctagagtgcagtggtacaatctcagctcattgcagcctctgcctcttcaatcaattctcctgcctcagccttccaagtagttgggactacagacacgtgccaccacacccagctaatttttgttgttgttttttttctcagtagaggggtttcaccatgttgcccaggctggtctcgaactcctgacctcaggtgatctgtctgcctcggcctcctaagtgctaggtttataggcatgagccactgtgcctagcttgcatatgcatattaataaggtagtttctcacaaaactaaatataccatctgatccagcaatcactctccttggtatttacccagatgaactgaaaacttacatccaccataaatctgcacgtggatgtttacagcagctttattcaaaattgctcaaattcggaagcaatcaagacatccttcagtaggtgaatggatgaatgaactatggcacacccagacagtggaatactattcagcacaaaaaagaaatgagctatcaagccatgaaaagacatggaggaaactgaaaagcacattactaagtgaaagaagccaatgtgaaaaggatacatacatactatatgattccagctacaaggttttctggaaaaggcaaaactatggagacagtaaaaggagcagtgggtgccagtggttagtggggtgggggtgggaggtgaacaagagaatttttagggcagtgaaactattctgtttgatactataatggtagatatgtgtcacttcaaaacccatagaatgtacaacaccaagagtgaaccctaatgttaactatggactctggatgacaacgaagtgtcagtgtaggttcatcaattgtaacaaacacgaccgtggtgtggaatgttgacagcagagagggcttactgggggacaacagtgagatatatgggaaccctctgtattttcggctcaatttttccctgaaactaaaactgctctaaaaaataaagtctatttaatagaaaaaaccaaattgattatgtaatttaaaaccttcctacaaagaaaaatccaggcctagatggctttactggctttttctttttaactaagtctgaactagacagctttactcgttaattttatccaacattttaggaaaaaaataatgtcaatctcatacaaacttttagaaaacacaggggaatgaggctggatgcaatggctcatgcctgtaatcccagcactttgggagactgaggcaggtggatcacttgagatcagcagtttgtgaccagcctggccaacatggtgaaaccctgcctctactaaaaatacaaaaattagccaggcatggtggcacgtgcctgtaatcccagctactcaagaggctgaggcagaagaatcgcttgaaatggggaggtggaggttgcagtgagctgagatcacaccattgcactacagcttgggcgacagagcgagactccgtctcagaaaaaaaaaaaaaaaaaggctgggcacagtggttcacacctgtaatcccagcactttgggaggctgaggagggtagatcacttgagttcaggagttcaagaccagcctggccaacatggtgaaaccccatctctactaaaaatacaaaaaaaaaaattagccaggtgtggtggtacacacctgtaatcccagctactcgagaggcagaggcaggagaatggcttgaacccaggaggggaggttgcagttagccaagatcgcgccactgcactccagcccaggtgacaaagcaagactctgtctcaaaaataaaaattaaaaaaaagaaagaagcatttcccaatttgttcaatgtagctagtataactctgacgtgaaagcctccccacaaaggctttataagaaaaagatcaacatcctgcacaaatatagaccaaaaatcctcaacaagatattaacaaatcaaatccagcaataaattttaaaagtctaatatatcacatatatttaggtccctactcctagaatgcaaaattggtttgatattttaaaaatcgatcaattttaaatcattttaacagaatgagaaaatcataaacgttatcacatcagtaaatacagaaatattatcttgataccaagacctgacaacaataagacaaaaacaaaactacagaatactatcccccatgaatgtaaacataaaattccttatcaaaatatcacccaacaattcaacaataatgatccaggctcagtggctcacacctgtaatcccagcactttgagaggccaaggtgggaggatagcttgaggccaggagtttgaaaccagcctgggcaacacagtgagaccttatttctaccaaaaaaaaaaaaaaaaaaaaaaaaacaggtgtagtggtgcataccagtaatctcagctacttgggagcctgaggcaggaagggagcttgggcccatgagtcagtggatggagtgagctatgatcacaccactgcactccagcctgggcaacaaagcaagacaccatctctaaaataaaagtaaaaaacaaaacaataaacataaagaattatacaccacacccagccaggtgtggtggctcacgcctgtaatcccagcactttgggaggccaaggtgggcggatcacgaggtcaggagatcaagaccatcttagctaacatggtgaaaccctgtctctactaaaaatacaaaaaattagccaggcgtggtggcgtgctcctgagtcccagctactcgagaggctgaggcaggagaatgatgggaacccaggaggaggaacttgcagtgagccacaatcacaccactgcactccagcctgggtgacagagcgagactccatctcaaaaaaaaaaaaaaaaaaaaaaaagatttatacaccacacccaggtggagtttattccaaggatgcaatgctgactcaagatcagaaagccaatcaatgtaatctaccatattaacaggctaaataagaaaaacacatgttcatagcaactgacacagaaatgcatttgacaaaatcgaacacccattcattctttttttaaaaagcctctcagaaaaatgggaatagagaggaacttcatcaatctggtaaagggatctaaaaagtccctacagctaacattatactaaatggtgaaagactgaatgctttccctataagaacatgaacaaggcaaagatatccactattactcaacacagctctagaagttctcgcaataaagcaagaaacagataaaaaaagtatacagtttgtaaaggaaaaaacaaaactatccccatttgcagatgacataactgtctatgtagaaattccccgtaatctacaaaaagtcttagaacaagtgagttcagcaagattgtgggatacaagataaacatacaaaagccaatcttatttcagtatattagcaatgaacacatgggcaatgaaatttaaaatacaataccatttacaattgctcaaaaaataaagtactaggtgtaaatctaaaaaaaaagggtacaggatttgtatactgaaaactatgcaacactgaggaaaaaatcaaaatgctaaatataacagatataacatgttcatggattaaaagactcgacaaaaagtacataaatcctcctcaaattggtataaaggatcaatgcaattcttatcaaaatcccagcaagatctgtagatatagacaaggttattctaaaatttacaaggaaaggcaaagaaactaaaatagctaaatcaatattttttttgagacggagactcactttgtcgcccaggctggagtgcagtggcgcaatctcggctcactgcaacctccacctcccgggtgcaagcagttttctgcttcagcctcccgagtagctggcattacaggtgcccaccaccacgcctggctaatttttgtatttttagtagagacagggtttcaccatcttcgccaggctggtcttgaactcctgaccccatgatccacccacctcagcctcccaaagtgctggattacaggcgtgagccaccacgcctggctgctaaatcaattttttataagaaagtgggaacaatcagtctacctgatttcaagacttacacaattatgataatcaagactatatagtattggcagagggacaaacatgtaaatcgataaaatagaaggcagaacccagaaacagactcacaaaaatatgcccaactgatttttgacaaagtgcaaaaacaattcaatgcaggcagcatagtttttacaacaaatagcgctggagcaaatgtaaatccatcagcaaaaaaatgaacctcaaactaaggttcacactttatacaaaaatttactcaaaatgtatcatgaacttaaatgtaaaacatcaaactctaaaacttttagaaaaaacataagagaaaccctcaagatctagggctaggcaaagagttcttagacttgacaccaaaagcacaatccataaaaagaaaagctggtcaactagacttcttgaaaattaaaatttttattccacaaaaaacaagtcacagactgggagaaaatacttgcaaaccacctatctgacaaagacaaaggagtagtatctaggaaatatacacctttcaaaatggctaaaatacagtgataacaccaagtgctagtaagaatgtggaaaaaatggatcactcatacattgctagtccaaatattgaatagtacagctactctggaaaacatcctggcaggttattaaaaaaactaaacatgcaataattagccaagtgtggtggcgcacacctgtaatcccagctatttgagtggctaaggcatgagaatcgcttgaacctgggaggcgcaggttgcagtgagccgtgatcccaccactgcactctagcctgagcaacagagactctgtctcaaaaaaagaaaaaacccaaggctgggcacggtggctcacgcctgtaatctcagcactttgagaggccaaggcgggtggatcacaacgtcaggagatcgagaccatcctggctaacacggtgaaaccccgtctctactaaaaatacaaaaaattagccgggcatggtggtgggctcctgtaatcccagctactcgggaggctgaggcaggagaatggcgtgaactgaagaggtggagcttgcagtgagccgagatggggccactgcactccagcctgggcaacagagcaagactccatctcaaaaaaaaaaaaaaaaaaaaccaaaaaactaaacatgcaactacaatatgacccagcagttgcacttctggtcatttatcccagagaaaggaagacctaggttcacacaaaaacctgtacgtgggctgggcgcagtggctcacgcctgtaatcccagcactttgggaggctgaggcaggtggatcacctgaggtcgggagttcgagaccagcctgaccagcatggagaaatcctgtctctactaaaaatacaaaactagctgggagcggtggcgcatgcctgtaatcccagctactcgggaggctgaggcgggagaatcgcttgaacctgggaggcagaggttgtggtgagcccagatcgcaccactgcactccattctgggcaacaagagcgaaactctgtctcagaaaaaaaataaaataaaataccctgtacacaagtgtttatatcacatttactcaaaaaagccacaaactggaaacaactcagataacctcaatgagtgaataaacaaacagtggtacattcataccacagggcaaaaagtaaaaatgccaaccccaagaggttgtgttctgtatgattccatttgtgtaacattcttgaaatgacaaagctatagaaatggagaacagggccgggcacagtggctgatgcctgtaatcccagcactttgggaggctgaggagggtggatcacctgaggtcaggagttcaaaaccagcctggccaacatggcgaagcctcgtctctaccaaaaatacaaaaattagcccggcgtggtggcaagcgcctatagtcccagctactcgggaggctgaggcaggagaatcacttgaacccaggaggcggaggtcgcagtgagctgaggtcaaggtcgtgacagtgtactccagcctgggcaacagagtagcaacatgggggactcttgtagtaatggaaatattttacatcttgaccatatcaatgtcaatatcctagtagtgatactgtattacagttttgcaagatgttaccaacaggggaaactgggtagggcataaggaatctctctgtattatttcttacaatggcatgtgaatctacaactatctcagaagtttaattaaaaaaaaaatcaatgccttgcatcacattaacaaaataagtgatgaaatcatgtataatcatatcaataaatgcagaaagataattggacaaaatttaacaatcattcactatatttaaaaaggggagggaaagctggcatctacaaaacaattacagctaacatgatacttaatggtgaaataggccaggcatggtggctcacacctgtaatctcagcactttcagaggctgaggcaagaagatcacagagctcaggagtttgaggttacagtgagctatgattgtaccactgcactccagcctgggcaacagagccagacactgtctttattttatatattttggttttttgtttctgttttttttttttttttttttggctcactgcagcctcctgggctcctgggctcaggtgatcctcccgcctcagcctcctgagtagctgggactataggtgtatgctaccatggccagctaatattttctgttttgtagagacagggtctcactttgctgcccaagctagtcttgacctcacagctcaattgatcctcccacctcaacttcctgagtagctgggactacaggcccacaccaccacacccagctaatttttgtattttttgtaagacagggttttgccatgttgcccaggtttccaactcctgagttcaagctatctgcctacctcggcctcccaaagtgctaagattacaggcatgggctaccatgcccagctgagactttgtctcaaaaaaaaaaaaaaaaaaaaaggtggggttgaaataaatgctttccccaagtactgaggatgaggcaaggatgtccactctcaccacttgtacttatattcaacaactgtaggtcctagccagtgtaataagacaagaaaaagaaaaaaaaaaacccagaaagttaaataaataataaagttaaataagacagtaaaactgtctttatttgcaatgacataattagctgtttacagtcaatccataaaaagtcctactagaactaataaggaaatttagcaaggtcacaggatatatgctcgatgtagaaaaaacaacaacagcagcaaacaactgaaaatgaaattttaggccaggcatggtggctcatgcctgtaatcccagcactttaggaggccaaggcttcccaaattttacacaagttattcctagaacactttccccagctctatgaatggttagttccatcctgcctttccgacatctggtaaaacatgaccatctcaaaaaagccttccctgtctacccaatctaacgtggctactcatcgttattctccaacaccttaaatcctgttatgatctcaaaatcaatcactatatgaattatcttgtttcttcatattgtgtgtgttggtcaggcatggtggttcatgcctgtaatctcagcattctgggaggctaaggtgggcagatggcttgagtccagaagtttgagaccagcctaggcaacatagggagaccccatctctgcaaaaaaattaaaaaaactagccaggcttggtggcacatgcctgtaatacaagctacagctactcagaatgctgagacaggaggaccacttgagcccggaaggtcaaggctgcaatgagccatgatcaggccactgcaccccagcctagatgacagagtgagaccctgtctcaaaacaaaaagtatatagatagatagatagatagtgtgtgtgtcaccccactagaataggacaaatgacatagtcttgttcagtcaataagagtgcctagagtggaagaagtcaataaatatttaatcaatcgatgaatgaattagaaataataaacgtgacagaagttactcaaaatctagagtacctacatgtttatatctaaatgtcttggctctttttgaaaatggttctaaaaaatacagtatccttgggcatactctatgcaaaatcctatataaggtatgaaacctaacacttccccactcacacgaggaagtcagaaaacagctagcagatgatagcagatgaatataaatacacatgttaagcacaaagtgaaacactggttcagtgtttttacattaaaaaaagaaaccagcacttgaaactgttttcaaatactaatttcagacataaaggagcaaaaaagcatataaagcacccctctggtaaaagagtatgtcctgactgagtgtgggggctcacgtttataattccagcagtttgggatgccaaggcaggtggatcacatgaggtcaggagttcgagaccagcctgaccaacatgatgaaaccccatatctactaaaaatacaaaattggccgggcgcagtggctcacgcctgtaatcccagcactttggaaggctgaggcaggtggatcacaaggtcaggagttcgagaccagcctgaccaacaaggtgaaaccccatctctactaaaaatacaaaaattagccaaatgcggtggcatgttcctgtaatcccagttactcaggaggctgaagcaggagaatcgcttgaacccgggaggcggaggatgcagtgggctgagatcgtgccattgcactccagcctgggcaacgagaacaagactcggtctcaaaaaaaaaaaattagccgggcatggtggtgcatgcctgtaatcccagctacttgggaggctgaggcaggggagtcacttgaaattgggaggcgaaggttgcagtgagctgagatcacaccattgcactccagcctgggcaacaagaacaagactccatctcaaaaaaaattaaataggccagccacggtggctcactcctataatcccagcactttcagaggccgaggcaggtggatcacctgaggagtttgagaccagcctggccaacatggtgaaaccccatctctactaaaaatacaaaaattagccaggtgtggtggtgggtgcctgtaatcccagctatttaggaggctgaggtgggaaaaccacttgaacccaagacgcagaggatacagtgagcagaaattgcgccactgcactccagcctgctaacaagagcaagactttgtctcaaaataaatacataaatgaagggaaaggggcaaaaaagcatatacagcactcctccaggccagccgcaatggctcacgcctataatcccagcactttgggaggccgacgtggacggcatggtggcatgcacctgtaatcccagctactcaggaggctgacaggataactgcttgaacccaagaggcggagcctgcagtgagccgacaccgcaccactgcactccagcctgggcaacagagcaagactccgtctagaaaaaaataaaaaataaataaaaataaagcactcctggctgggtgcagtggctcacagttgtaattccaggagtttgggaagccaaggcaggagcatcacttgagtccaggaattcaagaccaggctgggcaacacagcaagaccctgtctcaaaaaaaaaaacaaaaaacagtatgccccattagaaacactaagtctgaaagagtccagctctagggattaatcaaactctagatagttctctagtgatctaactgagccagtatcataaaactatgcggacagaaccgaagattaaaagaacaatgaattagcaggctcatacaggcttttttttgttacatttattatagaatgaaacagagccttgctctgtcgcccaggctagagtgcagtggcgcaatcttggctcactgcaacttctgcctcccaggttcaatcaggcaattctccttcctcagcctcctgagtagctgggactacaggcgcccgccaccacacccagctaatttttgtatttttagtagagatggggtttcaccatgttggccagactgatctcgaactcctgccttctggtgatctgctcacctcagcctctgcactaggattacaggcatgagccactgtgcctggcccttgggtaaattttcaatgcaacacaatttcaacaataatgatgatggtaaaaaagcacaaaatacacacattttaggcttcttttcccttcctgatcaacctttgcctaatgtcacaaaagcatgagtttcctttcctatcatttataatccatcataattctactcagatgcttagatagatgcagaataaaaagcaccagaaattaaccagatatgaaaaggcttttactgttttatttaacatatatctttaagacactgatgttgtgcattcaagtttatattatggtagtagtaactgaatagaatttttaacactttgaaaatgtggatactcgtttataagtgttcttctatgtagttaatattaatagaaacttttaaaaatataaccactgaatgtgtaacaaacttccctttcctcagaaacttcccttggtaaaatagcattattcaaaactcctcaaacaggtttattctataaagaaaattatgctatttacagaaaacagtaaatctaaaacaagtacagtgcccatcaactgggttcctaatcggactagggaaggggctccatcaattatacagctaacacctccacgtcaaaagaagtacaggagatacaggagctacaaggaaccaatcttgtcttttattttctacttttctatcaaggtataacatatacagtaagtcagtctacatattttaagtgtacacctccctgaaattttacatatcaattcacccatgtgaccaccactcaaaacaagacagactatttccaacacctcaaaaggctccattgtgtcctcctacaggtagttattattctgacatctatcatgaaagattatttgagcctgattttgagcttcacataaacagaatcataaaggttctctttcagagtgtttgtcttcttttgctcaaaagtacatctgtgaggccaggcatggtggctcatgcctgtaatcccagcactttgggaggccacggcgggtggatcacttgaggtcaagagttcaataccaatctagccaacatggcaaaaccctgtctctactaaaaatacaaaaaattagctgggcgtggtggcacatgcctgtaatcccagctactcaggaggctgaggcacaagaatcgcttgaactggggaggcggaggttgcagtgagccaagatcctgctactgcactccagtatgggtgacagagcgagatgctgtctcaaaaaaaaaaaaaaaaaaagtacatttgtgagattcatccccattgttgcatgtatcagaagtttattctttctcatagctgtgctgttttctgtaagcatgcctcaatgtatttatccattctactgctgatacatagttgggttatttctagttctgacttattacaaataatattcttaaactgtatacagtatatttctgcgatggacaaatacatccatttctactgggcatataacacaggaagtcatgttatatttatgactttattaggaaccactgaacagttttccaaagtggttgtaccattttgtattaccatctacatttatacaacccaccatacgtgagttctttctgctcctcatcttgccaaaacttggtactattgttctcttcaacttactcattctggtggggtgcaatggttttggtattttcttaaacatacttcttatttactcttgcttcattgatactgttattctcccaataaattattcctaaaattgtaatgactactgaattcagagatgttgtgaattactattcagtcaagaacttgctaccaaagttcatttagtcttatttgtcttccttctccctccatttcttttttttttttctttttttgagacggagtctcgctctttcgcccaggccggactgcagtggcactatctcagctcactgcaagctccgcctcctgggttcacaccatcctcccgcctcagcctcctgagtagctgggactacaggtgcccgccaccgcgcccggctaattttttgtatttttagtggagatggggtttcaccgtgttagccaggatggtctcgatctcctgacctcatgatccgcccgcctcggcctcccaaagtgctgggattacaggcgtgagccactgcgcccggccctgcctccatttcttaaacacctccaggtaagaatactttaattcatttaccactttgttcttatacaaataaacaagttgccaattacaaatctagctactttggaatatccttcatctcattaatacattactagtgtaagtttgctgacaggatttgatgtacaataaaaaaaaatacatcttccctgtaaagcctattcatgacaataaatccttcaaacaattccacttctaaaaaaaactaatttttctgtgtagtattcaacaatgttaaatatttcaaaaaaatgcaatgtttgtgcagctagctaaccaacacttattttgccaacttgttattaaaatctatcctaacaatctgtgtagctaggaagggagccacagatgtgacataatcaagattttccagattacttttaattatgggactattttgctcaaatgctgaactatcaggatttccagactactgaatgccagataagtaatgggactttatcattattctgataagcctttggataacaaagtcaggtagcgctaaacactcttccatctattatattactaaggcagcgcccaaatgatccataaattacaaataaacaagttgccaattacaaatctagctacctccatctctgtgccacatcagacaactcacagcattcagatccaataaacaacccttggcctgctaaaaacaattataattaacagctgtggatgagtgagtagttatagatttctgaaaaactaggaattgttccacacaacaggaaaggtgtttgtttaatcaaaatattgggaaaggcagagatcttaaaagaaaatatgcaacccagcatgatggctcaggccctacatcccagcactttgggaggctgaggcaggaggatcacttgaggccaggagtttcagaccagcctggacaacatagcaagactgtttccacccccaccccgcctcagaaaaagaaatccagcacaatcccctatctaaatccagtactaaacccatatcttccataaaaggcagcacggtgaaaagagaataaaattctgaaatcacactgggtgtggtggctcacgcctcaggtggctagtgtctgcaatcctagcactgtgggaggccaaggagggctgaccgcttgagcctaggagttcaaagccagcctgggcaacatggcaaaactctgtctctagaaaaaatacaaaaaattagtcagaagtgttgggaggcggaggttgcagtgagccaagattgcaccactgcactccagcctgggtggcagagcaagaccctgtctcaaaaaaaaaaaaaaagaaaaaaatgaaatcagacatcacagcccctggttcacttctgaacttccttactaaccagcactacgacctgggcaaattacctaatctgagtctcaactgcctcatctgtagggaattatgccaattatacacctatctcatagaaccactatatgaattattttaagatactatatggattattttaagatactatatggattattttaagattaaatgagataatccatatagtgtctacaacataaaaaattttagttcaaatgtctccttttgccagaaagaataccgatcacatagggaacttaagttatggcgctgtgagggccacctcacttctcacccaaacaaaattacaaaaatacatgaattccctctacaacatcttggaaatcaagtcctggtctttacactggaatacacatgtccgtagggggtacacaaagatatgcaagcaagggaatcaacttccatgctactctcataaacctgatctgtgtggataactagatgatcaattttaaattttcaggcataaaatttattactttaggatgggtaggaaaactacagccctaaaccagatctggtctgctaccaataaagttttattggaacacaactacacaaaaatacttgcatattatctacggctattttctgggtttttttgggtttttttgagacagtcttgctctgtcgtccaggctggagtgcagtggagcgatctcggctcactgcaacctccacctcccgggttcaagcgattctcctgcctcagcctcccaagtagctgggactacaggcgcccaccaacacgcccggctaattttttttgtattttttagtagaggcggggtttcactgtgttagccaggatggtctcgatctcctgacctcgtgatccgcctgcctcagtctcccaaagtgatgggattacaggcgtgagccaccgcacccggccacatattgtctatggctgttttctcactacagtgagaattaagcagtaatcacagaaaccatgtggcccataaagcctttcatctggcctttgacagaaagttgacttttgctttaggataaaattctgtgggaaaagtggaatggatacaagttcaaaaagaaaaaggaaaaatatgtaatggacaaactcccaaaatgataaaaatgaccaaaactaactcaactaactatattaagaaattgaattagtaaaatcttcccagagagaaaaacccaggcccataggacttcactggtaaattctatgaaacacgtaagaaataataccaatcctacacaaactatttcagaaaacagaggaggaaggaacacttcccaattcattttatgaggtcataattaccctgctactaaggccaaagatgacataaaaaaaaggaaacctcagaccaatatccatcatgaacacagtcacaaaaattaacaaaatgttagcaaattgaatccatctatatgtaaaaagtagtagatacattactaagcagggttcatttcacaaatgcaagatgggtttaacatctgaaaatcaagtaatgtaataagctatgttatgtatttcttacagtctttgtttcaaaagtttagttgtatgtttttacaacatcaaattgatattgtatttaggtaattttatatttatttttaagaagtcaatatttacttgtcagaaattacatcctaaactatttaaaattaaatacttacactatgtaaatctaggatgaaaagtttcaggtgccaacttaaaagtatataagatctaacagattccacagtcttttagacattctcaagaagaaatgttttaagactagtgacccagcctatacctgaaagcctgaaatgacaaggagaaaaataatcattcatgccaaagcaacaccaccatatcttcaaacttttgacttctgcccataaatttactcttagcacatctagatctaaacctaatattccaggtacaagcctaccagtgatgcaacctttctcattctagattttgcattttcctgatacaatatactaatgcaggtcacatcggttcttctcacagccttcttaaccacaccactgattggtgattaaaacatcacatctttttattatagaactcctgtgaggtcacatctccaccctcccctaataggtatagttgattttgtttggacccaagcgcaatttctcacatttatacatgcttccttcatttcattaaacagcactgagcaaattatattgagatcttttcccattctggcaatcaccaaccaaatgactctttctttacttcacaaaggcaccaaatccaataagcaaaccttctagataaggtctcaaatacatgaagtatataaagaaagtgatgaaaccccagtttagatcaccggaattccagctgtaagtagtgtccacaaatcaaacctctccatacatagattttcaaactcatgactccatctaactaccacaatctggcaaattcctccatctcgcccactcagttatagtaagactcagtaagaccaggcgcggtggctcacacctgtaatcccagcactttgggaggctgaggtgagtggatcacctgaggtcgggagttcgagaccagcccggccaacatggtgaaaccccatctctactgaaaatacaaaaattagccaggcgtggtggtgcatgcttgtagtcccaggtacttgggaggctgaggcaggagaatcgcttgaaccaggaggcagaggttacagtgagcagaaattgcaccactgcactccgtccaacctgggcaatggagtgagactccatctcaaaaaaaaaaacaaaaacttcataaatgccttgctaaaattctgacacactatcattatggtcactacactcctttgagccacaatttggatgtcctgtcctgttgttctggctgaatttaggagaactctagtaagcccttctctggataagaaaagaaaaatgatacatcttccattttgtattaattacagaatctcacaaatggcaaggattttaaacattttctaatgttgtttttcttagacagagtcttgctatgttgcccaggctggccttaagcaatcctcccaccactgcactcggccctagtctaatatttttcttttcttttctttttttgagaagtttagttcttgttgcccaggctggagtgcagtagcatatcttggctcactgcaacctctccctcccaggttcaagcgtttctcctgcctcagcctcccaaatagctgggattataggcacccaccaccacccagctaagttttgtatttttagtacatacggggtttcaccacgttgcccagactggtctccaactcctgacctcaggtgatccacccgcctcagcatcccaaagtgctgggattactggcgtgagccacagtgcccggccttaatatttttcaaactatacgtcatgacctattaggggtcagactcaatttagtgagttgcaaccaatatttttttagagtgcatcttctgtagaaagggtaagtaaacttttcattggtgtgtgtgtgtgtgtacacactgagtgtgcaggggcacaataagtcatgatgtataatatatctaactgtgggtcacaggtaaaaaattttgagacacttttctagccccacagccctatgccaaggaggctctaccaagaaattggtaataaacaaaatgtcatgtttttacatcatacagagaaactagctaagaggattttgtgctcagtacacgtaatctgccattcattaaaaaaaaaaaaaaagattaggatccatctgggtgtccagttgaaatactaaactgcttggagacagccatttctgttttggtggggtgaagacctgtatttgagacagcagactgaaatcggtttggtctgtggcgaaggaagagaagaaaaaccattctgggtcgcgagttcctcacctgtaaccacaggagaagactgttggcttggtcagttgattttcaactaatctcccaattgaagagttaggcgaagcaattgctattgggagattaactgaaaattaactgaccaagccaacaaggactatgcctcccacaaaccaaaacactttaaccactcagcaagtcaagtattgatacatacaatcaatatcacacaaagtgtactgaaaagaaccacagacttgcatcaaaggcagaaatgaatccagggataacttcctgggattcgaagatgtgacctggtaggtataaatttctcaggcatcctctttttctaccctccagttcatctccgtcctcaagctatcagtcatggatgtggcactggcgttcttctctgccaccgtatctcattatgcaaagggaaactgaggcacgaagaacagagtgagtgagccaaagaactgcagcagccaccaacaaggctggactaagggcccaagcagctaatgcctcactccccacacaatccccatactatttagaatcctgcagtcctcagccttccacctcaaaccaaactcctggggccgcccgtagtacgtggtcccctgctcatccgatgaagcccccagctcttgcctgcctgcctgcctctataaaggtctacgaggcctggaactctgaagcctaaagcaaccccggcagccccctcccacgaccgtccacaaaccagtagcctcccttcgctcccacctccgcgccgacgggcctggagctcctccgcacaccacaccaagccgaccactcaacaccagaggacccacagaagaattctctccacgcccacccccacagcatcggccttcaccaccgccgccgctgccggaagcgcccccacgtctccacgccaccaccgtga

SEQ ID NO: 974 - DNA, 65489 bp, Homo sapiens; identical to SEQ ID NO: 973

SEQ ID NO: 975 - DNA, 21116 bp, Homo sapiens; identical to SEQ ID NO: 971

SEQ ID NO: 976 - DNA, 65489 bp, Homo sapiens; identical to SEQ ID NO: 973

SEQ ID NO: 977 - DNA, 4378 bp, Homo sapiens
gagaaatctcctcaagccagagcctgtgctgtgaggggcttcgggaccttggggcagctcctgagttcagacagagttcaggaagggagacaggggcacagagagacagaggttcatggactgaggcaaaggctgggccaggctcagcaacccaggcctcccgcaggcaggcagaggctgccctgtaacccatggagaccagaccaacagctctgatgagctccacagtggctgcagctgcgcctgcagctggggctgcctccaggaaggagtctccaggcagatggggcctgggggaggatcccacaggtatggcttctcctggaggtagggttgggtctgggcccttggggagcagggtaagggccagaggttcgcagggaccatggaaggagccagaacaactcagacccagccccgccggctgtgggcaagggtggggtagcctgtgggtaaacccagaatcctagaaacacggtggggcggggatgggggttgggggcgggcaggctgcagagccaggacaggacagcctagccgatggggaaggaaagaacagagaagcgcccttagggcttaacagcacagaggtccctagtggcgttgacaagaatgtttctgtgggatgatggagcctgaagccacccacagagaagggatgggagctgggaaagtggagctagggctcggactcttgctgaaaattggccattgagggaggagagagggcaaggaatgggggtgggggctggggtgtggatgcacagtgagggagacacttctccagatggaagagtcacgcgtgggttcgttcaaatgcgggtgagcggggcctgaggactgggaaagggacccgagggaaggaggggagcgtgcagccctgccccggcccagccctgccctggcccagccctgccccctgcccctcaggcgtgagcccctcgctccagtgccgcgtgtgcggagacagcagcagcgggaagcactatggcatctatgcctgcaacggctgcagcggcttcttcaagaggagcgtacggcggaggctcatctacaggtgagtgcggtgggccctgctgggcgtctgcccctgaggggttctggaggggtgagggggtgctcaggggaagaggggcttgggcaaaaatgtccaagcccatggctcagggcatgggagggacactgacccctggggtctcctcttcacctgcaggtgccaggtgggggcagggatgtgccccgtggacaaggcccaccgcaaccagtgccaggcctgccggctgaagaagtgcctgcaggcggggatgaaccaggacggtgaggcgggggctggcccggggggaggtgacaagaaatgggcagcgggactggcgtgtcgtcctgacccttcctgcctccccagccgtgcagaacgagcgccagccgcgaagcacagcccaggtccacctggacagcatggagtccaacactgagtcccggccggagtccctggtggctcccccggccccggcagggcgcagcccacggggccccacacccatgtctgcagccagagccctgggccaccacttcatggccagccttataacagctgaaacctgtgctaagctggagccagaggatggtgagtgggagagcagctgagggcacagcagggcttggcttcccgggtcacagcagggctgcagcgccttgccttgatcctccctcccccggggctccaagtactccctgccacctcccgagaagcaggcgctaagatcacaacctcctcctccaacagctgatgagaatattgatgtcaccagcaatgaccctgagttcccctcctctccatactcctcttcctccccctgcggcctggacagcatccatgagacctcggctcgcctactcttcatggccgtcaagtgggccaagaacctgcctgtgttctccagcctgcccttccgggatcaggtacctaccggcctgcctgctggggagctaggctgggctggggtcaggcggcccactcgagtcaaccagacagggcacacacatccccacgccagtatgaatgcacacagcttggatggtgatggctggggacacacatacctctgattcagcgatggctggggtgcatctcagggatggtgacggtgggggtgcatgcatctctggcacagggatgatggtcggggtgcacacctaggagatgatgatggctagggacctacagggcccagggtcttcttaagttctggaagaccctcaggccctgcagacattctgtgggtaacaagtgacctgcacaccctgaacaggctgagtggctgactctaggcccccttggagcacaagtgcctacgacttcagggcttgcattttagttcaatctctccagctctgggccatccctctcggcttctaatgggcaagcagatctttcaggaaaaccaggaggagaggcatgaggagggtttgaggccctcagccagtctgtgtgctggggtggagcaactcagaagagtcaggccacaccacttgaatacactcaacttaggacactcatgaggcatgtctctgaggctgcccaacttccaatggctctgggcgttcctaaatgtcccagctgcagctctggatggaacccagtgtctcagatgataggcagctgagccggatggtgccaaatcccagagctctgagcctctggctgatgtcaggagagcattctcgggtcccaggacagcacttccattccttgggtgcctgagatggtggcagaggctccagactgagccagagaagctgtgtgtctgccataacaggcacccctgtctgagcacaggtgatcctgctggaagaggcgtggagtgaactctttctcctcggggccatccagtggtctctgcctctggacagctgtcctctgctggcaccgcccgaggcctctgctgccggtggtgcccagggccggctcacgctggccagcatggagacgcgtgtcctgcaggaaactatctctcggttccgggcattggcggtggacccccacggagtttgcctgcatgaaggccttggtcctcttcaagccaggtaactgagtctctgcccaaaccttgagtgggaattctggtgacttccatctgcctctcactctccctccactacccccatgtgtgcagatgtgtgtaggcctctatcctggggggtgggaggagagtggtgaggctggactcccttctccttggggccactcctggttgactgtgaggggacagggcaggctgggagcccctgggagaccctgagccccagccggagcccctggtggctcctctgggcctggcagagcccaccccacagggccccaggtccatgtctgcagccagaaccctgggccaccacttcatggccagccttataacagccgtaaacctgtgctaagctcactggtgctgcttctccccagagacgcggggcctgaaggatcctgagcacgtagaggccttgcaggaccagtcccaagtgatgctgagccagcacagcaaggcccaccaccccagccagcccgtgaggtgacctgagcatgcgcccacccactcatctgtccctgacctctaacctttctctgcctctcccacactctcccagagctcactgattagacagcacaagggtctcagttcaacagcatacagccaacatctatggtgtcccaggcacagtgccaggccccgggagtggggaccaagatgtacataagacaaagctactgccttctagagacaaccggcagtgacctcactgaagacaaaaactgccctagccaggtactgagggttgcatgaatctgcaggagacagagatccccttgcatgggaaacataaagcagaattgggagggactttgtggagacagggctggacttgaaaggaagaagaagtctaaaagaaaacatcatttgcaaagggagagaggggcaagcatgatatgttgttagaacaggagcccactttgaaggtataacaggttcctgccagtgagaaatggggagaataagccagaaaagtaccctaggaccagcccgttcaggactttgaatgccagccaaaggccacgtctgacttgggaggcagagggcagctactgcaggtttccgagcagagggtcatacacagggctggacctcacgcagactggcatggccatgggtccagaggatactactgggaaggggatggcagctactgccaccttccagatggttccatggagttctgatctttgggcatggccaggggaagcagaagggagactctaggagttgaaatgggtcagacccggtgtttgggtgaaggtaaggaatgagggaagaggagctctttg

SEQ ID NO: 978 - DNA, 7705 bp, Homo sapiens
gagaaatctcctcaagccagagcctgtgctgtgaggggcttcgggaccttggggcagctcctgagttcagacagagttcaggaagggagacaggggcacagagagacagaggttcatggactgaggcaaaggctgggccaggctcagcaacccaggcctcccgcaggcaggcagaggctgccctgtaacccatggagaccagaccaacagctctgatgagctccacagtggctgcagctgcgcctgcagctggggctgcctccaggaaggagtctccaggcagatggggcctgggggaggatcccacaggtatggcttctcctggaggtagggttgggtctgggcccttggggagcagggtaagggccagaggttcgcagggaccatggaaggagccagaacaactcagacccagccccgccggctgtgggcaagggtggggtagcctgtgggtaaacccagaatcctagaaacacggtggggcggggatgggggttgggggcgggcaggctgcagagccaggacaggacagcctagccgatggggaaggaaagaacagagaagcgcccttagggcttaacagcacagaggtccctagtggcgttgacaagaatgtttctgtgggatgatggagcctgaagccacccacagagaagggatgggagctgggaaagtggagctagggctcggactcttgctgaaaattggccattgagggaggagagagggcaaggaatgggggtgggggctggggtgtggatgcacagtgagggagacacttctccagatggaagagtcacgcgtgggttcgttcaaatgcgggtgagcggggcctgaggactgggaaagggacccgagggaaggaggggagcgtgcagccctgccccggcccagccctgccctggcccagccctgccccctgcccctcaggcgtgagcccctcgctccagtgccgcgtgtgcggagacagcagcagcgggaagcactatggcatctatgcctgcaacggctgcagcggcttcttcaagaggagcgtacggcggaggctcatctacaggtgagtgcggtgggccctgctgggcgtctgcccctgaggggttctggaggggtgagggggtgctcaggggaagaggggcttgggcaaaaatgtccaagcccatggctcagggcatgggagggacactgacccctggggtctcctcttcacctgcaggtgccaggtgggggcagggatgtgccccgtggacaaggcccaccgcaaccagtgccaggcctgccggctgaagaagtgcctgcaggcggggatgaaccaggacggtgaggcgggggctggcccggggggaggtgacaagaaatgggcagcgggactggcgtgtcgtcctgacccttcctgcctccccagccgtgcagaacgagcgccagccgcgaagcacagcccaggtccacctggacagcatggagtccaacactgagtcccggccggagtccctggtggctcccccggccccggcagggcgcagcccacggggccccacacccatgtctgcagccagagccctgggccaccacttcatggccagccttataacagctgaaacctgtgctaagctggagccagaggatggtgagtgggagagcagctgagggcacagcagggcttggcttcccgggtcacagcagggctgcagcgccttgccttgatcctccctcccccggggctccaagtactccctgccacctcccgagaagcaggcgctaagatcacaacctcctcctccaacagctgatgagaatattgatgtcaccagcaatgaccctgagttcccctcctctccatactcctcttcctccccctgcggcctggacagcatccatgagacctcggctcgcctactcttcatggccgtcaagtgggccaagaacctgcctgtgttctccagcctgcccttccgggatcaggtacctaccggcctgcctgctggggagctaggctgggctggggtcaggcggcccactcgagtcaaccagacagggcacacacatccccacgccagtatgaatgcacacagcttggatggtgatggctggggacacacatacctctgattcagcgatggctggggtgcatctcagggatggtgacggtgggggtgcatgcatctctggcacagggatgatggtcggggtgcacacctaggagatgatgatggctagggacctacagggcccagggtcttcttaagttctggaagaccctcaggccctgcagacattctgtgggtaacaagtgacctgcacaccctgaacaggctgagtggctgactctaggcccccttggagcacaagtgcctacgacttcagggcttgcattttagttcaatctctccagctctgggccatccctctcggcttctaatgggcaagcagatctttcaggaaaaccaggaggagaggcatgaggagggtttgaggccctcagccagtctgtgtgctggggtggagcaactcagaagagtcaggccacaccacttgaatacactcaacttaggacactcatgaggcatgtctctgaggctgcccaacttccaatggctctgggcgttcctaaatgtcccagctgcagctctggatggaacccagtgtctcagatgataggcagctgagccggatggtgccaaatcccagagctctgagcctctggctgatgtcaggagagcattctcgggtcccaggacagcacttccattccttgggtgcctgagatggtggcagaggctccagactgagccagagaagctgtgtgtctgccataacaggcacccctgtctgagcacaggtgatcctgctggaagaggcgtggagtgaactctttctcctcggggccatccagtggtctctgcctctggacagctgtcctctgctggcaccgcccgaggcctctgctgccggtggtgcccagggccggctcacgctggccagcatggagacgcgtgtcctgcaggaaactatctctcggttccgggcattggcggtggacccccacggagtttgcctgcatgaaggccttggtcctcttcaagccaggtaactgagtctctgcccaaaccttgagtgggaattctggtgacttccatctgcctctcactctccctccactacccccatgtgtgcagatgtgtgtaggcctctatcctggggggtgggaggagagtggtgaggctggactcccttctccttggggccactcctggttgactgtgaggggacagggcaggctgggagcccctgggagaccctgagccccagccggagcccctggtggctcctctgggcctggcagagcccaccccacagggccccaggtccatgtctgcagccagaaccctgggccaccacttcatggccagccttataacagccgtaaacctgtgctaagctcactggtgctgcttctccccagagacgcggggcctgaaggatcctgagcacgtagaggccttgcaggaccagtcccaagtgatgctgagccagcacagcaaggcccaccaccccagccagcccgtgaggtgacctgagcatgcgcccacccactcatctgtccctgacctctaacctttctctgcctctcccacactctcccagagctcactgattagacagcacaagggtctcagttcaacagcatacagccaacatctatggtgtcccaggcacagtgccaggccccgggagtggggaccaagatgtacataagacaaagctactgccttctagagacaaccggcagtgacctcactgaagacaaaaactgccctagccaggtactgagggttgcatgaatctgcaggagacagagatccccttgcatgggaaacataaagcagaattgggagggactttgtggagacagggctggacttgaaaggaagaagaagtctaaaagaaaacatcatttgcaaagggagagaggggcaagcatgatatgttgttagaacaggagcccactttgaaggtataacaggttcctgccagtgagaaatggggagaataagccagaaaagtaccctaggaccagcccgttcaggactttgaatgccagccaaaggccacgtctgacttgggaggcagagggcagctactgcaggtttccgagcagagggtcatacacagggctggacctcacgcagactggcatggccatgggtccagaggatactactgggaaggggatggcagctactgccaccttccagatggttccatggagttctgatctttgggcatggccaggggaagcagaagggagactctaggagttgaaatgggtcagacccggtgtttgggtgaaggtaaggaatgagggaagaggagctctttgggagaagacattgttaaaaatataaaaaggaaagccaggaggaaagacggttttgagggaagatgataaggtgttttgtaggtgcactgagcatcctgtagagatgccaagcacatggatggccctggctaggtttgggggagagttgctgcaggctgagtgtggctgcgcgagggtggggcaggagccggtgctctgggactacgctgtttggcccagcacaggcagatgtcatggagcctcagcaaggttggaacatttggccttcaggcatctactggctattttagaccatgttatctgcaatctttggggctcccggcagtttctttctgaagaagcaagctaatatgggcatccttgcatcacctctaatccaagaaatgattacaaggagaaaaggtaatttccttttaagaaaagccacagtatacaaagtatatgccatatagcacaggaagatttgtgctgcttatgagcatagggagaacgctgctactactaagacttgacttagcatctgaagagtgggattcagagacattcagaaaccagcagcctttctctgccaagtttctgttggaaccaactcccagagatgtcctggcatattggttatgcgtcaaatttcaaaatgctgattaagatttcctatgtcccttttatagcggttcattgcctactacaagggaattgagcatgaagatagtggtttggggttctctaatccagcatattatttcagtttttaaaaactgcaacacccaggaagaaacacaattaccatcgccccctgatatgcacacagacaccaaagcgaagttccacgaagtaattcctacccttagcttttacaatttacctgatgtttctcttttctttttttgaaaaggctgattgtgaccccctgaatttaatttcagacccactaggtgaggcaatacctgcagtttggaaaaaacattctttaactgactttatagttatttcttcttcctcccactctaatttagatcagaaaaacagaagcagggaaggcagatgggaggggtatacgacttgctcagtgctgctcacttggcactagcaagagaaaggaaggccttaggttggcaaagcaagtccagcagatcactgagtggtggggaagtcttccccgaaattcacggtgagaggagcatgggactgcccaatgtggagtagcctccttgatgctgggtgttgaccctggccatcagacctacccagggaaggtttagttcccccatctgtctcttggggcttcaccatccgtcttttgtgttgcggactcctgtcttagcaaatactttttttttttttttttttttgagacggagtctctctctgtcacccaggctggagcgcagtggcgtgatctcggttcactgcaagctccacctcctgggttcacgccattctcctgcctcagcctcccgagtagctgggactacaggcgcccaccaccacgcccggctaattttttgtatttttagtagagacggggtttcaccgcattagccaggatggtctcgatctcctgacctcgtgttccgcccgcctcggcctcccaaagtgctgggattacaggcgtgagccaccacgctcagccagcaaatagttcttatttaaaacaataaatatttttttcaatgactatctcagtcaccaaaattatccttcaacttcaggacattttcagtaatggctatcatcatcctaggtggtatacagacaggaatttgtattcttacaaacaattcttatctactaaaaactaatcatataattataatacttatatatgagattaataataatattttcatatacaggtgctccttgacttatgatggggttacatctggataaacccattgttaagttgaagctactgtaagttgaagatgaattttcatacataacccatcttaagtcaaggagcatactgaatgcttatcactttcacaccatgataaagtcgaaccatctgtatagagttaatataaacttcactttataatctttacatataataaacaatatttactcattattttcattgcactcctaaactaaatagagggtggcggctcacaatgggtcgaggtaggtggaggcaactcctctggttaatgcggcttttcttttttctttttttttttttttgagacggagtcttgctctgtagccgaggctggagtgcagtagcgggatctcggctcactgtaagctccgcctcccgggttcatgccattctcctgcctcagcctcccgagtagctgggactacaggtgcccgccaccacgcccggctaattttttgtatatttagtagagacggggtttcaccatgttagccaggatggtctcgatctcctgaccttgtgatccgcccgcctcagcctcccaaagtgctgggattacgggcgtgagccaccacgcctggcctgaatgtggcttttcctcgaaattcctcctgacccactctggggacctcatctctcctctccttcctcccctccctttcctgggagggcaccgccccagggactagtgctcagaagctggtcgtaaaactgatggcgtcctctctcctgttcaggtttgggaaattgctcctgctcctcccgtctttgaggtttatcactgcggaacgcatcgagctcctctttttccgcaagaccatagggaatactccaatggagaagctcctttgtgatatgttcaaaaactagtgggggtggaggtgaaatgtttccaagcactctggaaaacaatctactgaaacgaaacatttgcctactctttgccccagcaattcctcgtaggtgtgtgtacccagcagaaatgcccaccgaaagatattgtaagaatattcatagcagctttattcataatagccccaaactgtatattgatggtaggatgaattaacaagttgtggtatattcatataatgaaaaataatttaaaaagaatgaattacggatacatgtggcaacacaggtaaacttcacagacataaaagttgaatgaaagaagccaggccgaagttccatttatgcagagttcaggaacaggcaagactaattgacaataatagaagttggaatagtggttacttctgggtggtgggggattgatacagagggggctcatgggagccctctggtgtaccagaaatgttgattttgatctgggcagtggtttcacaaatgtattcatacgtaataattcattgagctgtgcactttattttgttagacctcaataaaaaagtaaaaaaaaaaaacaaaaaaaaccagaa

SEQ ID NO: 979 - DNA, 24121 bp, Homo sapiens
tataatggcacacacacaactggcctcatgcttccataacttcactctgcctcccacttttttcagcccaacccctccaaacatgggtctcggtcggtccccttaagccacaatggagggaatacattaggctaagcaaatattccctcaggatttcatggcaaagccctttcaaccaaagaaaggatcgcgactaaggagaaagataacaaggtttgcttgaggagaggtctgttgagagaggctacagtcggtggtgggagagaagccaaagtctgtgacggtgtctagagggactgacaccacatctaccgggagtaagaacaccatgacagcggctatctgaaagccgtgatggctagggttagtgctagtcggcttggtgatgagcgagctgggaggggttctactaagaagagtagggcgaggggcacatgggggacgcaatgggttagggggcggtcgagactttgcctgagaactgtaatcacgtcagcccaagggaggatgtaacgtagtctagaagctccattaagagtcctaagggactctgaggggtactaatggggtctgctgggttggggggaccgtgacagaatctccggggaggctggagggccggaatggtgcccggccaatggaagatacagggggtggggtctactggggatccggggccgtgatctggtgtttgggaggctcggcgcagacccgctcgcggggcgtctccgctgggacggggcggggcggcccgaccggagccaaatagcgaggctgagacgtgggccaggacgggctgcagggccgctgggcgcttgggcgggtcttacctcgggctccgccgcggtggccaccgcagccccctcctcttcgacggaagctgccttccaccctccgccccagggtaggaccggagatggcagaagaggccgaggccaccgagggtcggacggttccgggagggtgggcccagcagcctcagggtccgggcgagcggccgcggcgcatcccccgccctgtcagagagactccgcccggcctgagcaggcacatcccccgccgcaccccgcccagagagcacgcgttggaccgccgcctcaaccgctgccagcggccgcctctgccggtgcaactactgcctccgccgccgcctctcgcagtccgggctgtcctgtactctctcaacagacacagccaaccgccgccgcgtcccttatccgcttcggtcgcgcgcccccgaccccgcgcacgcggccccgccccgcgcgactccccggctgcaggcgagcaggcgcgcgcgcacttacctcccacgccccctactgccagcacgggtcggccccgccctgtcccgcccccgcacgtgacgccactggagagtacagcgtgcgcttgcgcagacacgccccctttcctacgccccaggcggccccgcccaaattttttcttcttcaccttacggcagagcagggaactcagctttagattctccctgtactggaaagggatgtcgcaaggttggggacgaaacctctgagtttgcgaccgtagctgtcgctttccggccaacacagaggtgcctgaaggctggttggggtggtgaggcccgaggcaggtaagaagcctcctccccacttcggtttgtctcggcagtggatcgctctcccacccactcagattctggcgtatccgtgctccctcccgattctggacctggattctcagcgccgccggtcatagcccccgccccttttcaaacacgcacgctctctccacccactgccccctccattgtccccgccccgacctccgtttccattcatttctcagacttttcactgagtggtttccatgccttgggttccagaatgtcagaggcgaattaagtggtgtcagctttttgaagtgcttttgtataggagaccgtgagagaatccgcagtggtagtacaataaagtgacaatagagaaaaatgcacgggatgctgtctgcgcacagaagaggggtcccaggttgtgtaggaggataacgtgaggaagccctttccagggtgacttttgggtcacttttagaggactgtgttaaaagactagtaatccagtacctggtcaaagaaatacgaaaggaggtaaaagcagaataacgggcgcaagagcatgtgacagtggtggtctgaaagagaaaaaagaagtaaaataaacctgatggaaaccgtactagtgtagacttccctttaaagaagcatcgttataaagttagagaaatgaggaacgagaatatggccctcaggaatgttttctgtttaggtagaagactcaaaagcgtaccatgaaaccgagaagtggcctcttcgagggtgagggaggctaatttataagatcaagatcactagtggaacgcaaccttgtatgtgcatttgaatcacctgggaaactttttgttaaataaaaccaatactgttgccccactctagaccaattaaattctgggttgtgccaggtgtcattactgttttaaagctccacaggtgactctaatgctaaagattgagactcactaaactagagagaaggaagttgagacagttggctctgtaacattaagatggaggtcatttagccgggcgcggtggctcacgcctgtaatcccagcactttgggaggccgaggcgggtggatcacgaggtcaagagatcgagaccatccaggccaacatggtgaaacctcgtctctactaaatatacaaaaaattagccgggcgtggtagcaggcgcctgtagtcccagctactcgggaggccaaggcaggagaatggcatgaacccggaaggcggagcttgcagtgagccaagatcgcgccactgcactccagcctgggtgacagagcgagactccgtccccgcccccagaaaaaaaagatggaggtcatttaactacagagaggcttggagatggaatgagaaacttgagcggcgttatgtttggaataactggtctgggaaatgggagaaggagccactcttgcctttctcttcagcactgttcattcctcagtgtttatcaggtccaaattagttacttgtctctttgctctcccgttcccttccgtccaggattggtcagctgttgtctccagccttaaagctcaaaggccatccccacttctgtccccaaaatgatcagagctaagccaatttatgagatgcagagaccaacatccagagctaagccaatttatgagatgcaaagaccaacatccactctcatagagattactacatacagtgccttgccaatttagaatctttttctattatttatcatttaagttagtaatgagatataaagatatttaaaatacagctcaattaggatggaaaattaccgtattagggaaagcaggcctttaaacaaagaattcacttggcaggcagagaagctgtatgaggtaaagaccaagacagtgtatggctgctatctattaactagggttaatccaaaaacctgtctatcagacccagataagaacgagttattgttgtctagtatggctagagcatagtatggagagtagaggtgggacagagatgaagatgataaagtgggtgtgaacagattatgaggagccttgaattccatggtgaagagtttagattatattactagaagtaattaataagtacaaaaaaggttcttaacctcttttacccagtggaccttgttggcagtccaccttatagattcagtctcagaaaaatgttcttaaatatataaaatagaatacgtagtaatataaaggaaactaattttgttaagtttttaaaatattaaaacaaatgtgtgatatatatgcactttatgcattaaataaaatctggcagcaggtctaattatataatttctaagtagtgatgactataaattatattttgaaatgcctgcagcaactttaatgtgatgtgaaaatatcagatttctattggtaaaaaagagagtgctaatattgtagtttgtggtccacacttattgaagaaatgctaaatttcagctactgattattgaaaacaaagatgcaattgttttcccagtctaagttcacagaaccctgatattctagccacatcctggtctatggatcctaagttttaaaatatctcagtataatggttttaagcaagagcatgacatcaaatctgtgtttcagaaaaatgatgaagcagtgttcacttcccaacctctctgctgggatgagaggctggctctggggcagcaaccagtactatcccactgtttcctaataaccagggcctgcagagggactgagcttgtgggtgtatatgtctgtgagagtaataccagaaaataaatcaggaaaggtagattggggctatttttgtggaaatcattgaatgccaggctgtaatttgtagttactttggtagacaatggagggttgttaaaattttttggagtagaataatgtgattagagttctgtttgaaaatctagaataatgtgcaggttagattatcaaaagagaagataggaatgaagagactagaacaataagttaattaatttttgaaaaatggaatcttgggccaggtgcagtggctcaggcctgtaatcccagcacttggggaggctgaggcaggaggatcacttgagcccaggagttcaagaccagcctgggcaacaaagtgagaccgtgtctctccaaaaaaaaaaaaagaaaattagccagacatagtggtgcctgcctgtggtcccatctacacgggagactgaagcaggaggattacatgagcccaggaggtcgaggctgcagtgttcatgccactgcactccagcctgagtgacagagagcctgtctccaaaaaaaatcttgaggtgatctctagagtctgctaaattcctttatttccacaatgtgctgaccagtctagagtaacatacattggaataaatggcatacctgtcaacaggaatatataccccagtgtgggagtcagttaactttatgtggtcaagaggctagcccagtcttttgtattataaatgatattgttagtacttctaataaagcaatggccttaccataagttcacagatcttgccaaggccttcctcagtcaaactccatctatacctgtgagtcctacatttctgacttttaaaagtcagaacctgtctatacctgtgagtcctacatttctgtcttttaaaagtcagaactcctctctttttgccaattccttaaacttcttggatgggaaagaagtttagtttaaacacattagcaaaagaatgggaggtcctcaaggcccaggcaacccatctcctttgaaactgatcaataccggactataaaaacttactgctcaaatccagctagtacccaaagtatgtactgtctatatacctgtctatacctgtgagtcctacatttctgacttttaaaagtcagaactcctctctttttgccaattccttaaacttcttggatgggaaagaagtttagtttaaacacattagcaaaagaatgtgaagtcctcaaggcccaggcaacccatctcctttgaaactgatcaataccggactatagaaacttactgctcaaatccagctagtacccaaagtatgtactttttaaatgtattctaaaaaattgaatttggggtttaggtattactgatccaaatgagtcctataaaattaacttccagaactaggttctcagagaggccaccattaccaccttcttcaacataactagcctatattgactttctgtccatcaaataattggaggccatttgggtggtgataggaagaattaagtttatgcagaacttgaggttcagctatctgacaccttttgcgggaggaggaggagtgggtctatctgaaatcagaaataatacttttatgaggctttttaataatttttattacttacagaaaatttctgaaagttcctttctctggctcccaattaaatggcttactccacaatcaacttataaaagcactggatcattgtcttgatcccaaaaaatttgtcccaactatagttactattttgagcatctgtattattgtttgaaaaccttaggcttgctttccctgatggccaatgaataaaactctcaaagtcgtgtgattcattactcattaattcattagatatttattgaacctctactatgtgccaggcacatttttgaaacccactaatgagcaatttgtaatgacaatttacctcttaactatctatgaaaaaaataacttgccaggatttgaaatccttagaacaaatgagattaaaagatcatagcttttttgtgttctttcaaatagtgtgtttgcatagagctgccatgtgctgaccacagtgattatctgtgaaatgaggtaaatcatggctttaaccactccttatcagactttgttaccacatgtactaaaataaagttctgtctacacctttataaaatattatcttacacagacgtcttattaattctaatggcctctccacacctgaccctcactcctagtcatttcaaagtttgcaattgtgtaaagtcatttctcagaaaatttgaagcaaaacaaagtcaccacaagaaaaacttggtatacaccaggtttatattgaggacaaaaactgtgacacaattacaaatggaacttttttttttttttttgtgatggagttttgctcttgttccccaggctggagtgcagtggcgtgctcttggctcaccacaaccgccacctcctgggttcaagcaattctcctgcctcagcctcccgagtagctaggattacagttgtacactaccacgcctggctaattttgtatttttagtagagacagggtttctccatgttggtcaggctgatctagaacgcccgacctcaggtgatccacccgccttggcctcccaaagtgctgggattacaggcatgagccaccgcacccagcctacaaatggaactcttgaggtagaaatggtagaccaggaataaaattattttcatggtcaatgacaccttagccattgatagctgtgcctagttacagagcaataaatggagagccttggtgttagatgaaatcctaaaaagtcacctgttttatctccttggccccagacagaataaagtggaatttatagcagtagagttaccaagcatcatcatcacaccaagtaggttttgtactttgagagctgaattcctctctgaaatattgatgttacaggaatgttgtttaaattcatagctcatttataaaattgagaatatttcttacatttataactgtgttgtgttttcctgagtttttcaagatatgtttcacttctgtactttgctcactcaggaaaaatatttatttattaaaactctagcttgtcaggcactgaagttagaaggatgagtaaaatctaatctgtgtactcaagagggttatataataaatcttgatggtcattcttacatgccacattatacagatctccagatggcttaggcttagttttaaaaggaaacgttttaattggggggaaattgaaaccccaaaaaaaagccatgaacttccttcctggaaatatttttgccataaaaagcatatttggtcttggatgtgattctttttgtgaaagtgcaagttgaatcagacattagaagttggacataatcttctaattttagtaaacatcaaattatttttaaatatttgtgtttgaacatttatggaaaagagattagatttacctgttttatccagaggacagaagtaagactcagaagttgaaaaaatggaaatattttatgtcattataagagtgggaactggtacatcttttattcctcttcaatatggaaatcactgtatttactaattatgtgttcattattaaaaaagggggaaaaattaaagcacaatatcaaaaggtagaaggaaaaaggcaaaaaagtattaatcctatttcttaaaatgatatttacacttgatggatatcgttcttgattatttttctgtatatttttatcatatacagatgtttatatcaaagcatattatgaacatttttcttttaataaatttgtattgacaatattatatttaatggctgaaaactattccatcgtgtggaaaccctgttgtttaatttaccagtccttttttgaactccagattgtttccagtttttctgttacaaatactgccatggtgaatatcttgttgaatttttgcacacattgttaatgtctcccttaagttaaatttcttaaagtataatacctacatatataaatttcttaagaattccaatataatggcaaattacccttgaaaaagcttgcatgtatgacagtcctatcaaaatggggcatcatttactcatttcccataatctctcagcaatgctaattattattagttttcttcacctttgctaacttgacaggtaaaaaaatgaaattttattttaacttacatttatttgattactactctgatgtccagtgtcttttcatgtgtttattgactagtcatgtaagtgtattaactaatattttctaacaattttttttttactttttaacatttaaatttgtattctatctaaaatataatttgatgtaaggtatgaggtaaaactctttacttttttaatcaaataattaacaagttgtgccaatgctacttattaaaaaatccagcaagcatatcccatacttcaatatacagataataaagtactgatagatattcctccaaaaaaaagaaagactatttcgtggttaaataagtttgggaaaagatcatacgaaaaaaagttaaaattttttatcgccaaactctcgttagcctctagtgtgtgtgtgtgcattaggagttagcatttcctaatttaattaaccatgtaatcttttttcttttttatttatttatttattttatttatttatttttttgagatggagtctcactctgtcgcccaggctgtagtgcagtggggtgatctcggctcactgcaacctctgcctcccaggttcaagcaattctcctgcctctacctcccaagtaactgagattacaagtatgcactaccatatccaacttgttttgtattttcagtagagatggggttttgccatattggccaggcgggtctcaagctcctgacctcaggtgatctgcctgccttagcctcccaaagtgctgggattacaggtgtgagctattttttttaaccatgtaatctcacttcataggtatttcaggaaatacctatgaaagcctgtggaactgagctgtccagtatactagcactagccacatgtggctatttaaattttagttaattaaaattactcagttcttcagtcacactgaccatatttcaagaactcaatagccacaaggggctagtggctactgtattgaacattttgcagataaaagaaaatttccgggccaggcacagtggctgatgcctgtaatcccagcacgctgagaggccgaggtgggtggatcacaaggtcaggaattcaagaccagcctggccaagctggtgaaaccctgtctctactaaaaaactacaaaaaattagccaggcacagtggcagttgcctgtaatcccagctactcgggaggctgaagcaggagaatcgcttgaacccaggcagcagaggttgcagtgagccgagattgcgccactacactccagccggggcgacggagtgagactccatctcaaaaaataggaaaatttccgtcacaagaagtgctattggacagcactgctatgggaacataatgttcagtggaacacgtgaacacgctgaaaacactggaataatccataatttctcctgatttgtcaggcaaacatgattactactacactatgagaacagactctctcattgatttgtaaagactccatcatcatatttaaaatttctaatctacatatgatttttttatgctattgatttatctacttctgctccaataccacacccctagttttaagtcaaggttctgcacctttctctttcagagcagaaatgaagaattcttgcatggagtaggaaattagattagaagtgatagtaaaggcgctttcacttcccagactctaaatgtaaacatttctctgccgaacttgatttatattatgttgagctgtatactcaattacttattcatttattctacaattatttattgagtacctgcctggtaagcactgttttaggtcctggggttaaaatggcaaacaaggcagacaaggcccctcgtcgtcttattttcatagagcttacattcttgttttggagagggaaagagaagaggcagggggaggaaaaaagaatatgaaccaataaacaaataaattaaaaaactatcacatagtaatcagtgctattcaaggaattgaaattagagtgatagtaactggtggcctctttgttttggctgccctgagacctctgtgacttagtggcatttaaactaagatctgtccaaagaagaagctaattactagaaggtccaggcagagctagtaccaccctcaggagggaaaaagcttggtgtatttgaggagtaaaaagaaagtctttgtggctgggtcttagtgggcaagcagggaaataataggagataaggttggagaaatagctgaagccacattttcatgtagggttttgtaaactagggtagggaattttcatttttttctgagtatgatagctactagagactcctaagcagggaacagacctggcctaatttaaatttttaaacaattattttgatggagaatttattggcacagtcagtagtggaaataggagacctgttaggctaggtcaagaaagaaatggtgatagatttgactaaggtgatagtagtgaagatggaaagcattggacagatttagaacatttaggctatagaatcaacaggacttgtcaattggatgtgaagtgtgaagacaatagaaaactctgggatgagcctgggcaacatagtgagaccctgcctctataaaaaaaaatattaattagccagacatggtggtatgcacgtatagtgcatatagctacttggaaggccaaggtgggaggatcacttgagcccatcagttaaaggctgcagtgagctatgattgcaccactgcactccatcctgggcaacagagtgagacgttttcaaagaaagagagagggaaaggggagaggggagagagggaggggaggggaagaagaaaaaacagagagagagagaaagaaaaaaactaactcttggatgatgtctgtaatccattatatagtaaccaggttcaattttcagtctgattatggcaggcaaaattgggacacataagacaccaataaatatattttaaccaaatgaataaatttactttaataaatgtttctctcctgtacacatttaagctgctaaagcataagcttgtgctcattcctttattattagggaatctgactcctaagaatttgaggtttatgtcataaacacatcagctataggtaattattagactgttcccctgaagtatccaagccaacagaggagactgaatgaaacagaaaaaattgcctgccacagttgcaaaagttctgtgagattctcatattttatttttaaatttcatgctgattttgcattttatgcccaagtttatgttaataattaaaatatttttagttgctgatttaaatgttttaagtcaatgattaagtggtttagctctttcccctaaagttggtcaaattaaagctctaggaagatgccctgtgattaacttgtgtttgttttttggactttctttgttgctatctgctggcacatgggcatgtatccatttagagaagtacagatgcatctctgagcatttgtagtttggtacaacttaaaatcgtagccaaagcgagtgaggaaggcaatagcatttagaaacaactgacttttataatctgcacttactttgtaatgtttttaaaaaacatacctgaatgaggctgtttctctctttttatttttttaaggaatgcttactgaataattagaaaaaaatgagtaaaggtcacaattctggaatagtatgttttcagtaaaacagatttatctggagtactacttaagtcaatagccaacaggcttattttccctgaagttttgagaattgctgtatgccatataaaatccttgttaatttaaaactctaatacatattttaatcccataaaataaatacttatacatctataaaatagacaattatcgttaatatccattgtaaattagtatttttaagcatttccattcattaaaaatccagattgagtccaggtgaggtagctcacgcctatcaacccagcactttgggagggctagacaggaggatcactggagccaaggagttcaagacggcctgggcagcataatgagacctcatctctacaaatttttttttttttgagacagtttcgctgttgttgcccaggctggagtgcaatggtgccatttcggctcactgcagcctccgcctcctgggttcaagcgattctcctgcctcagcctcccgagtagctgggattacaggcatgcaccaccacacccggctaattttgtattttttttttttttttttttagtagagactgggtttctccatgttggtcaggctggtgtcaaactcctgacctcaggtgatccacccacctcggcctcccaaagtgctgggattacaggcatgagccactgcgtctggccacattttttttttttaattagccaggtgtggtgggaggcacctgtggtcccagctacttaggaggctaaggcaggaggatcacttgagcccaggaggtcaaggctgcagtggccgtgattgcaccactgcattccagcctgggggacagagtgagacccagtctaaaaaaaaagaaaaaaaaaatccagactgaaacagcaataacacctccagttaaaagttaatctggccaggcaccatagctcacacctataatcccagcattttgggaggccaaggtggtggatcacctgaggtcaggagtttgagaccagcctggccaacatggtgaaaccccgtctctactaaaaacaatacaaaaaattagccaagcattgtggtaggcacctctaatcccagctacctgggaggctgaggcaggagaatcacttgaacctgggaggcagaggttacagtgagctgagatcgcgccattgcactccagcctgagcaagaagagcgaaatgccatctcaaaagaaaaaagaaaagtcaatttatctggaaactgcctttaagatagtttaataaatgtccccagtgctttattagaattgtaaaagttcttaaaattaattcaacctggaaatttacagattacataacagtgatctagaatagggattggcaaactttttctctaaaaggccaaatagtaaatattttagactttgcagactactctgtccttagaggtcaaaagtagccataaacagtatgtgaacaaatgaacatgacttagtccaataaaactttatttatagaagcaggcagtgggccagatttggcctgcaaactgtaatttgctgacctttggactagaaaactagaatgttttaggatttttttttttttttttttttttgagacagagtttcgcccttgttccccaggctggagtgcaatggcgtgatctcggctcaccgcaacctccacctcccaggttcaagcaattctcctgcctcagcctcccaagtagctgcaattacaggcatgcgccaccatgcccagctaattttgtatttttaatagagacagggtttctccatgttggtcaggccagtctcgaactcccgacctcaggtgatccgcctgcctcagcctcccaaagtgctgggattacaggtgtgagccactgcgcccggcaggatttttataaacaggatgacagaatttaaaaattggcagagatgacagcttagaatcatagaatatagagctagtggaaacttagaaaagagctagtggaaacttagacatcagaataacttggaaatatcttaaaaatgcagaggcccagattctatcccaggtgtatgctctttaaaatccccacagataggtgggcatggtggtgcatgcctatagtcccagctactcaagaggctgaggcagaaggatggccttgagcccaagagttcaaggatgcagtgagctataatcacaccactgcactccagcatgggcgacacagcaagacctcatctcttaaaataatttttttaaatctcatagatgattctaatatgcttccctggctagaaccactgtttacctggtccagaccactcagtttacagatgatgaagctgaaattcataggttaagtgactcttccagagtcaaacaactggttaattgtagatctgaactgaatcccaggtctgactccctaactaatattttttctactgaaccagcagcttcttcccttgtatcagcaggccatcagaatgactcctattgaattgtgaattttcccttcaagttggtttttattactttttatttaattactttgttttttataacaaatattcaagtagtgtgcatcttaaggattttaggattaataagaagtaatctccttctattaaaattaatcctttgttaaggaagtgttctacacttatgaattcaatattagcttcatttaattacagaatttggaagatacaataaactaacccctgtaatgacagggtttgtgtatactgacaacacattaacatcattgcttcactcagattgagagaacaattttccctggacttagcattctctctctttatgccaaagataaagcacaagagcagagtcatgccatggctagttccatctttgataactttgtggctttatataaagagacaagtgctttattttcaagaaatctttggggtccattattgccacctcaaacatagggaacagggaaggaaactaagtttttttgagagcctactgtagatcagacaaggtgctgagtgttttcactcatgtttttaattcgtgtaacaacctgtgattatgttattactacctcatcttacagatgaggaaaatgaggcccagaaagaggaagaataacttgcccacgatcacttaaatagtaagtggcaaggtcagagcctagacccaagacttcctagccctaaaacatagaactatgtgtttggtaagattttacaaatagaactataaggaggtcattggctccccagttgactcacctttcttgcccttcccctagtcttgcttaccatccaccaagaccaagtacacagatccttttaactctaaacgaatttactattaacagcagaacaataaaggataacaggcaaagcataaaaccaaagaataaggatgttacaaagaatacagaaatcttaagtggccttatttctttttttcccgtaatctaaattttctgacttccctttaaaaatatttcattcatctggcaaacatttattgcacttcagatatgccaggcacagtgctcactacatagaaaatattcctaaatgattatagatggctcttggttttttgctaggtccccttccatctccttttctcccaccccattgataatgttattatcatcctctcactcacccccaactgaaaccttcagaccatttcataattctttttttttttttttttttttaaacagagtctcactctatcccccaggctggagggcagtggcgaggtctcggctcattgcaacctctgcctcccgttttatctaccctcctctgatcacttactgagtcttattgattctctgtctacaatatctattcctccacattcctactatcatttctcctgctttaggtcattacctcctacctttacttgcaataaaaatctaattgggctgggcacagtggctcatgcctgtaatcccagcactttgggagggcaaggcgggcggaacacctgaggtcaggaattcgagaccagcctggccaacatggtgaaaccccgtctctactaaaaatacaaaaattagccaggcatggtgccaggcacctgtaatcccagctacgcgggaggctgagacgggagaatcgcttgaacccgggaggcagaggttgcagtgagccaagattgcaccactgcaccccagcctgggcgacagagtgagactcacctcaaaacaaaagaaaaaaatatctaattgatctctgctttcaatttttcccttaccaattagttctatatattatagctgaattattatcttcccaaagcattgacctggccattaatggctcccacttcctccagtataaatttcaaactccttcactggaattcagtctgtcaccacttagcttctaagaatcctctaatatttgcctgcacctctactactcccacttcattctagcacgctagactattcaagattctctccacatttgaaagcactttctttacctctctgtcttccacatgcatccagctccacctgtccttcaagagcccacttttatgccactttcctcaaagccatttctgatctgagcactcattccttttcatcctgttagccaggaatgattattctctcttgtgaattcccatacattctgtttgtgcctcttatggatttcttatctcattgactagaagccaccttatacatctttgtatctcccatagcatctaatatgaggtgctcagtaggtatttattgactaaaataatggtatatgcagtacgtgttcattataacaaaataggtttaagctcagtaagggtagaaactatttcattctcactctatattgccaccccctgacacaaaggagaacactcagtagacctttgttaaatgaaatacattacagttatcagtcattgggttataaatttcctgatgccataatagatacctagaaacactttgtctttttttgtttatttgttttgggggttttgtttttttggatggagtctcgctctgtcacccaggctggagtgcagtggcgctatctagactcactgcaacctctgcctcctgggttcaagctgttcttgtgcctcagtctccctagtagctgggactacaggcacccaccatgccccgctaattttttgtattttagtagagacagagtttcaccatgttgcctgggctggtctcgaactcctaagctcaggcagtttgcctgccttggccttatgttgtattttaaaatcctagttatgtatgtttctttattttatattgacaaataccacatgataaaggtcatatattcttattctcactttaagctgggcacggtggctcacacctgtaatcctagcatttagtggggcagaggcaggaggataacttgagctcaggagtttgaaaccagcctgggcaacaaagtgagaccctgtctctacaaaaatttaaaaattagccaggcatggtggtacgcacctgcagtcctagctactctggaggcagaagccagaaacttgcttgaacctaggagtttgaggctgctccgagctatgattgtgccactgtgctccagcctgagcaacagagcgaaaccctgtctttaatataaaaataaaaaatactgccttttggcccaaaatgccatcttccagtaatttgccaaatgactaacacaaagggaaagaggagaggtatccaatatatgttctctaggccttggaaaaaacatggagttgttcctttggccatgtatatgcgaatctataagaaatatgatatcgtagacatcaaggaaatggatactgttcaaaaaggaatgtcccagaagtgttaccatggcaaaactggaagagtttacagtgatacccagcatgatgttggcattgttgtaagcaaacaagggccagattcttgccaagagaattaacgtgcatattgagtgcattaagcactctgagaacagagatagcttcctgaaatcgtgaaggaaaatgatcagaaaaagaaggaagccaaagagaaaagagcctgggttcaccctgaagcaccagcctgctccacccagagaagcacacttttttgtttgttttttgtttgtttttgagacagagtctggctctgtcacccaggctggaatgcaatggcgcaatctcagctcactgcaacctctgcctcccgtgttcaagcgattctcctgcctcagcctcccgagtagttgggattacaggcacccaccaccacgcccggctaatttttgtatttttagtagagacgaggtttcaccatgttggtcaggctggtctcgaactcctggcctcaagtgatccgcccacctcatcctcccaaagtactgggattacaggtgtgagccaccatgcccagcctcagagaagcacactttgtgagaaataatagaaagaagcctgggctgctggtaggtgttaaaaaaaaaaaaactctggactataaaaaataaaaatagaaaatattttcactttacagaaaaggaaagtgagagttaaggaaatttagtaatttatttatgatcacacagccaatgagtaacagaattgaatctaaaatttaagtcttcaaatacgaagtttagagttatttttggcaaagggtgggtttggctaaaggctagttgagttctatttgcattagaatttttggagttaaacttgctgtcatgctgtatggaacagaattaaggccttgattaacattttgtctatgtgcttggtattttaaaaatcaaacagacaaaacacaaaaactatttctgaagaaaatcttagcccagcttgtggacattcccttcaaggtgagagatgactgactgttgaggcagtcttcttgcaggttcctttccctagttgggttggtgttgaagactgggtgtgatttcagcaggcagtgtagagagtaggtctccgggtttttgccaagctatatgacctggcactcacaagtatgcagtgtttattgaagacatgagagacagatgctgtagccagggagcagtcattctgcctttatattataaactcttacatcaagtcacatcgacaagctgattacctaaactctgtcaaattgcttttgtttgattgatctgtgcccatttgccataaggctagatagtaaagattattataggaaacaatcctgtctgtttcatctgttgtaaggatactgtgaggcactatttgttatgatgcaccatgtcttttatgaaaatctcttgagaaaaaactatcggactataatacaaagaattattttacctctcctgagcaattgctttgtttttgtcttatggacattgtgaatgtttacctttctctggccagatgccaaaaagcttagagccaaatttgtggcccacccataacaaatgtgctctatgcctcattaacttcattcttggctccagtttatgtctctccactagtctttttttcttaagaagatcctaattcatgccatcttattatatattttttcttttttctcataagtagccttatgttgtttctcaaatagtcagattatgacatactgtgtctacataaaaccatgttggatgccccttcatttactttggctttttttcttgaggggtgtattgatttttcatataggtttttgcagcgttttgttacacgaaaatggttatatcacaaaaattattgcttaatagtgtagacaagtggtaaaataactggtctaatggtcagaattgattaaattgatgtcataattctagtcttgtcttttacagcattattactattttcttataatatgctttgttttgcactctcaatctgcatgtgacagtttattgctgtgtgattttcagaaatattgtcgtgctgccaggtcactgcataacagctaactctctgttaactctgttgagtctgttaggctcaaatattctacacccatcagacttgtctcactttgggtggtcacaggcatattaatttcatcacacaacttgtcttgcttctcctctaaattagtcattcttttatttagacaagataatgtgaatggatatttgttttcaaacctcattttctttgattggtttggagctctagctggattttctgattatcttactaatgtcatctaattgataaatattattgtacaactttttaaactcttttagtacttccaagtaaaattatttggtcttctctacaactctctagggtatgtaaggtgggtatatgccttttttacagatggcatacaaaaatgattaaatgattttatatgccatctgtaaaaaaggcgtatacctttttagaaaaacaaggacaaagtcatttaaatgactgctcaagatgataccagcaaatcagtggtaaaactaggactagacccaggtttccagaatcttatcccatactaccttttaaaagaagtcaaaagaagttctaacttatattgtaaacattacttcatctttatcataccccttgaagctaaagctatgaaacaggcaaacacatgttatatcactcatgctcatagcagggcagaatcaggaatgaatttcatttgtattagtctcatgattctctgtttttaaaattacagttccttttaactactaccgtaatcactgtcacgttccattatggaaggaggaagcaatattttatcttatcttttgaaaattaatgttgaggccaggcgcggtggctcacgtctgtaatcccagcactttgggtggctgaggtgggtggatcacgaggtcaggagatcgagaccatcctggctaacacagtgaaaccccgtctctactaaaaatacaaagaattagccgggtgttgtggcgggcgcctgtagtcccagctacttgggaggctgaggcaggagaatggtgtgaacccgggaagcggagtttgcagtgagccaggatcgcgccactgcactccagcctgggtgacagtgcgagactccatctcaaaaaaaaaaagaaaaagaaaattagtgttgaaatgaaaagtatttcccttggaaattagtaactttttagattctttgaattcatctttaatataaaaataatttgttgtcattatgcatattcattaaggagccaaataatacagttaatggtatggtgtttggtaaaacattagctataattttaatctctgtgcttcaagaggatatttaaaattcatgcttactgtgtacatggcaagtttccagttctcattctaactaatcgtttacatgtagcacataagctagaatttcttatagttacagttgacccttgaacaacacaggggctaggagtgccaacccccgtatgcagtcaaaattctaggtataacttttttttttttttttttgagatggagtcttgctctgttgcccaggctggagcgcaatggcatgatctcagctcactgcaacctccaccttccaggttcaagcagttctcccacctcagcctttcgagtagctgggattacaggcatgccccaccacgcccggctaatttttgtatttttagtagagatggggtttcaccatgttggccaggctggtctcaaactcctgacctcaagtgatctgcccaccttggcctcccaaagtgctgggatttcaggcgtgagccacagcacccagcctaggtgtaggatttgactccctaaaaaaatacgccaggtgcggtggctcacgcctgtaattccagcactttgggaggctgaggcgggcggatcacaaggtcaggaattcgagaccagcctggctgatatggcgaaaccctgtctctactaaaaatacaaaaaaaaattagccgggcatggtggcacatgcctgtaatcccagctactcaggaggttgagtcaaaagaatcgcttcaacccaggaggcagaggttgcagtgagctgagatcgtgccactgcactccaatctgggcgacagagtgtgactccatctcaaaaaaaaaaaaaaaaaaaaactttactaccaataacatagccaattaacaataacatagccaattaatacatgttttgtaaatgtattatatactgcataatatataccttaccaataacatagccaattaacacgttttgtaaatgtattatatacatttacaaataaccttaccaataacatagccaattaacacgttaccttaccaataacatagccttaccaataacatagccagttaacacatgttttttaatgtattataaactgcattcttacgaaaaagtaagctaggggaaaatattaagaaaatcataaaagaaaatatatttactattcattaagtggaaatggatcgtcataaaggtcttcatcctcatcatcatgttgagtaggctgaagaggaggaggaaaaggagcaattggtcttgctgtctcaggggtggcagaggcaaaagaaaatccatgtgtaagtagatctgcacagatcaaacccaccttgtccaagggtcaactgtgtatttttttaccacaaccctataaaagtaactactattttccagccgcattttacagtcaggtatttattgacaataatattgtcttctagctcttgttcagcttctggaatttctgagcagccctcgtcagtacaagatggaccccgtagtcttgagttacatggacagtctactgcggcaatcagatgtctcactattggatccgccaagctggctcaatgaccatattattgggtttgcgtttgagtactttgccaacagtcagtttcatgactgctctgatcacgtcagtttcatcagccctgaagtcacccagttcatcaagtgcactagcaacccagcagagattgccatgttccttgaaccactggacctccccaacaagagagttgtatttttagccatcaatgataactccaaccaggcagctggaggaacccactggagtttattggtctacctccaagataaaaatagcttttttcattatgattcccatagcaggagcaactcagttcacgcaaagcaggtagcagagaaactggaggctttcttaggcagaaaaggagacaaactggcctttgtggaagagaaagcccctgcccaacaaaacagctatgactgtgggatgtacgtgatatgtaacactgaggccttgtgtcagaacttctttaggcaacagacagaatcactgctgcagctactcacccctgcatacatcacaaagaagaggggagaatggaaagatctcattaccacacttgctaaaaagtagctattgaagtatatttgcgacttttgaaggctcctctttctgcccttccccatttgttggatggctgcaatctcagtgcctgagggaagatgcctagtagaggaaagcttaatactctttttcctgaaagaatatcatcctctgcattatccccatggaacgtttcactttaaccctgactggggagcaatatgttctgtgaaaatatcttgaaattgtacaccaaaaccttacaaccaacttatttgaacatttattacacacagggtttacgtaagacttttcttattggtatataattaatttcctttggtctcccttatccacattggcttattctggaggaaaagcagtgatctgtaaaacaaatcaagaatatattaaatctagaggaatgcagagaagaaaactataaaacagaaccaaaaacttgttgcacagcctacataattaagagatcaactggctggaagcagatcaaggcctaacttcattcaagacctaaatattatgagactcagttattcggttttatgtgacatctcttccattcaccatgcacaggcttttccagctatctatataatgtttgcaaatatttgataaagatgatgttaccctatcttcctccatctgattcctggaatgcttgaagaaaggggaaatcttgagtaacctcattaaaattaatgtctggtggacctctca

SEQ ID NO: 980 - DNA, 22682 bp, Homo sapiens
attttttcttcttcaccttacggcagagcagggaactcagctttagattctccctgtactggaaagggatgtcgcaaggttggggacgaaacctctgagtttgcgaccgtagctgtcgctttccggccaacacagaggtgcctgaaggctggttggggtggtgaggcccgaggcaggtaagaagcctcctccccacttcggtttgtctcggcagtggatcgctctcccacccactcagattctggcgtatccgtgctccctcccgattctggacctggattctcagcgccgccggtcatagcccccgccccttttcaaacacgcacgctctctccacccactgccccctccattgtccccgccccgacctccgtttccattcatttctcagacttttcactgagtggtttccatgccttgggttccagaatgtcagaggcgaattaagtggtgtcagctttttgaagtgcttttgtataggagaccgtgagagaatccgcagtggtagtacaataaagtgacaatagagaaaaatgcacgggatgctgtctgcgcacagaagaggggtcccaggttgtgtaggaggataacgtgaggaagccctttccagggtgacttttgggtcacttttagaggactgtgttaaaagactagtaatccagtacctggtcaaagaaatacgaaaggaggtaaaagcagaataacgggcgcaagagcatgtgacagtggtggtctgaaagagaaaaaagaagtaaaataaacctgatggaaaccgtactagtgtagacttccctttaaagaagcatcgttataaagttagagaaatgaggaacgagaatatggccctcaggaatgttttctgtttaggtagaagactcaaaagcgtaccatgaaaccgagaagtggcctcttcgagggtgagggaggctaatttataagatcaagatcactagtggaacgcaaccttgtatgtgcatttgaatcacctgggaaactttttgttaaataaaaccaatactgttgccccactctagaccaattaaattctgggttgtgccaggtgtcattactgttttaaagctccacaggtgactctaatgctaaagattgagactcactaaactagagagaaggaagttgagacagttggctctgtaacattaagatggaggtcatttagccgggcgcggtggctcacgcctgtaatcccagcactttgggaggccgaggcgggtggatcacgaggtcaagagatcgagaccatccaggccaacatggtgaaacctcgtctctactaaatatacaaaaaattagccgggcgtggtagcaggcgcctgtagtcccagctactcgggaggccaaggcaggagaatggcatgaacccggaaggcggagcttgcagtgagccaagatcgcgccactgcactccagcctgggtgacagagcgagactccgtccccgcccccagaaaaaaaagatggaggtcatttaactacagagaggcttggagatggaatgagaaacttgagcggcgttatgtttggaataactggtctgggaaatgggagaaggagccactcttgcctttctcttcagcactgttcattcctcagtgtttatcaggtccaaattagttacttgtctctttgctctcccgttcccttccgtccaggattggtcagctgttgtctccagccttaaagctcaaaggccatccccacttctgtccccaaaatgatcagagctaagccaatttatgagatgcagagaccaacatccagagctaagccaatttatgagatgcaaagaccaacatccactctcatagagattactacatacagtgccttgccaatttagaatctttttctattatttatcatttaagttagtaatgagatataaagatatttaaaatacagctcaattaggatggaaaattaccgtattagggaaagcaggcctttaaacaaagaattcacttggcaggcagagaagctgtatgaggtaaagaccaagacagtgtatggctgctatctattaactagggttaatccaaaaacctgtctatcagacccagataagaacgagttattgttgtctagtatggctagagcatagtatggagagtagaggtgggacagagatgaagatgataaagtgggtgtgaacagattatgaggagccttgaattccatggtgaagagtttagattatattactagaagtaattaataagtacaaaaaaggttcttaacctcttttacccagtggaccttgttggcagtccaccttatagattcagtctcagaaaaatgttcttaaatatataaaatagaatacgtagtaatataaaggaaactaattttgttaagtttttaaaatattaaaacaaatgtgtgatatatatgcactttatgcattaaataaaatctggcagcaggtctaattatataatttctaagtagtgatgactataaattatattttgaaatgcctgcagcaactttaatgtgatgtgaaaatatcagatttctattggtaaaaaagagagtgctaatattgtagtttgtggtccacacttattgaagaaatgctaaatttcagctactgattattgaaaacaaagatgcaattgttttcccagtctaagttcacagaaccctgatattctagccacatcctggtctatggatcctaagttttaaaatatctcagtataatggttttaagcaagagcatgacatcaaatctgtgtttcagaaaaatgatgaagcagtgttcacttcccaacctctctgctgggatgagaggctggctctggggcagcaaccagtactatcccactgtttcctaataaccagggcctgcagagggactgagcttgtgggtgtatatgtctgtgagagtaataccagaaaataaatcaggaaaggtagattggggctatttttgtggaaatcattgaatgccaggctgtaatttgtagttactttggtagacaatggagggttgttaaaattttttggagtagaataatgtgattagagttctgtttgaaaatctagaataatgtgcaggttagattatcaaaagagaagataggaatgaagagactagaacaataagttaattaatttttgaaaaatggaatcttgggccaggtgcagtggctcaggcctgtaatcccagcacttggggaggctgaggcaggaggatcacttgagcccaggagttcaagaccagcctgggcaacaaagtgagaccgtgtctctccaaaaaaaaaaaaagaaaattagccagacatagtggtgcctgcctgtggtcccatctacacgggagactgaagcaggaggattacatgagcccaggaggtcgaggctgcagtgttcatgccactgcactccagcctgagtgacagagagcctgtctccaaaaaaaatcttgaggtgatctctagagtctgctaaattcctttatttccacaatgtgctgaccagtctagagtaacatacattggaataaatggcatacctgtcaacaggaatatataccccagtgtgggagtcagttaactttatgtggtcaagaggctagcccagtcttttgtattataaatgatattgttagtacttctaataaagcaatggccttaccataagttcacagatcttgccaaggccttcctcagtcaaactccatctatacctgtgagtcctacatttctgacttttaaaagtcagaacctgtctatacctgtgagtcctacatttctgtcttttaaaagtcagaactcctctctttttgccaattccttaaacttcttggatgggaaagaagtttagtttaaacacattagcaaaagaatgggaggtcctcaaggcccaggcaacccatctcctttgaaactgatcaataccggactataaaaacttactgctcaaatccagctagtacccaaagtatgtactgtctatatacctgtctatacctgtgagtcctacatttctgacttttaaaagtcagaactcctctctttttgccaattccttaaacttcttggatgggaaagaagtttagtttaaacacattagcaaaagaatgtgaagtcctcaaggcccaggcaacccatctcctttgaaactgatcaataccggactatagaaacttactgctcaaatccagctagtacccaaagtatgtactttttaaatgtattctaaaaaattgaatttggggtttaggtattactgatccaaatgagtcctataaaattaacttccagaactaggttctcagagaggccaccattaccaccttcttcaacataactagcctatattgactttctgtccatcaaataattggaggccatttgggtggtgataggaagaattaagtttatgcagaacttgaggttcagctatctgacaccttttgcgggaggaggaggagtgggtctatctgaaatcagaaataatacttttatgaggctttttaataatttttattacttacagaaaatttctgaaagttcctttctctggctcccaattaaatggcttactccacaatcaacttataaaagcactggatcattgtcttgatcccaaaaaatttgtcccaactatagttactattttgagcatctgtattattgtttgaaaaccttaggcttgctttccctgatggccaatgaataaaactctcaaagtcgtgtgattcattactcattaattcattagatatttattgaacctctactatgtgccaggcacatttttgaaacccactaatgagcaatttgtaatgacaatttacctcttaactatctatgaaaaaaataacttgccaggatttgaaatccttagaacaaatgagattaaaagatcatagcttttttgtgttctttcaaatagtgtgtttgcatagagctgccatgtgctgaccacagtgattatctgtgaaatgaggtaaatcatggctttaaccactccttatcagactttgttaccacatgtactaaaataaagttctgtctacacctttataaaatattatcttacacagacgtcttattaattctaatggcctctccacacctgaccctcactcctagtcatttcaaagtttgcaattgtgtaaagtcatttctcagaaaatttgaagcaaaacaaagtcaccacaagaaaaacttggtatacaccaggtttatattgaggacaaaaactgtgacacaattacaaatggaacttttttttttttttttgtgatggagttttgctcttgttccccaggctggagtgcagtggcgtgctcttggctcaccacaaccgccacctcctgggttcaagcaattctcctgcctcagcctcccgagtagctaggattacagttgtacactaccacgcctggctaattttgtatttttagtagagacagggtttctccatgttggtcaggctgatctagaacgcccgacctcaggtgatccacccgccttggcctcccaaagtgctgggattacaggcatgagccaccgcacccagcctacaaatggaactcttgaggtagaaatggtagaccaggaataaaattattttcatggtcaatgacaccttagccattgatagctgtgcctagttacagagcaataaatggagagccttggtgttagatgaaatcctaaaaagtcacctgttttatctccttggccccagacagaataaagtggaatttatagcagtagagttaccaagcatcatcatcacaccaagtaggttttgtactttgagagctgaattcctctctgaaatattgatgttacaggaatgttgtttaaattcatagctcatttataaaattgagaatatttcttacatttataactgtgttgtgttttcctgagtttttcaagatatgtttcacttctgtactttgctcactcaggaaaaatatttatttattaaaactctagcttgtcaggcactgaagttagaaggatgagtaaaatctaatctgtgtactcaagagggttatataataaatcttgatggtcattcttacatgccacattatacagatctccagatggcttaggcttagttttaaaaggaaacgttttaattggggggaaattgaaaccccaaaaaaaagccatgaacttccttcctggaaatatttttgccataaaaagcatatttggtcttggatgtgattctttttgtgaaagtgcaagttgaatcagacattagaagttggacataatcttctaattttagtaaacatcaaattatttttaaatatttgtgtttgaacatttatggaaaagagattagatttacctgttttatccagaggacagaagtaagactcagaagttgaaaaaatggaaatattttatgtcattataagagtgggaactggtacatcttttattcctcttcaatatggaaatcactgtatttactaattatgtgttcattattaaaaaagggggaaaaattaaagcacaatatcaaaaggtagaaggaaaaaggcaaaaaagtattaatcctatttcttaaaatgatatttacacttgatggatatcgttcttgattatttttctgtatatttttatcatatacagatgtttatatcaaagcatattatgaacatttttcttttaataaatttgtattgacaatattatatttaatggctgaaaactattccatcgtgtggaaaccctgttgtttaatttaccagtccttttttgaactccagattgtttccagtttttctgttacaaatactgccatggtgaatatcttgttgaatttttgcacacattgttaatgtctcccttaagttaaatttcttaaagtataatacctacatatataaatttcttaagaattccaatataatggcaaattacccttgaaaaagcttgcatgtatgacagtcctatcaaaatggggcatcatttactcatttcccataatctctcagcaatgctaattattattagttttcttcacctttgctaacttgacaggtaaaaaaatgaaattttattttaacttacatttatttgattactactctgatgtccagtgtcttttcatgtgtttattgactagtcatgtaagtgtattaactaatattttctaacaattttttttttactttttaacatttaaatttgtattctatctaaaatataatttgatgtaaggtatgaggtaaaactctttacttttttaatcaaataattaacaagttgtgccaatgctacttattaaaaaatccagcaagcatatcccatacttcaatatacagataataaagtactgatagatattcctccaaaaaaaagaaagactatttcgtggttaaataagtttgggaaaagatcatacgaaaaaaagttaaaattttttatcgccaaactctcgttagcctctagtgtgtgtgtgtgcattaggagttagcatttcctaatttaattaaccatgtaatcttttttcttttttatttatttatttattttatttatttatttttttgagatggagtctcactctgtcgcccaggctgtagtgcagtggggtgatctcggctcactgcaacctctgcctcccaggttcaagcaattctcctgcctctacctcccaagtaactgagattacaagtatgcactaccatatccaacttgttttgtattttcagtagagatggggttttgccatattggccaggcgggtctcaagctcctgacctcaggtgatctgcctgccttagcctcccaaagtgctgggattacaggtgtgagctattttttttaaccatgtaatctcacttcataggtatttcaggaaatacctatgaaagcctgtggaactgagctgtccagtatactagcactagccacatgtggctatttaaattttagttaattaaaattactcagttcttcagtcacactgaccatatttcaagaactcaatagccacaaggggctagtggctactgtattgaacattttgcagataaaagaaaatttccgggccaggcacagtggctgatgcctgtaatcccagcacgctgagaggccgaggtgggtggatcacaaggtcaggaattcaagaccagcctggccaagctggtgaaaccctgtctctactaaaaaactacaaaaaattagccaggcacagtggcagttgcctgtaatcccagctactcgggaggctgaagcaggagaatcgcttgaacccaggcagcagaggttgcagtgagccgagattgcgccactacactccagccggggcgacggagtgagactccatctcaaaaaataggaaaatttccgtcacaagaagtgctattggacagcactgctatgggaacataatgttcagtggaacacgtgaacacgctgaaaacactggaataatccataatttctcctgatttgtcaggcaaacatgattactactacactatgagaacagactctctcattgatttgtaaagactccatcatcatatttaaaatttctaatctacatatgatttttttatgctattgatttatctacttctgctccaataccacacccctagttttaagtcaaggttctgcacctttctctttcagagcagaaatgaagaattcttgcatggagtaggaaattagattagaagtgatagtaaaggcgctttcacttcccagactctaaatgtaaacatttctctgccgaacttgatttatattatgttgagctgtatactcaattacttattcatttattctacaattatttattgagtacctgcctggtaagcactgttttaggtcctggggttaaaatggcaaacaaggcagacaaggcccctcgtcgtcttattttcatagagcttacattcttgttttggagagggaaagagaagaggcagggggaggaaaaaagaatatgaaccaataaacaaataaattaaaaaactatcacatagtaatcagtgctattcaaggaattgaaattagagtgatagtaactggtggcctctttgttttggctgccctgagacctctgtgacttagtggcatttaaactaagatctgtccaaagaagaagctaattactagaaggtccaggcagagctagtaccaccctcaggagggaaaaagcttggtgtatttgaggagtaaaaagaaagtctttgtggctgggtcttagtgggcaagcagggaaataataggagataaggttggagaaatagctgaagccacattttcatgtagggttttgtaaactagggtagggaattttcatttttttctgagtatgatagctactagagactcctaagcagggaacagacctggcctaatttaaatttttaaacaattattttgatggagaatttattggcacagtcagtagtggaaataggagacctgttaggctaggtcaagaaagaaatggtgatagatttgactaaggtgatagtagtgaagatggaaagcattggacagatttagaacatttaggctatagaatcaacaggacttgtcaattggatgtgaagtgtgaagacaatagaaaactctgggatgagcctgggcaacatagtgagaccctgcctctataaaaaaaaatattaattagccagacatggtggtatgcacgtatagtgcatatagctacttggaaggccaaggtgggaggatcacttgagcccatcagttaaaggctgcagtgagctatgattgcaccactgcactccatcctgggcaacagagtgagacgttttcaaagaaagagagagggaaaggggagaggggagagagggaggggaggggaagaagaaaaaacagagagagagagaaagaaaaaaactaactcttggatgatgtctgtaatccattatatagtaaccaggttcaattttcagtctgattatggcaggcaaaattgggacacataagacaccaataaatatattttaaccaaatgaataaatttactttaataaatgtttctctcctgtacacatttaagctgctaaagcataagcttgtgctcattcctttattattagggaatctgactcctaagaatttgaggtttatgtcataaacacatcagctataggtaattattagactgttcccctgaagtatccaagccaacagaggagactgaatgaaacagaaaaaattgcctgccacagttgcaaaagttctgtgagattctcatattttatttttaaatttcatgctgattttgcattttatgcccaagtttatgttaataattaaaatatttttagttgctgatttaaatgttttaagtcaatgattaagtggtttagctctttcccctaaagttggtcaaattaaagctctaggaagatgccctgtgattaacttgtgtttgttttttggactttctttgttgctatctgctggcacatgggcatgtatccatttagagaagtacagatgcatctctgagcatttgtagtttggtacaacttaaaatcgtagccaaagcgagtgaggaaggcaatagcatttagaaacaactgacttttataatctgcacttactttgtaatgtttttaaaaaacatacctgaatgaggctgtttctctctttttatttttttaaggaatgcttactgaataattagaaaaaaatgagtaaaggtcacaattctggaatagtatgttttcagtaaaacagatttatctggagtactacttaagtcaatagccaacaggcttattttccctgaagttttgagaattgctgtatgccatataaaatccttgttaatttaaaactctaatacatattttaatcccataaaataaatacttatacatctataaaatagacaattatcgttaatatccattgtaaattagtatttttaagcatttccattcattaaaaatccagattgagtccaggtgaggtagctcacgcctatcaacccagcactttgggagggctagacaggaggatcactggagccaaggagttcaagacggcctgggcagcataatgagacctcatctctacaaatttttttttttttgagacagtttcgctgttgttgcccaggctggagtgcaatggtgccatttcggctcactgcagcctccgcctcctgggttcaagcgattctcctgcctcagcctcccgagtagctgggattacaggcatgcaccaccacacccggctaattttgtattttttttttttttttttttagtagagactgggtttctccatgttggtcaggctggtgtcaaactcctgacctcaggtgatccacccacctcggcctcccaaagtgctgggattacaggcatgagccactgcgtctggccacattttttttttttaattagccaggtgtggtgggaggcacctgtggtcccagctacttaggaggctaaggcaggaggatcacttgagcccaggaggtcaaggctgcagtggccgtgattgcaccactgcattccagcctgggggacagagtgagacccagtctaaaaaaaaagaaaaaaaaaatccagactgaaacagcaataacacctccagttaaaagttaatctggccaggcaccatagctcacacctataatcccagcattttgggaggccaaggtggtggatcacctgaggtcaggagtttgagaccagcctggccaacatggtgaaaccccgtctctactaaaaacaatacaaaaaattagccaagcattgtggtaggcacctctaatcccagctacctgggaggctgaggcaggagaatcacttgaacctgggaggcagaggttacagtgagctgagatcgcgccattgcactccagcctgagcaagaagagcgaaatgccatctcaaaagaaaaaagaaaagtcaatttatctggaaactgcctttaagatagtttaataaatgtccccagtgctttattagaattgtaaaagttcttaaaattaattcaacctggaaatttacagattacataacagtgatctagaatagggattggcaaactttttctctaaaaggccaaatagtaaatattttagactttgcagactactctgtccttagaggtcaaaagtagccataaacagtatgtgaacaaatgaacatgacttagtccaataaaactttatttatagaagcaggcagtgggccagatttggcctgcaaactgtaatttgctgacctttggactagaaaactagaatgttttaggatttttttttttttttttttttttgagacagagtttcgcccttgttccccaggctggagtgcaatggcgtgatctcggctcaccgcaacctccacctcccaggttcaagcaattctcctgcctcagcctcccaagtagctgcaattacaggcatgcgccaccatgcccagctaattttgtatttttaatagagacagggtttctccatgttggtcaggccagtctcgaactcccgacctcaggtgatccgcctgcctcagcctcccaaagtgctgggattacaggtgtgagccactgcgcccggcaggatttttataaacaggatgacagaatttaaaaattggcagagatgacagcttagaatcatagaatatagagctagtggaaacttagaaaagagctagtggaaacttagacatcagaataacttggaaatatcttaaaaatgcagaggcccagattctatcccaggtgtatgctctttaaaatccccacagataggtgggcatggtggtgcatgcctatagtcccagctactcaagaggctgaggcagaaggatggccttgagcccaagagttcaaggatgcagtgagctataatcacaccactgcactccagcatgggcgacacagcaagacctcatctcttaaaataatttttttaaatctcatagatgattctaatatgcttccctggctagaaccactgtttacctggtccagaccactcagtttacagatgatgaagctgaaattcataggttaagtgactcttccagagtcaaacaactggttaattgtagatctgaactgaatcccaggtctgactccctaactaatattttttctactgaaccagcagcttcttcccttgtatcagcaggccatcagaatgactcctattgaattgtgaattttcccttcaagttggtttttattactttttatttaattactttgttttttataacaaatattcaagtagtgtgcatcttaaggattttaggattaataagaagtaatctccttctattaaaattaatcctttgttaaggaagtgttctacacttatgaattcaatattagcttcatttaattacagaatttggaagatacaataaactaacccctgtaatgacagggtttgtgtatactgacaacacattaacatcattgcttcactcagattgagagaacaattttccctggacttagcattctctctctttatgccaaagataaagcacaagagcagagtcatgccatggctagttccatctttgataactttgtggctttatataaagagacaagtgctttattttcaagaaatctttggggtccattattgccacctcaaacatagggaacagggaaggaaactaagtttttttgagagcctactgtagatcagacaaggtgctgagtgttttcactcatgtttttaattcgtgtaacaacctgtgattatgttattactacctcatcttacagatgaggaaaatgaggcccagaaagaggaagaataacttgcccacgatcacttaaatagtaagtggcaaggtcagagcctagacccaagacttcctagccctaaaacatagaactatgtgtttggtaagattttacaaatagaactataaggaggtcattggctccccagttgactcacctttcttgcccttcccctagtcttgcttaccatccaccaagaccaagtacacagatccttttaactctaaacgaatttactattaacagcagaacaataaaggataacaggcaaagcataaaaccaaagaataaggatgttacaaagaatacagaaatcttaagtggccttatttctttttttcccgtaatctaaattttctgacttccctttaaaaatatttcattcatctggcaaacatttattgcacttcagatatgccaggcacagtgctcactacatagaaaatattcctaaatgattatagatggctcttggttttttgctaggtccccttccatctccttttctcccaccccattgataatgttattatcatcctctcactcacccccaactgaaaccttcagaccatttcataattctttttttttttttttttttttaaacagagtctcactctatcccccaggctggagggcagtggcgaggtctcggctcattgcaacctctgcctcccgttttatctaccctcctctgatcacttactgagtcttattgattctctgtctacaatatctattcctccacattcctactatcatttctcctgctttaggtcattacctcctacctttacttgcaataaaaatctaattgggctgggcacagtggctcatgcctgtaatcccagcactttgggagggcaaggcgggcggaacacctgaggtcaggaattcgagaccagcctggccaacatggtgaaaccccgtctctactaaaaatacaaaaattagccaggcatggtgccaggcacctgtaatcccagctacgcgggaggctgagacgggagaatcgcttgaacccgggaggcagaggttgcagtgagccaagattgcaccactgcaccccagcctgggcgacagagtgagactcacctcaaaacaaaagaaaaaaatatctaattgatctctgctttcaatttttcccttaccaattagttctatatattatagctgaattattatcttcccaaagcattgacctggccattaatggctcccacttcctccagtataaatttcaaactccttcactggaattcagtctgtcaccacttagcttctaagaatcctctaatatttgcctgcacctctactactcccacttcattctagcacgctagactattcaagattctctccacatttgaaagcactttctttacctctctgtcttccacatgcatccagctccacctgtccttcaagagcccacttttatgccactttcctcaaagccatttctgatctgagcactcattccttttcatcctgttagccaggaatgattattctctcttgtgaattcccatacattctgtttgtgcctcttatggatttcttatctcattgactagaagccaccttatacatctttgtatctcccatagcatctaatatgaggtgctcagtaggtatttattgactaaaataatggtatatgcagtacgtgttcattataacaaaataggtttaagctcagtaagggtagaaactatttcattctcactctatattgccaccccctgacacaaaggagaacactcagtagacctttgttaaatgaaatacattacagttatcagtcattgggttataaatttcctgatgccataatagatacctagaaacactttgtctttttttgtttatttgttttgggggttttgtttttttggatggagtctcgctctgtcacccaggctggagtgcagtggcgctatctagactcactgcaacctctgcctcctgggttcaagctgttcttgtgcctcagtctccctagtagctgggactacaggcacccaccatgccccgctaattttttgtattttagtagagacagagtttcaccatgttgcctgggctggtctcgaactcctaagctcaggcagtttgcctgccttggccttatgttgtattttaaaatcctagttatgtatgtttctttattttatattgacaaataccacatgataaaggtcatatattcttattctcactttaagctgggcacggtggctcacacctgtaatcctagcatttagtggggcagaggcaggaggataacttgagctcaggagtttgaaaccagcctgggcaacaaagtgagaccctgtctctacaaaaatttaaaaattagccaggcatggtggtacgcacctgcagtcctagctactctggaggcagaagccagaaacttgcttgaacctaggagtttgaggctgctccgagctatgattgtgccactgtgctccagcctgagcaacagagcgaaaccctgtctttaatataaaaataaaaaatactgccttttggcccaaaatgccatcttccagtaatttgccaaatgactaacacaaagggaaagaggagaggtatccaatatatgttctctaggccttggaaaaaacatggagttgttcctttggccatgtatatgcgaatctataagaaatatgatatcgtagacatcaaggaaatggatactgttcaaaaaggaatgtcccagaagtgttaccatggcaaaactggaagagtttacagtgatacccagcatgatgttggcattgttgtaagcaaacaagggccagattcttgccaagagaattaacgtgcatattgagtgcattaagcactctgagaacagagatagcttcctgaaatcgtgaaggaaaatgatcagaaaaagaaggaagccaaagagaaaagagcctgggttcaccctgaagcaccagcctgctccacccagagaagcacacttttttgtttgttttttgtttgtttttgagacagagtctggctctgtcacccaggctggaatgcaatggcgcaatctcagctcactgcaacctctgcctcccgtgttcaagcgattctcctgcctcagcctcccgagtagttgggattacaggcacccaccaccacgcccggctaatttttgtatttttagtagagacgaggtttcaccatgttggtcaggctggtctcgaactcctggcctcaagtgatccgcccacctcatcctcccaaagtactgggattacaggtgtgagccaccatgcccagcctcagagaagcacactttgtgagaaataatagaaagaagcctgggctgctggtaggtgttaaaaaaaaaaaaactctggactataaaaaataaaaatagaaaatattttcactttacagaaaaggaaagtgagagttaaggaaatttagtaatttatttatgatcacacagccaatgagtaacagaattgaatctaaaatttaagtcttcaaatacgaagtttagagttatttttggcaaagggtgggtttggctaaaggctagttgagttctatttgcattagaatttttggagttaaacttgctgtcatgctgtatggaacagaattaaggccttgattaacattttgtctatgtgcttggtattttaaaaatcaaacagacaaaacacaaaaactatttctgaagaaaatcttagcccagcttgtggacattcccttcaaggtgagagatgactgactgttgaggcagtcttcttgcaggttcctttccctagttgggttggtgttgaagactgggtgtgatttcagcaggcagtgtagagagtaggtctccgggtttttgccaagctatatgacctggcactcacaagtatgcagtgtttattgaagacatgagagacagatgctgtagccagggagcagtcattctgcctttatattataaactcttacatcaagtcacatcgacaagctgattacctaaactctgtcaaattgcttttgtttgattgatctgtgcccatttgccataaggctagatagtaaagattattataggaaacaatcctgtctgtttcatctgttgtaaggatactgtgaggcactatttgttatgatgcaccatgtcttttatgaaaatctcttgagaaaaaactatcggactataatacaaagaattattttacctctcctgagcaattgctttgtttttgtcttatggacattgtgaatgtttacctttctctggccagatgccaaaaagcttagagccaaatttgtggcccacccataacaaatgtgctctatgcctcattaacttcattcttggctccagtttatgtctctccactagtctttttttcttaagaagatcctaattcatgccatcttattatatattttttcttttttctcataagtagccttatgttgtttctcaaatagtcagattatgacatactgtgtctacataaaaccatgttggatgccccttcatttactttggctttttttcttgaggggtgtattgatttttcatataggtttttgcagcgttttgttacacgaaaatggttatatcacaaaaattattgcttaatagtgtagacaagtggtaaaataactggtctaatggtcagaattgattaaattgatgtcataattctagtcttgtcttttacagcattattactattttcttataatatgctttgttttgcactctcaatctgcatgtgacagtttattgctgtgtgattttcagaaatattgtcgtgctgccaggtcactgcataacagctaactctctgttaactctgttgagtctgttaggctcaaatattctacacccatcagacttgtctcactttgggtggtcacaggcatattaatttcatcacacaacttgtcttgcttctcctctaaattagtcattcttttatttagacaagataatgtgaatggatatttgttttcaaacctcattttctttgattggtttggagctctagctggattttctgattatcttactaatgtcatctaattgataaatattattgtacaactttttaaactcttttagtacttccaagtaaaattatttggtcttctctacaactctctagggtatgtaaggtgggtatatgccttttttacagatggcatacaaaaatgattaaatgattttatatgccatctgtaaaaaaggcgtatacctttttagaaaaacaaggacaaagtcatttaaatgactgctcaagatgataccagcaaatcagtggtaaaactaggactagacccaggtttccagaatcttatcccatactaccttttaaaagaagtcaaaagaagttctaacttatattgtaaacattacttcatctttatcataccccttgaagctaaagctatgaaacaggcaaacacatgttatatcactcatgctcatagcagggcagaatcaggaatgaatttcatttgtattagtctcatgattctctgtttttaaaattacagttccttttaactactaccgtaatcactgtcacgttccattatggaaggaggaagcaatattttatcttatcttttgaaaattaatgttgaggccaggcgcggtggctcacgtctgtaatcccagcactttgggtggctgaggtgggtggatcacgaggtcaggagatcgagaccatcctggctaacacagtgaaaccccgtctctactaaaaatacaaagaattagccgggtgttgtggcgggcgcctgtagtcccagctacttgggaggctgaggcaggagaatggtgtgaacccgggaagcggagtttgcagtgagccaggatcgcgccactgcactccagcctgggtgacagtgcgagactccatctcaaaaaaaaaaagaaaaagaaaattagtgttgaaatgaaaagtatttcccttggaaattagtaactttttagattctttgaattcatctttaatataaaaataatttgttgtcattatgcatattcattaaggagccaaataatacagttaatggtatggtgtttggtaaaacattagctataattttaatctctgtgcttcaagaggatatttaaaattcatgcttactgtgtacatggcaagtttccagttctcattctaactaatcgtttacatgtagcacataagctagaatttcttatagttacagttgacccttgaacaacacaggggctaggagtgccaacccccgtatgcagtcaaaattctaggtataacttttttttttttttttttgagatggagtcttgctctgttgcccaggctggagcgcaatggcatgatctcagctcactgcaacctccaccttccaggttcaagcagttctcccacctcagcctttcgagtagctgggattacaggcatgccccaccacgcccggctaatttttgtatttttagtagagatggggtttcaccatgttggccaggctggtctcaaactcctgacctcaagtgatctgcccaccttggcctcccaaagtgctgggatttcaggcgtgagccacagcacccagcctaggtgtaggatttgactccctaaaaaaatacgccaggtgcggtggctcacgcctgtaattccagcactttgggaggctgaggcgggcggatcacaaggtcaggaattcgagaccagcctggctgatatggcgaaaccctgtctctactaaaaatacaaaaaaaaattagccgggcatggtggcacatgcctgtaatcccagctactcaggaggttgagtcaaaagaatcgcttcaacccaggaggcagaggttgcagtgagctgagatcgtgccactgcactccaatctgggcgacagagtgtgactccatctcaaaaaaaaaaaaaaaaaaaaactttactaccaataacatagccaattaacaataacatagccaattaatacatgttttgtaaatgtattatatactgcataatatataccttaccaataacatagccaattaacacgttttgtaaatgtattatatacatttacaaataaccttaccaataacatagccaattaacacgttaccttaccaataacatagccttaccaataacatagccagttaacacatgttttttaatgtattataaactgcattcttacgaaaaagtaagctaggggaaaatattaagaaaatcataaaagaaaatatatttactattcattaagtggaaatggatcgtcataaaggtcttcatcctcatcatcatgttgagtaggctgaagaggaggaggaaaaggagcaattggtcttgctgtctcaggggtggcagaggcaaaagaaaatccatgtgtaagtagatctgcacagatcaaacccaccttgtccaagggtcaactgtgtatttttttaccacaaccctataaaagtaactactattttccagccgcattttacagtcaggtatttattgacaataatattgtcttctagctcttgttcagcttctggaatttctgagcagccctcgtcagtacaagatggaccccgtagtcttgagttacatggacagtctactgcggcaatcagatgtctcactattggatccgccaagctggctcaatgaccatattattgggtttgcgtttgagtactttgccaacagtcagtttcatgactgctctgatcacgtcagtttcatcagccctgaagtcacccagttcatcaagtgcactagcaacccagcagagattgccatgttccttgaaccactggacctccccaacaagagagttgtatttttagccatcaatgataactccaaccaggcagctggaggaacccactggagtttattggtctacctccaagataaaaatagcttttttcattatgattcccatagcaggagcaactcagttcacgcaaagcaggtagcagagaaactggaggctttcttaggcagaaaaggagacaaactggcctttgtggaagagaaagcccctgcccaacaaaacagctatgactgtgggatgtacgtgatatgtaacactgaggccttgtgtcagaacttctttaggcaacagacagaatcactgctgcagctactcacccctgcatacatcacaaagaagaggggagaatggaaagatctcattaccacacttgctaaaaagtagctattgaagtatatttgcgacttttgaaggctcctctttctgcccttccccatttgttggatggctgcaatctcagtgcctgagggaagatgcctagtagaggaaagcttaatactctttttcctgaaagaatatcatcctctgcattatccccatggaacgtttcactttaaccctgactggggagcaatatgttctgtgaaaatatcttgaaattgtacaccaaaaccttacaaccaacttatttgaacatttattacacacagggtttacgtaagacttttcttattggtatataattaatttcctttggtctcccttatccacattggcttattctggaggaaaagcagtgatctgtaaaacaaatcaagaatatattaaatctagaggaatgcagagaagaaaactataaaacagaaccaaaaacttgttgcacagcctacataattaagagatcaactggctggaagcagatcaaggcctaacttcattcaagacctaaatattatgagactcagttattcggttttatgtgacatctcttccattcaccatgcacaggcttttccagctatctatataatgtttgcaaatatttgataaagatgatgttaccctatcttcctccatctgattcctggaatgcttgaagaaaggggaaatcttgagtaacctcattaaaattaatgtctggtggacctctca

SEQ ID NO: 981 - DNA, 22682 bp, Homo sapiens; identical to SEQ ID NO: 980

SEQ ID NO: 982 - DNA, 24067 bp, Homo sapiens
cacttttttcagcccaacccctccaaacatgggtctcggtcggtccccttaagccacaatggagggaatacattaggctaagcaaatattccctcaggatttcatggcaaagccctttcaaccaaagaaaggatcgcgactaaggagaaagataacaaggtttgcttgaggagaggtctgttgagagaggctacagtcggtggtgggagagaagccaaagtctgtgacggtgtctagagggactgacaccacatctaccgggagtaagaacaccatgacagcggctatctgaaagccgtgatggctagggttagtgctagtcggcttggtgatgagcgagctgggaggggttctactaagaagagtagggcgaggggcacatgggggacgcaatgggttagggggcggtcgagactttgcctgagaactgtaatcacgtcagcccaagggaggatgtaacgtagtctagaagctccattaagagtcctaagggactctgaggggtactaatggggtctgctgggttggggggaccgtgacagaatctccggggaggctggagggccggaatggtgcccggccaatggaagatacagggggtggggtctactggggatccggggccgtgatctggtgtttgggaggctcggcgcagacccgctcgcggggcgtctccgctgggacggggcggggcggcccgaccggagccaaatagcgaggctgagacgtgggccaggacgggctgcagggccgctgggcgcttgggcgggtcttacctcgggctccgccgcggtggccaccgcagccccctcctcttcgacggaagctgccttccaccctccgccccagggtaggaccggagatggcagaagaggccgaggccaccgagggtcggacggttccgggagggtgggcccagcagcctcagggtccgggcgagcggccgcggcgcatcccccgccctgtcagagagactccgcccggcctgagcaggcacatcccccgccgcaccccgcccagagagcacgcgttggaccgccgcctcaaccgctgccagcggccgcctctgccggtgcaactactgcctccgccgccgcctctcgcagtccgggctgtcctgtactctctcaacagacacagccaaccgccgccgcgtcccttatccgcttcggtcgcgcgcccccgaccccgcgcacgcggccccgccccgcgcgactccccggctgcaggcgagcaggcgcgcgcgcacttacctcccacgccccctactgccagcacgggtcggccccgccctgtcccgcccccgcacgtgacgccactggagagtacagcgtgcgcttgcgcagacacgccccctttcctacgccccaggcggccccgcccaaattttttcttcttcaccttacggcagagcagggaactcagctttagattctccctgtactggaaagggatgtcgcaaggttggggacgaaacctctgagtttgcgaccgtagctgtcgctttccggccaacacagaggtgcctgaaggctggttggggtggtgaggcccgaggcaggtaagaagcctcctccccacttcggtttgtctcggcagtggatcgctctcccacccactcagattctggcgtatccgtgctccctcccgattctggacctggattctcagcgccgccggtcatagcccccgccccttttcaaacacgcacgctctctccacccactgccccctccattgtccccgccccgacctccgtttccattcatttctcagacttttcactgagtggtttccatgccttgggttccagaatgtcagaggcgaattaagtggtgtcagctttttgaagtgcttttgtataggagaccgtgagagaatccgcagtggtagtacaataaagtgacaatagagaaaaatgcacgggatgctgtctgcgcacagaagaggggtcccaggttgtgtaggaggataacgtgaggaagccctttccagggtgacttttgggtcacttttagaggactgtgttaaaagactagtaatccagtacctggtcaaagaaatacgaaaggaggtaaaagcagaataacgggcgcaagagcatgtgacagtggtggtctgaaagagaaaaaagaagtaaaataaacctgatggaaaccgtactagtgtagacttccctttaaagaagcatcgttataaagttagagaaatgaggaacgagaatatggccctcaggaatgttttctgtttaggtagaagactcaaaagcgtaccatgaaaccgagaagtggcctcttcgagggtgagggaggctaatttataagatcaagatcactagtggaacgcaaccttgtatgtgcatttgaatcacctgggaaactttttgttaaataaaaccaatactgttgccccactctagaccaattaaattctgggttgtgccaggtgtcattactgttttaaagctccacaggtgactctaatgctaaagattgagactcactaaactagagagaaggaagttgagacagttggctctgtaacattaagatggaggtcatttagccgggcgcggtggctcacgcctgtaatcccagcactttgggaggccgaggcgggtggatcacgaggtcaagagatcgagaccatccaggccaacatggtgaaacctcgtctctactaaatatacaaaaaattagccgggcgtggtagcaggcgcctgtagtcccagctactcgggaggccaaggcaggagaatggcatgaacccggaaggcggagcttgcagtgagccaagatcgcgccactgcactccagcctgggtgacagagcgagactccgtccccgcccccagaaaaaaaagatggaggtcatttaactacagagaggcttggagatggaatgagaaacttgagcggcgttatgtttggaataactggtctgggaaatgggagaaggagccactcttgcctttctcttcagcactgttcattcctcagtgtttatcaggtccaaattagttacttgtctctttgctctcccgttcccttccgtccaggattggtcagctgttgtctccagccttaaagctcaaaggccatccccacttctgtccccaaaatgatcagagctaagccaatttatgagatgcagagaccaacatccagagctaagccaatttatgagatgcaaagaccaacatccactctcatagagattactacatacagtgccttgccaatttagaatctttttctattatttatcatttaagttagtaatgagatataaagatatttaaaatacagctcaattaggatggaaaattaccgtattagggaaagcaggcctttaaacaaagaattcacttggcaggcagagaagctgtatgaggtaaagaccaagacagtgtatggctgctatctattaactagggttaatccaaaaacctgtctatcagacccagataagaacgagttattgttgtctagtatggctagagcatagtatggagagtagaggtgggacagagatgaagatgataaagtgggtgtgaacagattatgaggagccttgaattccatggtgaagagtttagattatattactagaagtaattaataagtacaaaaaaggttcttaacctcttttacccagtggaccttgttggcagtccaccttatagattcagtctcagaaaaatgttcttaaatatataaaatagaatacgtagtaatataaaggaaactaattttgttaagtttttaaaatattaaaacaaatgtgtgatatatatgcactttatgcattaaataaaatctggcagcaggtctaattatataatttctaagtagtgatgactataaattatattttgaaatgcctgcagcaactttaatgtgatgtgaaaatatcagatttctattggtaaaaaagagagtgctaatattgtagtttgtggtccacacttattgaagaaatgctaaatttcagctactgattattgaaaacaaagatgcaattgttttcccagtctaagttcacagaaccctgatattctagccacatcctggtctatggatcctaagttttaaaatatctcagtataatggttttaagcaagagcatgacatcaaatctgtgtttcagaaaaatgatgaagcagtgttcacttcccaacctctctgctgggatgagaggctggctctggggcagcaaccagtactatcccactgtttcctaataaccagggcctgcagagggactgagcttgtgggtgtatatgtctgtgagagtaataccagaaaataaatcaggaaaggtagattggggctatttttgtggaaatcattgaatgccaggctgtaatttgtagttactttggtagacaatggagggttgttaaaattttttggagtagaataatgtgattagagttctgtttgaaaatctagaataatgtgcaggttagattatcaaaagagaagataggaatgaagagactagaacaataagttaattaatttttgaaaaatggaatcttgggccaggtgcagtggctcaggcctgtaatcccagcacttggggaggctgaggcaggaggatcacttgagcccaggagttcaagaccagcctgggcaacaaagtgagaccgtgtctctccaaaaaaaaaaaaagaaaattagccagacatagtggtgcctgcctgtggtcccatctacacgggagactgaagcaggaggattacatgagcccaggaggtcgaggctgcagtgttcatgccactgcactccagcctgagtgacagagagcctgtctccaaaaaaaatcttgaggtgatctctagagtctgctaaattcctttatttccacaatgtgctgaccagtctagagtaacatacattggaataaatggcatacctgtcaacaggaatatataccccagtgtgggagtcagttaactttatgtggtcaagaggctagcccagtcttttgtattataaatgatattgttagtacttctaataaagcaatggccttaccataagttcacagatcttgccaaggccttcctcagtcaaactccatctatacctgtgagtcctacatttctgacttttaaaagtcagaacctgtctatacctgtgagtcctacatttctgtcttttaaaagtcagaactcctctctttttgccaattccttaaacttcttggatgggaaagaagtttagtttaaacacattagcaaaagaatgggaggtcctcaaggcccaggcaacccatctcctttgaaactgatcaataccggactataaaaacttactgctcaaatccagctagtacccaaagtatgtactgtctatatacctgtctatacctgtgagtcctacatttctgacttttaaaagtcagaactcctctctttttgccaattccttaaacttcttggatgggaaagaagtttagtttaaacacattagcaaaagaatgtgaagtcctcaaggcccaggcaacccatctcctttgaaactgatcaataccggactatagaaacttactgctcaaatccagctagtacccaaagtatgtactttttaaatgtattctaaaaaattgaatttggggtttaggtattactgatccaaatgagtcctataaaattaacttccagaactaggttctcagagaggccaccattaccaccttcttcaacataactagcctatattgactttctgtccatcaaataattggaggccatttgggtggtgataggaagaattaagtttatgcagaacttgaggttcagctatctgacaccttttgcgggaggaggaggagtgggtctatctgaaatcagaaataatacttttatgaggctttttaataatttttattacttacagaaaatttctgaaagttcctttctctggctcccaattaaatggcttactccacaatcaacttataaaagcactggatcattgtcttgatcccaaaaaatttgtcccaactatagttactattttgagcatctgtattattgtttgaaaaccttaggcttgctttccctgatggccaatgaataaaactctcaaagtcgtgtgattcattactcattaattcattagatatttattgaacctctactatgtgccaggcacatttttgaaacccactaatgagcaatttgtaatgacaatttacctcttaactatctatgaaaaaaataacttgccaggatttgaaatccttagaacaaatgagattaaaagatcatagcttttttgtgttctttcaaatagtgtgtttgcatagagctgccatgtgctgaccacagtgattatctgtgaaatgaggtaaatcatggctttaaccactccttatcagactttgttaccacatgtactaaaataaagttctgtctacacctttataaaatattatcttacacagacgtcttattaattctaatggcctctccacacctgaccctcactcctagtcatttcaaagtttgcaattgtgtaaagtcatttctcagaaaatttgaagcaaaacaaagtcaccacaagaaaaacttggtatacaccaggtttatattgaggacaaaaactgtgacacaattacaaatggaacttttttttttttttttgtgatggagttttgctcttgttccccaggctggagtgcagtggcgtgctcttggctcaccacaaccgccacctcctgggttcaagcaattctcctgcctcagcctcccgagtagctaggattacagttgtacactaccacgcctggctaattttgtatttttagtagagacagggtttctccatgttggtcaggctgatctagaacgcccgacctcaggtgatccacccgccttggcctcccaaagtgctgggattacaggcatgagccaccgcacccagcctacaaatggaactcttgaggtagaaatggtagaccaggaataaaattattttcatggtcaatgacaccttagccattgatagctgtgcctagttacagagcaataaatggagagccttggtgttagatgaaatcctaaaaagtcacctgttttatctccttggccccagacagaataaagtggaatttatagcagtagagttaccaagcatcatcatcacaccaagtaggttttgtactttgagagctgaattcctctctgaaatattgatgttacaggaatgttgtttaaattcatagctcatttataaaattgagaatatttcttacatttataactgtgttgtgttttcctgagtttttcaagatatgtttcacttctgtactttgctcactcaggaaaaatatttatttattaaaactctagcttgtcaggcactgaagttagaaggatgagtaaaatctaatctgtgtactcaagagggttatataataaatcttgatggtcattcttacatgccacattatacagatctccagatggcttaggcttagttttaaaaggaaacgttttaattggggggaaattgaaaccccaaaaaaaagccatgaacttccttcctggaaatatttttgccataaaaagcatatttggtcttggatgtgattctttttgtgaaagtgcaagttgaatcagacattagaagttggacataatcttctaattttagtaaacatcaaattatttttaaatatttgtgtttgaacatttatggaaaagagattagatttacctgttttatccagaggacagaagtaagactcagaagttgaaaaaatggaaatattttatgtcattataagagtgggaactggtacatcttttattcctcttcaatatggaaatcactgtatttactaattatgtgttcattattaaaaaagggggaaaaattaaagcacaatatcaaaaggtagaaggaaaaaggcaaaaaagtattaatcctatttcttaaaatgatatttacacttgatggatatcgttcttgattatttttctgtatatttttatcatatacagatgtttatatcaaagcatattatgaacatttttcttttaataaatttgtattgacaatattatatttaatggctgaaaactattccatcgtgtggaaaccctgttgtttaatttaccagtccttttttgaactccagattgtttccagtttttctgttacaaatactgccatggtgaatatcttgttgaatttttgcacacattgttaatgtctcccttaagttaaatttcttaaagtataatacctacatatataaatttcttaagaattccaatataatggcaaattacccttgaaaaagcttgcatgtatgacagtcctatcaaaatggggcatcatttactcatttcccataatctctcagcaatgctaattattattagttttcttcacctttgctaacttgacaggtaaaaaaatgaaattttattttaacttacatttatttgattactactctgatgtccagtgtcttttcatgtgtttattgactagtcatgtaagtgtattaactaatattttctaacaattttttttttactttttaacatttaaatttgtattctatctaaaatataatttgatgtaaggtatgaggtaaaactctttacttttttaatcaaataattaacaagttgtgccaatgctacttattaaaaaatccagcaagcatatcccatacttcaatatacagataataaagtactgatagatattcctccaaaaaaaagaaagactatttcgtggttaaataagtttgggaaaagatcatacgaaaaaaagttaaaattttttatcgccaaactctcgttagcctctagtgtgtgtgtgtgcattaggagttagcatttcctaatttaattaaccatgtaatcttttttcttttttatttatttatttattttatttatttatttttttgagatggagtctcactctgtcgcccaggctgtagtgcagtggggtgatctcggctcactgcaacctctgcctcccaggttcaagcaattctcctgcctctacctcccaagtaactgagattacaagtatgcactaccatatccaacttgttttgtattttcagtagagatggggttttgccatattggccaggcgggtctcaagctcctgacctcaggtgatctgcctgccttagcctcccaaagtgctgggattacaggtgtgagctattttttttaaccatgtaatctcacttcataggtatttcaggaaatacctatgaaagcctgtggaactgagctgtccagtatactagcactagccacatgtggctatttaaattttagttaattaaaattactcagttcttcagtcacactgaccatatttcaagaactcaatagccacaaggggctagtggctactgtattgaacattttgcagataaaagaaaatttccgggccaggcacagtggctgatgcctgtaatcccagcacgctgagaggccgaggtgggtggatcacaaggtcaggaattcaagaccagcctggccaagctggtgaaaccctgtctctactaaaaaactacaaaaaattagccaggcacagtggcagttgcctgtaatcccagctactcgggaggctgaagcaggagaatcgcttgaacccaggcagcagaggttgcagtgagccgagattgcgccactacactccagccggggcgacggagtgagactccatctcaaaaaataggaaaatttccgtcacaagaagtgctattggacagcactgctatgggaacataatgttcagtggaacacgtgaacacgctgaaaacactggaataatccataatttctcctgatttgtcaggcaaacatgattactactacactatgagaacagactctctcattgatttgtaaagactccatcatcatatttaaaatttctaatctacatatgatttttttatgctattgatttatctacttctgctccaataccacacccctagttttaagtcaaggttctgcacctttctctttcagagcagaaatgaagaattcttgcatggagtaggaaattagattagaagtgatagtaaaggcgctttcacttcccagactctaaatgtaaacatttctctgccgaacttgatttatattatgttgagctgtatactcaattacttattcatttattctacaattatttattgagtacctgcctggtaagcactgttttaggtcctggggttaaaatggcaaacaaggcagacaaggcccctcgtcgtcttattttcatagagcttacattcttgttttggagagggaaagagaagaggcagggggaggaaaaaagaatatgaaccaataaacaaataaattaaaaaactatcacatagtaatcagtgctattcaaggaattgaaattagagtgatagtaactggtggcctctttgttttggctgccctgagacctctgtgacttagtggcatttaaactaagatctgtccaaagaagaagctaattactagaaggtccaggcagagctagtaccaccctcaggagggaaaaagcttggtgtatttgaggagtaaaaagaaagtctttgtggctgggtcttagtgggcaagcagggaaataataggagataaggttggagaaatagctgaagccacattttcatgtagggttttgtaaactagggtagggaattttcatttttttctgagtatgatagctactagagactcctaagcagggaacagacctggcctaatttaaatttttaaacaattattttgatggagaatttattggcacagtcagtagtggaaataggagacctgttaggctaggtcaagaaagaaatggtgatagatttgactaaggtgatagtagtgaagatggaaagcattggacagatttagaacatttaggctatagaatcaacaggacttgtcaattggatgtgaagtgtgaagacaatagaaaactctgggatgagcctgggcaacatagtgagaccctgcctctataaaaaaaaatattaattagccagacatggtggtatgcacgtatagtgcatatagctacttggaaggccaaggtgggaggatcacttgagcccatcagttaaaggctgcagtgagctatgattgcaccactgcactccatcctgggcaacagagtgagacgttttcaaagaaagagagagggaaaggggagaggggagagagggaggggaggggaagaagaaaaaacagagagagagagaaagaaaaaaactaactcttggatgatgtctgtaatccattatatagtaaccaggttcaattttcagtctgattatggcaggcaaaattgggacacataagacaccaataaatatattttaaccaaatgaataaatttactttaataaatgtttctctcctgtacacatttaagctgctaaagcataagcttgtgctcattcctttattattagggaatctgactcctaagaatttgaggtttatgtcataaacacatcagctataggtaattattagactgttcccctgaagtatccaagccaacagaggagactgaatgaaacagaaaaaattgcctgccacagttgcaaaagttctgtgagattctcatattttatttttaaatttcatgctgattttgcattttatgcccaagtttatgttaataattaaaatatttttagttgctgatttaaatgttttaagtcaatgattaagtggtttagctctttcccctaaagttggtcaaattaaagctctaggaagatgccctgtgattaacttgtgtttgttttttggactttctttgttgctatctgctggcacatgggcatgtatccatttagagaagtacagatgcatctctgagcatttgtagtttggtacaacttaaaatcgtagccaaagcgagtgaggaaggcaatagcatttagaaacaactgacttttataatctgcacttactttgtaatgtttttaaaaaacatacctgaatgaggctgtttctctctttttatttttttaaggaatgcttactgaataattagaaaaaaatgagtaaaggtcacaattctggaatagtatgttttcagtaaaacagatttatctggagtactacttaagtcaatagccaacaggcttattttccctgaagttttgagaattgctgtatgccatataaaatccttgttaatttaaaactctaatacatattttaatcccataaaataaatacttatacatctataaaatagacaattatcgttaatatccattgtaaattagtatttttaagcatttccattcattaaaaatccagattgagtccaggtgaggtagctcacgcctatcaacccagcactttgggagggctagacaggaggatcactggagccaaggagttcaagacggcctgggcagcataatgagacctcatctctacaaatttttttttttttgagacagtttcgctgttgttgcccaggctggagtgcaatggtgccatttcggctcactgcagcctccgcctcctgggttcaagcgattctcctgcctcagcctcccgagtagctgggattacaggcatgcaccaccacacccggctaattttgtattttttttttttttttttttagtagagactgggtttctccatgttggtcaggctggtgtcaaactcctgacctcaggtgatccacccacctcggcctcccaaagtgctgggattacaggcatgagccactgcgtctggccacattttttttttttaattagccaggtgtggtgggaggcacctgtggtcccagctacttaggaggctaaggcaggaggatcacttgagcccaggaggtcaaggctgcagtggccgtgattgcaccactgcattccagcctgggggacagagtgagacccagtctaaaaaaaaagaaaaaaaaaatccagactgaaacagcaataacacctccagttaaaagttaatctggccaggcaccatagctcacacctataatcccagcattttgggaggccaaggtggtggatcacctgaggtcaggagtttgagaccagcctggccaacatggtgaaaccccgtctctactaaaaacaatacaaaaaattagccaagcattgtggtaggcacctctaatcccagctacctgggaggctgaggcaggagaatcacttgaacctgggaggcagaggttacagtgagctgagatcgcgccattgcactccagcctgagcaagaagagcgaaatgccatctcaaaagaaaaaagaaaagtcaatttatctggaaactgcctttaagatagtttaataaatgtccccagtgctttattagaattgtaaaagttcttaaaattaattcaacctggaaatttacagattacataacagtgatctagaatagggattggcaaactttttctctaaaaggccaaatagtaaatattttagactttgcagactactctgtccttagaggtcaaaagtagccataaacagtatgtgaacaaatgaacatgacttagtccaataaaactttatttatagaagcaggcagtgggccagatttggcctgcaaactgtaatttgctgacctttggactagaaaactagaatgttttaggatttttttttttttttttttttttgagacagagtttcgcccttgttccccaggctggagtgcaatggcgtgatctcggctcaccgcaacctccacctcccaggttcaagcaattctcctgcctcagcctcccaagtagctgcaattacaggcatgcgccaccatgcccagctaattttgtatttttaatagagacagggtttctccatgttggtcaggccagtctcgaactcccgacctcaggtgatccgcctgcctcagcctcccaaagtgctgggattacaggtgtgagccactgcgcccggcaggatttttataaacaggatgacagaatttaaaaattggcagagatgacagcttagaatcatagaatatagagctagtggaaacttagaaaagagctagtggaaacttagacatcagaataacttggaaatatcttaaaaatgcagaggcccagattctatcccaggtgtatgctctttaaaatccccacagataggtgggcatggtggtgcatgcctatagtcccagctactcaagaggctgaggcagaaggatggccttgagcccaagagttcaaggatgcagtgagctataatcacaccactgcactccagcatgggcgacacagcaagacctcatctcttaaaataatttttttaaatctcatagatgattctaatatgcttccctggctagaaccactgtttacctggtccagaccactcagtttacagatgatgaagctgaaattcataggttaagtgactcttccagagtcaaacaactggttaattgtagatctgaactgaatcccaggtctgactccctaactaatattttttctactgaaccagcagcttcttcccttgtatcagcaggccatcagaatgactcctattgaattgtgaattttcccttcaagttggtttttattactttttatttaattactttgttttttataacaaatattcaagtagtgtgcatcttaaggattttaggattaataagaagtaatctccttctattaaaattaatcctttgttaaggaagtgttctacacttatgaattcaatattagcttcatttaattacagaatttggaagatacaataaactaacccctgtaatgacagggtttgtgtatactgacaacacattaacatcattgcttcactcagattgagagaacaattttccctggacttagcattctctctctttatgccaaagataaagcacaagagcagagtcatgccatggctagttccatctttgataactttgtggctttatataaagagacaagtgctttattttcaagaaatctttggggtccattattgccacctcaaacatagggaacagggaaggaaactaagtttttttgagagcctactgtagatcagacaaggtgctgagtgttttcactcatgtttttaattcgtgtaacaacctgtgattatgttattactacctcatcttacagatgaggaaaatgaggcccagaaagaggaagaataacttgcccacgatcacttaaatagtaagtggcaaggtcagagcctagacccaagacttcctagccctaaaacatagaactatgtgtttggtaagattttacaaatagaactataaggaggtcattggctccccagttgactcacctttcttgcccttcccctagtcttgcttaccatccaccaagaccaagtacacagatccttttaactctaaacgaatttactattaacagcagaacaataaaggataacaggcaaagcataaaaccaaagaataaggatgttacaaagaatacagaaatcttaagtggccttatttctttttttcccgtaatctaaattttctgacttccctttaaaaatatttcattcatctggcaaacatttattgcacttcagatatgccaggcacagtgctcactacatagaaaatattcctaaatgattatagatggctcttggttttttgctaggtccccttccatctccttttctcccaccccattgataatgttattatcatcctctcactcacccccaactgaaaccttcagaccatttcataattctttttttttttttttttttttaaacagagtctcactctatcccccaggctggagggcagtggcgaggtctcggctcattgcaacctctgcctcccgttttatctaccctcctctgatcacttactgagtcttattgattctctgtctacaatatctattcctccacattcctactatcatttctcctgctttaggtcattacctcctacctttacttgcaataaaaatctaattgggctgggcacagtggctcatgcctgtaatcccagcactttgggagggcaaggcgggcggaacacctgaggtcaggaattcgagaccagcctggccaacatggtgaaaccccgtctctactaaaaatacaaaaattagccaggcatggtgccaggcacctgtaatcccagctacgcgggaggctgagacgggagaatcgcttgaacccgggaggcagaggttgcagtgagccaagattgcaccactgcaccccagcctgggcgacagagtgagactcacctcaaaacaaaagaaaaaaatatctaattgatctctgctttcaatttttcccttaccaattagttctatatattatagctgaattattatcttcccaaagcattgacctggccattaatggctcccacttcctccagtataaatttcaaactccttcactggaattcagtctgtcaccacttagcttctaagaatcctctaatatttgcctgcacctctactactcccacttcattctagcacgctagactattcaagattctctccacatttgaaagcactttctttacctctctgtcttccacatgcatccagctccacctgtccttcaagagcccacttttatgccactttcctcaaagccatttctgatctgagcactcattccttttcatcctgttagccaggaatgattattctctcttgtgaattcccatacattctgtttgtgcctcttatggatttcttatctcattgactagaagccaccttatacatctttgtatctcccatagcatctaatatgaggtgctcagtaggtatttattgactaaaataatggtatatgcagtacgtgttcattataacaaaataggtttaagctcagtaagggtagaaactatttcattctcactctatattgccaccccctgacacaaaggagaacactcagtagacctttgttaaatgaaatacattacagttatcagtcattgggttataaatttcctgatgccataatagatacctagaaacactttgtctttttttgtttatttgttttgggggttttgtttttttggatggagtctcgctctgtcacccaggctggagtgcagtggcgctatctagactcactgcaacctctgcctcctgggttcaagctgttcttgtgcctcagtctccctagtagctgggactacaggcacccaccatgccccgctaattttttgtattttagtagagacagagtttcaccatgttgcctgggctggtctcgaactcctaagctcaggcagtttgcctgccttggccttatgttgtattttaaaatcctagttatgtatgtttctttattttatattgacaaataccacatgataaaggtcatatattcttattctcactttaagctgggcacggtggctcacacctgtaatcctagcatttagtggggcagaggcaggaggataacttgagctcaggagtttgaaaccagcctgggcaacaaagtgagaccctgtctctacaaaaatttaaaaattagccaggcatggtggtacgcacctgcagtcctagctactctggaggcagaagccagaaacttgcttgaacctaggagtttgaggctgctccgagctatgattgtgccactgtgctccagcctgagcaacagagcgaaaccctgtctttaatataaaaataaaaaatactgccttttggcccaaaatgccatcttccagtaatttgccaaatgactaacacaaagggaaagaggagaggtatccaatatatgttctctaggccttggaaaaaacatggagttgttcctttggccatgtatatgcgaatctataagaaatatgatatcgtagacatcaaggaaatggatactgttcaaaaaggaatgtcccagaagtgttaccatggcaaaactggaagagtttacagtgatacccagcatgatgttggcattgttgtaagcaaacaagggccagattcttgccaagagaattaacgtgcatattgagtgcattaagcactctgagaacagagatagcttcctgaaatcgtgaaggaaaatgatcagaaaaagaaggaagccaaagagaaaagagcctgggttcaccctgaagcaccagcctgctccacccagagaagcacacttttttgtttgttttttgtttgtttttgagacagagtctggctctgtcacccaggctggaatgcaatggcgcaatctcagctcactgcaacctctgcctcccgtgttcaagcgattctcctgcctcagcctcccgagtagttgggattacaggcacccaccaccacgcccggctaatttttgtatttttagtagagacgaggtttcaccatgttggtcaggctggtctcgaactcctggcctcaagtgatccgcccacctcatcctcccaaagtactgggattacaggtgtgagccaccatgcccagcctcagagaagcacactttgtgagaaataatagaaagaagcctgggctgctggtaggtgttaaaaaaaaaaaaactctggactataaaaaataaaaatagaaaatattttcactttacagaaaaggaaagtgagagttaaggaaatttagtaatttatttatgatcacacagccaatgagtaacagaattgaatctaaaatttaagtcttcaaatacgaagtttagagttatttttggcaaagggtgggtttggctaaaggctagttgagttctatttgcattagaatttttggagttaaacttgctgtcatgctgtatggaacagaattaaggccttgattaacattttgtctatgtgcttggtattttaaaaatcaaacagacaaaacacaaaaactatttctgaagaaaatcttagcccagcttgtggacattcccttcaaggtgagagatgactgactgttgaggcagtcttcttgcaggttcctttccctagttgggttggtgttgaagactgggtgtgatttcagcaggcagtgtagagagtaggtctccgggtttttgccaagctatatgacctggcactcacaagtatgcagtgtttattgaagacatgagagacagatgctgtagccagggagcagtcattctgcctttatattataaactcttacatcaagtcacatcgacaagctgattacctaaactctgtcaaattgcttttgtttgattgatctgtgcccatttgccataaggctagatagtaaagattattataggaaacaatcctgtctgtttcatctgttgtaaggatactgtgaggcactatttgttatgatgcaccatgtcttttatgaaaatctcttgagaaaaaactatcggactataatacaaagaattattttacctctcctgagcaattgctttgtttttgtcttatggacattgtgaatgtttacctttctctggccagatgccaaaaagcttagagccaaatttgtggcccacccataacaaatgtgctctatgcctcattaacttcattcttggctccagtttatgtctctccactagtctttttttcttaagaagatcctaattcatgccatcttattatatattttttcttttttctcataagtagccttatgttgtttctcaaatagtcagattatgacatactgtgtctacataaaaccatgttggatgccccttcatttactttggctttttttcttgaggggtgtattgatttttcatataggtttttgcagcgttttgttacacgaaaatggttatatcacaaaaattattgcttaatagtgtagacaagtggtaaaataactggtctaatggtcagaattgattaaattgatgtcataattctagtcttgtcttttacagcattattactattttcttataatatgctttgttttgcactctcaatctgcatgtgacagtttattgctgtgtgattttcagaaatattgtcgtgctgccaggtcactgcataacagctaactctctgttaactctgttgagtctgttaggctcaaatattctacacccatcagacttgtctcactttgggtggtcacaggcatattaatttcatcacacaacttgtcttgcttctcctctaaattagtcattcttttatttagacaagataatgtgaatggatatttgttttcaaacctcattttctttgattggtttggagctctagctggattttctgattatcttactaatgtcatctaattgataaatattattgtacaactttttaaactcttttagtacttccaagtaaaattatttggtcttctctacaactctctagggtatgtaaggtgggtatatgccttttttacagatggcatacaaaaatgattaaatgattttatatgccatctgtaaaaaaggcgtatacctttttagaaaaacaaggacaaagtcatttaaatgactgctcaagatgataccagcaaatcagtggtaaaactaggactagacccaggtttccagaatcttatcccatactaccttttaaaagaagtcaaaagaagttctaacttatattgtaaacattacttcatctttatcataccccttgaagctaaagctatgaaacaggcaaacacatgttatatcactcatgctcatagcagggcagaatcaggaatgaatttcatttgtattagtctcatgattctctgtttttaaaattacagttccttttaactactaccgtaatcactgtcacgttccattatggaaggaggaagcaatattttatcttatcttttgaaaattaatgttgaggccaggcgcggtggctcacgtctgtaatcccagcactttgggtggctgaggtgggtggatcacgaggtcaggagatcgagaccatcctggctaacacagtgaaaccccgtctctactaaaaatacaaagaattagccgggtgttgtggcgggcgcctgtagtcccagctacttgggaggctgaggcaggagaatggtgtgaacccgggaagcggagtttgcagtgagccaggatcgcgccactgcactccagcctgggtgacagtgcgagactccatctcaaaaaaaaaaagaaaaagaaaattagtgttgaaatgaaaagtatttcccttggaaattagtaactttttagattctttgaattcatctttaatataaaaataatttgttgtcattatgcatattcattaaggagccaaataatacagttaatggtatggtgtttggtaaaacattagctataattttaatctctgtgcttcaagaggatatttaaaattcatgcttactgtgtacatggcaagtttccagttctcattctaactaatcgtttacatgtagcacataagctagaatttcttatagttacagttgacccttgaacaacacaggggctaggagtgccaacccccgtatgcagtcaaaattctaggtataacttttttttttttttttttgagatggagtcttgctctgttgcccaggctggagcgcaatggcatgatctcagctcactgcaacctccaccttccaggttcaagcagttctcccacctcagcctttcgagtagctgggattacaggcatgccccaccacgcccggctaatttttgtatttttagtagagatggggtttcaccatgttggccaggctggtctcaaactcctgacctcaagtgatctgcccaccttggcctcccaaagtgctgggatttcaggcgtgagccacagcacccagcctaggtgtaggatttgactccctaaaaaaatacgccaggtgcggtggctcacgcctgtaattccagcactttgggaggctgaggcgggcggatcacaaggtcaggaattcgagaccagcctggctgatatggcgaaaccctgtctctactaaaaatacaaaaaaaaattagccgggcatggtggcacatgcctgtaatcccagctactcaggaggttgagtcaaaagaatcgcttcaacccaggaggcagaggttgcagtgagctgagatcgtgccactgcactccaatctgggcgacagagtgtgactccatctcaaaaaaaaaaaaaaaaaaaaactttactaccaataacatagccaattaacaataacatagccaattaatacatgttttgtaaatgtattatatactgcataatatataccttaccaataacatagccaattaacacgttttgtaaatgtattatatacatttacaaataaccttaccaataacatagccaattaacacgttaccttaccaataacatagccttaccaataacatagccagttaacacatgttttttaatgtattataaactgcattcttacgaaaaagtaagctaggggaaaatattaagaaaatcataaaagaaaatatatttactattcattaagtggaaatggatcgtcataaaggtcttcatcctcatcatcatgttgagtaggctgaagaggaggaggaaaaggagcaattggtcttgctgtctcaggggtggcagaggcaaaagaaaatccatgtgtaagtagatctgcacagatcaaacccaccttgtccaagggtcaactgtgtatttttttaccacaaccctataaaagtaactactattttccagccgcattttacagtcaggtatttattgacaataatattgtcttctagctcttgttcagcttctggaatttctgagcagccctcgtcagtacaagatggaccccgtagtcttgagttacatggacagtctactgcggcaatcagatgtctcactattggatccgccaagctggctcaatgaccatattattgggtttgcgtttgagtactttgccaacagtcagtttcatgactgctctgatcacgtcagtttcatcagccctgaagtcacccagttcatcaagtgcactagcaacccagcagagattgccatgttccttgaaccactggacctccccaacaagagagttgtatttttagccatcaatgataactccaaccaggcagctggaggaacccactggagtttattggtctacctccaagataaaaatagcttttttcattatgattcccatagcaggagcaactcagttcacgcaaagcaggtagcagagaaactggaggctttcttaggcagaaaaggagacaaactggcctttgtggaagagaaagcccctgcccaacaaaacagctatgactgtgggatgtacgtgatatgtaacactgaggccttgtgtcagaacttctttaggcaacagacagaatcactgctgcagctactcacccctgcatacatcacaaagaagaggggagaatggaaagatctcattaccacacttgctaaaaagtagctattgaagtatatttgcgacttttgaaggctcctctttctgcccttccccatttgttggatggctgcaatctcagtgcctgagggaagatgcctagtagaggaaagcttaatactctttttcctgaaagaatatcatcctctgcattatccccatggaacgtttcactttaaccctgactggggagcaatatgttctgtgaaaatatcttgaaattgtacaccaaaaccttacaaccaacttatttgaacatttattacacacagggtttacgtaagacttttcttattggtatataattaatttcctttggtctcccttatccacattggcttattctggaggaaaagcagtgatctgtaaaacaaatcaagaatatattaaatctagaggaatgcagagaagaaaactataaaacagaaccaaaaacttgttgcacagcctacataattaagagatcaactggctggaagcagatcaaggcctaacttcattcaagacctaaatattatgagactcagttattcggttttatgtgacatctcttccattcaccatgcacaggcttttccagctatctatataatgtttgcaaatatttgataaagatgatgttaccctatcttcctccatctgattcctggaatgcttgaagaaaggggaaatcttgagtaacctcattaaaattaatgtctggtggacctctca

SEQ ID NO: 983 - DNA, 26714 bp, Homo sapiens
tacttactccaacagcagtcaagagaatgaacaggagggcatgacaagaggcagaagacagaaggcaagaagaccactcagcattacagaagcccaacaaacagatattttcagttaaaataagatagaggcaacaaaaagtaataaggaatgacctgaaatatcatgagggaaaatgtacaaggcagtgacagactggatgttggcagtgaagtacagagtgaagcggagggcaattcccaggttcctgaaggtttcatgaggaaagagtggtgccattaatcaaggtaggaaatcggggggaagaaaaaattttgttgcagtttctgtctccggctctctctccactgtttttgtggggggaaaagaggcaggaagagttttgtttcctaaatgtttggattgaagtgtttgtgaaatgtgaatcaaagtggtgatatccattaggcagtgcttttacaggggtctagagcaaaggcaagcactctagacagcagttctagacttaggaatcaatacattaagtcaatattgtggtttttaaaatgtctgaaaagtctttgactaatatttatttcaaactgagttaacataaccaaaaatcactccaactaaaaaccttaatattcttggcaaatcatattttcaaacctcctacatttctctgctattaaagactgaacaaacttccacatagtataatccaaatgattaggaaagatggagtttatatcgctaacttctattgaggtacttgttaaaaaaaatctaagtttacccaatttccctcaggaactatatactactaaaataactaagggaaaacaactgttaaaaattcatatattagatagtgaatctcactgttaatgcttaaactagaataagttttttaaaggcacttaatcatgtaatttactaatttaaatattcaactctacctgtaatttaaatgttgggtttccatcctaaaaccttttctcctcccttctgtatgattttgcctccaaaatctactgctatcaacccagaacctgatactgagcttcagccacaaatccaaatgcctaatggtcatctacatctgacagaactacagtcacctaaactgaacatgtcacaaattaacccctctatccttcctccttgacaaaataaaaacaaaatcccactccttcatgggaatccccacctcagtgaaaggcacaagccagaaacctagattttatcctgtatgcaacttctccccaaccccaaatacaataaaatcaccaactcaactccgaatatccaagttcagatccagtctcaccatttgcctggataaccctaatattcctggcctttagtcttattctactcttcaattcactgcagccagaatgacttttttaaaatgcaaatctgatcattccagtcccctgctttaaaatccttcaataatttaataaatattataatcatcatcacagctagtcacactgtggaagctcagaggttcaatgagaaatttagttacatcctttctgtaggttcaacataaaagaatcatcaggaatttttttcaactcacaaaattatttaaacatacatataacatcagacacatttaaaagaaaagcatgtaacattgttggtaaaagcaaaacaccaaaaataacctccagtccacaaaaatggaatactatccagccagtaaatgaggcacttccatatgtattgttaagaaatgacctctaggatgtagtattaagtaaaaaaaacaggctatgtatagaatgtaaagtatgcaaccatttgtgtacagtgtcttaaaaatataaatgtgtaggtttatatattggaaatatcacagaaaggatacacatgaagctggaaatagtggttgcctctaaagaggaaaaatgggtggctggagagtgaaggcggaacagaaatttttactacattactcttccgaaacttttggcttttacgtctagttattatctataattttaatgtgattttctcctgttactttaacattttttactgtgtgtgtgtgtatgactacaaagacctctttatatttcatctttataccaatattaaaattacgtactgatcatttgatgcaacattacatttctttcttgacaactcaggagctcaacttctacaaacattttattcaacattttactgctattgagaaggctgttgttggtaatgacctcagtgaacactgcatgatttctgtacttgcttcttggagaagcaagacagcagcaccaggcaacagaagtttattattaaaccgacatcgaagcattcagggattaaggaatgctacaaatcttatttttctagcaaatccaaaaaacagtgaatccaaaaaaagtcccctagtatcctttaaaaataaaaataagaaacagttctagtatctgcagcaatcgacaaggaggtgaagtaatactacaagacgacatagttatatccactagtgcaacgtgatttaatccttacagaggtccctaaaacatcagtgctggacaacctcacacgttctacacagaacagacaagacgaggtgcaggctctgtgaccttataatggcacacacacaactggcctcatgcttccataacttcactctgcctcccacttttttcagcccaacccctccaaacatgggtctcggtcggtccccttaagccacaatggagggaatacattaggctaagcaaatattccctcaggatttcatggcaaagccctttcaaccaaagaaaggatcgcgactaaggagaaagataacaaggtttgcttgaggagaggtctgttgagagaggctacagtcggtggtgggagagaagccaaagtctgtgacggtgtctagagggactgacaccacatctaccgggagtaagaacaccatgacagcggctatctgaaagccgtgatggctagggttagtgctagtcggcttggtgatgagcgagctgggaggggttctactaagaagagtagggcgaggggcacatgggggacgcaatgggttagggggcggtcgagactttgcctgagaactgtaatcacgtcagcccaagggaggatgtaacgtagtctagaagctccattaagagtcctaagggactctgaggggtactaatggggtctgctgggttggggggaccgtgacagaatctccggggaggctggagggccggaatggtgcccggccaatggaagatacagggggtggggtctactggggatccggggccgtgatctggtgtttgggaggctcggcgcagacccgctcgcggggcgtctccgctgggacggggcggggcggcccgaccggagccaaatagcgaggctgagacgtgggccaggacgggctgcagggccgctgggcgcttgggcgggtcttacctcgggctccgccgcggtggccaccgcagccccctcctcttcgacggaagctgccttccaccctccgccccagggtaggaccggagatggcagaagaggccgaggccaccgagggtcggacggttccgggagggtgggcccagcagcctcagggtccgggcgagcggccgcggcgcatcccccgccctgtcagagagactccgcccggcctgagcaggcacatcccccgccgcaccccgcccagagagcacgcgttggaccgccgcctcaaccgctgccagcggccgcctctgccggtgcaactactgcctccgccgccgcctctcgcagtccgggctgtcctgtactctctcaacagacacagccaaccgccgccgcgtcccttatccgcttcggtcgcgcgcccccgaccccgcgcacgcggccccgccccgcgcgactccccggctgcaggcgagcaggcgcgcgcgcacttacctcccacgccccctactgccagcacgggtcggccccgccctgtcccgcccccgcacgtgacgccactggagagtacagcgtgcgcttgcgcagacacgccccctttcctacgccccaggcggccccgcccaaattttttcttcttcaccttacggcagagcagggaactcagctttagattctccctgtactggaaagggatgtcgcaaggttggggacgaaacctctgagtttgcgaccgtagctgtcgctttccggccaacacagaggtgcctgaaggctggttggggtggtgaggcccgaggcaggtaagaagcctcctccccacttcggtttgtctcggcagtggatcgctctcccacccactcagattctggcgtatccgtgctccctcccgattctggacctggattctcagcgccgccggtcatagcccccgccccttttcaaacacgcacgctctctccacccactgccccctccattgtccccgccccgacctccgtttccattcatttctcagacttttcactgagtggtttccatgccttgggttccagaatgtcagaggcgaattaagtggtgtcagctttttgaagtgcttttgtataggagaccgtgagagaatccgcagtggtagtacaataaagtgacaatagagaaaaatgcacgggatgctgtctgcgcacagaagaggggtcccaggttgtgtaggaggataacgtgaggaagccctttccagggtgacttttgggtcacttttagaggactgtgttaaaagactagtaatccagtacctggtcaaagaaatacgaaaggaggtaaaagcagaataacgggcgcaagagcatgtgacagtggtggtctgaaagagaaaaaagaagtaaaataaacctgatggaaaccgtactagtgtagacttccctttaaagaagcatcgttataaagttagagaaatgaggaacgagaatatggccctcaggaatgttttctgtttaggtagaagactcaaaagcgtaccatgaaaccgagaagtggcctcttcgagggtgagggaggctaatttataagatcaagatcactagtggaacgcaaccttgtatgtgcatttgaatcacctgggaaactttttgttaaataaaaccaatactgttgccccactctagaccaattaaattctgggttgtgccaggtgtcattactgttttaaagctccacaggtgactctaatgctaaagattgagactcactaaactagagagaaggaagttgagacagttggctctgtaacattaagatggaggtcatttagccgggcgcggtggctcacgcctgtaatcccagcactttgggaggccgaggcgggtggatcacgaggtcaagagatcgagaccatccaggccaacatggtgaaacctcgtctctactaaatatacaaaaaattagccgggcgtggtagcaggcgcctgtagtcccagctactcgggaggccaaggcaggagaatggcatgaacccggaaggcggagcttgcagtgagccaagatcgcgccactgcactccagcctgggtgacagagcgagactccgtccccgcccccagaaaaaaaagatggaggtcatttaactacagagaggcttggagatggaatgagaaacttgagcggcgttatgtttggaataactggtctgggaaatgggagaaggagccactcttgcctttctcttcagcactgttcattcctcagtgtttatcaggtccaaattagttacttgtctctttgctctcccgttcccttccgtccaggattggtcagctgttgtctccagccttaaagctcaaaggccatccccacttctgtccccaaaatgatcagagctaagccaatttatgagatgcagagaccaacatccagagctaagccaatttatgagatgcaaagaccaacatccactctcatagagattactacatacagtgccttgccaatttagaatctttttctattatttatcatttaagttagtaatgagatataaagatatttaaaatacagctcaattaggatggaaaattaccgtattagggaaagcaggcctttaaacaaagaattcacttggcaggcagagaagctgtatgaggtaaagaccaagacagtgtatggctgctatctattaactagggttaatccaaaaacctgtctatcagacccagataagaacgagttattgttgtctagtatggctagagcatagtatggagagtagaggtgggacagagatgaagatgataaagtgggtgtgaacagattatgaggagccttgaattccatggtgaagagtttagattatattactagaagtaattaataagtacaaaaaaggttcttaacctcttttacccagtggaccttgttggcagtccaccttatagattcagtctcagaaaaatgttcttaaatatataaaatagaatacgtagtaatataaaggaaactaattttgttaagtttttaaaatattaaaacaaatgtgtgatatatatgcactttatgcattaaataaaatctggcagcaggtctaattatataatttctaagtagtgatgactataaattatattttgaaatgcctgcagcaactttaatgtgatgtgaaaatatcagatttctattggtaaaaaagagagtgctaatattgtagtttgtggtccacacttattgaagaaatgctaaatttcagctactgattattgaaaacaaagatgcaattgttttcccagtctaagttcacagaaccctgatattctagccacatcctggtctatggatcctaagttttaaaatatctcagtataatggttttaagcaagagcatgacatcaaatctgtgtttcagaaaaatgatgaagcagtgttcacttcccaacctctctgctgggatgagaggctggctctggggcagcaaccagtactatcccactgtttcctaataaccagggcctgcagagggactgagcttgtgggtgtatatgtctgtgagagtaataccagaaaataaatcaggaaaggtagattggggctatttttgtggaaatcattgaatgccaggctgtaatttgtagttactttggtagacaatggagggttgttaaaattttttggagtagaataatgtgattagagttctgtttgaaaatctagaataatgtgcaggttagattatcaaaagagaagataggaatgaagagactagaacaataagttaattaatttttgaaaaatggaatcttgggccaggtgcagtggctcaggcctgtaatcccagcacttggggaggctgaggcaggaggatcacttgagcccaggagttcaagaccagcctgggcaacaaagtgagaccgtgtctctccaaaaaaaaaaaaagaaaattagccagacatagtggtgcctgcctgtggtcccatctacacgggagactgaagcaggaggattacatgagcccaggaggtcgaggctgcagtgttcatgccactgcactccagcctgagtgacagagagcctgtctccaaaaaaaatcttgaggtgatctctagagtctgctaaattcctttatttccacaatgtgctgaccagtctagagtaacatacattggaataaatggcatacctgtcaacaggaatatataccccagtgtgggagtcagttaactttatgtggtcaagaggctagcccagtcttttgtattataaatgatattgttagtacttctaataaagcaatggccttaccataagttcacagatcttgccaaggccttcctcagtcaaactccatctatacctgtgagtcctacatttctgacttttaaaagtcagaacctgtctatacctgtgagtcctacatttctgtcttttaaaagtcagaactcctctctttttgccaattccttaaacttcttggatgggaaagaagtttagtttaaacacattagcaaaagaatgggaggtcctcaaggcccaggcaacccatctcctttgaaactgatcaataccggactataaaaacttactgctcaaatccagctagtacccaaagtatgtactgtctatatacctgtctatacctgtgagtcctacatttctgacttttaaaagtcagaactcctctctttttgccaattccttaaacttcttggatgggaaagaagtttagtttaaacacattagcaaaagaatgtgaagtcctcaaggcccaggcaacccatctcctttgaaactgatcaataccggactatagaaacttactgctcaaatccagctagtacccaaagtatgtactttttaaatgtattctaaaaaattgaatttggggtttaggtattactgatccaaatgagtcctataaaattaacttccagaactaggttctcagagaggccaccattaccaccttcttcaacataactagcctatattgactttctgtccatcaaataattggaggccatttgggtggtgataggaagaattaagtttatgcagaacttgaggttcagctatctgacaccttttgcgggaggaggaggagtgggtctatctgaaatcagaaataatacttttatgaggctttttaataatttttattacttacagaaaatttctgaaagttcctttctctggctcccaattaaatggcttactccacaatcaacttataaaagcactggatcattgtcttgatcccaaaaaatttgtcccaactatagttactattttgagcatctgtattattgtttgaaaaccttaggcttgctttccctgatggccaatgaataaaactctcaaagtcgtgtgattcattactcattaattcattagatatttattgaacctctactatgtgccaggcacatttttgaaacccactaatgagcaatttgtaatgacaatttacctcttaactatctatgaaaaaaataacttgccaggatttgaaatccttagaacaaatgagattaaaagatcatagcttttttgtgttctttcaaatagtgtgtttgcatagagctgccatgtgctgaccacagtgattatctgtgaaatgaggtaaatcatggctttaaccactccttatcagactttgttaccacatgtactaaaataaagttctgtctacacctttataaaatattatcttacacagacgtcttattaattctaatggcctctccacacctgaccctcactcctagtcatttcaaagtttgcaattgtgtaaagtcatttctcagaaaatttgaagcaaaacaaagtcaccacaagaaaaacttggtatacaccaggtttatattgaggacaaaaactgtgacacaattacaaatggaacttttttttttttttttgtgatggagttttgctcttgttccccaggctggagtgcagtggcgtgctcttggctcaccacaaccgccacctcctgggttcaagcaattctcctgcctcagcctcccgagtagctaggattacagttgtacactaccacgcctggctaattttgtatttttagtagagacagggtttctccatgttggtcaggctgatctagaacgcccgacctcaggtgatccacccgccttggcctcccaaagtgctgggattacaggcatgagccaccgcacccagcctacaaatggaactcttgaggtagaaatggtagaccaggaataaaattattttcatggtcaatgacaccttagccattgatagctgtgcctagttacagagcaataaatggagagccttggtgttagatgaaatcctaaaaagtcacctgttttatctccttggccccagacagaataaagtggaatttatagcagtagagttaccaagcatcatcatcacaccaagtaggttttgtactttgagagctgaattcctctctgaaatattgatgttacaggaatgttgtttaaattcatagctcatttataaaattgagaatatttcttacatttataactgtgttgtgttttcctgagtttttcaagatatgtttcacttctgtactttgctcactcaggaaaaatatttatttattaaaactctagcttgtcaggcactgaagttagaaggatgagtaaaatctaatctgtgtactcaagagggttatataataaatcttgatggtcattcttacatgccacattatacagatctccagatggcttaggcttagttttaaaaggaaacgttttaattggggggaaattgaaaccccaaaaaaaagccatgaacttccttcctggaaatatttttgccataaaaagcatatttggtcttggatgtgattctttttgtgaaagtgcaagttgaatcagacattagaagttggacataatcttctaattttagtaaacatcaaattatttttaaatatttgtgtttgaacatttatggaaaagagattagatttacctgttttatccagaggacagaagtaagactcagaagttgaaaaaatggaaatattttatgtcattataagagtgggaactggtacatcttttattcctcttcaatatggaaatcactgtatttactaattatgtgttcattattaaaaaagggggaaaaattaaagcacaatatcaaaaggtagaaggaaaaaggcaaaaaagtattaatcctatttcttaaaatgatatttacacttgatggatatcgttcttgattatttttctgtatatttttatcatatacagatgtttatatcaaagcatattatgaacatttttcttttaataaatttgtattgacaatattatatttaatggctgaaaactattccatcgtgtggaaaccctgttgtttaatttaccagtccttttttgaactccagattgtttccagtttttctgttacaaatactgccatggtgaatatcttgttgaatttttgcacacattgttaatgtctcccttaagttaaatttcttaaagtataatacctacatatataaatttcttaagaattccaatataatggcaaattacccttgaaaaagcttgcatgtatgacagtcctatcaaaatggggcatcatttactcatttcccataatctctcagcaatgctaattattattagttttcttcacctttgctaacttgacaggtaaaaaaatgaaattttattttaacttacatttatttgattactactctgatgtccagtgtcttttcatgtgtttattgactagtcatgtaagtgtattaactaatattttctaacaattttttttttactttttaacatttaaatttgtattctatctaaaatataatttgatgtaaggtatgaggtaaaactctttacttttttaatcaaataattaacaagttgtgccaatgctacttattaaaaaatccagcaagcatatcccatacttcaatatacagataataaagtactgatagatattcctccaaaaaaaagaaagactatttcgtggttaaataagtttgggaaaagatcatacgaaaaaaagttaaaattttttatcgccaaactctcgttagcctctagtgtgtgtgtgtgcattaggagttagcatttcctaatttaattaaccatgtaatcttttttcttttttatttatttatttattttatttatttatttttttgagatggagtctcactctgtcgcccaggctgtagtgcagtggggtgatctcggctcactgcaacctctgcctcccaggttcaagcaattctcctgcctctacctcccaagtaactgagattacaagtatgcactaccatatccaacttgttttgtattttcagtagagatggggttttgccatattggccaggcgggtctcaagctcctgacctcaggtgatctgcctgccttagcctcccaaagtgctgggattacaggtgtgagctattttttttaaccatgtaatctcacttcataggtatttcaggaaatacctatgaaagcctgtggaactgagctgtccagtatactagcactagccacatgtggctatttaaattttagttaattaaaattactcagttcttcagtcacactgaccatatttcaagaactcaatagccacaaggggctagtggctactgtattgaacattttgcagataaaagaaaatttccgggccaggcacagtggctgatgcctgtaatcccagcacgctgagaggccgaggtgggtggatcacaaggtcaggaattcaagaccagcctggccaagctggtgaaaccctgtctctactaaaaaactacaaaaaattagccaggcacagtggcagttgcctgtaatcccagctactcgggaggctgaagcaggagaatcgcttgaacccaggcagcagaggttgcagtgagccgagattgcgccactacactccagccggggcgacggagtgagactccatctcaaaaaataggaaaatttccgtcacaagaagtgctattggacagcactgctatgggaacataatgttcagtggaacacgtgaacacgctgaaaacactggaataatccataatttctcctgatttgtcaggcaaacatgattactactacactatgagaacagactctctcattgatttgtaaagactccatcatcatatttaaaatttctaatctacatatgatttttttatgctattgatttatctacttctgctccaataccacacccctagttttaagtcaaggttctgcacctttctctttcagagcagaaatgaagaattcttgcatggagtaggaaattagattagaagtgatagtaaaggcgctttcacttcccagactctaaatgtaaacatttctctgccgaacttgatttatattatgttgagctgtatactcaattacttattcatttattctacaattatttattgagtacctgcctggtaagcactgttttaggtcctggggttaaaatggcaaacaaggcagacaaggcccctcgtcgtcttattttcatagagcttacattcttgttttggagagggaaagagaagaggcagggggaggaaaaaagaatatgaaccaataaacaaataaattaaaaaactatcacatagtaatcagtgctattcaaggaattgaaattagagtgatagtaactggtggcctctttgttttggctgccctgagacctctgtgacttagtggcatttaaactaagatctgtccaaagaagaagctaattactagaaggtccaggcagagctagtaccaccctcaggagggaaaaagcttggtgtatttgaggagtaaaaagaaagtctttgtggctgggtcttagtgggcaagcagggaaataataggagataaggttggagaaatagctgaagccacattttcatgtagggttttgtaaactagggtagggaattttcatttttttctgagtatgatagctactagagactcctaagcagggaacagacctggcctaatttaaatttttaaacaattattttgatggagaatttattggcacagtcagtagtggaaataggagacctgttaggctaggtcaagaaagaaatggtgatagatttgactaaggtgatagtagtgaagatggaaagcattggacagatttagaacatttaggctatagaatcaacaggacttgtcaattggatgtgaagtgtgaagacaatagaaaactctgggatgagcctgggcaacatagtgagaccctgcctctataaaaaaaaatattaattagccagacatggtggtatgcacgtatagtgcatatagctacttggaaggccaaggtgggaggatcacttgagcccatcagttaaaggctgcagtgagctatgattgcaccactgcactccatcctgggcaacagagtgagacgttttcaaagaaagagagagggaaaggggagaggggagagagggaggggaggggaagaagaaaaaacagagagagagagaaagaaaaaaactaactcttggatgatgtctgtaatccattatatagtaaccaggttcaattttcagtctgattatggcaggcaaaattgggacacataagacaccaataaatatattttaaccaaatgaataaatttactttaataaatgtttctctcctgtacacatttaagctgctaaagcataagcttgtgctcattcctttattattagggaatctgactcctaagaatttgaggtttatgtcataaacacatcagctataggtaattattagactgttcccctgaagtatccaagccaacagaggagactgaatgaaacagaaaaaattgcctgccacagttgcaaaagttctgtgagattctcatattttatttttaaatttcatgctgattttgcattttatgcccaagtttatgttaataattaaaatatttttagttgctgatttaaatgttttaagtcaatgattaagtggtttagctctttcccctaaagttggtcaaattaaagctctaggaagatgccctgtgattaacttgtgtttgttttttggactttctttgttgctatctgctggcacatgggcatgtatccatttagagaagtacagatgcatctctgagcatttgtagtttggtacaacttaaaatcgtagccaaagcgagtgaggaaggcaatagcatttagaaacaactgacttttataatctgcacttactttgtaatgtttttaaaaaacatacctgaatgaggctgtttctctctttttatttttttaaggaatgcttactgaataattagaaaaaaatgagtaaaggtcacaattctggaatagtatgttttcagtaaaacagatttatctggagtactacttaagtcaatagccaacaggcttattttccctgaagttttgagaattgctgtatgccatataaaatccttgttaatttaaaactctaatacatattttaatcccataaaataaatacttatacatctataaaatagacaattatcgttaatatccattgtaaattagtatttttaagcatttccattcattaaaaatccagattgagtccaggtgaggtagctcacgcctatcaacccagcactttgggagggctagacaggaggatcactggagccaaggagttcaagacggcctgggcagcataatgagacctcatctctacaaatttttttttttttgagacagtttcgctgttgttgcccaggctggagtgcaatggtgccatttcggctcactgcagcctccgcctcctgggttcaagcgattctcctgcctcagcctcccgagtagctgggattacaggcatgcaccaccacacccggctaattttgtattttttttttttttttttttagtagagactgggtttctccatgttggtcaggctggtgtcaaactcctgacctcaggtgatccacccacctcggcctcccaaagtgctgggattacaggcatgagccactgcgtctggccacattttttttttttaattagccaggtgtggtgggaggcacctgtggtcccagctacttaggaggctaaggcaggaggatcacttgagcccaggaggtcaaggctgcagtggccgtgattgcaccactgcattccagcctgggggacagagtgagacccagtctaaaaaaaaagaaaaaaaaaatccagactgaaacagcaataacacctccagttaaaagttaatctggccaggcaccatagctcacacctataatcccagcattttgggaggccaaggtggtggatcacctgaggtcaggagtttgagaccagcctggccaacatggtgaaaccccgtctctactaaaaacaatacaaaaaattagccaagcattgtggtaggcacctctaatcccagctacctgggaggctgaggcaggagaatcacttgaacctgggaggcagaggttacagtgagctgagatcgcgccattgcactccagcctgagcaagaagagcgaaatgccatctcaaaagaaaaaagaaaagtcaatttatctggaaactgcctttaagatagtttaataaatgtccccagtgctttattagaattgtaaaagttcttaaaattaattcaacctggaaatttacagattacataacagtgatctagaatagggattggcaaactttttctctaaaaggccaaatagtaaatattttagactttgcagactactctgtccttagaggtcaaaagtagccataaacagtatgtgaacaaatgaacatgacttagtccaataaaactttatttatagaagcaggcagtgggccagatttggcctgcaaactgtaatttgctgacctttggactagaaaactagaatgttttaggatttttttttttttttttttttttgagacagagtttcgcccttgttccccaggctggagtgcaatggcgtgatctcggctcaccgcaacctccacctcccaggttcaagcaattctcctgcctcagcctcccaagtagctgcaattacaggcatgcgccaccatgcccagctaattttgtatttttaatagagacagggtttctccatgttggtcaggccagtctcgaactcccgacctcaggtgatccgcctgcctcagcctcccaaagtgctgggattacaggtgtgagccactgcgcccggcaggatttttataaacaggatgacagaatttaaaaattggcagagatgacagcttagaatcatagaatatagagctagtggaaacttagaaaagagctagtggaaacttagacatcagaataacttggaaatatcttaaaaatgcagaggcccagattctatcccaggtgtatgctctttaaaatccccacagataggtgggcatggtggtgcatgcctatagtcccagctactcaagaggctgaggcagaaggatggccttgagcccaagagttcaaggatgcagtgagctataatcacaccactgcactccagcatgggcgacacagcaagacctcatctcttaaaataatttttttaaatctcatagatgattctaatatgcttccctggctagaaccactgtttacctggtccagaccactcagtttacagatgatgaagctgaaattcataggttaagtgactcttccagagtcaaacaactggttaattgtagatctgaactgaatcccaggtctgactccctaactaatattttttctactgaaccagcagcttcttcccttgtatcagcaggccatcagaatgactcctattgaattgtgaattttcccttcaagttggtttttattactttttatttaattactttgttttttataacaaatattcaagtagtgtgcatcttaaggattttaggattaataagaagtaatctccttctattaaaattaatcctttgttaaggaagtgttctacacttatgaattcaatattagcttcatttaattacagaatttggaagatacaataaactaacccctgtaatgacagggtttgtgtatactgacaacacattaacatcattgcttcactcagattgagagaacaattttccctggacttagcattctctctctttatgccaaagataaagcacaagagcagagtcatgccatggctagttccatctttgataactttgtggctttatataaagagacaagtgctttattttcaagaaatctttggggtccattattgccacctcaaacatagggaacagggaaggaaactaagtttttttgagagcctactgtagatcagacaaggtgctgagtgttttcactcatgtttttaattcgtgtaacaacctgtgattatgttattactacctcatcttacagatgaggaaaatgaggcccagaaagaggaagaataacttgcccacgatcacttaaatagtaagtggcaaggtcagagcctagacccaagacttcctagccctaaaacatagaactatgtgtttggtaagattttacaaatagaactataaggaggtcattggctccccagttgactcacctttcttgcccttcccctagtcttgcttaccatccaccaagaccaagtacacagatccttttaactctaaacgaatttactattaacagcagaacaataaaggataacaggcaaagcataaaaccaaagaataaggatgttacaaagaatacagaaatcttaagtggccttatttctttttttcccgtaatctaaattttctgacttccctttaaaaatatttcattcatctggcaaacatttattgcacttcagatatgccaggcacagtgctcactacatagaaaatattcctaaatgattatagatggctcttggttttttgctaggtccccttccatctccttttctcccaccccattgataatgttattatcatcctctcactcacccccaactgaaaccttcagaccatttcataattctttttttttttttttttttttaaacagagtctcactctatcccccaggctggagggcagtggcgaggtctcggctcattgcaacctctgcctcccgttttatctaccctcctctgatcacttactgagtcttattgattctctgtctacaatatctattcctccacattcctactatcatttctcctgctttaggtcattacctcctacctttacttgcaataaaaatctaattgggctgggcacagtggctcatgcctgtaatcccagcactttgggagggcaaggcgggcggaacacctgaggtcaggaattcgagaccagcctggccaacatggtgaaaccccgtctctactaaaaatacaaaaattagccaggcatggtgccaggcacctgtaatcccagctacgcgggaggctgagacgggagaatcgcttgaacccgggaggcagaggttgcagtgagccaagattgcaccactgcaccccagcctgggcgacagagtgagactcacctcaaaacaaaagaaaaaaatatctaattgatctctgctttcaatttttcccttaccaattagttctatatattatagctgaattattatcttcccaaagcattgacctggccattaatggctcccacttcctccagtataaatttcaaactccttcactggaattcagtctgtcaccacttagcttctaagaatcctctaatatttgcctgcacctctactactcccacttcattctagcacgctagactattcaagattctctccacatttgaaagcactttctttacctctctgtcttccacatgcatccagctccacctgtccttcaagagcccacttttatgccactttcctcaaagccatttctgatctgagcactcattccttttcatcctgttagccaggaatgattattctctcttgtgaattcccatacattctgtttgtgcctcttatggatttcttatctcattgactagaagccaccttatacatctttgtatctcccatagcatctaatatgaggtgctcagtaggtatttattgactaaaataatggtatatgcagtacgtgttcattataacaaaataggtttaagctcagtaagggtagaaactatttcattctcactctatattgccaccccctgacacaaaggagaacactcagtagacctttgttaaatgaaatacattacagttatcagtcattgggttataaatttcctgatgccataatagatacctagaaacactttgtctttttttgtttatttgttttgggggttttgtttttttggatggagtctcgctctgtcacccaggctggagtgcagtggcgctatctagactcactgcaacctctgcctcctgggttcaagctgttcttgtgcctcagtctccctagtagctgggactacaggcacccaccatgccccgctaattttttgtattttagtagagacagagtttcaccatgttgcctgggctggtctcgaactcctaagctcaggcagtttgcctgccttggccttatgttgtattttaaaatcctagttatgtatgtttctttattttatattgacaaataccacatgataaaggtcatatattcttattctcactttaagctgggcacggtggctcacacctgtaatcctagcatttagtggggcagaggcaggaggataacttgagctcaggagtttgaaaccagcctgggcaacaaagtgagaccctgtctctacaaaaatttaaaaattagccaggcatggtggtacgcacctgcagtcctagctactctggaggcagaagccagaaacttgcttgaacctaggagtttgaggctgctccgagctatgattgtgccactgtgctccagcctgagcaacagagcgaaaccctgtctttaatataaaaataaaaaatactgccttttggcccaaaatgccatcttccagtaatttgccaaatgactaacacaaagggaaagaggagaggtatccaatatatgttctctaggccttggaaaaaacatggagttgttcctttggccatgtatatgcgaatctataagaaatatgatatcgtagacatcaaggaaatggatactgttcaaaaaggaatgtcccagaagtgttaccatggcaaaactggaagagtttacagtgatacccagcatgatgttggcattgttgtaagcaaacaagggccagattcttgccaagagaattaacgtgcatattgagtgcattaagcactctgagaacagagatagcttcctgaaatcgtgaaggaaaatgatcagaaaaagaaggaagccaaagagaaaagagcctgggttcaccctgaagcaccagcctgctccacccagagaagcacacttttttgtttgttttttgtttgtttttgagacagagtctggctctgtcacccaggctggaatgcaatggcgcaatctcagctcactgcaacctctgcctcccgtgttcaagcgattctcctgcctcagcctcccgagtagttgggattacaggcacccaccaccacgcccggctaatttttgtatttttagtagagacgaggtttcaccatgttggtcaggctggtctcgaactcctggcctcaagtgatccgcccacctcatcctcccaaagtactgggattacaggtgtgagccaccatgcccagcctcagagaagcacactttgtgagaaataatagaaagaagcctgggctgctggtaggtgttaaaaaaaaaaaaactctggactataaaaaataaaaatagaaaatattttcactttacagaaaaggaaagtgagagttaaggaaatttagtaatttatttatgatcacacagccaatgagtaacagaattgaatctaaaatttaagtcttcaaatacgaagtttagagttatttttggcaaagggtgggtttggctaaaggctagttgagttctatttgcattagaatttttggagttaaacttgctgtcatgctgtatggaacagaattaaggccttgattaacattttgtctatgtgcttggtattttaaaaatcaaacagacaaaacacaaaaactatttctgaagaaaatcttagcccagcttgtggacattcccttcaaggtgagagatgactgactgttgaggcagtcttcttgcaggttcctttccctagttgggttggtgttgaagactgggtgtgatttcagcaggcagtgtagagagtaggtctccgggtttttgccaagctatatgacctggcactcacaagtatgcagtgtttattgaagacatgagagacagatgctgtagccagggagcagtcattctgcctttatattataaactcttacatcaagtcacatcgacaagctgattacctaaactctgtcaaattgcttttgtttgattgatctgtgcccatttgccataaggctagatagtaaagattattataggaaacaatcctgtctgtttcatctgttgtaaggatactgtgaggcactatttgttatgatgcaccatgtcttttatgaaaatctcttgagaaaaaactatcggactataatacaaagaattattttacctctcctgagcaattgctttgtttttgtcttatggacattgtgaatgtttacctttctctggccagatgccaaaaagcttagagccaaatttgtggcccacccataacaaatgtgctctatgcctcattaacttcattcttggctccagtttatgtctctccactagtctttttttcttaagaagatcctaattcatgccatcttattatatattttttcttttttctcataagtagccttatgttgtttctcaaatagtcagattatgacatactgtgtctacataaaaccatgttggatgccccttcatttactttggctttttttcttgaggggtgtattgatttttcatataggtttttgcagcgttttgttacacgaaaatggttatatcacaaaaattattgcttaatagtgtagacaagtggtaaaataactggtctaatggtcagaattgattaaattgatgtcataattctagtcttgtcttttacagcattattactattttcttataatatgctttgttttgcactctcaatctgcatgtgacagtttattgctgtgtgattttcagaaatattgtcgtgctgccaggtcactgcataacagctaactctctgttaactctgttgagtctgttaggctcaaatattctacacccatcagacttgtctcactttgggtggtcacaggcatattaatttcatcacacaacttgtcttgcttctcctctaaattagtcattcttttatttagacaagataatgtgaatggatatttgttttcaaacctcattttctttgattggtttggagctctagctggattttctgattatcttactaatgtcatctaattgataaatattattgtacaactttttaaactcttttagtacttccaagtaaaattatttggtcttctctacaactctctagggtatgtaaggtgggtatatgccttttttacagatggcatacaaaaatgattaaatgattttatatgccatctgtaaaaaaggcgtatacctttttagaaaaacaaggacaaagtcatttaaatgactgctcaagatgataccagcaaatcagtggtaaaactaggactagacccaggtttccagaatcttatcccatactaccttttaaaagaagtcaaaagaagttctaacttatattgtaaacattacttcatctttatcataccccttgaagctaaagctatgaaacaggcaaacacatgttatatcactcatgctcatagcagggcagaatcaggaatgaatttcatttgtattagtctcatgattctctgtttttaaaattacagttccttttaactactaccgtaatcactgtcacgttccattatggaaggaggaagcaatattttatcttatcttttgaaaattaatgttgaggccaggcgcggtggctcacgtctgtaatcccagcactttgggtggctgaggtgggtggatcacgaggtcaggagatcgagaccatcctggctaacacagtgaaaccccgtctctactaaaaatacaaagaattagccgggtgttgtggcgggcgcctgtagtcccagctacttgggaggctgaggcaggagaatggtgtgaacccgggaagcggagtttgcagtgagccaggatcgcgccactgcactccagcctgggtgacagtgcgagactccatctcaaaaaaaaaaagaaaaagaaaattagtgttgaaatgaaaagtatttcccttggaaattagtaactttttagattctttgaattcatctttaatataaaaataatttgttgtcattatgcatattcattaaggagccaaataatacagttaatggtatggtgtttggtaaaacattagctataattttaatctctgtgcttcaagaggatatttaaaattcatgcttactgtgtacatggcaagtttccagttctcattctaactaatcgtttacatgtagcacataagctagaatttcttatagttacagttgacccttgaacaacacaggggctaggagtgccaacccccgtatgcagtcaaaattctaggtataacttttttttttttttttttgagatggagtcttgctctgttgcccaggctggagcgcaatggcatgatctcagctcactgcaacctccaccttccaggttcaagcagttctcccacctcagcctttcgagtagctgggattacaggcatgccccaccacgcccggctaatttttgtatttttagtagagatggggtttcaccatgttggccaggctggtctcaaactcctgacctcaagtgatctgcccaccttggcctcccaaagtgctgggatttcaggcgtgagccacagcacccagcctaggtgtaggatttgactccctaaaaaaatacgccaggtgcggtggctcacgcctgtaattccagcactttgggaggctgaggcgggcggatcacaaggtcaggaattcgagaccagcctggctgatatggcgaaaccctgtctctactaaaaatacaaaaaaaaattagccgggcatggtggcacatgcctgtaatcccagctactcaggaggttgagtcaaaagaatcgcttcaacccaggaggcagaggttgcagtgagctgagatcgtgccactgcactccaatctgggcgacagagtgtgactccatctcaaaaaaaaaaaaaaaaaaaaactttactaccaataacatagccaattaacaataacatagccaattaatacatgttttgtaaatgtattatatactgcataatatataccttaccaataacatagccaattaacacgttttgtaaatgtattatatacatttacaaataaccttaccaataacatagccaattaacacgttaccttaccaataacatagccttaccaataacatagccagttaacacatgttttttaatgtattataaactgcattcttacgaaaaagtaagctaggggaaaatattaagaaaatcataaaagaaaatatatttactattcattaagtggaaatggatcgtcataaaggtcttcatcctcatcatcatgttgagtaggctgaagaggaggaggaaaaggagcaattggtcttgctgtctcaggggtggcagaggcaaaagaaaatccatgtgtaagtagatctgcacagatcaaacccaccttgtccaagggtcaactgtgtatttttttaccacaaccctataaaagtaactactattttccagccgcattttacagtcaggtatttattgacaataatattgtcttctagctcttgttcagcttctggaatttctgagcagccctcgtcagtacaagatggaccccgtagtcttgagttacatggacagtctactgcggcaatcagatgtctcactattggatccgccaagctggctcaatgaccatattattgggtttgcgtttgagtactttgccaacagtcagtttcatgactgctctgatcacgtcagtttcatcagccctgaagtcacccagttcatcaagtgcactagcaacccagcagagattgccatgttccttgaaccactggacctccccaacaagagagttgtatttttagccatcaatgataactccaaccaggcagctggaggaacccactggagtttattggtctacctccaagataaaaatagcttttttcattatgattcccatagcaggagcaactcagttcacgcaaagcaggtagcagagaaactggaggctttcttaggcagaaaaggagacaaactggcctttgtggaagagaaagcccctgcccaacaaaacagctatgactgtgggatgtacgtgatatgtaacactgaggccttgtgtcagaacttctttaggcaacagacagaatcactgctgcagctactcacccctgcatacatcacaaagaagaggggagaatggaaagatctcattaccacacttgctaaaaagtagctattgaagtatatttgcgacttttgaaggctcctctttctgcccttccccatttgttggatggctgcaatctcagtgcctgagggaagatgcctagtagaggaaagcttaatactctttttcctgaaagaatatcatcctctgcattatccccatggaacgtttcactttaaccctgactggggagcaatatgttctgtgaaaatatcttgaaattgtacaccaaaaccttacaaccaacttatttgaacatttattacacacagggtttacgtaagacttttcttattggtatataattaatttcctttggtctcccttatccacattggcttattctggaggaaaagcagtgatctgtaaaacaaatcaagaatatattaaatctagaggaatgcagagaagaaaactataaaacagaaccaaaaacttgttgcacagcctacataattaagagatcaactggctggaagcagatcaaggcctaacttcattcaagacctaaatattatgagactcagttattcggttttatgtgacatctcttccattcaccatgcacaggcttttccagctatctatataatgtttgcaaatatttgataaagatgatgttaccctatcttcctccatctgattcctggaatgcttgaagaaaggggaaatcttgagtaacctcattaaaattaatgtctggtggacctctca

SEQ ID NO: 984 - DNA, 32359 bp, Homo sapiens
aggtgcttcagctgttgtttattgacatacaggtaggctctatagcaacaggcctggaggtgctgcagtagtgggggaaaatggaaggtggagggtggagtgtttgctgcaggacagctgagtggagggtggggacaggtgcaaactggagaggcctagagagctagagaagcaagtaagggccagggccagagtcggcttcaatggaacaacagcccagtgccctaaggcccctaactcttgctggctgtttcttgaccccaagccagggttgggagtcctctgggcatccattttttctaaaggaactggacagagtacacacaggaaaggaagctgtcaccctcttgccatctggctccaggggcctccagtccagcattcctccttcttcccttgattgggtggggccacatgatgggcagccaggctctgggctgtcccactagagcaggctgcaaacacagccatgtttcagtgaggcgttgatcttcttccctggtgtcccaacctaccagtgccacgttacagcccagagtgagttctacaagcgttgctggcctaatggatgggctgggggaagggggtgggacaggggctggaggaggggctctggggtccatcacggcacaggaacaacacgcatggtgttggtgaagccggagccagggcgccatccggtcagcacaatgaccacatctcccttcttgaagaagcctcgggccttgcctggaggaagagaagggaggttggtgagtaaaagccaagccaggcaggtttgcacctgggcagctgccccatagcctgagtactgaactaggctggctgaccactacttcctcacaccacaaggtggcaccaaactcacagcccaggcaaacaggaggaaggccctgaaatgtccttatcactcagatggcagggttggcagggacctttggacatcattcactatcctggagagggtgcaaagccttgcccagggtcagagctagctgcttcctgtcatctgatgataccctaccttatacagggacaatggccacatcagtacgtaatctgtgtatgccaccccacagcacaggagctgtggccaattttatttaaaaaaaaaacaaaaaacaaaaaaaactctcagtaatgagcagatgccaaaaaatggacaattttgctttgagccccagactagaagagaagaggaactgaattgctcagccctacaactcaaaggacccttttccctcctggctcagcttaggacttcggagaatgagagattcagaatgaacattcccaataagggagaggaacagtcgctgggccttttgccccactaaggtctgtgtgttcccctttctattccccaaactttcggggtcccacagaagccaatgctcaagcatccccaagctcctctaggctctagcccctgctccagccacgtaccaacattcatggcaaagttcacccggaggtccacgtcctcagcccaggcctcctggactgggtccttgcacagcacagggaagatgccacggtacaggtgggcctgacgagctgtctggggattccgggtcacagcaatgatgggggcacgtgggcggtatctggccacctggtgagcagacctgagatgggatgggggacatacagaagagaccattacacgaggccccaggaagtaccctcagggcgttcaaacagctcaccctctcatccagctcactgagggctctggcctcttcaacatctgctccctaggacccctcccgaggctcgggcagcccctcatcctatatcccccacagcatgctaggttaccatttgccctctacccccattccacaggccaagggctcaggatcaccttgacccagcaagatcagcctcacccacttaccccacacagcccatggttggcagaacccctcctacaccctgaactctgacacagagaggcagccctggcccaatgtcaccagcacccattcctctcgctgccaatgacagtgacaagccaagcagcacgtgactagcacctgactcttgacatctgcaaggagcagtagcagagctgaccagccccctgggaatcaacatcaggcttctctacttttgtgccctctccctgccccacatggcccctagctcctgaaacagtcccagcaactgggctataaaggcccagaatcaaatctgagtatctagatgaggcttagaaatctaggtgctactcagcaggcaagaacaggaaatgggagtgttgctgcaggagcagctctgcctgccaaagctcctttggaaggcaggggacccttctaaagcccctctgccaggcactttcttgaacactgacactgcacacttgtagctgcagctgtgtctcaggagctggggaggggcaccagaagggaagttatgaggacactcaacaggtgtcagggaaacttaagccacatcacagcagagaagtccctgcacttcacgcttggcctctatgcaaggccttcagagggaagcaattgctgaagccaggaccagctgagtgaaaccccagaagactagagcttaaaatagccaaacagcaagaactggaccttttaagaaaggtcaaccctacgggttggagctgttcagccaagagtgggaggctggagccctctgctgagggcatctgcacagagcttgtgtcctggttctctgggctgcccacgcccatctgctgctcctcagtgcatgggcactgcctgtttgctcccctcttccaggaaacccttgctgccctgtggacagggacaaggagcatactccctaactaggagagtgaaggacattaactcaatgtcctgggccaaggaagggatcccaagttggaggcccagcataggccacacagtcctcagcctggctgccaggccccacagaatgtcagccaagatagcacagcaacctctcctgagctggaacccaatttgtctttagggctcaaaaacagcagggactagtgtgccaaatggaggcacagtaaacagcatttaaataaattcatttcccaactgaaatttttaaagagcacatagtaactggaataagcaaaagtggttatcttttacaattttagaggactaaattttcaatatcaaataaccatttgtagtcagcctgtgcactgttatgtaataaatctccagcataaatttgcttttgatccaaatgttctgacattccttatgagtgctacctagagtcctttgggcccagggaaggggctctgctcaatccttccctgcaggcccaaggtggcaggcagaggggtcttaccttggctcagtgccacctgagcattgttcaatggactgctcccaggacccccaaggtgaggtaccactgagcagggcattccagggagccgctgccgcctcctacctgccagacttggtgaggacgattatggccccactgcagcacttgaaggaggcctccacggcacccacggcggtggcttctgtggggtcgctggtaatgggcgccaggcggcggagttcctcaaataattgcaagtggtagatggcagcctctgcctcacgggcaatctaggggagcaacatccgtccagagggacgagagggggacagagctttgtcagagctttgtcacaaaaggagagggaggggaagagtcaccggacagctggtgaggaacatgttcctgggaacaaaggccaagaggagcccaatcactggagattctgagctgagccaagatcaagactccacagaaaccagtccttcaccaagtgcctgtgacatctactgtgcctactgagccacaggaccctttggtcctgccctgccatgacctccctggcggtgttcctacagacgagaagaggctctgtgcccagatgccaggttgggcctggctgtcttctcctagagcaggtggagcaagaggctggttatcctaacagtgttacctgcccttagggccctacctgccagactccgtcagaactatcaaagctgctgctaaacacttataagaagcctccacgctgcccatggccatggcttccatgaggtctgtggagtgacttgaggctcgcacaagttcttcaaacagcttgcggtggaacatggctgcctcagcctcacgagctatctgtaaggtttaggggaagagggggcaaggaagagggaaggaggaggaaaaaaacgagacacaacacatgggaagacagaatggggaatttatcagagaggaaggtaaccttaggttaattggctaaatctgtccttcaggcagatgcagaggtagggtgatgaaagtccaactgcttcaggaggtgctgccacttcccctccaatacaggggaaattggctcttcccttctggaaggattttttcattgggggtggagggagacaatctggcagtaggctctagcaccctggcatgaaaacatgcccaggctgggcccaggccactccctggcagaggacttgaccacgctgcctcatgacatagcttacaggaaggaacaggccctccctcctcacatggctggttgattaggcaggctcctgcccagcctccatgcatgcatggagtgagcgctcacttggcttcaggcacggggatgcactgagcctttccaatggcctgccatggcaacagattgagcagcgctggaaagctgggatcaaagccaaagcaaggcagctcaactgagtttgaagcaggagaacagaaaacgtgggctaacttgtgagaggcacactgaacagccatgtgaagagacagatgcctgtggaagcatgcagatatatttaataagacacttgattaaaatctaataattaaaacagtcatgagaaagccactgagttatttatagatcacttgctcagataagaccaagaatcagaaagacaatgtaagctttagaggattataatgcaatcaccagcatctcagtaaatgatgggtgagggaagaatcggtaataccccctcatcaatttcacagtagaagcagatgtgtggcaggatgtactaggttaaaggtattctttctgtaagaacggaatgcatgcagcccagaggacaggggacatgaacaggaaacagagccatacctggtactgctcttagttatgggtcataaactgcatcagttagacacaggagaaagcagtgaacagttaatggaaggaactgttggccagtgttaactggtgacacagaaaggaaaggtctagccacctggaggggcagctacagcctagcccagacctgtaacttatcttctgagcagtgccatgcaatccaaaccttgcagccctaaagtatctatctgttcataggaaacaccagggtatggaagaaaggatatggaatttagaccctgagcctgaatcttagtctctgaccccactgacaggctccaaatggagacctgttctcatctcctgctagacagagcatgatgttgcaggagagaagactggctttggaggcagtagacctagattcaaacccaggctttattggccatataaccctcatctataaatggaggtaatgggagttaggaagattacatccatgtacacagagacttatcagacacttaataataacagcaatgaatatttaatgctaaggctataattaaacatatctaatccattttacagatgaggtcttaagaggttaaatgacttgcccaaagacacattcaagtccccacattctatgcagtgatttcatggttcagtatatctaagtcaagatcagcctctgttcctcctttgagaccatgaagtcacacgattaagtagggaaattagagagaggggatgtgtggagagacccagaaaggcagccactttagtggtgactggttcaaggtgcaccgtctcctgggacaccttcctaccatggtggcaattgtgagactgcgccaagagtatctaagcatcagaacagcaatcacatcacacgaatggtgaggtgtcagccaggcccagtctacattaagtgggcctgggagagaaatcactctctaccgatttttttgtttttttttttatgtttgtttggtttcttttttgagacagggtgtcactttgtcacctaggctggtaccatcttggctcactgcaacctcaacctcctgggttcaagcgatcctgctgccccagcatcaccccctctccaagtagctgggactacagaagtgcatcaccatgcccagctagctaacttgaatttttagtagagacagggtttcaccaggttgcccaggctggtcttctgagctcaagcaatccacctaccttggcctcccaaagtactgagattacaggtgtgagccaccatccctggcctctaccaatttaaatatggggaaacccactaaggatgctgatgacagacagtccggaaaatatccttagtcaagtgtgaactcagttcgctactgaaagagcatttaatagaaatgacatctcttctctgaaagctgtttaagcccagtaacaggatacatagtgaaaaaggaaaggaagatgcccagaccagatgggtgttttagttttttttttttttttttttttctgttttttctggtggcagggggtggcgttttaaacttgggggcttggaggggctgaggtcaaagggcagcgggtctttcactggctagaaagggaatagaaaggctgaaggaaaaccatatctggataaagtttaagttcactgagcatgacctaagactactgggagaaagttaatttccagcactcattttaccaaacctatgtaaccctgatcagggatccctgagttagctccagagctggaacagacagggcaaagggactgagcctccaaccctgagcagtggccaggcactcgacatgacaagctggaagagcctgaagaacgagctctcagaggagaaagaagggaaagagcctccacgactcctccagacgctcagtccagggccgccagggtcagccaccctccccgctgtctctatctgtggccctgccaccagtcactcaacccgactttttggtctagagtaagagcagcagctgtaccccaatggcacagcaaagcaaatccccctacaggcaccatgcaaggccagcacaggcagctcagtgaaggcaacagactccagtgcaggtccacaagggccccctgcgggagcgcctgtctgcaggatgcggggcagagggaactgaattggaagccaaaggaagagggcagctgggagcaggagcccctagcccttttcagaatagggcaaaggtactcagaacttctgactctgaggaagaggtacaagacctcctttcactgcagaagtatcccaggacttaagccatgggaagaattcacaaccttgaagtcagaagtgaaataaactgtgtggtgtccaatgaaggaggatgcctccagagcagaaggaaatggaggggtgggggtgtgggcaggaatgcagaacaggagaaaaaaaaaagccacctccacttccacccccaccctcttgctgctgtaacttggaggataatgaaaggctgtgcataagaggatggagaaacctaaaaagctctgcaccagagcttgcatccatcccaggcccagtccgaagccctgggggatggggcaggccccagaactcaccaggtgctgcatgcgcacagcctccagaggatagtcccctttggctgtttctccagacagcatgatgcagtcggctccatccaggactgcattggccacatcactgccttcagcccgagtggggcggggcttcttgatcatgctctccagcatctgggaggggacagagcattagtgagatgtagcttgagctgtcttcagagacaaatgacagcaagctgatcctctggatagtgagtaggtacacagagtatggctttgtgtaggtacatgggggaaggggattatctgtgtgttacgtgcgacaattccatgggaagagatcagacagcctccagagctttcccatacaaacatgcgagtgtgcacatgagaatgtggggaagggtgggcacatgcctgagtagcacagatgacaggcttcccagctcggttgcaccgtccaatcatcatcttctgagcaaggaagaccttctctgcaggaatctcaatgcctagatcaccacgagccaccatgatcccatcactggcctccaggatttcatcaaacctgatggacaaagttggggggagagaggttatatagaacagaggccacaagtatggcagtagacaagaagtttccctgggattccctaacttagatgtccttgtaccaggacagacatccatgatatcatcatgggtgcacacagatggcaaggcagtccagctaccttaggcccccagagtgggccaacaattctgcctgctgggcttcaacaccaatatggatgcttcattgacggaagaaaggggagagggcaaatccaaatgggctcattcccaaggtctcctctccaaatcccatgcatgttaggggtctctctagggcctccattttccaatcagcacttcaagacagggaacctgaggcctgatgactgcttccaccacaaagacccatggcctcatctagtcaaggacacttgaggactgccctttgaggtggcccactccaacctgctgaaggcaagagggaatgtggctttgcctggcctagggccaagttcagctagcctatggcttatcaggatggcaaaggggaggaccccaaattgcctggtacagaggatatctacacaaagctcagacagtaaggccactacagtgggtgcacagggttgctcccccaccctccccaaacacacttctaatccacaagagtgtgtctagcatcttagttgtgctgagttgtattcctagcaggatgccaaaaatggtggccatgcccactgggctctactttgtgagcattggggagggggtaagctaagttggggcaatctgaaactggagaagaaccacacatcttcctctgagagtggaatggaccataccagagttagcatgatcactgagccagctgcattctaagtgaagaccaggaggccataagctttaacatggacaccaggccctgaaattccacatggctccccaggaagggccaaaaagagccctttcttaagtgtctgctgtcatctttccccctggtccccccattccagcaaacactggtagtgtttctgatcaggaacagaacatcatggcccctggtcctgtgagcagtgaccctgttctctcaaatgttggtccccaggcccagggaacaatgtcaagctgccagcatctcaattacctgggaagcttttttttaaaaaaaacaaaaaaacaaaaacaaaaaaacataatgccttctactctcctaagatattctgattcagcaggtttggaactggcttgggagtctacattctgatgggctaggggctgggaatcagacattcacaggatggaccatgcccttcggagagctgcgctgggactggagcagggacaacggggacttgcctccgaaccccctcatgattctcgattttgctgataatcttgatgttctttcccttctctcccaggaccttcctaacttcatggacatcagatgccttgcggatgaatgacgcaaacaccatatcaacatcctgctcgaccccaaacttcagatcctggatgtccttctccgacacagcaggcaagtccacagcagccccaggaaggttcacacccttcttgctgcccaaggagccaccattttccacctccgtcaccaggaagtcggcacctgtatgaaaaagggtaagtaggggaggcagagcacgagggcacaggtcaacaggaagcaggcacctttcccgcaaggacagtgagctgggaagtggtgcattatgggtgctggagctgttttaccagagttgaaaacctactacactgtgtaatcctgggcaagccatttaacctctctgtacctcactttcctcacccataaataaggataattaagactgttctgactttgggaggccaaggcaggcagatcacctgaggtcaggagtttgagaccagcctggccaacatggcaaaacgccatctctactaaaaatacaaaaaaattagccgggtgtggtggcgggtgcctgtaatcccagctactcaggaggctgaggtaggagaatagctagaactctggaggcagaggttgcagtgagccaagatcatgccactgcactccagcctgggcaacagagcgagactctgtcttgaaaacaaaacaaaacacagcgaaacaaatatatatatatatatatatatatatatatatatatatatatatgtatatatatatatatatgtatgtatgttcctgtgttctccagaaccagaagaatgtaactatgctggattaaagcctatctttgaggataaatgagttataaaagggattcctgagaacacacagactcaatctcactgccaggcaaccaaccttcccatcttccttgtgtcaaggaagtttagagacaaaagactgttttagacaactggactccagctcccatacgtacctttctgcttcacctggagagaaataagcccatcatccacgtagatcttgctgcccacttccaccaccttgcagatgttcttgtagtccagccacaggatgttctcgtcacacttttccatgtaggcgttatccagcgtgattttgagagtggctcccttcttcagctccacctctgcagtgccgctctagggacaagagagtaagcaagagtccaaactggagacaccagtagcagcatcacctcagaaggaatggaaaagctctttcctcccgggaacaatgctcaagtcactgctaaaagtaatacagttttttgctcttattctctaactctgtatacttcacggaaataatccaagaaaagaatatgtttcagttatgctacttaatgatggggaaaaagatacaaagagatggttctccaagttagaaagcctaaagtttaggtttttagggtaaaaaaaaaaggttcctttgtggtaccatttcctagcaaagtagatcaaatcaacattgtttacagtgatgaataaatcctcatttgtagacctcaactcctctgcagtccttcatagtactgggaagaaacatggcaacccagcgctttggaggacatgtctctggggcatattgcctactgagccttcccctcgctctccgcagaatactcacgcccttgatgagcccagttcggatctcaggtcctttagtgtctagagccacagcaacgggccggtagaggatggggtcagaagcaaagctttccgtggctgtgcgcacattcttgatggtctccgcatggtactgggggaaaagaaggaagatgacaagcgtgctcccacactagaatccagctccaattcccctgcccaggagccaaagctgatcactcaggaaaggcccgtggatgtcttagagctctatctccatcctcagcacgatccatgcactgagaaatcctctacctgcttaatccaacctcctcagcctccacccacttctactacagcactaattcacccaaagggcaaatctttgaaatgtaggtggcaaatttcagaatattgccaccaaaacccattaaggtatgggtgcaaacatgtctcatcataaaagcagctgtgtccccagggctgttcttttttccctaagactcatcaaataccctcagcatataaagctcataaacagggcaaaaagcctaggacttgtgtttggataaggctggtctggcaatcaatgtcacattctgatatatgtggtaatgctgagagcttttcctctattgattccaactacaacgcaaacttgaagttattgacttaagctaacagtggcccaagctaaataactcattgctaaggtcacacagacctgattttctcaatcgctttgttttttttttttttgagacagagtcttgctctgtcgcccaggctggagtgcagtggcactatctaggctcactgcaagctccacctcccaggttcacgccattctcctgcctctcagcctcccgagtagctgggactgcaggcgcccaccaccacgcctggctaacttcttcgatttttagtagagacggggtttcaccatgttagccaggatggtctcgatctcctgatctcgtgatccgcccacctcggcctcccaaagtgctgggattacaggcgtgagccactgcgcccggcctcaatcactttctagattctgattggagggggaaaggtggtcatatgcctttctctaaatgaactgccctttattactccttgcttacaacaaatcctggcttcaatcttttttcttaagcctttcctcctttccatttaccattttgtttgtttaaaagagggactcaggctaagcacagtggctcatgcctataaaccaaacactttgggaggctaaggtgggaggacagtttgggccaggagtttgagatgagcctgggcaacatggcgaaacctcgtctctacaaaaaacacaaaaattaactgtgcatgatggtgcgtgcctggggtcccagctacttgtgaggctgaggtgggttatgtctaggaggtcaaggctacagtgagccatgatcacaccactgcactccggcctggataacaaagcaacaccctatctcaagaaaaaaaaaaaaaaaagacgcagagccaagatgtcaaaagagctctaagatagtgtcatcaataagacattagcggtaacaagggcacctaattcagcactttctgggccttgtcctttaaccaccactgtccaggaaagtggcacctgcaagtaagcctgcctgttattcacaggaggctggagggagctggagccagagcctagcctctaaagacagtgttgcctgaaacctgtgtctaaaaatcttcagcttcttattcaggcatacttcctaatgacagacccttggcttgtctgttttttatagggttccttataaattatgatattttcttgcttactggcttgtaatagaaatagaacaaaatagaatagaatagaggctgggcgcggtggctcacacctgtcatctaaacactttggaaggccaaggcgggtggatcatgagatcaagagattgacaacaaccaggccaacatggtgaaacctcgtctcaacttaaaatacaaaaattagctgggcgtggtggcgtgcacctgtagtcccagctattcaggaggctgaggcaagagaaccacttgaacctaggaggcagaagttgcagtgagccgagatcgtgccactgcactccagcctgggcgacagacagagtgagattccgtctctaaaagaaaaaaaaaaaaaagaatagtaatagttgttttcttttaaggggataggtggtgcctttccttcagagttgacgtgaggagtaaaagaatacatgaagtattaggacaaagtacatggtaattatctaataaatgttacctattatcatcttataatgataagactcaggtgtactgagttccactacagctgtggctttgttgggatgttatcacgtggataagagttccacacatcaatgctgtcctgcggaaggctctatatttagctatatttaggttgtttaaaagtcaaccttaactcaggccaggcgcagtggctcacgcctgtaatcccagcactttgggaggccgaggaggggggatcacaaggtcaggagatcgagaccatcctggctaacatggtgaaaccccgtctctactaaaagtacaaaaacaaaattagccgggcgtggtagcaggcgcctgtagtcccagctactcgggaggctgaggcaagagaatggtgtgaacccggaaggcagaggttgcagtgagccgagatcgtgccactgcattccagcctgggtgacagagcgagactccgtctcagaagaaaaaaaaaaaaatgtcaaccttaactctacttaatcccgatgtagaattttgttctcctagaataaaatctacttggtcatggatcaagacattcctttcaatcactactggatttggattattaaattttatttgttttctgcatctaagtgagactggtctagcacactaactgttagtacctgcctggttttggtactgtccttgtttgatctcagtatcagcgtatattggtttcaaagaacacagtgggaagatttctatatttctctaggctctggaacagtttaacaatgtaactgaactttgaaggggagacaattcagccactaaaatcatttggacttaagtgttctgaggtgaaccagatcttaatcactttttcaactttttggctggagtgcagtggcgcgatcttggctcactgtagcctccacctctcaggttcaagcgattctcctgcctcaggctcccgagtagctgggactgcaggcatgtgccaccatgcccagccaatttttgtatttttagtagagacagggtttcaccatgttggccaggctggtctcgaactcctgacctcaagtgatccctccgccttggcctcccaaagtgctgggattgcaggtgtgagccaccgcacgcccagcccactttttcaacttcttatggccactggtctattcatattttctatcttttggatatttatcttttctttgaaaatagccagagtcatctctctatataggaattaagttataagtctttcttgacttttaaaatctccaatgtgtaggaaatattctcttttctattcatactcttatttgcacatcctcgcattcttcacctggcttctcagaactttctattttactattttttccccacaaagaatcagctcttagcttaatctgtcaaatttattttcatttcattgagctataatcttacaaaattattttcttcaccctttttagggttttcctcccctagtgttctgagttaaatatttatttcatctaccttgagatctttgctttctaaagtaagcacacttcagttttcttgactttgttcttaatttccactaaaaaattttatcagagaatgtgtctgtataatttctactttatgaaacgtgggggtttttttggtggcctaatatatttttgtaaccatgagtgtttcatgcaaacatgcatttttggtcttggggatgtaaaaccatatattataaacataccaattattaggtatattattcaaatctatgtcatatatcataatctcttagagcatctctgggaggtgtactgagtcttccacttcagctgtggctttattgggatgttatgtggtaaagcatccatcaatgctgtcctgtggaaggctctacatttaggttgtttaaaagtcattatttctaggccaggtgtggtggctcacgcctgtaatcccagcaatttgggaggccaaggcggatggatcacttgaggtcaggaattcgagatcagcctggccaacaaggtgaaaccaagtctctactaaaatacaaaaattagtcgggtgtggtggcaggtgcctgtaatctcagatacttaggaggctgaggcagaagaatctcttgaacccaggaggcagaggttgcagtgagccaagatcgtgccactgcactccagcctggatgacagagcgagactccctctctaaataaataaataaataaataaataaatctggaaaacatggcatatggaaccacatgttcagcaagaatgcatcttgcccatgtgaactgccaaaagtgagggctgaagactagttgccaaagctgttaaaagagggctgggcgtggtggctcacgcctttaggaggccgaggcagtcggatcacctgaggtcacaagttcaagaccagcctggccaacatggcgaaaccccgtctctactaaaaatataaaaaaattagctgggcgtggtggcacaggtctgtaatcccagctactcaggaggctgaggtatgagaattgcttgaacctgggaggcagaggttgtggtgagcagagattgtgccagtgcactccagcctgggcaacagagcaagattctgtctcaaaaaaaaaaagctgttaaaagatcagatgcagacatttgatgtccctctgtcagagtgagagggaagacagtaatctcaacgttctgctcagaagagcatttaaaatagtcagaaactggaaaagtacgccccagcccctagtcaaaggtgcacatgaaacgatagccctgacgtatggtaaggctgaaactgtttacattacattatataaattagaataatttcagatcagtttccaagctgagcccacacacaacctcatcttggtctaaaacttcaaaatgaacacacaagagggacatctttaaaaaataaatagataaaaaataaaaaataaatcttaattataatctgggaataggagtgaaagtagagataatctccaaaagcctcttaaagtttaaaataccaaaatcggagccagctctcatccagcaggtgtggcaggtatcactcgcccttgccatgttagagctatgtggtgttattttactggatgaaggaaccataaagcctacttaaaggtcaacttcttaaaaatctatttctgctccttcccctgaatgcaggagcccatggcagactacagcagcagggatcaacagcgaacagacctccagcattgtcttcagctctctctaagctaagctaacacttaattctctaacaagtaattctcggtgactcctgctaaggaccccttgcttttggaaaactacagaattttccaaaaggtacagggacatgtcttaacctacatggtatgtctgctggacttggtcaggtccccatgacatttaagggccagccactagccaggccataggctgtttatgaacacaggttagggaatctatgatgaagagtcttgtgtttcccaaaaggaggaattcactcttggattgcatttcctgaggctttatttttagtccaaacttaataccaacttccaaatgccagagggcaacctctgtaaggcaattggccttacaggatagcattttctttactctcaacaggaaatacagaagccaagacaggtgcaaagtttgcctcttctgtaattcctcttatcaatgccattacgaaatcccatgatctatgggaaacctatggttaagtctgaaggttttaaaaaggcacaatcccaggctgagcatggtagctcattcctgtaatcccaacatttgagagaatcacttgagcccaggagtttgagaccagccaaggcaatatagtgagacctcatttcccccaaaaaaatttttaaattagccaggtgtggtggtgcatgcctgtattcccagctactcgggaggctgaggcaagaggatcacttgaacctgggaggtcaaggatccagttagccataatcataccactgcagtccagcctggatgacagagcaaaattttgttttataaaataaaaaaataaataagtcatggtacctcagggaaccccaagctcctcagaatgggttaattctaaatctggcaatggaggcaggaatggagccatcccaacagctgctacctggctcctgggcaaggcctctgtccataggtaaagccagctaataaagagcccagcacaaatacagtcctactaggctcctggggaagagtgctaactggtgttattttaatgtaccagaacccctgggaaggcacaggctgagaatacagtgctgaggaagtggggtattacaccccagatagtgcttatgcattaggctcagtccctcaaaacttagaatagtggaaaccgttctcatggacctgcccagttattttggttctaagctagaatcaatctgctagatggtttaccatggcaacacaaggtgaagcagaaaccctgggacaggagagtcaagcgctgtggccaggacacctaaggcttagagggttttccagtagaacctttccatatcttcctttgtaaaagctaagggtaggagaggtgtgtgggagaaccacagccagcaacaaagggggtcctttttgctaaaagagactcagccagttgctttgtcaggacaagagggaaggagagtagggatgggctagtaaagacaaacttcacactgactgtgaaactcagactcatccttgtctagtccactgtggctaaacgaacactgcaccccctccctgtttcctacaggccatcacaatggccatagggtccagccacagctcacctcatgagttccatgagagaagttcagacgagccacattcattccagacttaatcatctccttcaacgtctccactgatcgggaagctgggcctattaggaaaagttttaaagccacaagtattaattattcaaagaaggaaaaacatttaagtttgcttaagtttaaagaatttttttccctgaaaacttttcctctcccaaatagctcaaaagtctttaaaaagtgcatggaaggctactaccgtgccagcttactttcttgatctactgggacacttcgaccatttccttcaagttctgcaggctcccactgtatcagaaaagcctaggttaagacttggccagccttctccaccctcactgaaacccagccagatgtccaaccacagaatcttggtagcacagaacatgttagaaagatctttcctaggtctttaagttgctcctacaaagacctgctaaggaaaacatcttctaaattttgcctatagcataaaacctaaaccatatggattctttttgcaacaaattattttttattataaactggtaatttataatttgggttacaaagttatgtaatccaatacatacagtttggatacaatgtggaataattaaatcaggttagttaacatatccatgacttcaaatacttaacatttttgtggtgagaacatttgaaatttactcttagcgatgtttttttcttttttcttccttttttttttgaggcagagtttcgttcttgttgccaaggctggagtgcaatggtcagatctcagctcactgcaacctccgcctcccaggttcaagcaattctcctgcctcagcctcccaagtagctgggattataggtacccgccaccacccccggctaatttttttgtatttttagtagagatgggatttcaccatgttggccaggctggtctcgaactcctgacctcaggtgatccacctgcctcagcctcccgaagtgctggattacaggcatgtgccactgcgcccggacaatttttttttcttaagacaggatctcgctctgttgcctagactggagtgcagtggtgtgatcatggctcactgcaacttcaatctcctggactcaagtgatctttgtctcagcctcccatgtagccagaactacaggtgcatgccaccatgcccagctaattttttttttttttttttcactttttggagagacagggtctaagttgctcaggctggtctcaaatttcgaggctcaggcaatcctcccacgttggcctcccaaagtgctgggagccaccatacctcgccatcttagcaattttgaaatgtctaatactctcttattaactgtatttgccatcctatgcacatactaattctttactgcaacttcctatgacctgagtcctttcataagaatctgtgtagtatcccatgtagcacctaggtttgttaggacatttagttactcttttcaggagagaaaggtcactgcccatgaagcccttttttgggggaaggggcacacccactcaccaatggtacagatgatgccagtgttccgggctgtgatgggtggtgaatcaatgtccaggcggcacatgtgctccaggaatgtgtcagccatggctgcgtgcagctgctgggtctgaatgaaggcagtcccggcttcactatggggcttcgacatggctgctgaggtcctgggtcgagacaaattgaaagagagtggtaagactgagaagtggttaatataccatttagcacagaaggctgtctcctgcttacacattaactcaataagcacgctttgtacacaagccacagggaagccagacatgatctggttatgtgggtgctcctcatgttagaaaaagggttcaccagattgtgaacaatggaaaggaccttactgaacaagttaaaacctcccacccactccacatagtcccaagcacccacagtaagcaggtctctcttacactgggctgactgacatctacctagacagctttctcaccaccctatctataaataacatcatttaacatgcactgaaggagcttccaatgaaggaagttgtaaccaatcttccagtgatacaaacaactgactcctagcttagtgccttgataagcctagatctctgcatgtcaagctgtcacaaagctacaaatagctgctttgtcgtggggcacccatattgcctctttacaatcctcacccaaacccaaagtcattcccctgaatgcaaaagcttccatcccaggagtctaaacctaaaaccacatctactgttggccagaaggatgtcaggacacgcaaagcaatttgcaatttgcaaagcaaggataacataagggcactggtataattctgaaattatcacaactacattaacaggatagttgcaaacatagagaaattaaagttgctggtcaaatcttttccccaaatgatttttgatacacatcctgatttcttttctaagcctgacaagtataccaccactctgtaacacagaccatcagttccaggtaattaactagcccaggtcacaaccctgacaatggccccaacctttgctttcttcattaatgacttacaactaaactcactcagcctgttagttagctgattagagacaaaaactcaggagaagcttccaggcagtgtttgaataactatcaggtaaggatgtgaaccagaccaggcagtgtttgaagaactatcaggtaaggatgtgaaccagaagcttgctacacgtctcatcagaaagctgtttccttgagttctcagaccaagggctactctttctaaaacgcttgagcctaaatgcttcggccaagcaaggctcaggaacaagctcctctttagcccttccccacctcatcctaaatctcaaagttccaaatcaaggcatctcacacatatgacccttactcctttaccctgttccatctctgactttgtgggctctctgggtggctcgagtagagtatacatctaaatccatctctgccatctccaaagaaggcccgctgaggtccaaggagctctgaaggcagtagtgaacagtctgttggctatggaaaactgatggccacaagtcctcaaccacagattctaaaacttttaaaatggggaaataagataccggctaacggttcaacatggcaaatgcactcttcatttcgatgtgtatttcctaagcccctaatatctactacgtaccaaaatgaaaaaatcaatcctcccttccaggacctatatggttttgtatctcctagcacctagtatgtggaagcattccagtgtttgttaaatgacctttcagtctctctgaatgcctctttgtcagaatcaaagttatgcctctgctcccccttccctaaatctgaggaacttctgcattactgacaggaaagcctggggcccctggtccctttccctacactcatggttgagggagggctcgcataccttcagagctcccagctgggcttagggaagtctggctgttaagggaacattactgagagatggcacatcaggccaactggaacacaaaggctttgctgtggcctccaatgggcctacaatctagggactgtattgtgaacaaaataagatctgaataagtgggttggagtaactaattccactctttttaaaaaccatcagctggctcttcttagacctgagatatgagggtcttcctgtaaagacctggctggggccactgaatatcaggtcatacctttggttctctggggttgggcttccggtgacataatgctccccttttggctcagggtggctccttggcctcactagcaaagaccgctcagagctgaatacggtgtgccctggagagctgcacaaggattaaggaaaaagctgagtgtaactaaagctctttggggtaatggaaaaattaccttaataaccaggtatccaggtgacagctgctctagagattccactgttatgtctctttaaacctgtgatttactaacattccactattctatacaagaacctggtccctccccttttgggagcggggaagggacaccaaattaaacatacctaaaagacctgggaggatatatactgaaattttaataggacgtcattggggtggtaggattacagaaaaaaaaaaatcctctttattaacaaatttactgatataaatataaaaatacttttatagtaagaaattatgtgtacctcttttggaaatatttatatgcatcctataaaattgttgggaggaagtaaatgaaatgtgaagacaccaattccattaatcaattgctgctctatgcacttcaagaataatctgcttttaaaaggtggcagagaaaagacgcatgtctcaagttctgtacactgggttgtgattaaaaaaaaaaaacgatacaagtcttaggccctacatcacaaatgtactgcagaacagtttcaacggcttaagaaggtcaaccttaatacattcagaacctcaaagcaaaaaaaaaaaaaaaaaagtccacaggataatcccatgcctcaaacctgttagttacatgcccaaatccagcaaactagtttgttctcaagctttacagtaaaagcttttgacaatgttctggtacagaagggctgcctccaagtccacgagatgccattagcagataaaattatattggcctcaaacacaaaccctatttcaactatctcaaattaaatctgatgcctataagctctaattttttgccaataagtacaaaaatgacaaatgaaaatttctatagtggatttacgcattagcagtcaaaaaaagcttgcttgtcagcaagttcatccagactccagatctcatgtgtccttcatgctctctacccagccagagacctcatatctcatgcccaggtctttcctcaggctctgacctgaagcctcccttgcagggagggccagagctctcctgccttctccaaaatcctccacaagcctcttcccagcacaaactgcccatcccaccaaccacgtacctagagttgtatgtaaaacactcactggactcccctggctccaggagagcagcccagccttggtttctcagggcggacttctgggaaagactcctctccctcatgccagctgcctggacagtgcctgccaggacatgtggccccacccatgccagtctgactcactattgcatcctcctcctaggaaggcacagacatgcagagccaacctccagccagcagtggaagcctggcgtatccactgatagcagcacacaccatgcccaggtccaggagccttattcttgagcccgagcccctgcagtaagatcttcctcagagccatgtctcctctgtgagaaaggagacaccatctctaagaggccttagtctggagtgacaggttggaacaggcacaatcacagctcagctccaagtgccctattctccctttcctttctcatctcagacagctcctggctttttatattagtttcctttgtgtcagacacaattttttggccattcttcagaaaccaggagacaaaaatcataaaaaatacccaacactcctccctccaactttttttttttcttttttttttttttcagacagggtttcactctgtcacccaggctggagtgcagtggtgtgattatattatattatagctcactgcaccctcaaacgatcctccagcctcagcatcccaagtagctgggactacaggcacgaaccacacccaactcccatgctccacttcttagggccaggactgttgttgggttgtgctgggaaagattcacgcttcactccaccaattcttccacaaaggaccaaatcattctgccctaataaaatagcctggcccgtgagtctgcatctgcctaagtcatttttcctttgtaccaattatgctccgataccaacctcatcacatagatcaactataaaatgatggcacctgatgctcactttctccctccaacgttgccagtaggtacccaagattgtgttccttcctgtgacgtcagtttgctacctacacctccaagccatcatgaaggcgtttcgatccacaactcttccgaacacctgcatccgttagaaagtctgcatcatgatacgctggcattcaggtcagcctgctctctagttctcttcctcaacaatggaaatggagtttctaagatttgccctaatcaaactaggccagcaacatgatcaaaatgggtgacgggccagcagaacctagtaaggtctggaataggcactgttcatcttcatctatagttaagggtaatgacaataatgtatttgcatatgggtgcaggatacagaggataagatatcttctagctaagagacctgggtcttaagcccacactttaaccccaggaggccccacagcagaaagcagtatggtgttaccaggctacacagaacaaaatgagcccacttgtaggttctagtaaaattccctggctttaaaaaaaaaaaaaaaatcttggctcttttatttcttcggggctgaaagtaaatgacttgtcaacaggaacctaaggtcctatttccaactagagtgtggaatagggaagagcagctgatgctaaatgggcctacttccctcaaagaccactcaacttcaggtgaagaagccctaagtcagagacccctcaatgtcctcagatgccgaggatttcctggttccatcccagctgctcagtgcagagaactggtttcagcctgaaggaggtggtttgggggaagcattagttgtcctgggacatggtgcctccttactaggattaaaagtagggcggtgtttctgggtatgatatccacactctaaaatcagcaagggacctgggaccctgatttagggtcctcttaagtgcaactaaggtgggtgatggcctcagcaaagtgaggcactggctcaacatttactggaagggctgccctgcattctagtcggggggataaaggaggaaaggcagtgccaactctccaagagcactgaactagttactatgactggtcttcctacggcagcctttataggtttgcttctatgttacgaattaaagaaaaaaaagttttaacatctgcctctctaccacccagaactgaccattaacactgagccatggctggctgtgttggctcacgcctgtaatcccaacagtttgaaaggctgaggcgggcagatcacttgaggctaagagttcgagaccagcctggctaatatggtgaaacaccatcactactaaacatacaaaaattagccaggcgcgcacctgtaatcccagctacttgggtggctgagacacagaattgcttgaatccaggaagtggaggctgcagtgaacggagatcgcaccactgccctccagcccgggcaacagagtgaaaaactctgtctcagaaaaaaaggaaaaaaaaaaaaacacaaataaaggctgagctgtattttctttaatttcttttttctttttttttttttttttgagatggagtctcgctctgttgcccaggctggagtgcactggcgcgatctcagctcactgcaagctccacctcccaggttcaggccattctcctgcctcagcctcctgagtagctgggactacaggcgcccgccaccaggcccggctaatttttttttttttttttttttgtatttttagtacagacggggtttcaccgtgttagccaggatggtctcaatctcctgacctcgtgatccgcccacctcagcttcccaaagtgctgggattacaggcatgagccactgtgcccggccctctttactttctaaaaacaaaaacaagaattttaattttatacagttcattttttctccatccccaagctcctccaaccctttccacctccatcttaaacttttttttctattttatttatttaaatagagatgggaatcttgcgatgttgcccaggctggtctcgacctcctggcctcaagtgatcctcctgcatcagcctctcaaagtgctgggattacaggtgtgagccactgctcccagccacatcatgcattttgacacccaatcactgtcatgaactctatatccttccagttcactgaagtctatgtacagtgtatctatgtctatactgaaccctataatattgtggttttcttaatgccctaagtggtatactgtatatatcactgagtaacttgtttttcactcagcagcacatttaagatccatccagtgggtatatggatctagctaattcatttaagctgttacactagtccactgtacaacagaccattttatttatggactgtcttactggtggccactctccctccccgttaaactaagtttcttctattaatcaatactcttgtagtacatgtctccctgtactgtgtgagtttctatatatccagaaattgaagtcttaggtcatggagtatgtttatttctatttttactaaataaggctgaattgctctccaaagtggctatatcaatgaacgctgagttgctgccttccacacctttttccacacttggtactgccagactttttaaatgtttgcccatcggtgacatttgtttttctgctcatctaatgttaataaccaaagagggatacccagatagtttcaacgtttacaacatctctatttccctgcttaactcaatcaaatctcctctgaaatggcatggtggacacagtgtgtcttatgtgccctgactgactccactgatgggcagttctttttcgttcatggccaagggagatatcagttgtttaaaattgaagaaacatggccaggcgcggtggctgatgcctgtaatcccagcactttgggaggccaagacaggtggatcacgaggtcagcagactgagaccatcctggctaacacagtgaaaccccgtctctactaaaaaatacaaaaaaaatcagccaggcgtggttgcggttgcctgtagtcccagctactcaggaggctgaggcaggagaatggcatgaacccgggaggcggagcttgcagtgagctgagattgcaccactgcactccagcctgggtcatggtgcgagactccgtctcaaaaaaataaaataaaataaaataaaataaaaaatgaagaaacattatctgcaagtaaactgaagatgtttggaagggataggactcccttcagagaatcttgactgcagtattcagccagcagctgtgctggtccacagtgtgaaatgctaggactggcaacctcactgcccttgaataactggtcttggcatctctcccactgcagccccagcctgcttccaagactgcttgctggcatgaggaaagaggcttagggctccccaggagctttgtctatggacagaagtgggggaggtgagtctcagaggccaccgaaggtactgcagccggcttgttccctcctacgtgcagacaagcacaaaccactgcaggggcggggcttcaccgcactgcatggtaggggccctaaagcacccaactcctgagctgagcagtcataccaagaggcaggaaggcccagcagatgctgcacatcaccctccaccactcacccaggctcaccttcccccaacagcttctttaacaaagtcccaagtatttaaattactcaattatccagtctgccccttggtaaaaaaatgcaagctccccgcaagtatggtggtatcaaaaatggtcttcatatatctggttgtttagctctattcccatctgtatcagaactgatgcttaaagggacaacttaaaatccttaagacctcataccaaataaaccaatctcacgaagacccttgaagatgcaataaaactctgctcacagggtcaacgcattcttgtgttataccagctaattgagatttgactgtggacttttggagtgattcagaaagaagggtaatgtcaaatgagtcattttcctctactccggtctcagtcttagctcttggccaagataacacatcctgacttgccttcataaaagctgaagcaggccaggtgcagtggctcacgcccgtaatcccggcactttgggaggccgaggccggtggatcacctaagtcaggagttcaagaccagcctggccaacatggtgaaaccccatctctactaaaaatacaaaaatattagctgggcgtggtgcaagtgcctgtaattccagctacttcgggaggctgaggcaggagaattgcttgaacccaggaggtggaggttgcagtgagccgagatcacaccattgcactccagactgggcaacaagagcaaaactatctcaaaaaaaaaaaaaaaaaaaaaaaaaaaaaacaaaaaactgaagcaaaataaactaaaacccaagtaaagtgagtttgtaatgtaagtgctgcattttcttctaccttcctgcccacggccgtttcctcatttcttccattgcctcaatattaagaaataaacagctttaggaaataaaatggtttttcctgtgaccccacatcagtgtcacaacattcaaggcacagaagcaactcccataaagtgctagctgtttagagtcaccgccaccaaatttgctaagtcactgggggtacggttcttaaagagctaatgatgctctttgctaaaatatgaatacaacattatttctaatgcaatgcttaaaatgaaagcagttgtgctagacaggagaccaacatccatacattttggctcaagtcagtaactgagaaatgagttcaagaaccttctttaagtcatcattaatcaagtcccaggagaggcggctgtgcccgctacaaaagggccaggaatgaagctgcacagacggcattagctgggcaccgggctctgccagtctacacttaagctcttaaggcagtacagagaaccaggtgacccggaccaatcattttttaattagttgtggctttttttttttttttttttgagaaggagtctcgctctgtcgcccaggctggagtgcagtggcgcgatctcggctcactgcaagctccgtagttgaggcatttttaattaggggaaatgcatgcttcattatctgactcactgaaaggggagaagggactttttaagcctgcaagaaccacaatgtagtttccccactcacccagcgaagataattctctcaaaagcagaataattgaaaggttgagtcatcttccccacagagccccactcccccacagatttggtgatacgttacatttcccttccccacaagacagcccactcctgcccccacagcacctcaggccaccaaagggcaaattatttgctaacaacgctgcagcaggggagtcctgacctccatctcctctgtgacctagggagtggccacaccctcaagacggccaactgggggctactgaccctggctccaatcctaatctcaccagcaggcagagcaagtcaagggctggaatgttcctctggtaggtagtattctacttacagcggaacaccaaaggcttaactcagcccctccttgcctgcctttgtctacaggtcccaatctcagatgaccaaaaagcatctgctccaagcagagagttggaaagttacattatcagttactttgtcaatattaaaccagatcccttggggaactggtttccaggagacacgtggttattcagagagcctgattcctcacgattagctgtaggcgtttggggacagtaggaagacaatggatcaaggcccttatgctcaattgtggactaagtaattgtgctcaaaaataatatattcagtcacaggcttttcttctgggtatttcgccagagattagacacttactgagtgtgccacatccacgtaagcatgaatcctttcaaccatcatgaggaaaatgttactcccagttttcccaggggaaactgaggtgtagaggctgaactccttcagagtctcaggaaattaatgagtcaaacctgattctaaacgcctttttgacaacttcccaatgtctctctccacgtggaccttcactgtcggcctcactttaacccgtaccagcaaaggtccaagccctgggtctggagtacgtagattaagaagccaagggatgcccttacatgactgagtctttaaatgatcttcagactggaaggtgctttcctgcatcttctaatccagtgtgcttgccacctggtgagaccttacgaggcttcctgtccccctccctcccacagcaggaagctcgtaccccactcccagcattacaggagatacattttaagattgtgagctcggtgggctatgactcgtctagtcatcctggtctctaactctgacccccaaacagcccttgacccacaccgtttgcgttcagtgaacgcgacagatttcctgccccctccgtaaccagatccccaccccaccccgcggcctccgcgttccacaatcaggacgcatttgttaaaaaatgtgccggataattaaaaaaaaaaaaaagaaagaaaaaagaaaggaaaagaaagaaacgtgccggagaggcgcggaacgggcgagggccaggaggccccagcaaagcctgcagaggtttatcccgcccgttacgaggcccaaggccatcgcccggtgaagcggggtgggccctgggcgcggccgctacgtgcagcccggccgcggcgagatggagcgtggtccctggcggccacccggcaagggccggtcgagctctcgggccccgagccattcccaggccctcgcaggccgcccatctaatcccggccacaggggacggcaccgcgccgcaggggcaaccgccctgcctcccggcagcggggcaggccaacgttacgtaagtctccagctgcccccgggccgccgcatcccgcccgccgcgcggggcacccagcccagccctccgcccgcccgccccggacacggggcctcagcaccgcccgagcctgctgggagctgggaggcggtgatggaaaaggggggtgggaccgcgctcggagaccggagcaagtgggcgggcgcgaccagagcagagagggagggagggagcggacacgccaggcgaggaaggggatgcgggggagcggacgtgaccagcaagcagggggaggggcggcgagagggaactggggcgcgggaagggcggtcgcgcatgaatggagaatggacgcgggaggggaaccagaacgcagtttcaatgagttacacagaaagcattagaatcaggggacacgcacagcttgaagaggagggggtggaaggaccagacttaaggaggaagaggggaaaacgagcacggaacaggcggcgcggagaaaggggaagcaagggtggaatcaatcacgagggaccgagagaaggcaggcgaggatggaggcgcattgaggattggggcaggaggaagaggatgggaccagaatgagggggtagggctggggcgggaaaggagccggcggacccgcctgatctggaaggaacggcgctggggacttctgaagagcaggccccaggcgtgaggagccgttctcctctctctgagctccactgcatcccagacgccctggatcctgcgccgccctgcctgcgtgcccggggccggccggcgcgccgggattccgcactagccgggcgactggcccttggtggggactgatggcgtagcctcctgcaccgctcacctccggcgctgaccgactcgggctacgctgcaaagacgaagagatccggagccacggcgcgtgcagctgctgtgcaaggagccactgcctcagcctcaaggttatcccgctgcgggccgccgcaatccctccgccgccccgccctctgcccaatcccggctccgggcgacccgggccccgccccctgcgtccccgcgggcgcagtcaccttcaggaggaagcgcggcggcggcggcggaacgcgcgggcaggttgccctttcggtgggact

SEQ ID NO: 985 - DNA, 32359 bp, Homo sapiens; identical to SEQ ID NO: 984

SEQ ID NO: 986 - DNA, 30108 bp, Homo sapiens
atccagtccacagcaccttccattttattgttttatttacaaacagggtgaagtcaaagggaaagtcaggggatggagtcagtctgggccatccgaatgtggagtagttcttgggtcaagctctaccatgaaggccacctcttacatatccttttcctgccccttggtaatggccccttgattcctcagggcagcctcagctgctgtacctgaacacttttatgagggcagatggatcctggggtaacaggggtggtacgagggctggggccccctcagtttgtgtaaacctgagttccgatcacacgcatgatttccttctgtatcttggggtcctgagtattaatgttggcatcgcccacctgaccatcctcatatctgccaaagatagggcaagtgtgagcataagagggagaacaataccagaataacatcaatcagtggaactgtatttcaaggtatggccatcccatcccagaagtcaaagccctttctcactgcttcatagtggaagatattcagcttatctggtttcctctagatagatcccaaccatctatacccattcccatcctccaatggtaaagtcccagtgacagctccactcaggtagccaaggacatgtctcagataacagaaatagacttttcccagtagccacacaccatcacacccccaacctcactcctcgagtaatccccagagtccctccgacacttacacaaagaagaatcttgtgcagacatggtcggacacagggcacacccagatgttcccatgcttctggaggtccttagatgtaatcactgggagaaagagggccagaaatcatagatacaatgcttaaggcacagagtccaggcaggagaaggaagccatgccacttcaacatcactcttggccagatcatgtgccaaaattacatcagaaacaaaggttagagacccagaaaaacaggacatgggcaagctacctaccttcacaaagtgctatacagtttagattccgactctgcaggaaccgtgactgaatggatcgggtctggaagagaaggaggcaaaggagaccagagccaggtagatgggtacagctttccctagagaggctggttagctgatgattgggagtggggatcagagatatcctgggctcccagcaacacccctcgccgcccagaaaattcttctttcccataatcagtctggatagggtcacagcttccatctttacattttcatctaaactcagcctctgcttttatactcatgacttcagctacatatgactccagacgtgtgttcactttagaacatacctgactcctttaaatgatctcaaatcactccccaacccattctcaccccactgtttccctgtccagctctggagcctaaattagccccagggaaaggtcctgcctcattagaatagttccaatacctgggggatggtattcatcctgttgtatctctggaccagctcatccttggagggcatcctgtgctgtccttttcccattcctgtcacagaacaatacacccacttcatttatcaaaaatttacgaaagtgcctactatgtcccagcactgagctagatgctcatcaaaacagcagagaataaaacaaagaagattattttcccccacagaatttagtctgctggaaattacaagcaagaacaagtaattaacaacacagcatggtaaggggttgtgatgcagattatagagcatggtgtgagcctagaggagggcaactagcctagcctaagagtttaaagaagtcatgtggtgacagctagactgagaactgcaggattaggaagagttaattaaataaacagcggggaagtgtctgggaagaagtaataggatacagaaggcctgaaggaaagataaggtagtgtgtgttagttgcatagagaatagtgaattgcagaggagtggtgagaaatgatgtagaagaggcaagctaggatcagatcaagccggctttgcaggccatgttaaggcaactaaagtctatcctcagaacattagggaaccactgcagggttctaagataggggagcagcacatgaaatcagccaggaatgaggggcccaggagagtgggacatcaataccttggtgtcaagtgcctggatgagtaaaatgaatggaaaggaagcaagcagaacaagtcagatttgctctagtctcaaagttacattaaaaacctgaccagtcattcaagagaaaagcatcagcagttaagtgatgaataattttgtacaggaaatcacaatggcaactaacttgaagaatcctacttcaaacagtcttcccaggcttgagaaagaagtgcccattccttctagtttccacattatctaaatccataaactctctaccttccttacccgtttataacatttatagactcaacttggacttttcttatttagatatgaaaatgtgcttgtgtgctcccactcctcactctttttggtttgaggataggacgttaagtctctgtactcagctttatcataggcccaatcttaccacagttagggataaaaatgtctacccatgtgtggacacacgtgcctgtgtgtgtccaccagggagagagatgaagatggagatgatgctatcattataggtcataagcactctcaccactctaccctggaactttctattactattaactccactctgatcagttcttggttttctcatagccatggtgtagaaatagactgatagctgttgaactgacattcttcactgctcaggctgtcaattcatcatgcatttacactcaagtctcgtgacagatttaggtagggcctgaacaaaactcaggacaccaagagcctcaaggcttgaattgcccatttcttccttttacaggacaggtactcataacccctgttttcaccttccccattagccttaactaggttcagctctccacccaaacatcatgaccttctctcaaactgggtatgtcagtgacaaaaagtaaaattcccattcaggttatactccagaggaggcacataaaagataataaagaacaatctgatttctctggcaggtcttagagatggcccttatgatataacccaaatcttgtcccaactcaatcctgttgtacactatcctttccacactgatccaatgattgtccatttcctgagcccagaacctgagatcatggtggctagaataatccctagatgttctgtgtccagagtatgcacttatcagaagtccctaaacaagactaaacaaacagatggagtatatcacctcctttttcactgtcccctatttcaacctgaactttatagccaagtcactggaactagatatatgaacgctatttacaccaaccctcacttccagagggcactcaatgccattaggctaaagatagtgtgagaaagaaaaaacagaaaaccagagcagaatagcgtagaagaaaacatacaagacagttggtcaaatgctggagtaactacagtaagtggaacatttgcacacatttcccccaacatcccattatacatactcacatatctatagggccctcagagacccgtcattcaagcaaggcctactctgtcagtctaatatagtgtattagtccattttcacactactgataaagacatacccaagacttggtaatttatacaggaaaaagggtttaatggacttacagttccacatggctggggaggcctcacaatcatggtggaaggcaaggaggagcaagtcacatcttaaatggatggtggcagccaaagagagagcttgtgcagcaaaactcccccttatagaactatcagatctcatgagacttattcactatgacaagaacagcactggaaaaacctgcccccatgggccaggcacagtggctcacacctataatcccagcactttgggaggccaaggcaggcggatcacgaggtcaggagatcgagaccatcctggctaacatggtgaaaccccacttctactaaaaatacaaaaaaatcagctgggcgtggtggtgggcgcctgtagtcccagctactcgggaggctgaggcaggagaatggcgtgaacccgggaggtagagcttgcagtgagctgagaccgcgccactgcactccagcctgggcgatagagtgagactctgtctcaaaaaacaaaacaaaacaaaacaaaaacaaataaaaacctgcccccatgattcagttacctcccgctgggtcccttccacaacacatgggaattcaagatgagatctgggtggagacacagccaaaccgtatcatatagtgataacaacaatggcctagaaattaggagacctggattgcagccctatctctgctactcatagctgtgtgaccataagaaaatcatttaacttttctgtatatcagctttcttatctgtaaagtaataagggattaaattagatgatctctaactccaatagtaaaattcaactgcattttgtatctataatcaattaccctttgagagagggagatgaaaggtgtctatgatatctttatgtaatcggttaagtgatgaagaaagacgagaggtcaacagagatttctggcttcatctggtaactaaaggtatttaggcacttggtagtaaacaaaggccagggggagaaaagagaaagaaagggagggcatagggagaaaacagaaaagaagaatctcagtgggcaccaagaaccatgagaatctcactactcggaaagacaaaagaacttaatcagagggatgcttaggctgagacaaagataaaaagtgaagaatccagacaaatcaaaaagactattccaaccctaaccccactttggatgccaggcacacagagtaagattcactcatatattcaataaatatgtgttggtcacttgccctgtgtggattaatcataatctttgtttcataacacattattgttttgttttgtttttttgagacggagtctcactctgttgcccaggctagagtgcagtggcacgatctcagctcactgcaacctccgcctcccaggttcaagtgattcttctgcctcagcctcccgagtagctgggactacagatgtttgccaccatgtccagctaatttttctatttttagtagagacagggtttcaccatgttggtcaggctggtctcgaactcccaacctcgtgatccacctgctttggcctcccaaagtgctgggattacaggtgtgagccaccatgcccagcctcattattattttttaataagacaatgaatacccagagacccaatcaaagaactaaattctaaacctaaaacattaccagtgacttacatctaactatatgcctccctttggaggtaatcactatcctgcaatttgagttattattcttttgttttttctttttcctttagttttcacacacacacacataatacacatatatatgcctaaacaatgtttaattttgtttgcttttgaacaatataaaaaaggcatcacagtctcactctgtcttctgggacttccctcttcttattgaacatatttattattatttttttttttgagatggagtcttgctctgttacccaggctggagtgcaatggcgcagtctcacctcactgcaacctccgcctcccagattcaaacgattctcctgcctcagcctcctgagtatctaggattacaggcatgtgccaccacgcctggctaattttctttgtatttttagtagagatggggcttctccctgttggtcaggctggtctcaaactcccaacctcaggtgatctccctgccttggcctcccaaagtgctgggattacaggcgtgagccactgcgcccagccaaaaagtacacttttattactaatcttttgtggttatatgtgctgcaaatgtcttctgtcggtttgtagcctgtctcttcactttctttagggtgtcttctgaagaatataagttttaaattttttttcttttttgagacagggtctcgctctactgcccaagctggagtgcagtgacatgatcatggctcactgcagcttcaacctcctgggctcagtgatcttcctgcctcagcctcctgaccagctaggacttacaggcacgcactgccagacctggttatttttatttttttgcagagatggggtattgccatgttgcccaggctggtcttgaactcctgagctcaagcaatcatcccacgtcagcctcccagtgttgggattacaggtgtgagccactgtgcccagccagaagtttttaattttaatatagtcaaatttatcaatcttttatgatttgtaattccattttttctattctctggaagactttagataaaactaaaataatttgttccttgaaagtttaagattaatttgtaaaaccatctgggcttggtgaggtttattttgtgtgtggaaatttttacacaatttctatttcttttatagtattatgattatacaggctatttcttgtcagatttgttatctttttctagaaatttatccattttatcaaagtttttaaattattagcatagtgtaggtaactctcttattactttttattttttttttaggcagagtcttgctttgttgtctaggctggagtgcactggtttgatcttggctgactgcagcctctgcctcctgggttcaagcgattctcctgcctcagcctctcgagtaggtgcatgccaccatgcctggctaatttttctatttttagtagagacaggatttcaccatgttggccaggctggtcttgaactcctgacctcaagtgatctgcccacatcagcctcccaaagtactgggattacacgtgtgagccaccgtgccccgccttattacctttttaaattctgcttatctatagttgtactgctttttttggtcattatattatttaattgtgtcctttttctcttaatctaaccagggtttatctgttctgttagttctttgaaatcatctttggacttttttggtactatctattgtacctatttttatttcacaggtgttagttcttacctgtattatctccttttttctattttgtttggtttattctgttgttagagatgtttttaggcctctgattctggcactttcttttttctttttttttttgagacggggtctccctctgtcaaccaggctggtgtgcagtggtgcaatctcagctcactgcaacctccgcctcccgggttcaagcgattctcctgcctcagcctcctgatggcactacattttctgatctttgtaacagttacaaattactacaggatatcaagtaataatctattaagaatctagcacaatccccttcatgtagtgaacatgcaactacatggtgactataccttgtacagagactacatcaaacaagcacaaaagcagactgaaaatgaactaagacataagccaggaagactgagagaactctaaatcagatttccttttctgagcttgactcatctcctgattagaatctggacctcatctttagaataaaatgctttatcttgcattcaatgtgactaacataatagtgtaagattatagacagtttaaattttaaaagatggttgagagagagaacagtgtctctagaaatataagccaatggaaaggacgcaagccttcaggccttcagatgttttcacatgtaaacttacatgtacaagtatacacaaacacaatctataattgccaacaccaaacgtgttctacaaaaagccttgttatgtccctgttattcctccacccattcccagggccaagcccctgctatgaataaaaccatcatttttaacaataactggcctcaccttgtaaagaatctaaatttctaataagaaaatgtagagagagagagaatatgtatccatgatcggggagagagctgacacagaccaagtatccataatgagggaggaacagacagcacaaatcatgtattcacaaatggaggcaatgtaaatagagtcaaggtggccacagaatatttcttacctgagtatccaaaggaaatactggagatggggctcaggtagatgcctttgccataggctgctccatgcagcttgcagggaaacaccaggatgagtaatatgagcctgggccctcccatggctatttattaggcagcagcaaggcttatccagccctctgtccctccttctaccttctcattcaagtaaccctaagcacctattctcggaaagccaactggctgaaaagtggatgcaggttaacctgcttgcctatgaagtgctacatactgacacattcgagagtgggaaatggtagaaccactgagtcagtccctcagcattcattttcctgtctccaggccttggtacatatgcagattccaaaaaagaggaactacagaacgggtagccagaaggagggccaatacacactccctggagtctctcagggcatagaaaaagtctcccatatctactccttgaatgaatagccacataaattgaaaagctctaatagattaattcatcacagtggctacaatcagcaattccatattcctgcttacaggtacattcccattccccaaaccaccaaaaaaacgcagactgagatcaaatacacaacagccacgttctctattcatacagttctaacttcctctctagggaactccacaagacaggttaggcttgaggacactgaggcaaaaacagcttactctagagcagccttccacaaaactgagtagggaagggagcggttagaaataaaggagaaaggggcacagcctcacctgcagtttggtgtaggatgcattgaccagcccattgcgcaggatcgaatgccagttctcaatgtgggacccactgtaaggcagggtagaatacatgtctccttatgatatgaggttcccaggaacactcccaagactgccattcccacccattctcacccacacaggacatgaagatggacaggtacacctagtgatggacatgcacatggatacagtcacaggcatgcaagatgtgtgtgtgtggttaaactctacgtctctatttccagtcccatcctctcttcggtgcttcagctactcccatcctaaatcctcaactgctggttcagtatttttatttgcccattatcctgacatttcaaattcaataaattcatctgaaaatcaacaaatttatcactgaccccaaatatggcttccagttctgacttcatgttctattttaagaaaagggtactaccactccctataagttctctttaatacctctctttctctttccctcctctcaaaattaggcataaattgtggatttttccatcaaagtagctttcagatctgttctctccaatctatttcttcagccacatcttttcacatgtaaatgtcatttttcctcaactacatcataaatagtttgagaataaagaccacattatatgtacctttttgtcctctatagcacctaccacaatagcatttagtaagtatctgctgactggttgatggacacatgtaacacaaactcatatctcaagggcatccttcttgctcatccccgccccctcaccacccccactgcccagcccccagcctcctcactggaaggcaaaggtgctgccatagagcttcttggcggtccggaaccgagcctccttggcaggagggctgctcagcaggaggaactggtgtgaggtgtgcatgaacttcagctgctgcccagggtgggggtggaatcaggaaaacagagcagaaatcgagatcagggagggaagggttggggataggggaaaaaatcaggcttgcattaaccccacacaagggaaatatgctaaggcccaaagactaagttgatggacagagcaatgtaggcagatctaggaccaatatggttagctggcttccagcccctccctgcccctcaccagaaatttaaagcatttagagggagaatggtcacttaccctgctgagaggtagtttgacaatgtgtgacctgttgctagagatgatcctgggaagaaacagaaaaaaataaaaaggatagaataattatgtatttaagctatcctttctgaacaagccagtcttcctctgcctttgggagaataaacaaggattcctgggctgtccaaattgtgtgaaatgtcaaggtcactatctggatattcctgtgggtgatagtgcttatgaataaaaaggtaaaaaggaaggtagtgaccagacacaagctaattattggggagttaaacaatggatgaaaaaaaaaaaggggtgggaggagtgctgctacaagtagggagtaaaaagggtagaacaaaaggaagagcacagaggtcacctacaaaaaaagaaaagaaaaaacagcaagaggtctgaattagaatggtgacaacttatacctgggatttagactcagattcagacctgggctcagaagccatccttccttagcttaagagaaaacatgaaagctctcaggaatggggagaaacggagagaaagttactgtctaggctggaaaaagaaacagaagaaactagaatgaacttccttaggagtcaaggacagactaagctctatacaggctgaacacagaagatagaagagaacagacataaaacactgagggctcagcaagagagcactatctcccatgtggatacagtttgctgttgtctttgttttttgtgcctcatctatgtacctgtgatgccacctcagatggtctatgcctggttattcctcaggctaagagggagaaagctgttgcactgaggaagtactgaaggctgactaggaagagggaggcaaactaaaaagggaaagctatgtcaggaaaacaatagaaattgagatcaggaatggatggcagcagggacagtcaaaatcttggctaggagaagagcacagcaatagtgcctcaaggctctggacattctatatcatcaaggaggcccagagacagggcaaggggatagcaggaggagacagacgtctctggatgcaaagaaaacttagttgaaattaacagtgttaatttctacatgcaaaggacacaaaaacctattggtggtgactatagttagtaacaatgtgtaatattcttcaaaatcactgtggtagattttaagtgttctcgccacaaaaaatacatacgcgagataatgcatatgcttattagctctactgaaccattctgcaatgtacacatatttcaaaacatcatgttgtacacaatacatgtaattttttttttttgagacggagtttcgctcttgttgcccaggctggagtgtaatggagcaatctcagctcacggcaacctccgcctcccgggttcaagcgattctcctgcctcagcctcccgagtagctgggactacaggcatgggccaccatgcccagctgattttgtatttttagtagaaatggggtttctccatgttggtcaggctggtctcgaactcccaacctcaggtgatccgcccgcctcggcctcccaaagtattgggatcacaggtgtgagccactgcacccggccctgtaatttctatctgtcaatttaaaaaataaattaacaaaccaaaaaagaaaacaaacaacaaaacctattgcgaaacatggaacacctaaagagaacttgaaaaatcatgtcagctgcacatcgtggctcacagctgtaatcccagcactttgggaagccaatcaggaggatcacttgagcccaagagttcaagactggcttgggcaacatagggagactccatctctattaaaaaaaaaaaattagctgggtgtggtggcacatgcctgtggtcccagctactggggaggctgaggtggatcacttgagcactgaagggcaaggctacagtgaaccatgatcgcaccactgcactctagccggggcaacagagtgagaccctatctcaaaaaaaaaaaaaaagaaacaattaaaataagattaaaaataatttttttgaaagaaaaatcatgtcagaatttgtgggcgttttgtaggatgtgttattttcaaggcaaggtatgccaacaaactccaagaaaaagcacccattactgcctataaccttgggaaggatgttgaaaccaccactaaaagaaggtacaggttccatgtccaataactccctccctccccataacccaagaaggatgagccattctatccataccactgcaggagaggatgggccaggggatccaacttgtccatctgtttcttgatttccaaatatgagccctgtaagacaatggccataacgttatctccttggagaggtgggagcctacctgctttctgcttttcacagagtgactattagggtccagggcaaggtaggcaccaaaggccacacagaggaaaaaggagatagggttcccaccctcaaggagccctagtcaggctgggaagactcataaataaatatgaaaatgactgaagatgcttacaaaacaacatgcaggtgggtctccctcattttatgcaattcctacagccctaaaaagttgattataaatcaaaaaataaataaaatcaatgtcccaagaagattaggctaaggaatcctgtggtaaatctttaaataatgcaaagcgtcctcctgacaagtaaatcattcctcctaggtgtatcttatgtgtaaatctcaactgtgatatacaggatttgctgagaagaggcccacctgtaaatgagtacaaatgaatgtctattcatgcagagattgcagacgaggggtggggaagtctggtgagggacagccttgagtcaaaggatggtcaccgctccatgtggctgccccacccctagaaggatagaagatgtaggcccctgtgtctagttccttaccttcaagcccccctcctcctcaccctcccaaccctgggcagaggtctttccttcacttcttaactccctaagaattatggcaaaacattaaatatgaacaacttgtaaaggaattaacagcaaaggtaaagattgagacacaaagactaaagagaataaagaggagtaacagagctaacaaaacagagaacaggaattgggaaggttaaagaggaaagactaaaaaaaaaatacagtgcgtagcatctctaaatcttcatcccactcccacaaattaccaacagaataggacacttgaactgggcaggcaaaggagaggggacagagagaaggcagaatacctgggtcatctcccgaatagacatcacactatccagagctttctgaagccgctcataattcttcttctgtggagaatcaatgggaagagaagaaccaaataaagaaaagtagaggaaagtaagatgtgatgaaaaggggctagatgtaccaaaaaagtctaggccctaggaaacaatagtatgtcatggaaagagcattaatgtcagacagttctaggggcacatgctagttctcttttaccagctgggagtaacagggtaagttatttggcctcttagaacctttagcatccctttatgcaagtgaagataactcctatcacccccatagagatgttctgaggattaaatatcatatataaagaactctgtatagtaatgacagtaatagtgaggtactatgctgggtacttgtgatggttaattttgtgtgtcaacttgactgggccatgaggtacccactcatctggtcaaccattatttctgggtgtgtttgtgagggtgtttctggttgagattaacatttgaatcagcagactgagtaaagcaaattgtcctccctaatgtggaagggccttatccaatcaatcgatgacctaaatagaacaaaaaggctgactcctctgccccaccccgccatgagtttgtagagtttgtaggtattcctcctgcctgattgcttgaattggattatcagtcttttccagtctttggatttgaactaaaaaaaaaattggctcttcttggatgttaagccttcaggctttcagactagaacttacaccattggctctgattttttggttttgtttttttgaggcagagtctcgctctgtcacccagcctggagtgcagtggtgcgatcctggctcactgcaacctctgcctcctgggttcaagcgattctcatgcctcagcctcccaagtagctgagattacaggtgcccaccaacatgcctggctaattttttgtattttcagtagagacagggtttcaccatgttggccaggctggtctttaactcctcactccagtcaagtgatccacccgccttggcctcccgaagtgctaggattacaggcagaagccactgcgcccagcccactctctgatttttcaagccttgggactgggactaccactgtaccactggctctcctgggtctgcagcctgctaactgtagatattgggacttctcagcctccataatcatgtgaggcaattccttataataaacctctttctccttctctctccatatatatctcctattggctctgtttctctggaaaaccctaaaacagtactttacatatattacttctctcttttttttttttttttttttttttttttttgagacagagtctcgctctgtcaagcaggctggagtgcagtagtacaatctcggctcactgcaagctctgcctcccaagttcatgccattctcctgcctcagcctcccgagtagctgggactacaggcgcccaccaccacacctggctaattttttgtattttttagtagagacagggtttcaccatgttagccaggatggtctcgatctcctgaccttgtgatccacctgcctcagcctcccaaagtgctgggattacaggcgtgagccaccgcgcccagcctacttctcatttgtataatgatctgcaaaataaatattatccctttttacaagataaggagattgaagtttagaaacgttaagtgacttgcctaatacccttcaaatggggagtagcagaatctcaaatggaatccaggtctgtctggctccaaaagccctttttccctatcataatgtaactaatattaattcttctcccctttctgtgtcaaacttggctatttatttactgaaacagctaaatcacagagtttaagaattctgtcccttattccaagccctgtatataccagaatgtcagcccatagtctgccactatcttttatcatttctgttccttagccctgactttctcaagtaacataccttagggttaaaggccagagtcttgggatcagtggggtccaccacagagggataaggctcaaagatgatgctctttctaggggactctaaagctgccctacacatggccaccagcagatccaccaccttaggggaaaggaaaaaaaacagggcagaagctaaatgatttcccagtactgggagtcagagtacccagtatttctctctgatgttcttttaaaaagcaaatatgtttaaggctttcaaaatagaaaatacaagctcataaaaattcaagtaataccaaagtaattaaagataaaaaaccatcttcctgcccttaaactaatctcaattctcacagctaagtactagtgagtttgatgtatatccttccagataattttcctacggaaatattttcttttctttctctctcattcttttttaaagagacaggggctcactctgttacccaggctggagtgcagtggtgtgatcatggcccactgcagcctcgacctcctgagctcaagccatcctcccatctcagcctcccaaagtactgggattacaggtgtgagccactgtgctcggccctttattttcttacatggacaattttactacatatgctgttgtatttgcttttttatatgactatgttaaaattttgtctataaataatacctatatagtacatctactctaacgatatcccataatttctttaactggagcccctacagatggggttgtatccattttttattttacaaacaatactacagtggttatcttatatacaaaagcatttttggaagttaaattccaagaatgaaattgctgggttcctctgtctttcttgatcccaattccccagccacgtttccctcccccatacctctgctccagtggccacctcctctgcagctccagacatgacgcccagtgtgtagaaggagaaaacgcatagttcacgagtacagacagctggctgaaaggatatattaaacagatggtggtgggatggggtgtgcaataaggtgtaggcagagagggacagtcctaacctcagacaactctaaaacagggtaggaatttgaggccctctatatcaggagaaaactaccaataaagtcttaattaaaatgccttactgataagtttgggagttaacactgtctcccctatgaagccttccctgatcttcctatgaagtcagatgttctctcacctgatttttaacaatgctaatatctcttctataaacttaccatacattgtgatttgtctgtctcccatctggacttagagtccttgaggacagcatcatatccaatcatcttggtcaatatctgatccccatttttaaatgtcaggtggactctatcctaaataaatattctcatatcctcatctctctaaacagtactgctgagacttgttttctgagaaaaatcaacaatttctagagtatcagggtgtacagacagaattttaccttgaccacagaccaaggaagaaggaaataaaggagaggagtgaaggggacctggttaaggaagagggtcatagagtacggtcctataccttcagcatagatccattttggaagacatgctgctcatcacacaccacacagtactcattcaatgttggaatcctctgttctgcatacttcatgatctgagaaaacaacagattctaagtcttttggaagtactggcacacacagatatgggaaataatttcagcttttttttccaactaccctccatcctcccagccccgtgcctaaggtaggatatattcttaggctgtgtacttaaactgatggcctgactgcagagctaagactgtatggtatagtaaaaataagaacatgatgtttgattgagaagacctgggttaacactgtacttctaatacttaatggcatatataactttaagcaagtcagttaacctgagccttggtttctttgtttatatagcacagcattattcacctcataggggtattgcaagaaatgagatgatgtccatgaaggcattttaaaaatataaaatggatgctaatcaaactattaaaagtacttgtaattataggctgtccctctgggataggagagcattcaatcaattagatggcagaaggtcctgagaagccatttcaactacctagaacaattagccagaccactggtcaaaactacagacaattctgtgctaggaagataggaaaatccagagctaatgcagcaatatcctacagcgttttttttgttgttgttgtttgtttgtttttaatgacaccctgtcttaacatagcttttgtgcatcaatcaagttgttcccctttcacatgattttaggctggtaatgggacatgcaagagactttattcatttaatgcagatttactgaatgcccattatgtacccagctctgtgaaaggtcttcttgattatgaaataaaattaaaggttgttttctcagaagctgaacttcaataggagagatgtggcatgtttataaattaataacaattcaaggcagcccatagtatgtgacacacaggtgccatatgaaacaaaaacaaatcgtaacagttcagtgaggggagacatcacatctagttaatgcattggagtaatggcaattttatggaaaaggtgccatctgactcttgatagcaagaggaagataggaagaattacatgaacaaaggttaacagagatgcaaaagtgaaagcatgcccagggaataaagagattttaaaaagcaaatgaccagtagtagctgagcagtgaaagggggtctgtgaagaatactaaagatcatttgagcaagggctattgggaatcattaaggaaattagtgtcaatctcattctcatctcatgtcatatgagtctcgacactcatacacttaaaattggcggtgcctcattggcacttgatcataagtggtaagtattgtctttctagtaatgctgtcagtttcttgaagatgggaacaatgccttctttccttctaccattagttctggaagcaaagcaattcagaaagtatttgattgaggagctgggaggtgttaggagaccaaatgggtcagacaacagggaagggcttcggagtgacaattttgacttgattacctgaacgaggaatccatactccagagtgggaatgttcttgcagtgaccactgacctggtgagagtaaaaagacagaccccgtgaacctcctatgaagctggggcctagacagacctgactcttgcctatcacctaggactctcctaaagcagctaaaccctagctcagaatcccgaagctagaaaggagacttttagacatttttgccaaaggttctggaaaggggctcacctgtccttaaccctccttcaaagtagatggaataggttagtacagcagctacagttaactacagtcctactcacaaactaataaaatcatacatgacttctccttgagattcccatctccagactctgtgcttcatggcctatcagagaagctcgctagacaatttagacataagttttctactgttaaaaaatgttttccagctgggagtggtggctcgtgcctgtaatcccagcactttgggaggtgaaggaaggcggatcacttgagctcaggagttcaagactaccctggccaacatggcaaaagcccgtctctacaaaaatatgaaaaattagccagtcgtggcatgtgcctatagtcccagctacttgacaggctgaggtaggaggatcatgagcctgggaggcagcaactgcaatgagcagagatcgccactgccctccagcctggatgacagagtgagaccctgtctcaaaaaaaaagaagtgttccattctactcactcatggtacatacctaggtttgatttatgatgcctagacaaccatatccccaccccattttgagaaactacactcccacagttccactcccaccctcctgatagccaagtcaaaccctccccagcccatgtaccaaaggagaggtccgtgctgggggagggaggcccacgtgctgagggcacaggagacctgcctgggggctgggagggtagccaaacacttccactttggggttcttcatggtacaggagatggaacggttcatgaggcgcccaacccgaagctctggtacacctagtttgcctttcagcatggagtcctgtatgatagggaaactgggagacctgcagagagagagcaaagagaagtgataaaactggggatttcataggatccctggaggggactggagataagtgagccctaagccaaaagttctaaactaaagaaagacaaactcatatctgaggaaagttgcattgtatcttaaacactattaaaacaagtagatcacacatctgaattaaaatttttatgtcatcatctgtgggttcttcacattgggacactgagggtgggcagaggcagaggataggttattatgtttctaagccaagtatggaataatcccttggaaaggctgcctgtttttctgagagagagaaaaaaaaatagagagagagattgttaaacactgcgctaggcaagaagtagttgcatcccaaagggcgtaatattgactatctgactgtcaacaatgattcctgggaagctacaaatctgggtttgtgtctgcctttgggaatatcagaagacaccacagggggaaaatgtagacctggggtcaaagaatggagcaatatttatttccagaacctagcaaggaattactgcctgttctctgacactttcttcttaggatggggaaacggatcaggacaaaagaacagaaagatggaagattcagcatacatttctccaaatacatatcacgagctaggtattctgttttacataaaggattaggtattaaccttggataaggagtagaaaggtaaggacacatagggaacaggaccatgtgagtggtgtcagtagttaaagagacagaattcagggaagagaggggatagaaacatttatgtaatcaagaaggtgggggtgggggctatcacaaggtgtttacagatgatcagctttagggagcacttacttggggatgggtgaaaagatgctgaggccagctcggaacttcttgatggtaccacttgccttgaaccaactgtgcctcttctcctgctgggtcttcaagaaatcattgctcagatgtttccattgttgggatgtaaacatacccaggatcctgagggatcaaaaagaatgagcttaggcaagatgaggcagggtcaagaaataaggactaaagagagacaaataatctaaaattcagacccaaggactgcaaagctagttgtggtaggggaatgtgtatctgaagacccctttaaatgaccttagtaaataaaaaaatcaccatcccagagcaccccttcaccctagagggcacctagcctaatggccagaaaaattcagagatgcgttgcctttagagtgagatttcaaaggtgagccttcaaaggctgcaaactttgaaatctattgccaagaatgactatactgttgacagggaaacagaagtggtaggatggaggtgagtaccactttgttccttgtgagtcatgaagaaagggagtagggacataaggggtactgacattgttaggagaaaaattatattctcaaatttatggtttccaatttgagctgcgcccttagctagatttgtcaatcctttcacttgtccttgatcagttctctctagcattactctaaggtattgttctaaatccttattaccttctttaagttactaacttcatctacaaccaaaaacctctcttccttcttaagccatcaggtatcagttcccttaattttccaaccctactataaaatctacttacatttccaccctaccttgatccctccattctctggaggtaaggtgacccttctacctaagatcaatcctttgattgcctttttagggaccatgatgtgtcaatcattcccctttcctgtcagttcctttcccaaagtcaacaaaagatgtcaactttctgcaccttagtctagttaacctctccctgttgccttcccatccccatacaaatttctcaacccatactcattgtttctatgttgttgccaaccactcacctccaaactttctgtattctggttcctaccttcaccactataattgttctcatcctgatgctaaatccgatggaaactcccaggttcttctcttatcttctctggcatctggccctccttgcagaacctgccctcctttgtcttctgtgccaccattatcttcctattctactctgacctacctgcagtgtttcttcttcctctgcctaccctgctggtttctttgggatttcatctgagtgtttaagggtattttgtccttgatcctatcttcttttcccactatcatgccttcctttggcaatctcatattcactgactgtaacttcttcccacacacattgatgcatatcttcaaccctaacctctcctttaagtagcaaattgacatatactctggtaagtagcaaattgacatttcggataagcatctctacctgcatatctgaaagttacctttaaataacatgtcaaaaatggaactaattacctatcatcatcctacaaacctgctcccctctcatatccctatttacattggtggtatcacaatttacccagacatctaggctggaaacctaaatgtattttccactactctttggcccttatggctatattcaatatatctaaatcagtcttcaagtcttattgattttatatctcacaaatctttctaatctgtctctcatctccattctcacctataatcacactttagctctggcctttagcatctcttgtcttgacttttacaaaagcaccctactacactagttctggtctcttgtctcatcccctcctacccattttgtataatgctaccagaatggtttttaaaaataaatctgaccacgtcatttctttccctaaacccttcaatgttcacactgcctaaaggataaaagtccaagatcctctctaacttgaacccttccctattctctggctttggctcctacacccccagcttgtattttaccagcaatatttaactacctgaagctccctacacatatactgctttatgtgactaagcccctgcaaatgttattcaccctcagaatctgtctacatggacaactcttatccatccttgaaaattactaatcattggctgggtgcggtggctcacacctgtaatctcagcactttgggaggctgaggcaggtggatcacttgaggccaggagtttgggaccaacctggccaacatggagaaacccccatctctactaaaaatacaaaaattagccgggcatggtggtgggtgactgtaatcccagctacttaggaggctgaggcacaggaatcacttgaactcaggaggcagaagttgcagtgagccaagatcatgccactgcactccagcctgggtgagagcaagactctgtctccaaaaaaaaaaaaaaaaggaaattattaatcatcaccctttcaacagactgagtcactcttcagtgtcctttctaaaccttacatattcacctgtattagaatatgtatccagtggactctatttgaaacttcactgagagtggaaaatatgcttcatttctttgcataccaaatacctagcttaatgctcaacacattcaataaactagagttcctagagacttactctgaagaaaccactagagaaatatgaatagcatgactctgatttcagggtagtaaaaatgctaagtagtgatgagcctcttttatctctagaaagtctcagcttctgacacccaagaaccacatactctctctccacaagcttaaatctggctccctaaatttattttagcttttcctgggcatatttcagaaagacatttttggaagggggcattccatccaaggctctgcctgtccatccatatatttccacctctctctccttccttcacatgtccatgaccagaaaagaccaaagttcttactttttcaactgaagacccagcccaaatccttccttatttgatggctggaaaacctcaatggatggttctgcaaagagaagagaaggctactagtaagtacatatctcttgtcttcctggagtccaaagctcagtggaatagcttccatacattctaaagatcatagctgctgggtactctaaacagtaacggtggaagaaaaaaaacatctgagggagagggcagattctcgaagctgtcatatgaatctgaaatatcctcaggaggatgttgagaaaaggaggagaaagaaattttatcttggaaccagagaaaacaatgtcattaggcaagaaggcctttagggaatggttattaggtgacaggggatgaagataccaattacaggggactaaaaagcccctaccaatagcctgcagattgagcccaaggaccttgttcctaatttttttctacctcagttaacttagggctttggattagaccacactcagaccacccacttgcccaaagtcactgcctttacctggtccatctaggtactgggagagagaaaatcgcagcctcaacacaataggttctgtccggaggaccttccaggctgtagagacttcctcctaaaagaagaagggaaatagtttccagtttagcaacatagacgaatggacctgaaatttcccctatatgacacacacatgcacatgacagtacacaccactgtctgctgatggtctaggaaagacagagatgaagaatatgtgctccaaatacagcactcgggaacaagactcctggcctacatgacaaattccacaagtccagctagacatgttgttggcaggtactagccccacttacatcgaggaagctgatgttgatgtggaggtcaatgtccacgtcatcgatagttccatattctctatagagatacaggtgacaacaggtgagactcattaagggagaaagaagggaatagaaactgagttggaaagagaactgagcctggggacaggggaaagggaagagtggatgacagttttgtacctagggtcttagctatagccttacaccacttacctgatcaggatctacttccaggccaaaagcatttcttacctgaaaggtgaaactactggcccagaggggtctaggataagagggaattcctaagaaaagtggccttactctctactctcagccaagctcatttattctgagcattttctatcattaagttcataatttatcccactatcataccataaaaagaaaaacctctagccttttaacaactcagaaagaagtgacttgctcccctgccacccctgaagtagagtcccacctgatggatacagagttctcactgtagatctccttcacggcttcaatgtctgcatcaagctgtgggtgtcgatacaggtcagctgcacagctcccctgagatagcagcaaaaatggtggtggagagaggtggaaaaagacgagggaaagagagagataataaaaagaatatgaaaagacaccaggaacaggagaaatcagacagcagtataggggaagtaaaagccacttatgtgaaggggttctcagtggtgaccctagcaagggatttcattaacagaggtctccatctcatcatgactttaaaaaggttcagcagaccaaatgtaggcttttgcttggagttcacttccttaaatctccagcttttctctcagaccttgaccaggataccttctatgacaactcagaacaggctgaagagttacaggtttcctaagattggttctaagtgaagagcattctgagagtctgggtacttctgctcaggactgtgccctgggtagtgatggcattaagcaaacgctggcagagtaatcttttaagatgtgaccctaatgaatgaaactacccccactggctagtgttataaaagtcagaaaataattatgtctaattaagatatgggtagtctccacatacagaggatgtagtttactctggaacaggtatgactccaaagaaagagcaagggcacgggatcagctctgacaagaccatgctcagaccacatcaacattataacctcatctcatctgtgctccagaacctctttcactcctgatgtatccaaaaagcagcacatatctagaccatccaacacgggggtcttgggagatgtaacctcacctgaacgccatagagaaattcctctgattcattatctccctccgagtcgtcatcattccagaactggcctttgatgtcctagtggtgagaaataaggatatcatgctttgttaggtccctattatcccatggaaaggcgtgggatgatatggtgaggaacagattcccacaaagattgggaaatatagaataactgaagccctgatccctttacacctttcatgtcaccctttgtgagagtctcagtctcttcctgatatgatcatatccataaactagctcttagtgggacagaggaaaacatctagggaattttggccttctgaagtctcagtatgatgactgagaggctctggtagccagtaggaaagaaatgcaaatgacttcaatgtcaaggttgactcctaagcatatctgggttccagtacaagctggcctcttccaggatcattacctaagacagttcccaagcacacctaaactctcttgtctcattattttctttctatcctttaaagtacttaactctcctctccctccccaagaaaacccactacacaaacacaccaagtaatactgtttctgtgccccttccctttcctttaacttcaaatagccactctatcttccaaaagggtagaagggaaaataccaagaaagggtgagatctgcactttgtctcctctaccctttgaacaatcagttggagaggtgggcagtcagttctcaccattgggtcagtgggtcacacacactctcaggtcagtgctaggcagcacccctccataccactagccgaaccaaggccaacgagatgggcatttaggagaccacaaagggagacaaggtagggcacgatgtcagggacaactggtgatctgttggggatggcaggctctgctgttgcggtggtaacaagtcactgtcctgtggaaagtagataataatgggtttcatcaccacttaatagctgggtggtgtatatatacaggcacacgtatttatcaatacactttttttttttgagacagagtttcgctcttgtcgcccaggctggagtgcaatggcgcgatcttggctcactgcaacctccgcctcctgggttcaagtaattctcatgcctcagcctcccaagtagctggaattacaggtgcctgctgccacgcccagctaattttaatattttcagtagagatggggtttcaccacattggccaggctggtctcgaactcccgacttcaggtgacctaccggcctcggcctcccaaattgctgggaatacaggcgtgagccattgcacctggctattaatacacttttattatacatacagatacttgcatataaaaagacatgcttgcgtgcatatacatgcacacttgcacatgcagttctttatagataatgaaacacaaaagcactatatgcaagatactgctgttctacttaaactggagagctgggattagagcaagatcctgctctagctcataatgttacaactcctaaagccaaaagtgatggtggcaggacaagatgcttatgtttactctgtcagttaattcttcagagtaccaactcacaccagagttaagattcagaatcggattatttctggactctttattcttagttatttctccatattagccagtatctctctttaaacatcagtattactagctattatacggcaacaatagctaacttaaaaagtcctcaacggccagatcacctgaggtcaggagttcaagaccagcctgaccaatggggtgaaaccccgtctctaccaaaaatacaaacttagctgggtgtggtggcgtgcgcttacgatcccagctactcaggaggctgaggcaggagaatcgcttgaatccgggaggcggagattgcagtgagcctagatcacgccactgcactccagcctggacagtaagagcaaaaactccatctcaaaataaaaagtcctcaacaacactgaacatcttttggcagttatggtctcagttgtcattgccaaaataatgccctaaagtcatcttggaacctgcttcccaaagaaaaatgcaataattatcccaaaaattgcttagaaaaacttttacttaacccagagccctttcatacacaattccctgctcgcttctaatcccacagactcctaatcctataccagcaacttttagctccattaaaacctccacatatagcagaaaaacaaaacaaaacaaaaaactcatctgtgaaattatgaaggctttaatggctgaagatggcaaatctaccctaaaagcaggctaaaaaagctttctgttgctctctagaccagcaagtcactggctttgcacacatcgcagctgaagctactccaacctcaaacagaggtgttcttggtctctaacacagttcttcttcttcttctttttttgttttctgacagagtttcgctgtgtcgcccaggctggagtgcaatggtgcgatctcggctcactgcaacctctgcctcccgggttcaagcaattctcctgtctcagcctcccacgtagctgggattataggcgcccgccaccatgcccagctaatttttgtatttttagtagagacggggtttcaccaggttggccaggctggtctcgaactcctgacctcaggtgatccacccgcctcggcctcccaaagtgttgggattacagatgtgagccactgtgcctggcaggtctctaatacagttctactgaatgtcaggtttccagattagtgattctctgactggggttggtggacctacagcatcagtatcatctaggaacttgttagaaatgcaaattctcagactcctcctaagacctactgaattagaaactccagaaatggccaggcactgaggctcatgcctgtaatcctagcactttgtgaggcccaggtgggcaggacacctgaggtcaggagttcgagaccagcatggccaacatggtgaaactccttctccactaaaataaaaacattagcaaggcatggtggtgcacgcctgtaatcccagctactcaggaggctgaggcaggagaatcacttgacctacggaggcagaggttgcagtgagccaagactgcgccattgcactccagcctggggggcaacagcaaaactctgtctcaaaaaaaaaaaaaaaaaaagaaaaagaaaaaaagaaattccagaaattggacccagtaatctgtgttttaacacacgctccaagttgttctgatgcataaaatttgagaaccactgttctagttctagatccttgtgtgttctaaggacctgtggttcattccttagataccaacttaagtctggtaactaagccaggatggggacaaaagacaccatgccagagcagagccagcataggagtcttccagctcatagtgttgcctgatccttcagaaacaacatgcaaacggaaagtataactaaagttcttagagatggaatgacccgattactgagatttgtttaaaatactaccctggcacacacataaaaaaaggagggaggataacagatgaaataaatacagcaaatagcaaaatgttgattactggtgaagctatgtgacgtacatgatggttttctggtaatccctacctccctacttttgtgtaaagttgaaaagtttcaaaataaaaagtttaaaaaaaaaatcagaagctactctaatgggctgtcctcaaagtcaagtctaaatgttaacaggaagattaaccaacactccacaattgcctcattactgttcttcaaactcatcaagcatattcccactatagggccttcatcttcccaccatattcccaagcatattcccgccatagagcctttgtccctgctgttcccctttcttggaatgctttccacccagatatccacatggcttgttccttcactcttccagatctctgctcaaaggccaccttgaccatcctatttattaaaacagaaacaactcaacacccacacactagcactctctatctcccttcccagctttatttttttccacttaccatgttctaacatataaaatgtttatcagaatgtaacctctggtggcagaggctttgactgctttcagtctacattcttagtcccttaacacatttcttgaatgagagaataaatgaatgaaccctctgctggatacttaagtcaaatgggagatatatacaataacctgcatgtttctacacatagacaaaaatcacacaaaaaaatgattttaaaaagcaaaacttcaccttcaagagcagctgagatccagaatgtgaagatcttggggtgaggttcgtgagatttgaaaataaacagtcaagtgctgatctggatgatcacagaggaataaagagggaggcactaaatgtccagcctgggttgccctggggtgaggggtaggatgacggcagcgttaggccagaagtgccaacttttcacggtctttgttgctgcagaagtcaagaaaaatttagcctctttccaagggctgttgctgcttggtttctgttg

SEQ ID NO: 987 - DNA, 32359 bp, Homo sapiens; identical to SEQ ID NO: 984

SEQ ID NO: 988 - DNA, 32359 bp, Homo sapiens; identical to SEQ ID NO: 984

SEQ ID NO: 989 - DNA, 30695 bp, Homo sapiens
aggtgcttcagctgttgtttattgacatacaggtaggctctatagcaacaggcctggaggtgctgcagtagtgggggaaaatggaaggtggagggtggagtgtttgctgcaggacagctgagtggagggtggggacaggtgcaaactggagaggcctagagagctagagaagcaagtaagggccagggccagagtcggcttcaatggaacaacagcccagtgccctaaggcccctaactcttgctggctgtttcttgaccccaagccagggttgggagtcctctgggcatccattttttctaaaggaactggacagagtacacacaggaaaggaagctgtcaccctcttgccatctggctccaggggcctccagtccagcattcctccttcttcccttgattgggtggggccacatgatgggcagccaggctctgggctgtcccactagagcaggctgcaaacacagccatgtttcagtgaggcgttgatcttcttccctggtgtcccaacctaccagtgccacgttacagcccagagtgagttctacaagcgttgctggcctaatggatgggctgggggaagggggtgggacaggggctggaggaggggctctggggtccatcacggcacaggaacaacacgcatggtgttggtgaagccggagccagggcgccatccggtcagcacaatgaccacatctcccttcttgaagaagcctcgggccttgcctggaggaagagaagggaggttggtgagtaaaagccaagccaggcaggtttgcacctgggcagctgccccatagcctgagtactgaactaggctggctgaccactacttcctcacaccacaaggtggcaccaaactcacagcccaggcaaacaggaggaaggccctgaaatgtccttatcactcagatggcagggttggcagggacctttggacatcattcactatcctggagagggtgcaaagccttgcccagggtcagagctagctgcttcctgtcatctgatgataccctaccttatacagggacaatggccacatcagtacgtaatctgtgtatgccaccccacagcacaggagctgtggccaattttatttaaaaaaaaaacaaaaaacaaaaaaaactctcagtaatgagcagatgccaaaaaatggacaattttgctttgagccccagactagaagagaagaggaactgaattgctcagccctacaactcaaaggacccttttccctcctggctcagcttaggacttcggagaatgagagattcagaatgaacattcccaataagggagaggaacagtcgctgggccttttgccccactaaggtctgtgtgttcccctttctattccccaaactttcggggtcccacagaagccaatgctcaagcatccccaagctcctctaggctctagcccctgctccagccacgtaccaacattcatggcaaagttcacccggaggtccacgtcctcagcccaggcctcctggactgggtccttgcacagcacagggaagatgccacggtacaggtgggcctgacgagctgtctggggattccgggtcacagcaatgatgggggcacgtgggcggtatctggccacctggtgagcagacctgagatgggatgggggacatacagaagagaccattacacgaggccccaggaagtaccctcagggcgttcaaacagctcaccctctcatccagctcactgagggctctggcctcttcaacatctgctccctaggacccctcccgaggctcgggcagcccctcatcctatatcccccacagcatgctaggttaccatttgccctctacccccattccacaggccaagggctcaggatcaccttgacccagcaagatcagcctcacccacttaccccacacagcccatggttggcagaacccctcctacaccctgaactctgacacagagaggcagccctggcccaatgtcaccagcacccattcctctcgctgccaatgacagtgacaagccaagcagcacgtgactagcacctgactcttgacatctgcaaggagcagtagcagagctgaccagccccctgggaatcaacatcaggcttctctacttttgtgccctctccctgccccacatggcccctagctcctgaaacagtcccagcaactgggctataaaggcccagaatcaaatctgagtatctagatgaggcttagaaatctaggtgctactcagcaggcaagaacaggaaatgggagtgttgctgcaggagcagctctgcctgccaaagctcctttggaaggcaggggacccttctaaagcccctctgccaggcactttcttgaacactgacactgcacacttgtagctgcagctgtgtctcaggagctggggaggggcaccagaagggaagttatgaggacactcaacaggtgtcagggaaacttaagccacatcacagcagagaagtccctgcacttcacgcttggcctctatgcaaggccttcagagggaagcaattgctgaagccaggaccagctgagtgaaaccccagaagactagagcttaaaatagccaaacagcaagaactggaccttttaagaaaggtcaaccctacgggttggagctgttcagccaagagtgggaggctggagccctctgctgagggcatctgcacagagcttgtgtcctggttctctgggctgcccacgcccatctgctgctcctcagtgcatgggcactgcctgtttgctcccctcttccaggaaacccttgctgccctgtggacagggacaaggagcatactccctaactaggagagtgaaggacattaactcaatgtcctgggccaaggaagggatcccaagttggaggcccagcataggccacacagtcctcagcctggctgccaggccccacagaatgtcagccaagatagcacagcaacctctcctgagctggaacccaatttgtctttagggctcaaaaacagcagggactagtgtgccaaatggaggcacagtaaacagcatttaaataaattcatttcccaactgaaatttttaaagagcacatagtaactggaataagcaaaagtggttatcttttacaattttagaggactaaattttcaatatcaaataaccatttgtagtcagcctgtgcactgttatgtaataaatctccagcataaatttgcttttgatccaaatgttctgacattccttatgagtgctacctagagtcctttgggcccagggaaggggctctgctcaatccttccctgcaggcccaaggtggcaggcagaggggtcttaccttggctcagtgccacctgagcattgttcaatggactgctcccaggacccccaaggtgaggtaccactgagcagggcattccagggagccgctgccgcctcctacctgccagacttggtgaggacgattatggccccactgcagcacttgaaggaggcctccacggcacccacggcggtggcttctgtggggtcgctggtaatgggcgccaggcggcggagttcctcaaataattgcaagtggtagatggcagcctctgcctcacgggcaatctaggggagcaacatccgtccagagggacgagagggggacagagctttgtcagagctttgtcacaaaaggagagggaggggaagagtcaccggacagctggtgaggaacatgttcctgggaacaaaggccaagaggagcccaatcactggagattctgagctgagccaagatcaagactccacagaaaccagtccttcaccaagtgcctgtgacatctactgtgcctactgagccacaggaccctttggtcctgccctgccatgacctccctggcggtgttcctacagacgagaagaggctctgtgcccagatgccaggttgggcctggctgtcttctcctagagcaggtggagcaagaggctggttatcctaacagtgttacctgcccttagggccctacctgccagactccgtcagaactatcaaagctgctgctaaacacttataagaagcctccacgctgcccatggccatggcttccatgaggtctgtggagtgacttgaggctcgcacaagttcttcaaacagcttgcggtggaacatggctgcctcagcctcacgagctatctgtaaggtttaggggaagagggggcaaggaagagggaaggaggaggaaaaaaacgagacacaacacatgggaagacagaatggggaatttatcagagaggaaggtaaccttaggttaattggctaaatctgtccttcaggcagatgcagaggtagggtgatgaaagtccaactgcttcaggaggtgctgccacttcccctccaatacaggggaaattggctcttcccttctggaaggattttttcattgggggtggagggagacaatctggcagtaggctctagcaccctggcatgaaaacatgcccaggctgggcccaggccactccctggcagaggacttgaccacgctgcctcatgacatagcttacaggaaggaacaggccctccctcctcacatggctggttgattaggcaggctcctgcccagcctccatgcatgcatggagtgagcgctcacttggcttcaggcacggggatgcactgagcctttccaatggcctgccatggcaacagattgagcagcgctggaaagctgggatcaaagccaaagcaaggcagctcaactgagtttgaagcaggagaacagaaaacgtgggctaacttgtgagaggcacactgaacagccatgtgaagagacagatgcctgtggaagcatgcagatatatttaataagacacttgattaaaatctaataattaaaacagtcatgagaaagccactgagttatttatagatcacttgctcagataagaccaagaatcagaaagacaatgtaagctttagaggattataatgcaatcaccagcatctcagtaaatgatgggtgagggaagaatcggtaataccccctcatcaatttcacagtagaagcagatgtgtggcaggatgtactaggttaaaggtattctttctgtaagaacggaatgcatgcagcccagaggacaggggacatgaacaggaaacagagccatacctggtactgctcttagttatgggtcataaactgcatcagttagacacaggagaaagcagtgaacagttaatggaaggaactgttggccagtgttaactggtgacacagaaaggaaaggtctagccacctggaggggcagctacagcctagcccagacctgtaacttatcttctgagcagtgccatgcaatccaaaccttgcagccctaaagtatctatctgttcataggaaacaccagggtatggaagaaaggatatggaatttagaccctgagcctgaatcttagtctctgaccccactgacaggctccaaatggagacctgttctcatctcctgctagacagagcatgatgttgcaggagagaagactggctttggaggcagtagacctagattcaaacccaggctttattggccatataaccctcatctataaatggaggtaatgggagttaggaagattacatccatgtacacagagacttatcagacacttaataataacagcaatgaatatttaatgctaaggctataattaaacatatctaatccattttacagatgaggtcttaagaggttaaatgacttgcccaaagacacattcaagtccccacattctatgcagtgatttcatggttcagtatatctaagtcaagatcagcctctgttcctcctttgagaccatgaagtcacacgattaagtagggaaattagagagaggggatgtgtggagagacccagaaaggcagccactttagtggtgactggttcaaggtgcaccgtctcctgggacaccttcctaccatggtggcaattgtgagactgcgccaagagtatctaagcatcagaacagcaatcacatcacacgaatggtgaggtgtcagccaggcccagtctacattaagtgggcctgggagagaaatcactctctaccgatttttttgtttttttttttatgtttgtttggtttcttttttgagacagggtgtcactttgtcacctaggctggtaccatcttggctcactgcaacctcaacctcctgggttcaagcgatcctgctgccccagcatcaccccctctccaagtagctgggactacagaagtgcatcaccatgcccagctagctaacttgaatttttagtagagacagggtttcaccaggttgcccaggctggtcttctgagctcaagcaatccacctaccttggcctcccaaagtactgagattacaggtgtgagccaccatccctggcctctaccaatttaaatatggggaaacccactaaggatgctgatgacagacagtccggaaaatatccttagtcaagtgtgaactcagttcgctactgaaagagcatttaatagaaatgacatctcttctctgaaagctgtttaagcccagtaacaggatacatagtgaaaaaggaaaggaagatgcccagaccagatgggtgttttagttttttttttttttttttttttctgttttttctggtggcagggggtggcgttttaaacttgggggcttggaggggctgaggtcaaagggcagcgggtctttcactggctagaaagggaatagaaaggctgaaggaaaaccatatctggataaagtttaagttcactgagcatgacctaagactactgggagaaagttaatttccagcactcattttaccaaacctatgtaaccctgatcagggatccctgagttagctccagagctggaacagacagggcaaagggactgagcctccaaccctgagcagtggccaggcactcgacatgacaagctggaagagcctgaagaacgagctctcagaggagaaagaagggaaagagcctccacgactcctccagacgctcagtccagggccgccagggtcagccaccctccccgctgtctctatctgtggccctgccaccagtcactcaacccgactttttggtctagagtaagagcagcagctgtaccccaatggcacagcaaagcaaatccccctacaggcaccatgcaaggccagcacaggcagctcagtgaaggcaacagactccagtgcaggtccacaagggccccctgcgggagcgcctgtctgcaggatgcggggcagagggaactgaattggaagccaaaggaagagggcagctgggagcaggagcccctagcccttttcagaatagggcaaaggtactcagaacttctgactctgaggaagaggtacaagacctcctttcactgcagaagtatcccaggacttaagccatgggaagaattcacaaccttgaagtcagaagtgaaataaactgtgtggtgtccaatgaaggaggatgcctccagagcagaaggaaatggaggggtgggggtgtgggcaggaatgcagaacaggagaaaaaaaaaagccacctccacttccacccccaccctcttgctgctgtaacttggaggataatgaaaggctgtgcataagaggatggagaaacctaaaaagctctgcaccagagcttgcatccatcccaggcccagtccgaagccctgggggatggggcaggccccagaactcaccaggtgctgcatgcgcacagcctccagaggatagtcccctttggctgtttctccagacagcatgatgcagtcggctccatccaggactgcattggccacatcactgccttcagcccgagtggggcggggcttcttgatcatgctctccagcatctgggaggggacagagcattagtgagatgtagcttgagctgtcttcagagacaaatgacagcaagctgatcctctggatagtgagtaggtacacagagtatggctttgtgtaggtacatgggggaaggggattatctgtgtgttacgtgcgacaattccatgggaagagatcagacagcctccagagctttcccatacaaacatgcgagtgtgcacatgagaatgtggggaagggtgggcacatgcctgagtagcacagatgacaggcttcccagctcggttgcaccgtccaatcatcatcttctgagcaaggaagaccttctctgcaggaatctcaatgcctagatcaccacgagccaccatgatcccatcactggcctccaggatttcatcaaacctgatggacaaagttggggggagagaggttatatagaacagaggccacaagtatggcagtagacaagaagtttccctgggattccctaacttagatgtccttgtaccaggacagacatccatgatatcatcatgggtgcacacagatggcaaggcagtccagctaccttaggcccccagagtgggccaacaattctgcctgctgggcttcaacaccaatatggatgcttcattgacggaagaaaggggagagggcaaatccaaatgggctcattcccaaggtctcctctccaaatcccatgcatgttaggggtctctctagggcctccattttccaatcagcacttcaagacagggaacctgaggcctgatgactgcttccaccacaaagacccatggcctcatctagtcaaggacacttgaggactgccctttgaggtggcccactccaacctgctgaaggcaagagggaatgtggctttgcctggcctagggccaagttcagctagcctatggcttatcaggatggcaaaggggaggaccccaaattgcctggtacagaggatatctacacaaagctcagacagtaaggccactacagtgggtgcacagggttgctcccccaccctccccaaacacacttctaatccacaagagtgtgtctagcatcttagttgtgctgagttgtattcctagcaggatgccaaaaatggtggccatgcccactgggctctactttgtgagcattggggagggggtaagctaagttggggcaatctgaaactggagaagaaccacacatcttcctctgagagtggaatggaccataccagagttagcatgatcactgagccagctgcattctaagtgaagaccaggaggccataagctttaacatggacaccaggccctgaaattccacatggctccccaggaagggccaaaaagagccctttcttaagtgtctgctgtcatctttccccctggtccccccattccagcaaacactggtagtgtttctgatcaggaacagaacatcatggcccctggtcctgtgagcagtgaccctgttctctcaaatgttggtccccaggcccagggaacaatgtcaagctgccagcatctcaattacctgggaagcttttttttaaaaaaaacaaaaaaacaaaaacaaaaaaacataatgccttctactctcctaagatattctgattcagcaggtttggaactggcttgggagtctacattctgatgggctaggggctgggaatcagacattcacaggatggaccatgcccttcggagagctgcgctgggactggagcagggacaacggggacttgcctccgaaccccctcatgattctcgattttgctgataatcttgatgttctttcccttctctcccaggaccttcctaacttcatggacatcagatgccttgcggatgaatgacgcaaacaccatatcaacatcctgctcgaccccaaacttcagatcctggatgtccttctccgacacagcaggcaagtccacagcagccccaggaaggttcacacccttcttgctgcccaaggagccaccattttccacctccgtcaccaggaagtcggcacctgtatgaaaaagggtaagtaggggaggcagagcacgagggcacaggtcaacaggaagcaggcacctttcccgcaaggacagtgagctgggaagtggtgcattatgggtgctggagctgttttaccagagttgaaaacctactacactgtgtaatcctgggcaagccatttaacctctctgtacctcactttcctcacccataaataaggataattaagactgttctgactttgggaggccaaggcaggcagatcacctgaggtcaggagtttgagaccagcctggccaacatggcaaaacgccatctctactaaaaatacaaaaaaattagccgggtgtggtggcgggtgcctgtaatcccagctactcaggaggctgaggtaggagaatagctagaactctggaggcagaggttgcagtgagccaagatcatgccactgcactccagcctgggcaacagagcgagactctgtcttgaaaacaaaacaaaacacagcgaaacaaatatatatatatatatatatatatatatatatatatatatatatgtatatatatatatatatgtatgtatgttcctgtgttctccagaaccagaagaatgtaactatgctggattaaagcctatctttgaggataaatgagttataaaagggattcctgagaacacacagactcaatctcactgccaggcaaccaaccttcccatcttccttgtgtcaaggaagtttagagacaaaagactgttttagacaactggactccagctcccatacgtacctttctgcttcacctggagagaaataagcccatcatccacgtagatcttgctgcccacttccaccaccttgcagatgttcttgtagtccagccacaggatgttctcgtcacacttttccatgtaggcgttatccagcgtgattttgagagtggctcccttcttcagctccacctctgcagtgccgctctagggacaagagagtaagcaagagtccaaactggagacaccagtagcagcatcacctcagaaggaatggaaaagctctttcctcccgggaacaatgctcaagtcactgctaaaagtaatacagttttttgctcttattctctaactctgtatacttcacggaaataatccaagaaaagaatatgtttcagttatgctacttaatgatggggaaaaagatacaaagagatggttctccaagttagaaagcctaaagtttaggtttttagggtaaaaaaaaaaggttcctttgtggtaccatttcctagcaaagtagatcaaatcaacattgtttacagtgatgaataaatcctcatttgtagacctcaactcctctgcagtccttcatagtactgggaagaaacatggcaacccagcgctttggaggacatgtctctggggcatattgcctactgagccttcccctcgctctccgcagaatactcacgcccttgatgagcccagttcggatctcaggtcctttagtgtctagagccacagcaacgggccggtagaggatggggtcagaagcaaagctttccgtggctgtgcgcacattcttgatggtctccgcatggtactgggggaaaagaaggaagatgacaagcgtgctcccacactagaatccagctccaattcccctgcccaggagccaaagctgatcactcaggaaaggcccgtggatgtcttagagctctatctccatcctcagcacgatccatgcactgagaaatcctctacctgcttaatccaacctcctcagcctccacccacttctactacagcactaattcacccaaagggcaaatctttgaaatgtaggtggcaaatttcagaatattgccaccaaaacccattaaggtatgggtgcaaacatgtctcatcataaaagcagctgtgtccccagggctgttcttttttccctaagactcatcaaataccctcagcatataaagctcataaacagggcaaaaagcctaggacttgtgtttggataaggctggtctggcaatcaatgtcacattctgatatatgtggtaatgctgagagcttttcctctattgattccaactacaacgcaaacttgaagttattgacttaagctaacagtggcccaagctaaataactcattgctaaggtcacacagacctgattttctcaatcgctttgttttttttttttttgagacagagtcttgctctgtcgcccaggctggagtgcagtggcactatctaggctcactgcaagctccacctcccaggttcacgccattctcctgcctctcagcctcccgagtagctgggactgcaggcgcccaccaccacgcctggctaacttcttcgatttttagtagagacggggtttcaccatgttagccaggatggtctcgatctcctgatctcgtgatccgcccacctcggcctcccaaagtgctgggattacaggcgtgagccactgcgcccggcctcaatcactttctagattctgattggagggggaaaggtggtcatatgcctttctctaaatgaactgccctttattactccttgcttacaacaaatcctggcttcaatcttttttcttaagcctttcctcctttccatttaccattttgtttgtttaaaagagggactcaggctaagcacagtggctcatgcctataaaccaaacactttgggaggctaaggtgggaggacagtttgggccaggagtttgagatgagcctgggcaacatggcgaaacctcgtctctacaaaaaacacaaaaattaactgtgcatgatggtgcgtgcctggggtcccagctacttgtgaggctgaggtgggttatgtctaggaggtcaaggctacagtgagccatgatcacaccactgcactccggcctggataacaaagcaacaccctatctcaagaaaaaaaaaaaaaaaagacgcagagccaagatgtcaaaagagctctaagatagtgtcatcaataagacattagcggtaacaagggcacctaattcagcactttctgggccttgtcctttaaccaccactgtccaggaaagtggcacctgcaagtaagcctgcctgttattcacaggaggctggagggagctggagccagagcctagcctctaaagacagtgttgcctgaaacctgtgtctaaaaatcttcagcttcttattcaggcatacttcctaatgacagacccttggcttgtctgttttttatagggttccttataaattatgatattttcttgcttactggcttgtaatagaaatagaacaaaatagaatagaatagaggctgggcgcggtggctcacacctgtcatctaaacactttggaaggccaaggcgggtggatcatgagatcaagagattgacaacaaccaggccaacatggtgaaacctcgtctcaacttaaaatacaaaaattagctgggcgtggtggcgtgcacctgtagtcccagctattcaggaggctgaggcaagagaaccacttgaacctaggaggcagaagttgcagtgagccgagatcgtgccactgcactccagcctgggcgacagacagagtgagattccgtctctaaaagaaaaaaaaaaaaaagaatagtaatagttgttttcttttaaggggataggtggtgcctttccttcagagttgacgtgaggagtaaaagaatacatgaagtattaggacaaagtacatggtaattatctaataaatgttacctattatcatcttataatgataagactcaggtgtactgagttccactacagctgtggctttgttgggatgttatcacgtggataagagttccacacatcaatgctgtcctgcggaaggctctatatttagctatatttaggttgtttaaaagtcaaccttaactcaggccaggcgcagtggctcacgcctgtaatcccagcactttgggaggccgaggaggggggatcacaaggtcaggagatcgagaccatcctggctaacatggtgaaaccccgtctctactaaaagtacaaaaacaaaattagccgggcgtggtagcaggcgcctgtagtcccagctactcgggaggctgaggcaagagaatggtgtgaacccggaaggcagaggttgcagtgagccgagatcgtgccactgcattccagcctgggtgacagagcgagactccgtctcagaagaaaaaaaaaaaaatgtcaaccttaactctacttaatcccgatgtagaattttgttctcctagaataaaatctacttggtcatggatcaagacattcctttcaatcactactggatttggattattaaattttatttgttttctgcatctaagtgagactggtctagcacactaactgttagtacctgcctggttttggtactgtccttgtttgatctcagtatcagcgtatattggtttcaaagaacacagtgggaagatttctatatttctctaggctctggaacagtttaacaatgtaactgaactttgaaggggagacaattcagccactaaaatcatttggacttaagtgttctgaggtgaaccagatcttaatcactttttcaactttttggctggagtgcagtggcgcgatcttggctcactgtagcctccacctctcaggttcaagcgattctcctgcctcaggctcccgagtagctgggactgcaggcatgtgccaccatgcccagccaatttttgtatttttagtagagacagggtttcaccatgttggccaggctggtctcgaactcctgacctcaagtgatccctccgccttggcctcccaaagtgctgggattgcaggtgtgagccaccgcacgcccagcccactttttcaacttcttatggccactggtctattcatattttctatcttttggatatttatcttttctttgaaaatagccagagtcatctctctatataggaattaagttataagtctttcttgacttttaaaatctccaatgtgtaggaaatattctcttttctattcatactcttatttgcacatcctcgcattcttcacctggcttctcagaactttctattttactattttttccccacaaagaatcagctcttagcttaatctgtcaaatttattttcatttcattgagctataatcttacaaaattattttcttcaccctttttagggttttcctcccctagtgttctgagttaaatatttatttcatctaccttgagatctttgctttctaaagtaagcacacttcagttttcttgactttgttcttaatttccactaaaaaattttatcagagaatgtgtctgtataatttctactttatgaaacgtgggggtttttttggtggcctaatatatttttgtaaccatgagtgtttcatgcaaacatgcatttttggtcttggggatgtaaaaccatatattataaacataccaattattaggtatattattcaaatctatgtcatatatcataatctcttagagcatctctgggaggtgtactgagtcttccacttcagctgtggctttattgggatgttatgtggtaaagcatccatcaatgctgtcctgtggaaggctctacatttaggttgtttaaaagtcattatttctaggccaggtgtggtggctcacgcctgtaatcccagcaatttgggaggccaaggcggatggatcacttgaggtcaggaattcgagatcagcctggccaacaaggtgaaaccaagtctctactaaaatacaaaaattagtcgggtgtggtggcaggtgcctgtaatctcagatacttaggaggctgaggcagaagaatctcttgaacccaggaggcagaggttgcagtgagccaagatcgtgccactgcactccagcctggatgacagagcgagactccctctctaaataaataaataaataaataaataaatctggaaaacatggcatatggaaccacatgttcagcaagaatgcatcttgcccatgtgaactgccaaaagtgagggctgaagactagttgccaaagctgttaaaagagggctgggcgtggtggctcacgcctttaggaggccgaggcagtcggatcacctgaggtcacaagttcaagaccagcctggccaacatggcgaaaccccgtctctactaaaaatataaaaaaattagctgggcgtggtggcacaggtctgtaatcccagctactcaggaggctgaggtatgagaattgcttgaacctgggaggcagaggttgtggtgagcagagattgtgccagtgcactccagcctgggcaacagagcaagattctgtctcaaaaaaaaaaagctgttaaaagatcagatgcagacatttgatgtccctctgtcagagtgagagggaagacagtaatctcaacgttctgctcagaagagcatttaaaatagtcagaaactggaaaagtacgccccagcccctagtcaaaggtgcacatgaaacgatagccctgacgtatggtaaggctgaaactgtttacattacattatataaattagaataatttcagatcagtttccaagctgagcccacacacaacctcatcttggtctaaaacttcaaaatgaacacacaagagggacatctttaaaaaataaatagataaaaaataaaaaataaatcttaattataatctgggaataggagtgaaagtagagataatctccaaaagcctcttaaagtttaaaataccaaaatcggagccagctctcatccagcaggtgtggcaggtatcactcgcccttgccatgttagagctatgtggtgttattttactggatgaaggaaccataaagcctacttaaaggtcaacttcttaaaaatctatttctgctccttcccctgaatgcaggagcccatggcagactacagcagcagggatcaacagcgaacagacctccagcattgtcttcagctctctctaagctaagctaacacttaattctctaacaagtaattctcggtgactcctgctaaggaccccttgcttttggaaaactacagaattttccaaaaggtacagggacatgtcttaacctacatggtatgtctgctggacttggtcaggtccccatgacatttaagggccagccactagccaggccataggctgtttatgaacacaggttagggaatctatgatgaagagtcttgtgtttcccaaaaggaggaattcactcttggattgcatttcctgaggctttatttttagtccaaacttaataccaacttccaaatgccagagggcaacctctgtaaggcaattggccttacaggatagcattttctttactctcaacaggaaatacagaagccaagacaggtgcaaagtttgcctcttctgtaattcctcttatcaatgccattacgaaatcccatgatctatgggaaacctatggttaagtctgaaggttttaaaaaggcacaatcccaggctgagcatggtagctcattcctgtaatcccaacatttgagagaatcacttgagcccaggagtttgagaccagccaaggcaatatagtgagacctcatttcccccaaaaaaatttttaaattagccaggtgtggtggtgcatgcctgtattcccagctactcgggaggctgaggcaagaggatcacttgaacctgggaggtcaaggatccagttagccataatcataccactgcagtccagcctggatgacagagcaaaattttgttttataaaataaaaaaataaataagtcatggtacctcagggaaccccaagctcctcagaatgggttaattctaaatctggcaatggaggcaggaatggagccatcccaacagctgctacctggctcctgggcaaggcctctgtccataggtaaagccagctaataaagagcccagcacaaatacagtcctactaggctcctggggaagagtgctaactggtgttattttaatgtaccagaacccctgggaaggcacaggctgagaatacagtgctgaggaagtggggtattacaccccagatagtgcttatgcattaggctcagtccctcaaaacttagaatagtggaaaccgttctcatggacctgcccagttattttggttctaagctagaatcaatctgctagatggtttaccatggcaacacaaggtgaagcagaaaccctgggacaggagagtcaagcgctgtggccaggacacctaaggcttagagggttttccagtagaacctttccatatcttcctttgtaaaagctaagggtaggagaggtgtgtgggagaaccacagccagcaacaaagggggtcctttttgctaaaagagactcagccagttgctttgtcaggacaagagggaaggagagtagggatgggctagtaaagacaaacttcacactgactgtgaaactcagactcatccttgtctagtccactgtggctaaacgaacactgcaccccctccctgtttcctacaggccatcacaatggccatagggtccagccacagctcacctcatgagttccatgagagaagttcagacgagccacattcattccagacttaatcatctccttcaacgtctccactgatcgggaagctgggcctattaggaaaagttttaaagccacaagtattaattattcaaagaaggaaaaacatttaagtttgcttaagtttaaagaatttttttccctgaaaacttttcctctcccaaatagctcaaaagtctttaaaaagtgcatggaaggctactaccgtgccagcttactttcttgatctactgggacacttcgaccatttccttcaagttctgcaggctcccactgtatcagaaaagcctaggttaagacttggccagccttctccaccctcactgaaacccagccagatgtccaaccacagaatcttggtagcacagaacatgttagaaagatctttcctaggtctttaagttgctcctacaaagacctgctaaggaaaacatcttctaaattttgcctatagcataaaacctaaaccatatggattctttttgcaacaaattattttttattataaactggtaatttataatttgggttacaaagttatgtaatccaatacatacagtttggatacaatgtggaataattaaatcaggttagttaacatatccatgacttcaaatacttaacatttttgtggtgagaacatttgaaatttactcttagcgatgtttttttcttttttcttccttttttttttgaggcagagtttcgttcttgttgccaaggctggagtgcaatggtcagatctcagctcactgcaacctccgcctcccaggttcaagcaattctcctgcctcagcctcccaagtagctgggattataggtacccgccaccacccccggctaatttttttgtatttttagtagagatgggatttcaccatgttggccaggctggtctcgaactcctgacctcaggtgatccacctgcctcagcctcccgaagtgctggattacaggcatgtgccactgcgcccggacaatttttttttcttaagacaggatctcgctctgttgcctagactggagtgcagtggtgtgatcatggctcactgcaacttcaatctcctggactcaagtgatctttgtctcagcctcccatgtagccagaactacaggtgcatgccaccatgcccagctaattttttttttttttttttcactttttggagagacagggtctaagttgctcaggctggtctcaaatttcgaggctcaggcaatcctcccacgttggcctcccaaagtgctgggagccaccatacctcgccatcttagcaattttgaaatgtctaatactctcttattaactgtatttgccatcctatgcacatactaattctttactgcaacttcctatgacctgagtcctttcataagaatctgtgtagtatcccatgtagcacctaggtttgttaggacatttagttactcttttcaggagagaaaggtcactgcccatgaagcccttttttgggggaaggggcacacccactcaccaatggtacagatgatgccagtgttccgggctgtgatgggtggtgaatcaatgtccaggcggcacatgtgctccaggaatgtgtcagccatggctgcgtgcagctgctgggtctgaatgaaggcagtcccggcttcactatggggcttcgacatggctgctgaggtcctgggtcgagacaaattgaaagagagtggtaagactgagaagtggttaatataccatttagcacagaaggctgtctcctgcttacacattaactcaataagcacgctttgtacacaagccacagggaagccagacatgatctggttatgtgggtgctcctcatgttagaaaaagggttcaccagattgtgaacaatggaaaggaccttactgaacaagttaaaacctcccacccactccacatagtcccaagcacccacagtaagcaggtctctcttacactgggctgactgacatctacctagacagctttctcaccaccctatctataaataacatcatttaacatgcactgaaggagcttccaatgaaggaagttgtaaccaatcttccagtgatacaaacaactgactcctagcttagtgccttgataagcctagatctctgcatgtcaagctgtcacaaagctacaaatagctgctttgtcgtggggcacccatattgcctctttacaatcctcacccaaacccaaagtcattcccctgaatgcaaaagcttccatcccaggagtctaaacctaaaaccacatctactgttggccagaaggatgtcaggacacgcaaagcaatttgcaatttgcaaagcaaggataacataagggcactggtataattctgaaattatcacaactacattaacaggatagttgcaaacatagagaaattaaagttgctggtcaaatcttttccccaaatgatttttgatacacatcctgatttcttttctaagcctgacaagtataccaccactctgtaacacagaccatcagttccaggtaattaactagcccaggtcacaaccctgacaatggccccaacctttgctttcttcattaatgacttacaactaaactcactcagcctgttagttagctgattagagacaaaaactcaggagaagcttccaggcagtgtttgaataactatcaggtaaggatgtgaaccagaccaggcagtgtttgaagaactatcaggtaaggatgtgaaccagaagcttgctacacgtctcatcagaaagctgtttccttgagttctcagaccaagggctactctttctaaaacgcttgagcctaaatgcttcggccaagcaaggctcaggaacaagctcctctttagcccttccccacctcatcctaaatctcaaagttccaaatcaaggcatctcacacatatgacccttactcctttaccctgttccatctctgactttgtgggctctctgggtggctcgagtagagtatacatctaaatccatctctgccatctccaaagaaggcccgctgaggtccaaggagctctgaaggcagtagtgaacagtctgttggctatggaaaactgatggccacaagtcctcaaccacagattctaaaacttttaaaatggggaaataagataccggctaacggttcaacatggcaaatgcactcttcatttcgatgtgtatttcctaagcccctaatatctactacgtaccaaaatgaaaaaatcaatcctcccttccaggacctatatggttttgtatctcctagcacctagtatgtggaagcattccagtgtttgttaaatgacctttcagtctctctgaatgcctctttgtcagaatcaaagttatgcctctgctcccccttccctaaatctgaggaacttctgcattactgacaggaaagcctggggcccctggtccctttccctacactcatggttgagggagggctcgcataccttcagagctcccagctgggcttagggaagtctggctgttaagggaacattactgagagatggcacatcaggccaactggaacacaaaggctttgctgtggcctccaatgggcctacaatctagggactgtattgtgaacaaaataagatctgaataagtgggttggagtaactaattccactctttttaaaaaccatcagctggctcttcttagacctgagatatgagggtcttcctgtaaagacctggctggggccactgaatatcaggtcatacctttggttctctggggttgggcttccggtgacataatgctccccttttggctcagggtggctccttggcctcactagcaaagaccgctcagagctgaatacggtgtgccctggagagctgcacaaggattaaggaaaaagctgagtgtaactaaagctctttggggtaatggaaaaattaccttaataaccaggtatccaggtgacagctgctctagagattccactgttatgtctctttaaacctgtgatttactaacattccactattctatacaagaacctggtccctccccttttgggagcggggaagggacaccaaattaaacatacctaaaagacctgggaggatatatactgaaattttaataggacgtcattggggtggtaggattacagaaaaaaaaaaatcctctttattaacaaatttactgatataaatataaaaatacttttatagtaagaaattatgtgtacctcttttggaaatatttatatgcatcctataaaattgttgggaggaagtaaatgaaatgtgaagacaccaattccattaatcaattgctgctctatgcacttcaagaataatctgcttttaaaaggtggcagagaaaagacgcatgtctcaagttctgtacactgggttgtgattaaaaaaaaaaaacgatacaagtcttaggccctacatcacaaatgtactgcagaacagtttcaacggcttaagaaggtcaaccttaatacattcagaacctcaaagcaaaaaaaaaaaaaaaaaagtccacaggataatcccatgcctcaaacctgttagttacatgcccaaatccagcaaactagtttgttctcaagctttacagtaaaagcttttgacaatgttctggtacagaagggctgcctccaagtccacgagatgccattagcagataaaattatattggcctcaaacacaaaccctatttcaactatctcaaattaaatctgatgcctataagctctaattttttgccaataagtacaaaaatgacaaatgaaaatttctatagtggatttacgcattagcagtcaaaaaaagcttgcttgtcagcaagttcatccagactccagatctcatgtgtccttcatgctctctacccagccagagacctcatatctcatgcccaggtctttcctcaggctctgacctgaagcctcccttgcagggagggccagagctctcctgccttctccaaaatcctccacaagcctcttcccagcacaaactgcccatcccaccaaccacgtacctagagttgtatgtaaaacactcactggactcccctggctccaggagagcagcccagccttggtttctcagggcggacttctgggaaagactcctctccctcatgccagctgcctggacagtgcctgccaggacatgtggccccacccatgccagtctgactcactattgcatcctcctcctaggaaggcacagacatgcagagccaacctccagccagcagtggaagcctggcgtatccactgatagcagcacacaccatgcccaggtccaggagccttattcttgagcccgagcccctgcagtaagatcttcctcagagccatgtctcctctgtgagaaaggagacaccatctctaagaggccttagtctggagtgacaggttggaacaggcacaatcacagctcagctccaagtgccctattctccctttcctttctcatctcagacagctcctggctttttatattagtttcctttgtgtcagacacaattttttggccattcttcagaaaccaggagacaaaaatcataaaaaatacccaacactcctccctccaactttttttttttcttttttttttttttcagacagggtttcactctgtcacccaggctggagtgcagtggtgtgattatattatattatagctcactgcaccctcaaacgatcctccagcctcagcatcccaagtagctgggactacaggcacgaaccacacccaactcccatgctccacttcttagggccaggactgttgttgggttgtgctgggaaagattcacgcttcactccaccaattcttccacaaaggaccaaatcattctgccctaataaaatagcctggcccgtgagtctgcatctgcctaagtcatttttcctttgtaccaattatgctccgataccaacctcatcacatagatcaactataaaatgatggcacctgatgctcactttctccctccaacgttgccagtaggtacccaagattgtgttccttcctgtgacgtcagtttgctacctacacctccaagccatcatgaaggcgtttcgatccacaactcttccgaacacctgcatccgttagaaagtctgcatcatgatacgctggcattcaggtcagcctgctctctagttctcttcctcaacaatggaaatggagtttctaagatttgccctaatcaaactaggccagcaacatgatcaaaatgggtgacgggccagcagaacctagtaaggtctggaataggcactgttcatcttcatctatagttaagggtaatgacaataatgtatttgcatatgggtgcaggatacagaggataagatatcttctagctaagagacctgggtcttaagcccacactttaaccccaggaggccccacagcagaaagcagtatggtgttaccaggctacacagaacaaaatgagcccacttgtaggttctagtaaaattccctggctttaaaaaaaaaaaaaaaatcttggctcttttatttcttcggggctgaaagtaaatgacttgtcaacaggaacctaaggtcctatttccaactagagtgtggaatagggaagagcagctgatgctaaatgggcctacttccctcaaagaccactcaacttcaggtgaagaagccctaagtcagagacccctcaatgtcctcagatgccgaggatttcctggttccatcccagctgctcagtgcagagaactggtttcagcctgaaggaggtggtttgggggaagcattagttgtcctgggacatggtgcctccttactaggattaaaagtagggcggtgtttctgggtatgatatccacactctaaaatcagcaagggacctgggaccctgatttagggtcctcttaagtgcaactaaggtgggtgatggcctcagcaaagtgaggcactggctcaacatttactggaagggctgccctgcattctagtcggggggataaaggaggaaaggcagtgccaactctccaagagcactgaactagttactatgactggtcttcctacggcagcctttataggtttgcttctatgttacgaattaaagaaaaaaaagttttaacatctgcctctctaccacccagaactgaccattaacactgagccatggctggctgtgttggctcacgcctgtaatcccaacagtttgaaaggctgaggcgggcagatcacttgaggctaagagttcgagaccagcctggctaatatggtgaaacaccatcactactaaacatacaaaaattagccaggcgcgcacctgtaatcccagctacttgggtggctgagacacagaattgcttgaatccaggaagtggaggctgcagtgaacggagatcgcaccactgccctccagcccgggcaacagagtgaaaaactctgtctcagaaaaaaaggaaaaaaaaaaaaacacaaataaaggctgagctgtattttctttaatttcttttttctttttttttttttttttgagatggagtctcgctctgttgcccaggctggagtgcactggcgcgatctcagctcactgcaagctccacctcccaggttcaggccattctcctgcctcagcctcctgagtagctgggactacaggcgcccgccaccaggcccggctaatttttttttttttttttttttgtatttttagtacagacggggtttcaccgtgttagccaggatggtctcaatctcctgacctcgtgatccgcccacctcagcttcccaaagtgctgggattacaggcatgagccactgtgcccggccctctttactttctaaaaacaaaaacaagaattttaattttatacagttcattttttctccatccccaagctcctccaaccctttccacctccatcttaaacttttttttctattttatttatttaaatagagatgggaatcttgcgatgttgcccaggctggtctcgacctcctggcctcaagtgatcctcctgcatcagcctctcaaagtgctgggattacaggtgtgagccactgctcccagccacatcatgcattttgacacccaatcactgtcatgaactctatatccttccagttcactgaagtctatgtacagtgtatctatgtctatactgaaccctataatattgtggttttcttaatgccctaagtggtatactgtatatatcactgagtaacttgtttttcactcagcagcacatttaagatccatccagtgggtatatggatctagctaattcatttaagctgttacactagtccactgtacaacagaccattttatttatggactgtcttactggtggccactctccctccccgttaaactaagtttcttctattaatcaatactcttgtagtacatgtctccctgtactgtgtgagtttctatatatccagaaattgaagtcttaggtcatggagtatgtttatttctatttttactaaataaggctgaattgctctccaaagtggctatatcaatgaacgctgagttgctgccttccacacctttttccacacttggtactgccagactttttaaatgtttgcccatcggtgacatttgtttttctgctcatctaatgttaataaccaaagagggatacccagatagtttcaacgtttacaacatctctatttccctgcttaactcaatcaaatctcctctgaaatggcatggtggacacagtgtgtcttatgtgccctgactgactccactgatgggcagttctttttcgttcatggccaagggagatatcagttgtttaaaattgaagaaacatggccaggcgcggtggctgatgcctgtaatcccagcactttgggaggccaagacaggtggatcacgaggtcagcagactgagaccatcctggctaacacagtgaaaccccgtctctactaaaaaatacaaaaaaaatcagccaggcgtggttgcggttgcctgtagtcccagctactcaggaggctgaggcaggagaatggcatgaacccgggaggcggagcttgcagtgagctgagattgcaccactgcactccagcctgggtcatggtgcgagactccgtctcaaaaaaataaaataaaataaaataaaataaaaaatgaagaaacattatctgcaagtaaactgaagatgtttggaagggataggactcccttcagagaatcttgactgcagtattcagccagcagctgtgctggtccacagtgtgaaatgctaggactggcaacctcactgcccttgaataactggtcttggcatctctcccactgcagccccagcctgcttccaagactgcttgctggcatgaggaaagaggcttagggctccccaggagctttgtctatggacagaagtgggggaggtgagtctcagaggccaccgaaggtactgcagccggcttgttccctcctacgtgcagacaagcacaaaccactgcaggggcggggcttcaccgcactgcatggtaggggccctaaagcacccaactcctgagctgagcagtcataccaagaggcaggaaggcccagcagatgctgcacatcaccctccaccactcacccaggctcaccttcccccaacagcttctttaacaaagtcccaagtatttaaattactcaattatccagtctgccccttggtaaaaaaatgcaagctccccgcaagtatggtggtatcaaaaatggtcttcatatatctggttgtttagctctattcccatctgtatcagaactgatgcttaaagggacaacttaaaatccttaagacctcataccaaataaaccaatctcacgaagacccttgaagatgcaataaaactctgctcacagggtcaacgcattcttgtgttataccagctaattgagatttgactgtggacttttggagtgattcagaaagaagggtaatgtcaaatgagtcattttcctctactccggtctcagtcttagctcttggccaagataacacatcctgacttgccttcataaaagctgaagcaggccaggtgcagtggctcacgcccgtaatcccggcactttgggaggccgaggccggtggatcacctaagtcaggagttcaagaccagcctggccaacatggtgaaaccccatctctactaaaaatacaaaaatattagctgggcgtggtgcaagtgcctgtaattccagctacttcgggaggctgaggcaggagaattgcttgaacccaggaggtggaggttgcagtgagccgagatcacaccattgcactccagactgggcaacaagagcaaaactatctcaaaaaaaaaaaaaaaaaaaaaaaaaaaaaacaaaaaactgaagcaaaataaactaaaacccaagtaaagtgagtttgtaatgtaagtgctgcattttcttctaccttcctgcccacggccgtttcctcatttcttccattgcctcaatattaagaaataaacagctttaggaaataaaatggtttttcctgtgaccccacatcagtgtcacaacattcaaggcacagaagcaactcccataaagtgctagctgtttagagtcaccgccaccaaatttgctaagtcactgggggtacggttcttaaagagctaatgatgctctttgctaaaatatgaatacaacattatttctaatgcaatgcttaaaatgaaagcagttgtgctagacaggagaccaacatccatacattttggctcaagtcagtaactgagaaatgagttcaagaaccttctttaagtcatcattaatcaagtcccaggagaggcggctgtgcccgctacaaaagggccaggaatgaagctgcacagacggcattagctgggcaccgggctctgccagtctacacttaagctcttaaggcagtacagagaaccaggtgacccggaccaatcattttttaattagttgtggctttttttttttttttttttgagaaggagtctcgctctgtcgcccaggctggagtgcagtggcgcgatctcggctcactgcaagctccgtagttgaggcatttttaattaggggaaatgcatgcttcattatctgactcactgaaaggggagaagggactttttaagcctgcaagaaccacaatgtagtttccccactcacccagcgaagataattctctcaaaagcagaataattgaaaggttgagtcatcttccccacagagccccactcccccacagatttggtgatacgttacatttcccttccccacaagacagcccactcctgcccccacagcacctcaggccaccaaagggcaaattatttgctaacaacgctgcagcaggggagtcctgacctccatctcctctgtgacctagggagtggccacaccctcaagacggccaactgggggctactgaccctggctccaatcctaatctcaccagcaggcagagcaagtcaagggctggaatgttcctctggtaggtagtattctacttacagcggaacaccaaaggcttaactcagcccctccttgcctgcctttgtctacaggtcccaatctcagatgaccaaaaagcatctgctccaagcagagagttggaaagttacattatcagttactttgtcaatattaaaccagatcccttggggaactggtttccaggagacacgtggttattcagagagcctgattcctcacgattagctgtaggcgtttggggacagtaggaagacaatggatcaaggcccttatgctcaattgtggactaagtaattgtgctcaaaaataatatattcagtcacaggcttttcttctgggtatttcgccagagattagacacttactgagtgtgccacatccacgtaagcatgaatcctttcaaccatcatgaggaaaatgttactcccagttttcccaggggaaactgaggtgtagaggctgaactccttcagagtctcaggaaattaatgagtcaaacctgattctaaacgcctttttgacaacttcccaatgtctctctccacgtggaccttcactgtcggcctcactttaacccgtaccagcaaaggtccaagccctgggtctggagtacgtagattaagaagccaagggatgcccttacatgactgagtctttaaatgatcttcagactggaaggtgctttcctgcatcttctaatccagtgtgcttgccacctggtgagaccttacgaggcttcctgtccccctccctcccacagcaggaagctcgtaccccactcccagcattacaggagatacattttaagattgtgagctc

SEQ ID NO: 990 - DNA, 32359 bp, Homo sapiens; identical to SEQ ID NO: 984

SEQ ID NO: 991 - DNA, 32359 bp, Homo sapiens; identical to SEQ ID NO: 984

SEQ ID NO: 992 - DNA, 2677 bp, Homo sapiens
cctttcacttccggcctggacctgaggctcctgctacgtgcagcggattgtgccgggcgtcggcaactgctcggctcgccagactgttcacgggcccagtagagcagtaaataaccggccacccctgcggccgtgccggccgtgatggaactagacagctcacccgactcgagaagaacggggtggggaggcgaggacgcagggcgacctggagaagaaagtttcccagatggctctagggtgaatcttgaatgttgtgatgcagctcgccaggcctacggggaggtaaaggacttgccaggctgaagtaacttcagaagcagaaaaacggaggattaaaaccacaagtcgttgtgatgtgaaatttcgtggggcaagaaagggccggaagtaggtagtctgcacggctctgctagagagaggatcacaagatcacacaaatgtgatctacttatgactggaaaaaatgtgtactttcagagccagcttgaggcattccattgcctccaatatgagctcttcccttcaagattgactataaatctcttagttacaactcacatcccctttccccagacaaaaccccacatagcccggtgtgtatttactgaaagcagtaagatattgctggggctttgggtgcaagatggagagtgctcagagataatgacaggggcctggtcctgcagggccttacgtagaaagtcaaggaatttattctctgagcaattgaaaatcatcccgaaagatctgcattttagaaataccatgttgagtagttgcataagaaaccagttaggaggcccctttttattggaggtagagaataatgagagactgaactacagaagtggggaaggaagacagctgtagatccaagaaatagtatccggaagagaggcttgagaagtgatcaaggagaattccacagttatcagagaccctgtcttccttgttcaccactatattaccagaacataatacaaataatgctattgttattgggtggcattatttggttagtaggtactttttaaaatttttaaatttaattttagtattaaaatacatgtaaagatcaggaaaatgaacttttaaaaataaagggctttcactgggcatgataacacatccctgtagtcccagctactcccagctattcaggaggctgaggcggcaggatcacttgaaccaaggagttcaagtttagcctgggcagtatagtgaaaccctttctcaaaaacaaataaagggctactgaaataatgataatttatattcaggtcgtaggtacctaattactagttacacatacatggctttgatgggaaatcaaagaaacattctgacaatacagagattcatcaagcaatttgtctttgaaagttgattattcaaaaacagagcttgtagcaaaagaagcagaaattagatcccacagtcatcaagtttcagatcctaaggcttgcattcttacaccaatttcttctttgcttaaatcttaattttcatcagcattaattaagtgtctgggtactctgccagtcaggagagatgttaccaaaggtacaggatttgagaagtattgtcagaagagccaagttcataatcaggcccacaggatcaataatttgggggagtgtttagagcagtttcaaagatgagagcagtagatcaaagtagaatttcaggactgagcacatgccaaggcacccttttatggatattcaacctgtaccagaagggaggagtcatttacttaaaagagttacacaagatgaaagagctagatccaaataaagacgctataaaaattactaatggggctgagcatggtggattacagggattcagttatttaattattactgaaagagctcttttagacttaaccagatttttaaaccaaatattcttatgcatacataaaagtaagttacacaagataaatttgttgatcttccaaaatatccccccttactatacactagagtggggttttggcataatggcagacaaatagatggaacggaatagagggtccaggaaaagagccatttgattattactccatttcaatgaagacaccaatttaatttagtggggaaggcaagttattttcaataaaaggtgatgaagaaaatagatatccctatgtgggaaaaatgaactatgatcccctacctcacagcatacacaaacttaattaaaaatggatcacaggctggggatggtggctcacacctgcaattccagcactgtggaaggccaagatgggaggatcacttgagcccaggagttcaagatcagcatgggtaatacgaggaaatcccatctctctttatttttttcttttttgagatgggggtggttaatgggtacaaaaaaagtagcctgaataagacatactattcgagagcacaatagggtgactatagtcaataataattgtatattttaaaagagtgtaactggattgtttataactcaaaggataaatgattgagggtatggataaccccattctccatgatgtgcttatttcacattggatgcctatatcaaaacatctcaggtaccccataaatatatacacctactatataccaaaaaaacttaaaattaaaattagactgggtatggtagctcatgccttaatcccagcactttgggaggc

SEQ ID NO: 993 - DNA, 32744 bp, Homo sapiens
ctagagaacaatatgtgtttaataatatttaaataatggttgtataaaattgaagcagcaagaaacccaaaggagaatagctctaggggagggaggtggatgagtatgcatgggggagaggctcttctgtgaccaggttgggtctggagccctccccactgtccagaacacctccaagcccctacatctttttccatataccaacgccttggagatataatgcagaagtgaagtgagcaggctgaggattagggcaggtgtctggaatatggtcaggagtgggaggggagtgacatagctcacaggcaaggcagaacagcacaaaggctataggtttcattcccagccctcaacttaaaagacctcaggggcagacactgactccagcctggctgtgcccttaccctaacgccattcacacttttttttttaaacacaggtaatccatgtttattatagaaaaatgccacattactctttattgaatgcgagcgccagcaccggcccctttctctccaagcacaggggcacgcaggcaaggggcacgaaggcaaggggctccgtcccctggccaggatgcagtggaagcctggctccactaccattcacctacagccagcaccctcctcggtgcctggggctcaggtctgttcaaactcctgctcacagaagcctacattgaggggttgggcctggacacctcgcctgcaagaggacatgaagaaatggcaagataagcccctcagaaggggccccagcaacacttttcacaccagtcaacagtctctccttccccatttcggtgactctcaaactgtcactgtacaccaaatgcacctgggaatctcaattccagagattctcacctggggtggggcaaagtattggcaagaatctgcaagctgaacaggtgcctcaggtgattctgatacaggtcttggagatccagaaacgttggcgacatctatttatatcctgcccatctctgtaccctaaccccaaataactcaatccctttagaatatagatggatgtctgaaaggcagccaatgctcttggtctacttagccctctgttcctgactctaaaatgctgtaaatatggtggcactgggggacttaggtgctgtcctgtccatgaacatggatgcgaaatcctgtccttgggtctcagtctataacctgaccaatctccttaggggacctctaggcatgcttcccttatcatccaagtaagcaacatgcttagagaaccagctggaagttacccagtgaatgacataattgaggcttagacaccatcatgcttgactctcagcccaggactctgctctgcactaggctatgtcccccaagtactcaagacctagccaacgaaggaatcagggaaatgactatcttacacaggcacatccctgacagaggcaaaggtgtcatgacatcctgtaagtcagcctggttcaaatcctgcttcttagtgactttgggcaaggtcctgaactctgtgcttcagtgtctatctctaaaatgcacctgtctcatggggctgtggtgaagactaaatgagacaatatttgtaacaaacttagcacagtgtttgccacaaaatacagttgtccctcagtatccacaggggatttgtttcaggacccccgtggataccaaaatccaaggatgctcaagtcccttatataaaaatgacatagtatttgcatataaccaatgtacaacttcccatatacttgaaatgatcttagattacttatacctaatacaatataaatgctatgtaaatagttgttatacagtattttttatttgtaccattttttgttgtattttttttttcctgaatactttttatcgcagttggttgaatccgtggatgagggctgactataagcctctgtaagtgttagctattgttaattattgtcttcctctctctaaggggttccccagccctggatctggcctgctccgccttgcgaaggccccacagcttgcttacctcagcaattcacagcggaagtgtgacaaacgttcataggcaaatgtcaggtcagatgtcaacttgttgctccacagcctttcggcaacagcccctgctctgggcctggaggaaaaggggcatgtgccagattgggccctgtattccctgcaaaggtgctggacatccacaggctgctacctcttgtctaggcaccctggactcactcaggccaaaggaagtgatcaataccttgttatgagccacagccaggttggatggctcccagagagttctacggctcagctccaccttcattaaaatgtgggtagcaatcccactctcttcctctctcaaagatatgggaataagaataaaccttaaagccatcattaaccacaatgacagtggcagcagcagaggtccttaaaatgtaaactttgcacacccaaccatacttggtaaggctgcagtgaaaacagcagagggaagccttattacaggaatcatggatgcttgtgctgggtcttgagcaactcacctatgttctccaggcctcattatctctctgggaagtaaggttaacaatccctatcccacataccaaagggcagctggagggatatagacggaagtcatgtggagagtgaatattgcacacaaatcttcagaaggctcgttgcacggcctgctctctctcaggcctgaaagaagggtactagtccagaggtggctagatgggattgggtctctaagggagaactcctgctctcaggcccaaccctccacctcccccccgaaaacccttaccagagcctggggaccaggtttgtgttgtccacatattctccccacatacaagcctctccaccaatcaccagagccttctgctcaggggtacctgagggaaaacaagcaacaacagtctggtgatggtggggtaactccagggtccctctcaaccaccttcccaatgtggccctcaccccagctaagttgtttcatttactaactggaaatgtctggcccagaccttcctgcctcccatcctgtgccccaacccagcctcctttggttagcaaggagagctctctgctttcaccttcaaatgccaggggttccactatgtagaaatccttccagtcagggccataggatatacggttcaggtaccagggggcagagagaagggcccggaagccggccttggtgaccagttccagctccttcatatagttcactggaatatcctctcgccacacctgtatgattgtgtctggctgaatctgttataaaaggtcaaatggcagtaaggacacaaagctgaggagattcctgggccttattcatacacaggcaacatgggacaacaggtatgtgctccctctgttccccagcagcaaagtatgtctctgtgactcctgaccattgagctcacacctcaggacagaggccaaggaatccagggccctaagaggcctccctgcagctctcctccccgtccctctgcagcctccctgtccacacagagctagtaataccagctgtgagctgagggaggcaagcagtgggacccaggagctgccatgtccaaaagtctccagatgtttctggggacgggacaaggttcctgaagagtccttgcatgtgacaggagactgggatcttactgatcaacaataaaggagaaggtaaccttggtcccacagacccagaagaccctcatctatgatttaggaagaaaaatccagcctatccaagtaacctaacagcagaaatagttcttaattaagtttgtagtgagggaagatagaaactctgacacataaacccagggctcataccacagcggcctttggtttttttgaggcagggtctcactctgttgcccagggttgagtgcagaggcacatcttggctcacagcaacctctgcctcctgggctcaagcagtaccccaacctcagcctcctgatttttgtattttttgtagagatgagggttttgctatgttggccaggctggtcttgaactcctaggctcaagcaatccccctgccttggcctaccaaagtgcttggattacaggcgtgagccactgcacccagcactctgtggcctttctagagagaaaaggagagtgctccgaccattaaagcccaatccaaaccaggaggatcagtctctgtagaggcagggaggagctggggagaccagagggaggcactgctggtggcttcttctcttctctgccccggctcacctttactttattatcaaacacctcctgccacaccacatagcccttgccataagaagagacgatgtccagcagcctggagaggagaggagtgtctagtaagtgtctgcttagctcagatgggttctagactgtttgtgccagtgctctaggggttgagcctggccaggggcctattcctcattaagcagtgtctttcccctgggctgaaaaccaaccactccaaatctgaaaggatgggacaaaggacaagggaaccctgcagggaccagacagtggccaagcagggcctgactcggtatggaaagggaggaccccacaggaggacccccaagggaccccacccaccctccttccttcctcacgtctggatgtagaaggactccagctgcttgaagtcctcaccgaagcctttcttcctcataaagtcctggatctctgggttggacttcctgaatcccaagagaaaatgaagattaatctttcaacatcctgaaagcctaatgcctggggattagtcacctggccccctataacttcctcttttcacctgaaaaatcaaataagcaaggatctcagaagccctacatgtggaaagtgtggccaagcaaagttatgtgaagcaggtgggctgttgacacaggctgagaaaggctgagtctggacctgaagagttttaagttcaaactcccaaagagaaaacatattaatcctctctggactgcaacatgagaatccaaggtcttaacttgaagctccagcacactggatttcggctttcctatctgctcttccagttggatgacaagccttgctgtctaacacctgctgcagatcccttgcgttatgacgtccacattttgctcacattgttctccttctggaatattttcccctgctcacatctccaaaaagccaaattgatttccccagattcagctctagcgccctcttctcaaagaagcccctcagcctcttttgagcttactagaaccaagggtttggactttacaactgaatactaattagacattgtcacctattagtcttgaattctgtgtcttgactcttcaactagacaattttaagccttcataaacagggattatttttctctatcccgaacttttccaagacaattctgtgcccagggctgttttttctatcaatacctcaaggatatgagagtaggaaggaagaggttcacagtgaaagccttgccaaaatcaggtaggatctctacgtagatgggcagaggaaggcctaagacctgagcaatgtgagcccatacagacccctgagagcagcagctgagctaagcagcccctcgggtgctaacttctattctgagtaagcaactgatcaggccacagtgggaagatcaaagggctcataccagcaggtgaaatcaacctcatctcctccaagatgaagataaaaatctgggaagacagagctgacttctaagaagaatgtgctcatgaactcataggtattattgagactgggattcactggtccaaaggtgccagagggctcagacccagagtagcaaggagtcagtaatccagggatacctaagccaagagaaaaccccatatgagtgtcacaaatacataaacccccacgcacagtcctacacgtaaggacacgagtcacacaaagcaagacaagtgtattcataaacatcacacacatttaggtaggcacacttaggcactcacagacactggtagtcaccaccatttagtcacagtaaaaagatacaaatatatccacaatcataggcagaggctaagttccagccagacaactgtcagtgcgcacactcttgcctggacacactgcttctagcaggtgctacccttgctcccaaggctgctctcctcacaggccttgaggcagagagagagcctaatccagccaaactggcaaaatctttcttctctatctcctcctgtaggtggggtcaaccatcacccagaatctttttacatttgctaagggatatctcccttggcccagagactacttcctgacgctgaggtcacaagatatcttcagggtttttttttggttgttgttgtttgtttgtttttgagacagagtcttgctctgtcgcccaggctggagtacagtggcatgatcttggctcactgcaacctctgcctcctgggttcaagcgattctcctgcctcagcctcccgagtagctgggattacaggcgcctgccaccacgcctggctaatttttgtatttttagtagagatggagtttcaccatgttggccaggctggtcttgaactcctgacctcaggtgatccacccgccttggcctccaaaagtggtgggattacagacatgagccaccacgcccggccaatatcttcagttttctatcaggccagtagcccttttcaactgtcatttaacctgtgttgggggctcacactggagggctgagggtatacagaagaaagggagcaggggtactgactgactctgacctctgcaggctgcccttgggcttctttctttcagattctaccctggtggtcagattcctcagcatccactctaggcacaactacctgcaacggcatctgagaaaaatgtgcccttacatagtctaacagtacatattttaatagtaagaagcagcctccattgtccaaagtgagttcttcctatctaaattcccaggtggaagaagtcgatggaaaacattcttctaaggaccaaggctgggatatgccacttccatgagccagtgccctgaagcttcactctgagcataacaagcagagtccctctggtcccagacatcattcttacctggtccccaggacaaagtgtggccaggagtgtcaaactctgcaagcacacggataccccggagccgtgcgtattcaatgacctccttcacatcctgtgctgtgtagatgtgggtgacagggttgtaggacccctgaaaggcacaagacacccttcaggttcacacttcctgaaagctagcagagtagaagatactcaaaatgcccacaagactccccagatatcagaaaacctgcccatagccctttggtgtcagggactatcttcaaaaaacttgatcataatttcccagaagttatcacatctgttttatctgagtatcataatgccagtgagataatcatggtaggtattaatactatgtccatttaacagaatataaatacataaaaagggaataaggccagaagagattctctcctgaaggtcacaaggcaaattatcggcaaagttttggacttgaactcaagtctcctgactccaaatccagtgtccttcccctatattggtctaaaactggctggttaggatgagagaccctgttcttgccagcagggccacagccagattcagacattgacccataaacttggtctgagtgaaacgggaacatacctttctcatgagctctggaaaagtgaagctctcatatgggaaggaaggatcatctaccagatgccagtggaacacgttcaatttattgtacgccatgacatcctgtaggttaaagtgcacactgtgaacccatcacagtctctccggtttcagcctcaaacttgcgatgttgggcgagctctcaggccgctccacacacccctacaggcttgacctgcctcagctctcaattaagtatttatggggtctatcaaaccttcccatcagggagggatggcatggagggaaggcccagcacacttctacttttcccagaacacatccaaagatggatgatagaagtggtctttcctcttcttgaaataaattctggccacattaagaggagggctgcagctactgtggtagcctggaatcttccaaaagcctgaagatcaatacttcctcttgccatttgtgttcggttgtctgactgatgttaagcccaactgtgagacctcctgggaacttagtagcctcttaactcataatctcagaagcaaaggctggcagatgtgtggcctcctttggttccgtcacaggagcaaaggaaaaggcagacacaggaactggattgggaactgtcagataagactgcacattaaactcaagagagttaggaacttccccaggaaaggctttttttttttttttttttttttttgagacagagtcttgctgtgtcacccaggctggagtgcagtggcacaatctcagctcactgcaacctccacctcccaggttcaagtgcttctcatgcctcagcctccttccttccttcacttatttatttatttatttatttttgagacagggtctctgttgtccaggctggagtgcagtggtgcaatcacagttcatgcatccttgatctccccaggctcaggtgattctcccatcacagactcctgagtagctgggactacaggtttgcgccatcgcgcctggctaattttttgtattttcagtagagatggggtttcaccgtcttggccaggttagtctcaaactcctgagctcgggcaatccacccgccttggcctcccagagtgctaggattacaggtgtgagccactgcacctggccccaagttaaggctttgaacgtctctctcctatgaccttgttctaactaaagttagctctgccggccaggtgtagtgactcatgcctgtaattctaccactctggcaggccaaggtgggcagattgcttgagcccaggagttcaagaccagcctgggtaacatgacgaaaccccagctctacaaaaaatacaaaaaaaaaaaaaaaaaattgagacgctgtctcaaaaacaaatatagttagctctgccaatgaagccaattcccctaaacatttgtatccctggaaacagcctgaacattgatctacagtagcctgtaaggtagatttaagtcactctgttattttttgagtcttggagcagctcatcttctacatttttcccaggagctcatagaattacatacaatttttttttttttttttgagacagcgtctcactctttcacccaggctggagtgcagtggcgtgatctccacccactgcaacctctgcctcctgggttcatgcgattctcctgcctcagcctcccaggtagctgggattacaagcatgcaccaccatgcccagctaatttttgtatttttagtagagacagagtttcaccatgttggccaggctggccttgaacttctgacttcaggtgatccgcccacctcggcctcccaaagtgttgggattacaggcatgagccaccacacccagtccatacattccctctctaactctttaagaatttggaacttggtctgtccgttgctccatcaccctagaactcttaagtgtgaagaaggccttaaggcctggttaccagagtgtccaggatgctagagagtggcaggtaatggcgagatgtatccaacagcaagccccggtgaggaaagcggggaaagtcctcaatctcagtcttgttgataaagaactgtgcagaacaaacattgaacatgtcagtttcaaaggaagcttactatgggggcacagggagatgaagacaactctcccaggattcttaaaaagccaatctgtgactgttctcagggtcgctctctccctaaatgctccccacctctataaatgaccataagcagccaccttcccagagagcaattgtccaacgccagcctaatacaactgtcccaaacaccactcagcctacaaattctggattttcctgttaacatagtttattttcttcaaagcagtgtggcctcaaggtcattactaaatgatgactcagggggaccaaattacagtgattccaaacagaccaaatctaccaaaccagttttccactcacatctcctcttccatttctactggggctatctcaagccaccaggatcctaaggcaaaacaagatttttctaggattctcaatattgggatccaaccccagagatgaaaaaggagccctttttgagggtccacacttactgtgccctcagcagatttccaaacaagctggctaaaagtctccagacctaggaagatgtagagaggcagagtaaagactcagggagtggaaaaagagatgtctctatttggaaggttctcaatgtagcagagcataacatttgggtacacagggaaaatggatgtagtgtaggcttgacgatttttaacactgatgaaaaggggatattaggaagccactatccatctttacttctgtatttcattttgggagatgtcagagtaagggttttagtgcccttccttacaacatactaaccttcaaaacccacatacctcttatctatatttcctgtgccttcacaagaatattgagaagagaggccaagacatatactcatgaggacagacacagagacaactcagcctgcaagagttggacttttcatggataacccctatcaggagctaagagagctgagaaaaggggtcccagaataaattgtgagaaagtgatcataagcttgggtttccaaggagcctgggttcatggctggacctagaagataaaaaaaatcatccactcttcctcttcagagtctaagaagagacccagctatagggagctgaggtgtggtggacagcaactgccccagaaggactcccctagtccactgacactgtctcctagagtctagcaaggcccacacacaggtatgttgaacccagagtattgtatgttctcaacagctggggcccctcttctggaaaccctgcagaagccccatgaaaattatcagagtccccagtttcaaagtgaaagaatccatgagacctcagcagtcactcagcacctgatttgagcagactgctagtgtactgttttggcttctccccactctgactctgacacccagcattctggagttccaggtcctcccttacctctagcctgactcaccatcagcacctgcatgaaaggtacaagagggcaggaaggggaggcagcatgctgttgctccaagcatagaagtggagcaagggaatgaagacaaactaaagcaaggtgtggaattccgagagagtttcccacatcattcaccagcagagggtttaccaaaagtgggagagatatttggctaagtctgtatctaggcaccaaatgccttctcagtaaacccagaagaagggcaagggccaatagtttagccagtaaactcattttctccagaaataatgtagttctaaatatttcactactatttatctttttttttgcatgtatctatttcttttgttatagttttccttttaaaaaaacctttccaattacatgtctttagcaagagctggacagacagtgtctgtggtagcatcattccccctgcccccagctacctgtcccctgctggcacctagaacatcagcccacagactctcctactgcttcccagagcccctgactagggcagcagcagttgctgatgctgcacagggtaaaacctgtcaacttccagggacaattccacagagacgggaaaacacgccaattgttcccataaaaaaagcttcctggctgggcgcggtggcacacacctgtaatcccagaactttgggaggccgagatgggtggatcacttgaactcaggagttcaagactggcctgggcaatatggtgaaatcccatctctactaaaaatacaagaattagctgggcatggtggcaggcacctgtaatcccagctacttgggaggctaaagagggaagattgcttgagcctaggaggcagaggttgcagtgagcagggactgggccactgcactccaccaacaccaaccttcccacatcatcctttctctctctcttttaatcagccccaatttgttacctcggagagctccccagacagtctcagagaggagtaaacactggtcatcatttatggtcagggtatctgaaatgacagaaatgaactcatttagttggttaaggttttctattctcagattatagaccagatattctatataaatcactggactaaaaaaaaaaaacagtaagaccatatattttaaaaaatctttcaatgaggagatgtccccagagcaagacagctgtaggatggcctggtctggggccagagtgggagggtggtcaccacagtgactctgtagaccctggatgatgatgtacagcaagagtcaggctggagtggaggtctgtacaaagcaccacctacctcatgggtcagtttccacagcagaaagatgaaagaagtcttctcctggcaaagggaacagggatgcctgcaggggtgagtgcagcacgcgatgctcccaatgcctttgtaatcaccctcctttccccttcctctatgcttcagctacttcctccaagaatgtgaggaaggagccaaactcaactgttcactttggagactgagaagtccccaaatgctgctcagggaagacaggaggcagtcactggactaatgacttaacttcatctcagtataagtgaccagaacccctgctttccccagtgtagggtctattagagaaaagtagcaaagtatacactttcctaaaatagaaatgtattcagtacaccaggtagaagtcctgtgggactcagtgaagagccagtgtgatgttccacagccaacctttagcactggttaagtttctgcataggaaaaactcatcttccatggctctcagcacttggtgaccctcggtccccagggtcaagggggactccaggccgagcatcagcagtttaggccaggccatccagagttacagcttcagacaagtgtttgctcttctaagacagggaacaggatggtacttacaattctccactgactccaaagtaggaagctggttacatccaggtgtgactacagagacaaccaacacattcttctccagtgtatgccgtttccctaggaagacagggtaagcttggtgcggccaacctgccattagaagcaacaggcaaaaccaagaccctagctctagtccctcagctcacacgcctgtggtaaaggaaagggaggacatggcatttacccttggcataggcagtgcctgatcatctgttcagctgtctcactctcgttgtgcccctcttctcctcagtagctgccctgacccatgtctgaatgctctgggtgacagctcttcttaaccagggctctatatttctgactgcccttggcctgtaccaaacaaacaactccatgacctcaacaactgcttctgaatgaaaggcagctctagagcactgctactccaagtatggtctgcagattagctgccaatttgcaaactgtgttactggctggtcactatatagaaaacttatatgaagcctgaatgtaaatcaattatgtcagagtaaacacactgtctagttctaacattttttcatacaagattttcttgatgaagagatcagtcttacattctggtacatatgcttcttatctcattgaagattggcatattaagtagtactgctcttgagggctccagatgaagggtttccagttttgcaaaagcctaggagctaatggagcagatgacagaaggatcaggcagaggaggcctgagatgatgcaactgatacctcagagaagatcagggtcacccacccatcttgcttccttccttcctcttcccaaacaggttctctatccaaggtagattttaccctaatagtggagggttgaaccaacatagtatctaatatagctttacagacccttgtctatgcagaaaaaatgccaaagccaaaatatgaatacactgtctcttctcaccctcctgctggttcttccctgtgattttcagggtggctctggtgttatagccccaagccttaacttaatgaacccctctctattctattctttcctggagccatattcatcccactggcatcacaacatccatgacttcttatggcactacaatgtcagggataggatggcctggcagaaggcaatgagagaattcagaaccaaactggaatctcaaatgttacccatctccaggcagaaggaatccaagcgctcagatcatctcacggaagcctgctcagacctcttgagcactaccacatggctgtatctcagctctttggtctgccaagaagcaagccaataagggggcctttcctaccatcatgaacaacacattctttcccttaccagtaaataccctggatccccacaccaatacctgcctacattctgcaaagaggagggaatctgaggcaactctgggccaggtcaattcacagctccatacttgaaccctaaaactacattgttacaacacaaaaggacaagcagaccttcaaggcaaagaccacactcaaggcagaatctgcagggccatccaagcagacaggctacaaacccatctccacaggagactctacagggagaccaatgaggacttaacctaggagcaagggtgaggaaaaactataccccatcctctgacttcttgcccccactcccaaccccacacatcatggagccccaatatcattgtgtggagaattcatctgcatatctacccaggcagccatccaaaagacagccgaagtcctgagctttagttctaatcctctggggctcagcctgccacataaggagaaatcacaactaatccatatgcaactaccatggctcgctgccctcatgacaaaataagagaggccacacaaacaccaggtttatctgaactattacttggaagacagaaaaatacctaatctttcgatttttaaaaaatttatttttctaaaagacacctgcactgtactccctaaatctgtagtcttttggagagtcacagactcctttgcagatctgctgaataggaaaacactttttttcccagaacaatgcccctaatttaagggctgtttctccagaattacaattcttccactccctgccatcaatctcatggtgaagaatccctgtccgaagttctctcagtgactcatctgggtttgggctgaaagaagtagatacgggggcatggctgctgtttaaacaaattatgagagggatgtttgggggaggcagcaacatgagagctggcaaaacaggagggacactaggtcattgtaaaggatgtaaatagggtatcaccactgtggttttccgcctccaagttgctactttgcctggctatgaagagggcaggaaataggcaggggacagtagtacagccgcctctacacacacccgcccacaccctgaacactgagaagcaccaacgtgtgggaagcacagtatggcaaacagcccggtcagccagcaatgtcatgagcacatgtgccatgagtctggctggaacagcaggaaattgagaagcctccagggcttaggaggtagcatgaaaaacagaccagagggctgggaaatcaggacaggttgcttctggttctggttttgctgctgccaagctgagcaagtctcagggctcccatttccttccctgtaaacaatggcagggtgggaccagattccagctactcctcttcagatctaagaccttgtgattccatagacagataatacactccagggtcccattccaggaccacagcctgctacctctgcagctcactcatctccctgctttcatgtaaacctactcttctctttgggttcactgaaaactttgtatctttttttaaaatcaaaacagttgtataggcctggtgcggtggctcaggtccatgatctcagcactttgggaggctgaggcaggcggatcacttaaggtcgggagttagtgaccagcctggccaacacggtgagaccctgtctctactaaaaatacaaacaaattagctggtcatggtggtgggccctgtaatcccagctactcaggaggctgaggcaggagaatcacttgaacccaagagacggaggctacagtgagcagagactgcaccactgcaccccagcctgggcaatagagtgaaactgtctcaaaaaaaaaaaaaaaaaaaaaaaaaagagtagtacatactggttaaaaaaaaaatcaaacagtactaccaaacagtagaaaatatttacgattaaaaaaaaaaagtatctttggtacccttccttagtcccctcagtaaagagacaaacatcactggtagttttctacccctgtagtaccttatagagtaattttgccttattcatcacagacaggtcacctctggacatggaattctaataacaaggacgctctatcaccaaagtcctactgttgaaccttctccagactccagtactatgacccctccatttcccttctgttctcagtcttctctcattcttgcttccttccctgctggcctacatgtagtgattcatcacctcaaacgcaatctagccaatactcccaacgatctgtctcttttcttctgtcacaaccaatgggcaaaactttcaaccctggatcaatctaacatctgcctgctgtgcccctgaccccggctactgtaccctactggagggaagggagaaaaatcacaaaacagcaggactggaccactgcaaaataatggtctccatcttggctgggcccttgatgctaccctgaaaatcttctatctccatcattgcttcattctattctctacaccttcctcaagtctacttgatcaccacctcccttatgctcagcagacaatcagaagagaactttcaactatccctaccctcttcccctctcctcgctgacaaaaatatctgcaacacacacctgcctgtaccctctcctggacctccaccttgatggaaggggcttccttttacctgtgctctggagctcttctcagtctcctcttgtataaattatttccccttttcccaaagccttcaaattatttctttcaactctcatcagcattaaaatgtttgcaatcttcctggcctcacttactctttcttttgccttcctgccacaaagactccctagaggaaatgtagcctgggcagctaaggacctgaactccaaaggaagacagatctggattcaaatcttggttctaacactttctagctgcaggccttctctaggcaagttatttaccctctctaagctgcagtttcctcaactgtaaaatagggatcataatacctatataattgggctgctgggaaggttaaatgagttaatacatgtaaagtgcttagctcagtgcctggtacctcctatgtgctcatgatgttggtcatacttagtattttgtagctgcttccttacaacctatctattcctcaatccactataatctggcttccttcaccaccacttctctcaaaatggcttcaccaaagtcctgtggttctgtaaccaaattcaagggactcttttcaattcattcattcattcaacagtaatttactgaatgcttactatgtgccagggtgttgtaagtgctggggatacagcagtggtcaaaacagacaaaaatcccagctgtcagagagctaatagaaaccactcactccttctgggacctcttgacagcatcagacatctctgaccttcttgaaactaaactcccttagcttaggggacattgctctcttggttttccttctaactccttgaatatgcttcttcattcaacttctcctttaccaatcccaatgtactaatgttacccagggtatccaaggttccaaacttctctttttcccttcgcttacactctccctagacaatgtcatccactcccacagcaggccaatgactcccaaatctatctttccaagccaactcttcttctggagctctagacttgtacacctccactcaaatgtctcaaaagccacttgaatcttaaacataaaactaatctaactcttcattcctcctcctggctgatcctctctctcactttgataacagccccatctattcacctataccagaaatctccttcttctacaccttccatctaactgagtagatcacaagttcatcaactcaaaataacatttacagactgtctgatatctcaaacattgtgttaagcactgagattacaacagtaaaaatactttttaaaagtcttacaattacacaatccttataatctcttaacacatcgccattttcccagccccactgggccaaagccttaattcagcctcttgtaatttctcacctggatgactataaaaaatctcccaggcagtcttcccctgcctccaggaatacccatgtcaatctactatcctcagagatattagaatatgaagataagagcatgacagtctccgcttaaaatcttccaatggctcccatagctttcagaatacagtccagaattcactgggtaatcataagaaaatgccttgtctttttctgctcctgtgcaggaactctcacaatgaacaatgaactcttaacagaaccctgaaaatgccatattttctccatatttttctttgcacatattgcttcctccaattgaaacaaactttgccttcccgccacatctcccctaattaagaaacagctctattttccttttaggaaacttttctgttattccccccctctttcctaagaaaccctcctatgtgatcatgcagcaatgtatacatacatttttcaaaacacttttcttaagatatgctgtttatttgtctatctcctcacctaggttgtgagttcctcaacaggagggaccaatctcagtgtctttgtattcccagtgcctgacacacagcagtcattcagtacatgtttgctgaaaaaatgaatgatgttggaattcaaaaaatgcatattttatgattgtgctatgtgataatcaggcataaatagcaagtagttaatgtagagattacttttatatccccaaacctagtatttctgaaatcctgagactggggtgggcgatgctaagaagacgcccagacttacacaaagtgccttttcagacactgctctgaagacctctggatccataaattctaagatttaggtctttccacttctctgagaggaagaactcgttgctgtattagggtcactaataactattagggtaacctggaaactatcaatctttacctcagtgcacaatagcctttccctctaccacccgttccctcctgaatcaaaacacttccatcgtatcaatgtgtttgattcacagaatcccagcactatggaaaaaaaacacattggtttcggttataaagtggtagctgattttgcttctggattgaaaactaagaaaggcaacccagactttgccaccttcccactctttaatgtctactctgctcccatatcccctggtaccctcctaggctggtgccaaagtttgttcccatgcccactttcttctcttccccctcccacctttatacacatcatatccaggtttcatctcccccatattctgcctaataaaagcccattatatcattcatttcccactcatttcttcattccaaccaagatatattgtgcatttaatgtgcatcaggaactgtgctaggtgctggggcagttaaaaagaaaaacaaaccctggtccctgcccttgaggagatcacagtctagcaggagagatgaacacaaacaataattacaaacattgtgataagggctatggtagatttaatagccacgtccaggaaaggtggaaggcttgacgttgaaggggacctctgagtgggatcttgaaccctgaattggtgttcaccaagctaccaagaggagaaaaggtattccaagcctgggaagtgaattggtgtagctaggagagaagtcaaggccaaccttgtcaaacttcttatcccagtaaagtgggagtctgtgaagccgactgccctgagctggggccttctccttagtgctgctgaatttagtctagatcatggtacctcctcctgtaagttccaagattcttcaccctccacagactattaatacctacttggaagtatcactctctccagcccacagatgaatcctgaatgttcttccttcctctcattcccatcccatattttttgggtaaaagttgtacccatctttttttgggaaaagctgtagttaaaaattttctattttcccctacttttaaaactgatctgtccctcccaaccctatccccactggaaagagaacatctccctaaaattctagatctcaagggataactttagttataacattttgcacaattttccaatttttttgtaaatacataaatttattaatttttaaaataaaaatgggcccaggctaggtggctcatacctgcaaccccagcactttgggaggctgaggcaggtggatcacttgagttcaagagttcgagcccagcgaacgacttcaaggttcgccagtcaacatggcgaaaccttgtctctactaaaaatacaaaaattagctgggcgtggtagcaggcgcctgtaaacccagctacttgggaggctgcggcaggagaatcacttgaacctgggaggtggcagctgcagtgagccaagcgaccacgccactgcactctagccttggtgacagagcgagactgtctcaaaaaaaccccaaaacaaaaaacaaaaacagaaaaaaaaaatgggatcctaatactattagtttgtaacatttttccccttaccaaaatgagctgtagatctgttaatgtcaatatatatagatttacatccttcttgtaaatgttgaatataattccaatgatgagatatacattaacttacctaacttctcttctgtttgtagacattcggtaatgtttataagtttttagtattataaacaacactctagtaaacaaatattcatatatatgtatataagcaattgtgaaagatatctgtaggataaattcttggaggtggaaatgctaggccacaggtaagaaaagttttggttttgatactgccaaattcctcttccaagttactgtactgacttacacccaaatccacatatatgggcccatctctccacatctttccaacactagaacatctcaattctttttcaccattgccagctggatttaaaaaaacacatacattgtttcaatttcaatttgtatttctttttaagttttaatttaattttttttttttttttttttagagacagggtcttgctctgtcacccaggctggagtgcagtggcacaatcatagctcactgcagcctcaacctcctaggctcaagtgatcctcctgcctcagcctcccaaacagctaagactacaagcgtgcaccagcatgtcaggctaatttttatttttattttttgtagagacagggtctcactatgctgcccaggctggtcttgaactcttggcctcaagcatttctttgcatttactagccaaattttttttactcttttttttgagacggagtctcgctctgtcgcccaggctggagtgcaatggcgcgatctcggctcaccgcaagctccgcctcccaggttcatgccattctcctgcctcagcctcctgagtagctgggaccacaggcgcacgccaccgtgcccggctaattttttattattattattatttttagtagagacgatgtttcaccatgttagccaggatggtctagatctcctgacctcatgatccacccgccttggcctcccaaagtgctgggactacaggcgtgagccacggcacccagccattctttttactttttaaagttacttttcttttattgacttgttgcaaatatctgcctcattttatcccttattttttaaccttatgctttcttttgctttaatttttatgtagtcaaagctatgactcttttcctttacggtctctttatttgcttacttagaaaggcctcctctacccctaaaattataataatagtttccttcatttctgtctaacacttcaatggtcttttatcttcagatctttaatctccctggaatttacttttgagtttgatatgaggtaaggatttatttttttcccaattggataaccagtcatccttaggtatttattgactaatacatcttttcacatttgatcagaaatacttctttgatcatatattaaattcccacatatatacacatgcttgcttgtctctggaatctattttcttggtaatcttattgtcagggaaatccgccatgtcatatctctaccatattttgtcactttgcccaatatataaccccctttgctcacttctggtcctgcacttctatttttatacatgttgcttcctcttctccaccagaccacctgtgtactacatatcattcaccttgtaaaccctctgagatcttgttgtgtagttacttaattactcagcctcttctacttcctccctaactgaagcctggctctccccaggaataccacacaccacttcccctacaacatgctctgagaggcagccacttcccacatcatagggttgagatatggggctgcttctgggtcatccattccaccaccaccaagtaataaaacacctttcttctgtggttcatgtcatccagctgttaaatcttcagctctccttgttacaacactctgtagcttcctgatcacttctttattcacttaatttttttttttttttgagatggagtcctcctctgttgcccaggctggggtgcagtggcgcgatctcagctcactgcaatctccgcctcccaggctcaagtgatcctcctacctcagcctcctaagtagctgggattacaggtgtgcaccaccacacctggctaatttttctatttttacaaattagacggggtttcaccacattagccaagctggtctcgaactcctgacctcaagtgatcccacagcctcagcctcccaaagtgctgggattacaggtgtgagccaccatgcccaaccttatttacttaatactttggatcctgttgcccagtattcctctccacctcaaggctggctattatcctagatgattttcacacccaagaggaagaactaacccatgttctggcttagcagtcatccaacaacatcctcctcctcctcctcaaccaccctcctgtggttgccttttggaccttcttctcctcggaagtgttcaaactcattctcccaagctctagtactacatagctaactgtttgcttgatacctcatagtcaacacgtcaaaatcaaatttacttttcatgattctcactctacctctcaacctcttaatttcactgttttttttttgttttgttttttgagatggagtttcactcctgttgcccaggctggagtgcagtggcgcactctcggctcactgcaacctccacctcctggattcaagcgattctgctgcctcagcctccagagtagctgggattacaggaatgcaccactatgcccagctaattttgtattttcagtagagatggggtttctccatgttggtcagactggtctcgaactctcgacctcaggtaatccacctgcctcagcctcccaaagtgctgggattacaggtgtgagccaccacgaccaccaatttagctctttttactccttcccttcctctcctactattttccctatctttgttaatggcagcacgagtgaatgagagccaacattcaaactgctaagtcagaaatctgggagtcatcctcagcaccctttccctccaacctaactcccacttccaagcagccacctcctaaatctctcttcagtctttctagttttctctgtccttacagccatcaacccaacttcagccactactctctcttatctagaccactgttggcagccttttaactgggtttcctgcctctaatcccactctacagcaagccccaatgtagctagagtttagtcacatcacttatcctgttgactggactttactggccttctttgaccttaggataaagctccattccttaccagggcttattaggccatttcatgacctttccatctatcacctctttagcttcagaacttgctgatccaccctagagttgtgtacttcagctagacaccttgagttccttgaatatggcatgaaggcttctcgcctgtaggccttttccacgcgcagttctttctatgcggaatactatcttcacccccactaacttctacttttagatctccttcaacagctctctaggaaagccttttcaatgtgcactttctccttttccccccatacacttaggtcaggtgttcctcttctgcactcccaaagtaccttgtgcttcagttatcatagaaaaatatcacactctgtctgtatccccacttccagaaactgtaaattctttaaggacggggaagttcaatttaatattccttggacctagtactattgacaattaaagttacttaataaatactacctgtactaagaatagatgggaggaaggaagaaatgctactggaatctggtaacaatgggccagggatcaaaatattcataacctgagtgcttatgagtaactagatgttagaagttactacctatttgaagtaattaacactaagatgtgattagagcttaatcctgccagaggccagtagttttccaaattgctaactggactgacaaagacgtgtatgagtatattacaagactgtacagtgacaaaagcaaaatttatgcatgactggaatttctgctccatccctacaagctgtgtaaccctgggcatgttacttagcctctatgtctccattctcaaagattgggataacactgacctcacagagctgtttatgaagattaaagggcaataacatacatcaagtgccagacaataaatgctagtttccttccgtgttctacttcccttttcccaataagacagttttgccccagcaaacctcgactctctcatttggccagaggagtcctggggcagggtctcctatggcaaagccacactctaggagcagcttccctgaagggtttttcatgagcctcttataggagactgaaggcttcactactgtgagatgccattctgtatatgaacaggctgacacttcaaaatacaagagggacatggccttagaactctgaatctcccccaacctaggactgcagctccaggcaaaacaacaaagccactaatgtggaatcctagttacaacaaggacaaggttgaacaaacagtaagtagttaaacttttcatgcataacagtgtacctagtaaggcatctctcttaccccctcaatcccaagagctttacaaaagaaggggaaggctgcttaatgacagctgacaaacacccatacgtcctgtatttttgagtatacgcttccacagaaaggagctctacaccacacccaagcctaaccagcctcaagatgtggacacaacaatagcatacagcagttggctggggatcagggctgagtgtgtggccaggaagcttaagcaaatgccacagcttgaaacaggaacaaaggacaagaagagagaagactcaagttcctgacccaataatgggttttattcattacagccaggaatacagaagaaaatataatccatttctgtattacaatggactgtaaacatgtaaaccttgagacagctcacaccacagaaaactcttcacacatacacctctctgacccctacagacccaacctcctttcttcagctgactttgttgtcagtggctccaaaaaggtcatggaacctcttgaggatgatgcaaattgactctattttatcacttattttcaggaccagtagaagaaatttaggaaactgcagaaacataagagtgatccctttcttttgtttttgtttctaggtttttgtttgtttgtttgtttgtttgagacaaggtctggctctgttgtccaggctggagtgcaatgacacgatctcagctaactgcaacctccacctcctgagctcaagccatcctcccacctcagcctctggagtagctgggactataggcatgagacaccatgcccagctttatttcttaaaagaagtactggtaaggctgtaaaactcctttccctctatataacaacaggaaagggattgaggcttatgccttgaacaggctaagaaacagacaacatgccctagcatgagacggttaaaaacaaacaacaacaaaacgacaaggtatccattgtcaaaaaccttccaatgctatgcttctcgctcctgtttggaggtaaggaactggggtagaaggaaatggaaggaaaggcatctctggggcttggacttttaatttttattgttttatttttaaaatcaccaagttcttcccactattataccctcccttaaagactgaaaaaacattcataactattttcttgttatcctcggaaatgtctggaaggcaggcagagttaaaaaaaaaaaaaaaaaaaaggaagtagcagcaacagcttggaaattaggcaattagtctgaaggcacagagttaaggggttaataaacactttctcagctgactcctgaatgaatcatgttccacatcctgagtcctccaatgtatactgtgttcaaacagaatatccaaagcaggggaacacctacagctcacagaaataaaactcaaatttttcataaaccaggcccaggctacccacatacaccttgatcaagtttagcttcttggactcagtactatacagggatactagaaaagtatcatgctttaggtaataaatggtggctcacacctgtaatctcagcactcggggaggccgagacaagaggatcgcttgaagccaggggttcaagaccagcctgggcaacacagtaagacccccatctctacaaaatgcaaaaaataaaaaaattagctgggtgcggtggcatgcgtctgtagtcctagctactcatcagtgaggcgggaagactgcttgagtcctggagttcgaggttgctgtaagccgtgatcacaccactgcactccagtctgaatgacagagaaagacctgtttcttaaaaaaaaaaagaaagaaaagaaaagaaaaaaacagggctgtgagaagagaggctggtggaagactgcaggccaagctaatctaggccctgggattcaaaatgaaatatgacacttattttgcccttcaactaaaaactgtgcttctgccatcaccttctttctaaagacaatttattcatcactgtatttctcctatgtatccctcgttctccagaaaccccttcatgagaaaaagtaattctactacaaaaccttcttcccgtgttgttttcttcctctttgcttttaaaacaataaacttagtggcaatcatctttggcaggaatatgccttgtctttgccgtgggaaaggttaaagtatagttagccgctagcccaattaaagtggagagaactaatcggccttattctttctccccagcccagctgcttgaccttatctgtttccctcctagatgcaatcccaatgcatctctcactgcatgctgagttaagagcagcacgagttgggatcacacaataagcagcatagtgtgattatcctttgcctggaatcacacacttacactccaaattggtaacctgaaaggaaaggtaatcctcaatgaaaacctgcaaatcatatctttttgatgatcttctcagacctgtaatcccaacactttgggtggctgaagcaggcagagtggttgagcccaggggttcgagaccagctggggcaacatggtggtactccatctctacaaaaattagctatgcacctgtagtcccagctactcaagaggctgagatgggaggacagcttgagcctcggaggtcgaggctgcagtgggctgtgtttgtgccactgcactccagactgggtgacaaaataagaccctgtctctaaaagaaaaaaaaaaaaaaaaaaaaaagaaaacaaaacccaaacccataaagccttcttacaaatgtttacacaaagtagctctttaacgttaatatattttacaaataattactacatatctacaacgttccagatacagaagaaatggccaaagaaggtattttaggagatccagattataatgaactatgccatttattaatttagtcacttctttaatatctgaggatgagcaaatcaaatactgataatggctgcagaaggacacaggctcttatataataatcttacttccattccagaataaaagggctggagaaggggggcaggattattctgttgaaggacaatggcatcctcagcaactcacagggatgtgcaggtgaacatcagaccaggatgggaaccttataatatctatgatatactatggcttctatcaaccagtttcaggaaaagcaaagaagaatgcagtcatggccaggtgcagtggctcacacctgtaatcttgaggtgggcagatcacatgaggccaggagttcgagaccagtctggccaacgtggtgaaaccccatcgctactaaaccccgtctctactaaaaaataaaaaattagccaggcatggtggtgggtgcctgaattcccagctacttgggaggctgaggcaggataatcacttgaacccaggaggtggaggttgcagtgagtcaaaatcacaccactgcattccagcctgggcaacagagcaagactccatctcaaaaaaaaaaaaaaaatgcagtctaatggcagaattagacttagccactttacttggaaaaatttggactttatcagctccatcaagcaccatgctccacaccatgcttattaaatgtctggagcaacattagatgggtgccattccaaattccaaataatcacatctttgctttgcaaacaggatgtggcttaataatcaaacagggaactagattcattcaagtatctagttcctaaaataagtctatttaacaggttcaacaacatgcaacacacaccctccaattggtagaaacacctctcaatgacaaagaaaggtggcaaatactaaacaccttcacagaccatttagcaactggtgggactaacccttgaaggtgaattcaaaatagaactgaacctcaataccagacttctttttcagaaaagggagtatgaattcttagtttcaggttcagacaaaaaccagaagttgtattgcattaggaaaaacactgggctggtcaggtggctcattccaccctgtaatcccaggactttggtaggccaaagcagggggatcacttgagctcaggaattggagaccagcttgggcaacatggcgaaaccccatctacagaaaatacaaaaattagccaggtgtggtggcatgctcctgtggtcccagctactcaggaggctgaggtgggagaattgcttgagaccgggaggcagaggttgcagtgagccaagattgtgccactgaactccagcctaggtgactaagcaagattctgtctcaaaaaaacaaaaacaaacaaacaaacaaaacctactggcccagagcctacaaataagttgtttggaggaagaggatggaaatctgttagttaagatttaacctgcatatgttgccttctttactaaaatcagactcataaagaaatgtattctggcttcagccttgttggtattgctctacctctatttgtttcccatgctattgcttcatccttgtttctgcagaactaggattttagctcaaagtcacctaaaagcctccacaggaaactacattccaaagggaagactccatgggaagagcaatagagaaagaagttacttttaagtctttggtaatgttcacccaacccagttttcattttctctcaatggacaagaaccctcaactaataaagctaatgaacttacaggaaggtaatatatggaaataaacatcttattgaatttatctggctctaaatctcttttgttagggaatttatagtattccattatcttacaatctctccatttctatctacttgattaaactatggtgctatagcaatggaggtgaaggcctaatttagaagtataggaattaggtatggcgcggtggctcatgcctgtaatctcagcactttgggaggctgaggtgggtggatcacttgaggccaggagtttgagaccagcctggccaacatggtgaaaccccatctctactaaaaatacaaaaattagctgggcgtggtggcaagcacgtgtagtcccacctactcgggaggctgaggcaggagaatcgcttgaacccaggaggcggaggctgcagtgagccaagatcgtatcactgcactcagcctcagtgtaggctgagtgataaagcgagactccgtctcaaaaaaaaaaaaaaaaaggaaaggaattattctcatgtatacaatagtaggaaacaacctataaagcttttgagaatcttataattcactgtgtacctccctctgtttcatattttcgcaattgaactatagagcctaggcctaggtcttaagacttttcttgtaaccttcagagtgcccagcactgggattgacatataccagttagacggatttttttttccataaaccaggctcaaactcttctaaaccaaaatcaacatattctgagtgccaatcttgggtaaggcactctattatttgtcatgaaggattcagaggaaaatgtgatctaccacactcaacagcaggcctcttatcctctccagcttaatgcattttaccagttaaggactaccctgatgctgagattgtgtttctttccccaaatcaaatgtcactctctaagggtcatctgtataattaaatgcttttaattctatatatcaaatgataacttttgtgaaagtaatttaaacacacttgaaacatcatataaaatattactacaagacttaaccgtaaatgtggctcccacccccataacatctatacaatataaccaaagagctagattccagattatcaagaaacttctaaattttgaacccatgcagcagaattgtattcctttacattgttggctcgacttacaaatgtgctgtggaataattatcctcaaatacaattttcagtactgattacatagctgcctaaaagaaaactgttagccccttccattttatgtgaaaccaatgtctaaagcgctcttgactcttcaaccccacattttccccaccctcatccctcctcaatccccagcccccactcatcacatccactagacctgaactttgaactcaatcataattctttgtgcctctgctcaagcccttcttcctgcctggaataccctcttttcagtcccggctaattacatctaccatcccattccaagtggccgctggaaactcacttccttatgttctatgatttctttcacaatttacactttttttgttttgttttgttttgtttgggggggggggttgtttttctgagagggagtcttgctctgttgcccaggctggagtgcagtggcgcgatctcagctcaccacaacctccacctcatgggttcaaccgattctcctgcctcagcatcccgagtagctgggactacaggcgcgcgccgccacgcctggctaattttttgtgtttttggtagagacggggtttcactatgttggccgggctggtctcgaactcctgacctcgtgatccgcccgccaaacattctatgtgccagaaacttgtatgtaactttgcatagttcttgtattatgtctccccaattttgagtgttttctctggtctctactcagcccttgctcacagtctcactaggaccctggctagcttgaacacggtcagaaggatcaccttagatttctgctggcacagtattttccataaattaatctcctgattgaaccgtagtcctatagtagttatctttggatgaaaacctaatgcagctcgaggaggaagtggagtgcctgtgatcagagggctggacaaaagcccatagggcgtctctggagccctgggggaactgtccccaggcaggcactctcagggcccaggaacagggcgggacaagtccgactcacctgtgaggtaaggacggggccaagacccggaaccgaaaagcaggtcacgatagcgctggaaggcctcgtcgaggactgagcagccgggctgcgcggccgagctgacatcgtactggaattgaaagttgttcgggtaaaggacgtagcgctggtcggaggtttggaagttctgaggccagggccagagggccgtcgcccgtcctgcgaacgctgccgccagcagcagcgaaaaccaaagcctggagcttgtcatggcccgctggtctcccctctcggagggggctggccacgtgagaccctggtcaggtgagcggcgcccccgtgacttatcggcgaatcacgtgaccagaggcggctctgcgcctgcgaccccaggaggacccacaccctgccctttcacttccggcctggacctgaggctcctgctacgtgcagcggattgtgccgggcgtcggcaact

SEQ ID NO: 994 - DNA, 10042 bp, Homo sapiens
gatggagcgaagggaacatttaaccttgactttccacagtcctgaggttcccaaaataaaggggaaccggaaataccaaagggtgaggaggtatctaattgaaagtcagatgggaagaagagaacttacttaaaggcagggctacacagagcatcctaaagacagaaaagatcaccctgaaaattgtggggttttttttttttaggagtagggaaaaatatctataaatcaaacacacatgggaatgcttgaggtagagaagagcgggtgaccctggggatcaggggttattctttcgggtaggcaatatttccctcatccttgtagcctaccgtccctgccaagaaacatccaagtgcctcgatgtcatgccaaaggcagcagcagcttatggatcaggcacacatctacatccgaacgctctgtggcagcctctgtagttttagcctcctaatgctgatcgccatgtccccactgaactgggtacagtttctggtgatcaagaatggccttgagctctacgcaggactctggaccttatgcaaccatgagctgtgctggagccacacacccaagccaccctgtgagtgccaccgaattaaatgccacaggccccacacaattgcagagctttctgctcacacaaattggcccttcatgtttcttcctccaagatcttttggccttcacctctccaagtgcaggatggatctttctttggtatcctcagtgtgccctttctctctcctattccaggttgtttcctgtcctaaataatgggttatactctctttatgggaagaactgtttttgtttgttggttggtttttcgagacaggctcttgctctaacgcctagccgaagtgcaaaagcactatcattgctcactgcagcctccacctccaggactcaagcaatcttcctgttcaacctcctgagtaggtggaactacagatgtgtgccaacactcctggctaatttttaatttttttaaatttttttttcttttgtagagacaagttctcattatatttcccaggctggtctcaaagtcctggcctcaagtgatcctcccaaagtaccaggactataggtgtaagccaccatgcctgccctaggaataactcatttacaaggtgttactgctaagcaatgtgattggtattctaatgtggcttgcagaattagaagagaagtgattgatcatagctggaagataaagcaaatatcttaacctctattagatttaactttcaaggtcagcttgttcttctcctagcagtggaatagaacttaaatgtacgttagatatgtggtataacaaatgccagctatgaagataatgttatttatgtcaaattttatgtgaatttaaataaatctgaaagtgcaacacaaaatattttaaaataagtttttggggctaaaaataacatatgcatgaatttttcaatcaaaccaaaaacttagaggaaagatatcattacactgacagttttcccataacccgcaagatatacatttacacaaagaagtgggtattgtgaaagaaaacatatgtgagtaaagcatctattctcatcacataagcaggggtcccatctattctcctcacataagcaggaggggagcacctgtgcccaactctgaggtacagcatcagttgtttggccatgggctgtgacatttgatattaagggacagtatcctgcatgatcttgagaagaaactaaaatcaaaggcagacagacaattcaactgcataaaacgaaaactagagaaaatatttgcaacaattatgaaagataaaggttaatggccttaatatagtaaaaggatacacaaagtattacaaagacacaaactcaaataaataagttctttttgaacagacatgcacaaaagaagaactataactatctaataaacataggaaaaataatttaacctcaatcattaaagaaaggtaaatcaaatgaataacaagatgtaacttttcaaccaccatattaacagatttttaaatgataatgcaactgctatcactcccatacgcattcctgtacatgccatgcaaattggtataactaaagcaatatgattaggtgtatccagagacttaaaaatgttcatctcctttgagtaaataattccatttctagaaattaattccaaggaaataactagaaatggattaaaaggtttaggcaaaaagattaagctgcaatcatatttatgtaactgggtgcccaggctaaaatttcatccttaagattattatttaaatttttaataaattagggctgggtgtggtgactcacgcctgtaatcccagtgttaccagaaaggggtcctgatccagaccccaggagagggttcttggatcttgggcaagaaagaattcaagatgagtccatagagtaaagtgaaagcaaatttaagaaagtaaaggaataaaagaatggctactccataggaagaggagccccgagggctgctgtttgcccattttaatggctatttctttattatatgctaaacaaggggtgaattatattcataagtttttggggaaagaggtgggcaattcccggaactaagggtttctcccctttttagaccatatagggtaaattcctgacattgccatggcatttgttaactgtcatggcactggtgggagtgtcttttagtatgctaatgcattataattcatgtataatgagcagtgaggatgatcagaggtcacttttgttgccatcttggttttagcgggttttggctggcttctttaccacagcctgttttatcagcaaggtctttatgacctgtattttgtgctgacctcctatcattcagtgactaagaatgccttaacctcctgggaatgcagcccagtaggtttcagccttattttaaccagcccctattcaagatggagttgttctggttcaaacacctctgatatcagcactttggaaggctgaggtgggggatcacttgagcttaggagttcaagaccagcctgagcaacaaggtaaaaccctgtctctacaaaaaatacaaaaattagctgggcgtggtagtgggcacctgcaatcccagttacttgggaggccgaagtggagagttgcttgagcctgggatgcagaggttgttgtgagccgagattgagctactgtactctagcctgggtgacacagtgagaccctgtctcaaaaaagaaaaaaattaatacattagaatcccgaaattatgtcacttaaagcagtgaatagtttatttcttggagccctggattcacctttatgcagataaagaaaatcaaggaaatcaagccagcctgtcactcagattttgtggagtcactttgtcactcacctttgtttatgctttgttttatctctacagactgtaattatttagagaaagtcaactgaatccttaaggtgcataagtataaatcaagtatccaccctattttccatgttattataactagctctaattcaagagtcagtaattaatctgcaatacagatctcataagaaatatcccacaatgtaagcaaaatgtccaggcctcatctccctgtgacaatataatgttattattgcccgaatacattatttatttatttatttatctatttatttttgagatcgaatctcattctgtcacccaggctggagtgcagtggcgcgatcttggctcactgcaacctctccctcccgggttcaagcaattctcctgcctcagcctcccaagtagctgggattacaggtgtgcgccactgcacccagctaatttttgtgtttttagtagagatggggtttcaccatgttagccaggcaggtcttgaactcctgatctcaggtgatccgcctgcctcggcctcccaaagtgctcagattacaggcatgagccactgcacctggcctccgaatacattattgtctaataattactgtccaattcaatgacttcaaacttttacctactggattgcaagaatttcgttcccctccctgacagtttcctttcataagtcattttcgtaagtttcacaggggctatctcaggtgtgtttaagaatgtgcatgctcatattcctattccctgggctcacttcagggtgttgtgcttctgtctctgagttcacctgggtctagatgactgacagcctctctgttgtggctgttgctaatgggatgaagaagggatggggaggaaaggacagtattcttcacttttactaggaagtctcaagtgtagaacagacccttctgttattttcccatagcactggtgagatcaggctgaaatataaaggatatattgccacagagagtagtttgaactgttttgcagagcgtgggaaagaaagggtaagtctttttgtcaaggcactgggcaccctagagttaggaccctaggaacaaccatatagtacacattgccaagctgtgtagggatgctttattctggcactccaactgggttacgaggggacttaaatactaagcagatttcatagatacctcttcagggtcctaagtctccacccaggatcatttccattccaaaaccacccacttggggcacctcatctgagcctggagaagttgtatgttgccttccgtgccttgaaagcggtcacaatggcagcagcgtggaagttcagatttggctaaataagtgagctgattccccagcttgtctccagcaacaccactttccaaaagctccctggccaacttttacttccacaacagtagaaggagatcccgcccattatttacaaactgccaaatggtgaacgttctcatttcactgagatctgaggggatgccacagaacactactgctttctggttgggtgatgccccctccaatcttggtaggggttttacatctcacccaatggtactctgaagtgtagcatcgctgactgatgctgggctgatcccgagaacatctacgaaaatcttaccaagtttttcagatgatttgtacttcctcctcaaattgaaagtgacatcctttctcttcccaaggtattagtttcagtaagctgggagaagtgccttggtattcttgtaacttaagtctgcatcaaagtatatcagtaaggaaaacatcaaaaatgtttggatacagttgacccagacaggtgacacaggggtgttcgttttatctcaggcactcctttttccggaccaaggcttcttacagaaacatacaagcagagccttttgtgatttagatcctaagatttttgaaactttgatgagtaagctgttgtaaaaactgttgtttaaaagctgaaattagctttggtgttacaggagatagaagcttgaaatcagcttttggacatttatttatttagagtaatatgaattaaaaaactataaagttaaccaaatgcagatgtcttagactctgaatataagtgtgtagtttgtttatataatttgttgtatatgattattcctaatagacttggttactttgggaaggttagactcttctatgctgcacatctttaaattgttccttcagagttgtgaggatcttgtttatgtagttttcaggagatgagaaggtaacacagagagaattgtaagaaatatataaagttgcagtcttctcctcatggtagaagaggaactggactttatatgttaggctggagttggacaggaaatatcctcgacagtgctccttggtgttttgaatattaaaatcatttgaattagtgcaagctaaagagtgaacttatttataaagattcagaagaatctgccaggtgtggtggctcaagactgtaatcccagcactttgggagtctgaggtgggcagatcgcttgagctcaggagtttgagaccagcctgggcaacatggtgaaaccccacctccaccaaaaatacaaaaaattagccaggtgtggtagtgtgcacctgtggtcccagctactcaagaggctgaggtgggaggatagcttgagtctgggagttggaggctgcagtgagtagagatcatgctactgcactccagcctgggttacagactgagaccccgtctcaaagaaaaagataaagaaaaaaaaatgtggctcagaagaataacatagactcccaaggcaggaagttcgctggaccttaggggattccagaggaggctgggatctcagataaagaaaatcaagccagccagtcactcagattttctacagtcactttgtcattcagctttgtttatgttttgttttatctctacagctcagtttttcctgtttattagtgtgtaagtgcctaaaaggtgataccccggtcaaactttacatcttctcagttcaagcaagcaaaagaggaaatccaatttctaagcataagaataaaattgtcccaggatgggtcaggttcccatgcttagtccaggtagctatagtcagagggctatacagacaatagtcaagggctatagacaagggctgctagagctcatggaggattgtggactaaataccacaaaggctgcctgttaccctgggcttcatacagctcaatctgggcttatgttctggctggctacatatactgctaattctgcataacccagtcttcagaaaatgtgcagcttgtgaattactatgttttaatgtggctcacttgttagggctacagagcaacttaacatctgtggataggggtgtggtttctctgaatggaaattcctgcaattcatcatattagtaagtggcaggttctggagaacaaaatgaaacaaggaggcagatattagactggataagcttgatacataatttctgctctctgggttactcagaagctggacttggattcttaggcatataagtggttagagaactttctaaccactggggtgggggtgagctggtccctgctacactgggacagaaaaagaagctagataaggaggcaccttataagggatactgaagatattcctgggtgtctggtagctcagaaaagctatagctacttgtaattataagttatcttctaaatcttcagtaaaatattgatggggaagtcgaagaacctgttccatcttagggatgtggtagcaaaaagtaaggttgagcatatccccgctgctctcttaccaacatccagtccgcagtggcagagccaaagagaagacacctagagccaaagatggaagaaggagaggtgtggcacttggataagagcaacttgaacaaatatgagataggactttgggggactctcagaataaaaaaaaagtggagggaaacactttgtggtaagttcctgcagcttggtaaattggggcttgaaatcatcataatatggaattaaagtaaatgaggctgggcgaggtggctcacgcctttaatcccagcactttgagaggtcaaggcgggcagatcacctgaggtcaggagttcaagaccagcctggccaacatggtgaaaccctgtttctactaaaaaaaaacaaaaattagccaggcatggtggcatgtgcctgtaatctcagctactctgggtgacagaatgagactctgtctcaaaaaaataataataaaataaagaaatagataaataaagtaaatgtgacttcattttgtagtcataggctgacaaggcctgtacatgccagatagagctggaagtgaaaaaccaatggaactaaacaatgggtaagtcattaagcaaagtatattaatatgatagaatattttgtagccatcgaaaataatatttacaacagataatggggaaaatcacatcatatattcttaagaaaaaaacccacatgatatctagtatcatatctactatgtacagagggtagaaaaataaaatattaacaatggttgcctctaggtagtcaaattgtggctaatttttttcctgcttctttgttcttttgtagtcttttgaatacttatgttgaacgcgtattacttactacttttagaattagaattagaaacaagaaaaaggtttaatctgttttgtcattggtgacaccttttataagctagtttatatctaaatcaatgcatgcagaagtatttgtatattatctttagtttaacaatcatagtaaagaaattccaagcaaaaaggatgtcatgtagcaagctctgctccatcatcctttgttcttaaatccttctctaagactctatctggcctttttaagggaaggtccctcactggactaaccacggtcttcctttcctcttcttcatgcagattatctccaatattccagggccttctttctcatctctgtctttaccatacttactggccttggctggctcttcagctcttggatccttaatcgaggaagcatgaccaccaacttggatctgaaggtatccatgctcagcttcatctcaggtacagacctagactggcagggtattttaccatggtaaaatagtcaaggtaacaaattttctctgtggaactctcatactctttttcttatctctttgctcttcttcagtatcacaccaacttgccagctatctgccttatctaattatatagaacacaccttagctgactttaccagggtatagagcctttctctcatcttggtcagtccccaggtttttatctttttgatcctcgctatacatatggcctctggaggccaaagagctgggggtggcggggaagacagactgaagatgctgatgggttgtgacatctttccttctggtcctagctacctgcttgctcctctgcctcaacctgtttgtggcacaggttcactggcatactagggatgccatggagtcagatctcctatggacctattatcttaactggtgcagtgacatcttttacatgtttgctggtgagtcacttccctgctctatgctagaaggatggatagggaaatcgcttctggaaagggaggtataatccaggagaaatagaagcactgactgttccttttcagaacactgatacttggagagtcaggggggcataatgaagaaagggtggattttagagtctgaaaacctagcattagtaacctgctctatcacaaagtgaggcatggacaagttgagtaacttgcccaagaccacacagaaaatagtggaactatgatctgaatccaggaggttcaagctttgtcctaatcagtctgagaaatattataatgcaattagagcacaggagggtaaagtaactccactgggggagagaggggttcactgaaaagatgcctcttgaactggttattaaaggatgcataagaattttaaaagccaaaagaccattgcctattgaacctcacctcaaattattcccttcccgtagggatcatctctcttctcaactacttaacttccagatcgcctgcctgtgatgaaaacgtcactgtgattccaacagagagatcaaggctgggggttggtccggtgactacagtatcacctgctaaagatgaagggccaaggtctgagatggaatctctaagtgtgagagagaaaaatttaccaaagtcaggactgtggtggtgataggaaaacctaactatagcttgtcttaaaagcaggggagaagctgagttgggaatggtcacataaattctgggaaactctcctaatatcatgtccatattacttgaggagacagcattaaagctgatgaaatgtcttttgcgtgcattggatccaaaatatatatgatagtcataaagtaaataactcacttaagaaaaacatttctaaaagaaaacaacaatgtttagagtcatgaatgaaagaaactagtgaaagatgcagtgtgtagaccagagacctctttgggtatcagggatctcatggaccagaatggcccgtggagaagaatgttaattacttctgtttggaattttctttattatgtgtggctttgggtatactcaggatggaaagcacttggacaaatactgttgaatctgaacttaatagcattaccagaaatggaataaatatcaatggatataagaccta

SEQ ID NO: 995 - DNA, 10369 bp, Homo sapiens
atgtgtgtaattttttacttttttcttatttttagagtttattaagcaggggagtggagggaagatgtggcacaaatagaaatatgtaacattcaaacaacagaatctgggatttttgaaaaaatctttcagttatggttacaggaagggtcacttcctcccccaacgacacagggacctctcaaaggagaggagagagtaagtcccatggtagggccagtggttgctcctgggttttggaatgatttctgcagagttttcaagaccctgggctcagggtggagacttcatagcggtggcagctagacccagcaagatggctgcaatggtgaagccctgggcggcgatctgggtgtgcatcataagccgtgaacattggctgttgccctggtggaagcagtagaggccgttggtgaggacggccgccgtgcacaggaaacctatgggtaccaccggattctcgcgggtcttgcgaaggaacttttccttgaaaccctctggattgctgtaaacagtggggctaagcccctcaaagatggggggcttcgatgattcaaagggggcctccggagtcacaaagccgagagtcgccatgcctaggccacagctgcaggagaaaatcctttgtttttttttttttttgagaaggagtcttgctctgtagcccaggctggagtgcagtggtgcaaccttggctcactgaaacctctgcctccctggtcccagttaaagcaattctcctgcttcagccttccaagtagctgggattacaggaacatgccaccatgccaggctaattttcatatttgtatttttagtagagacggggtttcaccatattggccaggctggtctcgaactcctgacctcatgatctgcctgccttagcctgccaaagtgctgggattacaggtgtgagccaccatgcccagcctacatgttttatataatgttatttgatataacaacttggaaaggacaaaattatagaaatggagaatagattagtggctgcaggggttaggaatggggaggtggtgggaaggaggtatatgtttattaaagggtaatgacagggaggcttatggtgatggaactcttcgtatgttgactatggtgacagataggaaaacctacacgcgtgacaaaactgcacagaactaaatacacacaaatgaagtaaaagtggggaagtctaaatcagattggtggactgtatcaatgttaacattctggctgtgatattacacaatagttttggaagatgttaccatgggataactgtagaaagggtatatgtgatctgtctattatttcttatgactgcaggtgaatctacaattatctcataagaaaaagtaagaagaggccaggggtggtggctcacacctataatcccagcactttgggaggccgaggcaagcagatcacttgaggccaggagtttgagaccagcctgggcaacatggtgaaagcccatctctactaaaaatacaaaaattagccgggcatggtggcacactactcaggagctacacaagaggctgaggcaggagaatcgcttgaaccccggaggcggaggttgcagtgagctgagatcacaccactgccctccagcctgggtgggcaacaacagcaagactgcaagggaataatgttctgtttgggaaagagactgcatgtaaatagggggtctggtaggtgggcatggtggctaacacctataatcccagcaccttggaaagctgaggcaagaggatcacttgaacctaggagttcaagaccagcctgggcaatatagcgagattctgtatctataaaaaatgaaaaaattagccaggcatggtaatgcatgcctgtgatctcaactactcaagaggctgaggcaagaggatcaattgagcatccagaagttgaggctgcagtgagccatgatcatgccactgcactccagcctgggcaacagggcaagactgtatctctaaaaattaaaaaaaaataaaataataaatagaacatataaaagtaaataaaaattaaaaatagggatctggagctggtagggaagaaacagagctgtatgggagaaaagaatacttttccttgttgatatatggtctgtgtcccctttttctcctcttattttcttttgcattcttgctctgattgacttctttctcaagtgcctcttctctctgactttccctgtgtcattattttcctcaactcattattttccctctttgctttgctaaaagactctatccctgcatcttattcagagcacactgactgcactggacaggagttacaagagggaagaggtactcatagaatcctggatttctaaaacacttaagctacaaaggttggtgaatatcagagtccaatagtcacatattacacagaggaaaactgaagtgctgagaaaggaaataacttgtgtcactcacagagggaatttttggtaaagttggaatataagcctgggatccactagaacagcttccctaattttcttttcttttttttttagacaggttctcactctgtcacccaggctggagtttggtggcatgatcaaaactcactgtggtcttgacgtcctgggctcaagtgatcctcctgccttagcctcccaagtagctaggaatgcaggagtgtgccaccatgcctggctaatttttttgtattttaagtttgtagagatggggtctggatatattgcccatgctggtctcaaactcctggacacaagtgatcctcctaccttgtgctcccaaagtgctggaattagaggcgtgagccactacgcctagccctagtttctataattttcaacagacggagctcactagttggagaaaaagagattcctgggggcagccaattaaaacatagagaaattagagcaacatggtgagagaaataatctgatcaggtgcagtggttcgcgcctgtaatcccaacactttgggaggtcaaggcaggaggatcacttaagccttggagtttgagaccagcctgggcaatatggcaaaaccccatctctacaaaaaataaaaaattagctgagcatggtggcgcatgcctgtagtcccagctactcaggagtctgaggtaggaggatcgtttgagcctaggaattcgaggctacaatgagccatgattgtgccactgcatttcagcctgggtgacagagcaagagactttgtctcaaaaatagaaaagaaaagaaagaaaaagaaaaggaaggaaggaaggagggaaaagaaaaaagaaaaaaaaaagaaggaaagaaagagggcagccaggcgtagtggctcacgcctgtaatcctaggactttcgaggtgggcagatcacctaaaatcaggagtttgagagcagcctcgttaacatggtgaaacctcatctttactaaaaatacaaaaaattagccgggcatggtggcacactcctgtagccccagctactagggaggctgaggcaggagaatcgcttgaaccaaggaggcagaggttgcagtgagctgagattctgccattgcactccagcctgggcaacaagcacaaaactgtgtctcaaaaaaaaaaaaaagagagagagagaaagaaagaagaaaaagatgcagagaggggaagaggaaagaaggaagggaaggaaggaaggaaggatatagttattaagtagttatgagccagaattataaactagccagatggttttgtgataggatttgggtagaatgaaaatctcaagaggttaaattcctaagaggcaactcttctctcttactaactatggattattttaaatgcaccagatacccctcctcaagatgtaatattataccataaatgttatggggagaaactgcccaaatgaacagaccagcgctcacactgagaacaggaatagggagtagcctattttgagcctacctttttaaaaaacacttgcattttgggaaaatataaaaaaaaatgtccaacagggttgtcctgttggtaccaaaaaccttcagaaatttcagagtataggatgttggtaagaagcaccaaagcagaaagtacctctttctgcatgcgagaaaccatcatttatctgagagtgatgttccctaacacaagaaagggtctctgttaagcaagtgaggggtggaaggagctgttgccagagcccgccagaagcatcctggtaaccaactgctggtccaaacatttcctacttacatggaacagtggaaagtgccaacagagttctcccgacgaatgtcttcatattcctcatagattccctgcttttgcctgggcaaaatagtccatcaaccaaagtttaggttttctgatcttcttcccattcttacccagctggtggagtctacagcctatttcaggtttgacctcagtagctagaggaaaagtggttaaacaaaataaagaagttagaagctgatttacctttaaaaataacaaacttaagttcttgtctacagtaagttttatggatcaaaaactattctgacttcttatctcaacagatatcctacacatatctcacatcagcatatatatatgccttttagaaaattctgttattaaaactcgaaggaaaaatgagatcatgaataaactgaacatttttaaaaaattatctttcataacttttcaatctaatatctgtgtattataatcatttattgtttcatgtactaattcatctatgtatttaccaatcaataaatataatctgatatgcactatgataaatgaggtcaaaaaaaaaggagataccctgatccacacaggatataaagatgaagggctgggtgcgttggctcacgcctgtaattccagcactttgggaggctgaggtgggcagaccacctgagctcaggagttcaagaccagccaggcaaacatggcaaaaacctgtctctactaaaaatacaaaaaattagctggccgtggtggcagatgcctgtaattccagctactcaggaggctgagcctgaggcacgagaattgcctgaactcaggtggtggaggttgcagtgagatcgtgcactccagcctgggtgacagagtgaaattctgtctcaaaaaaaaacaaaagtgctgtattgaggactgagacctgagatagtgagagacagggatgtacaacttgagtcatactgtggactgacaggatgggaatagctaagggactgtctgaggtggggatgcctgtctggttcacttgttactgccttgtttatgtgacttagatagtacttagcttccgctgttgatactcagtgggagatacacctaaaccacacagacagcattattctgaaaaggagaagttgccagggagtgtggaccagtagtctccgtggccctgtactctccaagcagaagtgtagacttcttcttccctgtgactagccttcaggtgtaatttccagtacatagttccttataaattctatagctcaggagaataaataagaggctccttttccagaaaatccagtattggttttcctcctttggaggcgtagagtcagaactctcatggcatggcaggatccatggaggtggccacatctcccttttttcagtgagtattagatcccacaagacaaccgcacagctaaacataattaaaacttaggttttatgatatttgttcctttcctaaaaccttcagtgactccttattatccatagggaacatataagctaaataaatgtgaacttttttctccaagcaaaacattctccccagtgaatagaaaatcttgttttcctgtgttaccttgaaccaaaattttttttttttttttttttttgaggcaaagtcttgctctgtcgcccaggctggagtgcagtggtggcgcgatctcatctcactgcaacctccacctcccgggttcaagtgattctcctgcctcagcctcccgagtagctgggattacaggcgcctgccaccacaccttgctaatttttgtatttttagtagacatgaggttttgccaggttggccaggctggtctcaaactccggacctgaagggatccatctgcctaccttggcctctcaaagtgctgggattacaggcatgagccaccgcacttggactcctttaaaattattattattattgagacagagtttcgtgctgttgcccaggcaggagtgtggcactaccttgattatagacgcaagtcactgggccttgggattatagacgcgagtcactgggcccagctttctttccagttttaaagtattatttttaattatccaaactaaatgtgtagtaaatactcttcttataaatctttgttttcttgattgcttccttagcatataatttcagaaatagaactgatcaaagggtatgcacatttttaaggatttataatgccagatgccttccaaaagatgttaacaacttattgaactgacagtatataagggtgctatagagtaatttatttatttgaaaaacaaatctttattgtgtagaaatatgtattttaaaaatcccccagaaaagatgctcttctctcatttccccatcctcttccttttcttccacacctctgatatgaaggacattattataccttattaaaacttcatccacactaggcatggtggctcatgcctgtaatcctggcattttgggaggccaaggcaggcagatcacttgaggtcaggagtttgagaccagcctggccaacatggtgaaatcctgtctctactaaaaatacaacaattagccaggtgtggtggctgacgcttgtaatcccagctacttgggaggccaaggcacgagaatcacttgaacctggaggttgcagtgagctgagatcgcaccactgcactccagcctgggtgatagagcgagactctgtctaaaaataagataaaataaaataaaatgaaaacttcatccagatgtctagacaacactttaactatgtattcttctgtatttgcaagttacatgttcatatagccatctacagataccagttagcctttgtaatccattccccacttaagtttcaccatctactggcttttctgttaatcccttgaggaaaggtttggaattgaggagtaaatcctttataaggagaatgctgcagtctattcgctattcaccgctgaccaagctgccacctggccctcctgactgcagcaggcacccccagacagtcatgtaaatggactaggcctgagtctgtagttctttgctctgaaaaaggagacgtaatggcttctactttttatcatttggtggaaataatagaggagtttttctagaatgttttttgatctggtggttaaagggaacttggacatttagtccctgaaataaattgttgcatctttgaaggaaaagatgaaagtagtttcttacactttagtgaagaagcctttggaaaattttgttctggatgttgtatattctctgtagaggagtgttggggattccccacatcagcagaactaaagggtaactgaagagaacagggagtgacatgtcagattgagaatcagtcttttgaaagtggcaaaaagaatatgtgttaaaagaaaaaatagggtagaagataaaaagaatagggcagaagatattagcttcaattcctccttttttttttttttttttgatcctttggaatgatttcttcctagactgccagtgttgcgtagtaaccccgcccatgaagaggactggaatactgaaaaactgcatgaaactaagcgctgtgggttgggcggggtggctcacgcctgtaattccacactttgggaggccaagttggctggattgcttgagctcaggagcttgagaccagcctaggtaacatgatgaaaccccatctttacaaaagatacaaaaattagctgggtgtggtggcatgaagctgtagtcccagctactcaggaggctgaggtgggaggatcacttgagcctgggaggtagaggctgcagtgagccgtgattgtcccactgcacttccgcctgggcaacagagcgagatcctgtcccaaaaacaaaaaaactaagcactgtggattagaaattaataatttttcatctttatatctttttttttttttttgagacagtcttgctctgtctcccaggctggagtgcagtggcacgatctcggctcacttaggcaaggtgtttaattaatctctgaaaagtggagaatttagcaccaggcatggtgactggtgcctgtaatcctagctacttgagaggatgaggtggaagtgttaaaggtggagggtgtccaggttcttggtgtcttgaaaaaagaattggacaaaatgcacaaacaaagcaaggaagggacaaggaatttactgaacatgaaagtacactccagtgtgggagcgggcctgagcttagaagttcagtggctccgttacagaattttggggagtttaaataaccccagaggattccatggttacttcgggtatgccttatgtaaatagagaagatgaagtaaagttacaaagacatttatggcctatgccctatggacagaatattacctgttatagctgaagtgtgaattggccttatgttccctacctccagaccctattttcctgcctcaggaggattacttgagcctaggagttcaagtccagtctggacatcaatagtgagacccctgcctctgaaaaaaaatttttttgagacagagttttgctcttgttgcccaggctggagtgcaatgggatgatctcagctcactgtaacttccacctcctggattcaagcaattctcctgcctcagcttccctagtagctgggattacaggagccggccaccacgcccggataattttttgtatttttagtagagacagggttacaccatgttggccaggctggtcttgaactcctgacctcaggtgatctgcccacctcagcctcacaaagtcctgggattacaggcgtgagccaccgagcccagcaaatttttgttttttagacggagtctccctctatcgcccaggctggagcacagaaatgcgatctcggctcactgcaacctctgccgcttgggttcaagtgattctcctgactcagcctcccgagtagctgcgattacaggcgggcaccaccatgcccgactaattttttgtatttttagtagagacggggtttcaccatgctggccaagctggaaaattttatttttaataaatgaaaggcagagtatttatctgaaaaaagtgggagaccaacagtctcatgggattgttataaagattaaaagagagagtgttactgaaatacttagaagagctgttattctattgctgtcctttccccttgtatttggatagattaccgtacttgtttcttctatgtaactctaattgtcagtggggttctccctctcttagaggcctggagaaacttgtcttaaatgctttcccagttaatgaattgggagaggcagattttatgtctaaattacaagggcgagacttaaaagtatgaattggggctaatgtcagtgctcaggtgcagggatcctccgttttgttcatcacacagctcccggcactttaataaatgaggctcaaagaaacgacgggcttaggtcatgcagtagtcaaattcagaactcatgtttgattccaaagcccacacgttttcctagtttagaaacactaaacatttaattcaccgcaccgggggccagacaggtaatggagaacgccttaagtatgttaggaagggaagttatctacagtcgcagccgctattcagatctatttcactgccttgcagaaaacgccgactgtcgtctctttatcccatggccgatttcttgtgaaatctcctaacttttaaatatttccaatcaaaagactgccgttcaaatgcagcccaccaggagcatgtttgcaaactctggagtaaacaagagtgggaagctgataaggtgagtacctcagttcgatagtgacagccaagaaacggggagttttgtacctaaggcgagaaagaaattctccgccgaaatctcccggaagaaggactgaattaaatgcagattagagtcagggcagggtaaggtggcgggagaactaggctgccatcccaggtggctggcctaccagccagcgcggccggaggtacagaccatgtacagaccacggcgaggggtgttaggggcttctcgggataaaggcagcgagtggctgcgcattccctccccgactctttcagaggtaagccttctgtggagcagaccctaatcctccccctgattccttaggtcactcggcgatttacttccttcccccgcttcctcacagtcctcc

SEQ ID NO: 996 - DNA, 12701 bp, Homo sapiens
cagtcacacagcagccttgtaggtgactggaggtgttcgctgatgtggccccaaccctacctccctccccaccccatgatgttagaagaatctcgacagaataaattggcagcagccaagaaaaaggtaaaaagccaagaaaaaggtcatggccccccaacctagccagagatcccctctgatgacaagaccactcccagagtccataccactcctgaggcacaccgggctgggcccccctaccccggcgcctctggactccccccaccaacgtcttgtcagtcagccccgccccttcagcaagcagcccagcctctgccctcgccaatcaccctgcggtgactttgggcggatgactactggggatacctgctccatattcagccctcacgtcctgccaccccaagcccaacctccctgggttctttgggctcacctctccaaggacctgggtcccccagccccaaccccccagcatcgccagtcatcccggggtgactttgggctggtgactcctggggttccctgagcagactctgctctcccctcctgctgacccaagcccgacctccctgggctctctggactggcatctccaaggacctgggtcccagccccacgtcccccctcccccatcgtggatcggcaactcagccattgcactgatgaggtttcccccacccccaggaggagtggaatgtagtgatgtcacagtcctcctaggaactgtcattactgctgcaagaccggcctttgatcttataacccagtcccctaagcattctcaccccatttctggttcctctggtcacagcacaaatttccagctagaagggaaatggggaccatgggacctaggagcaagaggtttcaggctgccttactcccttcacatagacatcgacagtgtgaaaagcctacacttcccctgtgagctcaaaacgttgacagtatctctgggtggtaatgggagaatgggtttggtttggttttctcccaggcttctactctccagagagactttaacatttttttccgagttctccacctcatattctaattctccacggttctgggaccagactgcccttcagtcagtggtctctgaagtgagatttgctcatcttctgtggaataggtcttgggaaactgaacttgacagcttgaatcttcctcatatcatctcaacttagggtacattgagtgccacaggataaatgtgggagatctttctgaagcatcagtttcccttgagtctcttgagagagaaaaaacattaatgtacttaggggtgaccctcacataggtttctaagagtataccagacttctctctgaaatgagacttgggttgtcctctttctgataaattcccagatttaacaaaaaagctgccttctgccatgaggacacattgatataaaagtttgagagatactggtgcacttcttcacactaacagacatttgaggatgtatgactctaaaccacacagcgtgtagttcatgcctatgtaatgtttacttttctacctctgcgtctggttttggtccccggcagctgctgattcatggcaaaaccccagagcttggagtcagaagactgagtttaagttccattattgcccccccacacttttttttttagccataatatccatccctctcagtcacttaagtgattgtgacaacaccttgtacagttgttggtggcattaaatcagatggtgtataagagtattttgcaaaaactgtaaggagggtgtggctgtaagggctggtagttctcatgagtattactgctcttctttcccacagctaaaagaatatcagcaaaggaagagccctggtattccagcaggagcaaagacaaaaaagaaaaaaactgacagtagccctgagacaaccacttccggtggtggccactcacctggggatgtgagtcttggctggccaggctcctggggacagggggcccaaggggcagtagagggtaattgttgagattgctgggtactggttaagaattctgggtttgaatcctgcttcttcatctgctagcgatctgatttatggcaagttgcttgagctctttgggcctctcttttcacatctgtaaaataggggtagtattgtttgacttccatttgtgaagtttaaatgagattccttattgttgttgttttcatgttaacccctagtacgtggcctgctgtaaacacccgggatacccaggaaatggtcattgctgtttgattttcctgatccccactcgcaaggggaagctgggctaatgagtacagccacttgccatcaggctgtccctctaggagtcactgaagggggcccagggtgtggtgaggagagcccaaggcactaggagcaagagaaggtctaacttgccaccagcttgctgggtgaccacagaaaaatcacttcttctgctgggcctcagtttcctcctctgtaagatgatactggataagatcagtgtctttcaaacttgttttttagctgaagtccccttagttcaagtgaactcttactcaggagtctgtttttttttaatggaggtggaggtctggagctctaccagattcatcgcccatgtcctgggcctgaggagaggggtccagtgagcgtattaagatctgcattggtcagctgactccactctgtgactgcgtcactcgggggacttttccatctatttttttcctgcccctggcaaggcagcaggtggccatttggaagaatggcacaggccatggttttaatctcctctgctcttcttcagcgtttccttttcctgaacccacatcttcctcctaccctgactttcttgcttctctctaagccacttctgtctttcaccccctgcccttgtttttcccttgtcacctcctgtagattcaggacattctgaaggtgcgggtgtccaaccttaaccactccaatggggtagtgctcccccattggacaagtggaaggtgaggcagtgccaagacccctctctggcttgctgtctacagctgtgcatggccctgaggcttctctggcttgggggatgcttggcctctgccttgttttatgttgctgccattaaccttcagcctgtttctgtctgcttcttcacctgcttgattgattgggttttttccttccccgcgtcttttattatcttggaaatggtgacgcctaaaagtttaaaagtaatctgggaataacgtacagagcaggcatgtgggatttgggctctttttttttttttttttttttttttttttgagacagagtctcactctgtcactcagactggagtggagtggtgcgatctcggctcactacaacctctgcctcccgggttcaagtgattctcttgccttagcctcctgagtagctgggattacaggcacctgccactacgcctggctactctttgtatttttagtagagatgcagtttcaccatgtcggccaggctgatcttgatctcctgacctcaagtgatccacttgtctcagcctcctgaactgctgggattacatgtgtgagccactgtgcccggctccttgctgtttttatactttctccatatacataactatttcccatgtaagtttttttttaatttctcatttttattactcctgcatcatctgttaccctgaaggatctggaagtaagaggccctgggctgaggtgcagtgactttgcaggccagccctccaacctcctctcacagtgggggctgggtgaccctctgccagctgagacagcccacacacaccccagccctaatgattgttctctctacctctccccacaatcctcttccaactcctcctctctgcatgtgcctcagagccagtaccaagaactagcagtagccctggagtcaagctcagtgacaatcagtcaactcaatgaaaacatagaatcattggtaagtccagtggggtcccctgattccatgctgccaatcctgggctttagtttccccttggggccctgaagaaaggggctgggggcccctggtgccaagggcaaatggggagctggagcacccaggcctcacctggagggaccccagagcaaggagcacgcagcatggctcttctgtcactgccctctttgccgactctctcttctccagacacccctgctccagtccttgccacacacgccctgaggttgtcacctctcagggaagcgctagcctgactggttgtcaggggccctgtatttctgccctgactcagtccctaatttgctttgagtctggacaagccacctgtcctccttgggcttgtgtttctggaggaggtagagcatcagagttctctgttagctctgagagcctgagatttaaaggcccctagaatggaaacctgagggccaagggctcctgtctgtccttttccatcctatatctgctgtgaagaaccgtagctggcccgtatgtgttcagtaaatgtttgttgaatgaaggcacctttctaaatcacaagctggcagaagggtgggccttcctgagactccctctctaggggtttatgttactgtcctttcaagagaatccagattcagacttcgagttctgtggctgtgggcaaaaaccaacaaagacccaagtcctctgtccttgggagcttgaagagggttgaccagtttgtgttgccattggttctgagaatgttgcctttaaaatccattcctggaccctgcctaccgcttccaggtctggggaatagagttgagggggccactctcagtcacctgaatttgactctccccacagaaacagcagaagaaacaagtggaacatcagctggaagaagtaacgtgatttctttgctcacaacatgactgctgggtttgggggacactcagatgcagaggcgccagtctcatcttgcccactcccagcctggggaagaaggctcacccatcagattccaccccatccccacagggtccctgataacctggtcccatgggtgggcctgtcctggggcattggtggcattctgggggcatgtctcttgctgtgccatctctgcctccctgtgataagagctctgtcttcctcttcctacaggcaaagaaaacaaacaatgaaatacacaaagcacaaatggagcggttagaggtgagtggagggtggggagctttctcctgtcctctggagaatgtttctttccttctctttcagcatttccttggcttttctcccaaacgttcaattccagacaatcaacatcctcacattggaaaaggcagacttgaagaccaccctttaccatactaaacgtgctgcccgacacttcgaaggtgggaatctgggcatcccgtcatccttcaacctggcactttgacaggtctttagggggagtcttttgggccccatctcaacctctctcattacagaagagtccaaggatctggctggccgcctgcaatactccttacagcgtattcaagaattggagcgggctctctgtgctgtgtctacacagcagcaggaagaggacagggtgagtccaaccagctgccccatcccctggcagcctggcttcccagatagaggagtgagcctaaaggtcccttctgcaggatggagtgtcctgcccagaaggcagcatggtcatttctcactacttttgtgtatggttgttagaggcagcctggggctgagtcagctgctgtgggtgagttggggggcactgtggggagtgagcactggatgcagagctcagaggccaagtgcctgccctgccctttcctggctgtggccttggccaagtcctaggtggggtattgggtagttgttctgtgaaggtacagaagagcacctttagtatgttaccatttctgtagagagaggaaaggggtgtgtgtgtgtgtgtgtgtgtgtgtgtgtgtgtactatgataatatacaaaaacatgtctgcaagcattcataaaaaactcaggagagagtaacagggtgcctggagacacctcccttctgtaccttctgagttttggactatatgaatgtatcatcctttcaaaaagtgaacaaaagattaatttcccccttcctatctgtgtccccacccccagcaagaaaaatgggcttagagaataggatagacctgggtgttcaaatcccagctctgtctaagtgatcttaggcaatcacttaaccttgaacactcgatgtttttcatctacacaatagaggtaatcctagtaactgtctcatatggtggttgtgaggattaaatgggatcgctagcatggaacctggtgaagcactccataacggttcaaacagtggtagtaataacagtaataacaatagcaatattatctgatctctctgggcctctgttagccagctgtaaattctatctctttccctctcccttccaactttactgagttcttttaataaccaggccacgggcttggaaatgccttgacctttactgaccgagttgtatattgagcctagccctagcccttttaaggggcactgcctgagctccccagatcaaaacttctcactcttcaccatccagtcctcgagctgcagagaagcggtcctccaccggcggttacagcagaccataaaggagcgggcgctgctgaacgcacacgtgacacaggtgaggctttgcagagggagggatgtggaaggaagatgaccccaggtggccaggagcaggtgaggaccagtgacagcccttcctaacttctgtgcccatttcttgcaggtgacagagtcactaaaacaagtccagctagagcgagacgaatatgctaaacacataaaaggagagagggcccggtggcaggagaggatgtggaaaatgtcggtggaggtgaggtctgacccttcagcccccactttagataggtcactggatctttctgggcatctgtaaaatgggaatagtacagccagaggtggtcatgggtctgggctttgtggagatggggacagagaatgagatggtagcctgtccagccaccagcccctctctccagggccctttcccctgtgctttgggcaggctcgaacattgaaggaagagaagaagcgtgacatacatcggatacaggagctggagaggagcttgtccgaactcaaaaaccagatgggtaagatggggctggtgtgacctcggagcaggactggcatcagaggtctgtgggggtggcttagaatgccccagggaggtgggtgggtggaagggctttgaggcagagggaaagaggtctgtgccaggagacggcaagttttgtcatctccatgagcctcagggtccccatcagcaaagagggaggagtgcccgttgtcagccacccacagtgctctctatgtgaaagtggcttggaaattggctaccattgggtgcgaggaatgattagcagtgaggccaagtttgggaagcctgagaggagctgtgcatcaagaggaggttttttttttttttttttttgagggggatgtgggtagaggggttggggaatccagaggcccttattgtctgcttcatttctcagctaagcccccatccctggcgcccccagcagtgacctctgtggtggaacagctacaagatgaggccaaacacctgaggcaggaggtggaaggtctggagggaaagctccaatcccaggtggaaaacaatcaggccttgagtctccttagcaaggaacaaaagcagagactccaggagcaggaggagatgctccgagagcaggaggtgcagagagtgcgggagcaggagagactgtgtgaacaaaacgagaggcttcgggagcagcagaagacgctacaggagcagggtgagaggctgcgaaagcaggagcagaggctacgcaaacaggaggagaggctgcgaaaggaggaggagaggctgcaaaagcaggaaaagaggctgtgggaccaggaggagaggctgtggaagaaggaggagaggctacaaaagcaggaggagaggctcgcgctctcccagaaccacaagctcgacaagcagctggccgagccacagtgcagcttcgaggatctggtgggttgccccacctggggagcctgccctcatccctatccctccaggcctttgtttccccacctgtaaaatgggccagtgtagccctcacatgaaatggtacttctaaaggcacctgtgagctacagctcatcgggctctgctctgatggctgtgggggagaagggatgatttttctaacctgcctccacccttcctggtgatatgggaggcagacaccaaggtctggtgtctccagctgcagtggatggccactgattgcttctctctgtccagaacaacgagaaaaagagcgcactgcagttggagcagcaagtaaaggagctgcaggagaagctagacgaggtgaaggagatggtaacctccaccccatccaagaagggctgggaggcgggcaccagcctctggggaggggaggtgccaggccaaaggcagctccagctgggaggcaggtgaccccagcaccctccagtgcagctctatgactgtttcttgcttcctgccctctgacttttagaggtgggtagccctgggctcctcccaggtctggacatcatcatcccagctagagacatggagcccccaatcataggggaagagacagtggtacaagaggctccttatccaggcacggtggctcgcacctgtaatcccagcactttgggaggctgaggcaggagaatcacttgaggtcaggagtttgagaccagcctggccaacgtggcgaaacctcacccctactaaaattacaacaacaacaacaaaaaattagccaggcatggtggcgcatgcctgtaatcccagctactcaggaggctgaggcacgagaatcgcttgagcccacgtggtggaggttgcagtgagctgagattgcaccactgcactccagcctgggccacagagtgacactgtctcaaaacaaaacaaaaaagcctccttagattcaaactggattctggcctgggttccactggtcaccattcaactactgttcatctctaagtctctgtttctgtgacttcaaaaggaagttagcattttccttgcagaggtgctgaggattgaatgagagaatacctggaaagcattaggcatgtagcacacttagcagatggtggttggctccctctgcttttccgccagtctgtggcctacagtttaaatggtgggaagaaggacatgagatttgaggctggggaaggaggtatggggttctaggcaagagaggaagcctcttaggcctggagcaagggaccagggtcctgggcaggtgacagagccccacggtgccctcgctaccctattaatgggcccagaatctggaagccagccaccatgtgccctcatgcccagggtcttcctgcaggtggagctgaagagccaagggtctcagagtctgcagcagcagcgagactagtacctgggtcacctgcagcagtacgtggccacctatcagcagctgacctctgagaaggaggcgctgcacaggcagttactgctgcagacccagctcgtggaccagctgcagcagcaggaagcttggggcaaagcggtggctgagatggccggccaaaagttgcaggagacccaggggaggcagttgctgaggacggggccccgagggggatgacctggcaacctccgtgccttctcactctgtttcccgtccccttaggagcacctagaagctgccagccagcagaaccaacagctagagacccagctaagcctcgtggctctcccgggagaaggtacaggagaccactcagaggaagaggagagagccccaggaggaaggggggactgttagcagcataggattgaggggttggaagagacctttagaacagctggtcgttatgccaaccgggtgtccgcactaagttcagcatcaatatggtgacctcctgggagcagggggccaccaggttgcctaaggatgaatgaactggaccagatcagaaagggagcaggtcaggactcccgcaccgaccggtagtgggactgtgcctgggcaatatagcaagatcttggttcttaaaaggaaaaataaagaacagcagctcactcccctctggggagaggctggctcagggttacacagtcagggtggggacagaggtaggcccacaggaccttccttgttgggttgtctgaggacccctctggccacctccctacaggagatggaggacaacatctggacagtgaggaggaggaggcgcctcggcccacgccaaacatcccagaggacctggagagccgggaggccacggtgagcctgactttccctgccccgctttgccaccttcctctgtggtccctcccagacccccttatgctcttggtttcccaccttctgattgctctggcccctcaccccttccgggagccagtggtcagacactttgtcacctgtgaccaacaggtgcactctctgaggccccaagggaaggggttgttctccacctccctgcctcatttgttctgtctatgcccctacaagaatactcacctcttgccttcaagtggcatttttcacctctgctggagccagttcccaggaggagcaggcacggctatgtgggcagcggaaggtgtgaaggctgtgctgcctgcacctggctcatctgttggccttggcctggaaggagccagaggcagaggccccagccccagggagtgggggtgagtttgtgtgtggggagagctaccgggccctgaaggaggccatggtgaagctgaaagggagtgagtcctggcatgggccaagaaaagtgggggcggggcagaacaggtcactcccgagatgtgaccccattattttggctccagagcagctttatggacctcccgaaggagaaggcggacgggacggagcagtggagagacgagagcttggattcgtccagccttctggagtgacagacggcatgagtgagcgggaggccagggcacgggcacggggagctgcagggccgtcggagggaccctagtgtctgagctgtgtcctctcacaggagagtccttcaccgtatatgaaagccagggggcagtgccaaacacgcggcaccaggagatggaggatgtcatcaggctggcccagaaggaggaggagatgaaggtagggcgtgcaacatctctgcgggggtgggggtgggcatgggcgctggtgcaggctccagggtgggagctgagcacccctcccttcaggtgaagctgctggagctgcaagagttggtgttgccccttgtgggcaaccatgaggggcatggcaaattcctcatcgctgcccagaaccctgctgatgagcccactccaggggccccagccccccaggaacttggggctgccggtgagcaggatggtgagtagagctctcaggcggggtgggcaggcaggggcaggggaggctcgcactgtgctcagacccccgcctccctctctctgaagatttttatgaagtgagcctggacaacaacgtggagcctgcaccaggagcggccagggagggttctccccatgacaaccccactgtacagcagatcgtgcagctgtctcctgtcatgcaggacacctaggagcacccaggcttgcccagcaaaccctgcgtgccattcttctaccaggcagccgagaacagggagataaacatcatcatcttctaagagctgatcaagaaatttaaaacaacaacaacaacaaaaagttacggggttcatctcctacacaattcatttactccatttgaatgctagagccactcacatttatttgtgtttctaatttaccgtttaaatttatttgtaaaaagttaagggagagttggtctttccctgatgttctttctggcatcctttagcatttttatttttaatttgataattgtaggtcattagtatgcatatcgagtttgcccttaggtggtgggaattcaaacacacaaagacccactaatttgcacaaaactattctggctggtttggaacaggctgccatgcttttttaatgttattgcagcatgtatattcattccagaattcagataaaatgtgcttatgttctgctatgacgtttgatcgaatcctaaccacagtgagctcttcattagctcaatatgtggtttgccctcaattgagcactgtttattactttgtaatatgccactgtgagtactgacatttagagttgtttaaaggccaagaactggaaacagccttttccctattttctgtgtattggggatgggagtaataacattttggggagctttttaaatctcacagaagaggaaagtggcctgctctggcaggtgtgtgcaggatagagtgtgtttcatttgttctggtgccaagaatgagcgctgtactatggtagttcccttaggatttgtatgtgctctgggctcatgaagatattgcatcatgagctgcagcagttgtaccctttcttgatgacctaaaaagggattatttctgaggaatgaaaggctcccatcattgactgtggatgtggaaaaccttttctagcttagagcatttatatctacaatacattttaaagtcagagttcatgttacctgttttaatcacatgagtatatgtcccagtacacaaaagggcactggttggcattc

SEQ ID NO: 997 - DNA, 98 bp, Homo sapiens
aaacttaacatcatgctacctctttgtatcatattttgttattctggtcacagaatgacctagtattctgtaccagggaaggtagttcttaactatat

SEQ ID NO: 998 - DNA, 32420 bp, Homo sapiens
attcctgaaatgtaaattgtttttaatatatttaagagcacacagaagtcttgatttataaaaaaataaatatataacatgacaaatttactgatgatcctggagctctgaggtcaaactctttaaatgatcagtgaaaacataaaacatccatgatctgttaacacacacaggagcatattccagttgtaaaaaacaaattccttgaaggctcagaacgaacaaaaatcagtctttatggcagaaagcacatccaaagctaggcaatgaagttcagcctgggccacgtgaacctttcaccagccagcctataacctatggagccaggacaggaaagcatgatccttcagctcatgacgccacccaggcttccagacaactgcagaatgaaagagtccctcagaggctccccagcccctgctgccatcataaagcacgggagggattgttttgtccttagcggctctgtcctaaatttgagagcaggagactgagaaggttatgctcattaaatattgtcattgtaacacggaatggaaatcatgatccttgcccatgggcactgagctgaaagaaagaggaacctcacatgaggctttcctagagaccaggatgttgggtgagtgggcgtgcacttctcaagtgggcaaggaagaactgcttttctccagctgacatgctctcaggggtgaagaagtttagcttaaaatacctgatggcgctgcataaactggggatttgggaactgagtttttagctctgtgacacacaacataaaaaacaaaaatccagtctcattagctaaattcggattaaaatctgaaatgtttttatggagttgccaacaggctggaatgtacctgatacagtttaatctgcttttatttctttggctgtcttccaaaccactttcttcctgtaattcttaagttggctagttctccttcctcagaaaaattacccctaagaatcttcctaatagtgagggtgtacttccgaatagaagagtccttcggctgaaatggcatctccaaggcctacagttcgaatggggtctttacacaccaatactggtgtgaagtggaaggatattccctctctgtgccattctactactggcttgtttgggtttaatacaatcctggagcctgcctccgaatgggaagtcatgaactcttggggtgccctcagagacactcggctggtgtctatggtttctgtggcgcaggcctgtgtcccagccacacgagctcctgcagccacggctgccagctggttggcccagtgtccatccacagttgccaggatgtggtagaccagcgtgtggaaatggatcctggtgagatccgaggctctgcttttactcctcccatgttctttcaagatccagaagaggatgtcactgaccatgcccacatcaggaacaccgttccaggaagagagagaagagtgaggtccagaggctgactgggtgagaaataacagctcctgttcattcagcccaagggaagtcaccgcgggaaagacctgctaacaaaaacaacaacaggtatctttctgatggagataacctggctcctaagatgtcttatgacacagccagtgactaaatgacagggaacacaggcaggcagctttcttccttgatacaggactccctggccctgaagtcactgttttagctatcacacccctatcttcaccttcatcatcatttgggagaaactggaaagctgcagtaacattgtttcagatgcagtcttttgtgatatgccactgtaagacaaaaggcagaggtgtctatattttgtgtttctttccatggtccctagcttttgccactgcacacataggagatactcttaccactgatggggcatggctctcagttcctgaatgtcagcagtattagaccagtaaaatggagacctcaagcaacatactgtcagggttataatgattttttttatacaaaacaccaagaagcaaaaagcatacagtttcatgttagagctaagctttttaaaagcaggtgtgggttaggaagactgtctgaatttagcaataacactgtaagaaaaagattaccaaacaggtgcccgtgttttctgtctgatggggaaccacaatatccacctccctgtctttcttacttagcacttccctccttagaaccagagaaccacacttaaggtaacaatttttgcaggagagaggagtccttgtatgtatgtgtgcatgtataaaatggttttaaaaatttaatggcctacatctttgttggagcaatagcagctttccttcactgcatgttcttctgtgtcaggcactgagctaaaggctttatttcatccaattcttactgtaatcttctgagggaaggagggactgcctccattgtacagactaagcctcagaagggttaagtagacagttacagagaaaatgaaatagaaatggctcatttttttaaaggtgagaagaaaaacccaaacaaaagctatactgaaaaacaccaagagtgaacccaagtgtaaactatggactttgggtgctgatgacgtgcctgtgtaggctcactagcttaacaaatgtaccactctggtgcaggctgctggtagttggggaggcttgtgtgtgaggggactggaagtatatgggaactctcttggattctgctctattttgctatgcacctaatattaccataaaaaaaaaatgaagtctatcaaaaaaaaaaaaaacaaaaccaacgacagtcagccctccatatccatggcttcaaccaacttcagatggaaaacagagtattcaaggatgtggaacctgcagatagggagggccaacttgtctaatccacagattccacagggccaactgcaggacttaaccatctgcagattctagtatctgggaagggttctggaaccgcccccgccgccccacacaccgctgatgacgagggatgactgtatactgaaataccattttttcatctgtcagactgatataaatgcaaattttaacattctggtagcaaggatatgagggaacaagtatttgtaattattgccagtgggaagtaaactggtataattcttatggagggcaatctggcaatctcaaaattacaagtgcttttttatgctccagtccagctgttctacttctgagactttctcctaaatatggacttgttcacaggcaaaacaaaatcatgtatcaagttgttcactgcagcactgtgtgtaacagcaaagggcagtaaataaccaatatgtccatccagaaggttcaggttaagtaaacggaggtacatctacacattcattttaaccatatggctatgaaaagacagaggatactctccatgttagtgatgcaggaagatctccaagatatatttagtgaaaaaaagagcaaagtgaagaacagagtattcagtaggctatgctatctttttgggtaaaaagggatggaaaacaaaatcaggatatatttctgtattttcttatacttgtacaaaagaactctggaaataaactgatgaagggtgcaagtagggaaggggaggaagtagaagggagacttcattgtatatcttttcatagtttttgggtattttttaaccaaatgaatatattaccaattaaaattaggtaacactagattgccaggtgaggtaacttgcctgagttcatgaagcccgtgagtgcaaggctggcatgcgaacccaggtctccagagcttgtgttctgaagcttcacctgctcagatttatactagtcaatgctgctgcccagaggcaggcactgaacacccagatgcctgaggaaggagggaggttccctcaaagtttctttgctttgagcttcttgaagttcaactgaaagcagctgagctgggctttcagttttttccattcactttcaacttttccattccagaggagaaatatgatcaacaatctgtcagttacactgccataactttaacctagtaggagatactgctgtttcagaacagtcctggatccttatttggatctccatggacttgggtctgagtgacacaaacctacatgtcagtgagccagtccctgagcccaaacagatggtcccactgcacaaaaaagcttctctgcaaggctctatgaggatcagggccaaacgatggtcccatgaggttacctgatggacaatgctgctcatgagctccctgttagtcatactggccagctctaggtgaactggaataccagtggggatgtcagaaatggaggttacaacctgcaaagagaagaagataagcactgccattagaaatagaaggaagtcaagaaagagggaagaaaagatcagatcctgagaggcggttcctcctggtaatggccttctttgcatgctcacgggagctacaagcaatgtgggtccccaccacctctgtggacaagggacactcttcccaccagggaagactaggctgtgcagagccatcagggatacagaatcagagatggcagttcacttcgactgctgtacgaatctgtaggagttgcagcatagctgatgtgaagtgagatgatacaaataacacaaaggacacaaactacaaaccctgcagcttgcagccatggtcggtttagcacaggatgcagaggctcaggcaagaagatgttctgccctgtcctactcaagctgctgcccacatctgaagggatacagtgaggtgcctcactgcagcaggaggcaagctccacagccagctgccaagatatgtccctgggaggccaggacctaagacaaggcagcagatgccaagagaggctggaacctgaagaaaaccaccagctgagatctgtgaaattctgtaacagtgccattacctccaagagtctcttcctctggagctccttgctttgtccctccatcatgtgcaatccagagaggaccaccaggtctggctgaaactcctccaggctagacacaaacacctccagcatattcatggccccgttggagaggtcgtgagagaagatgaatcggttggcatggggagcttttaactggccccactcctcccctggaaaaacccagtcaacacaatgggaagaaaaggaagaggctttaggtctcctagctgtgggggcactttcaggcacctcacaggagccttggctccaagcaggctggtttctggctgaggagaccccagcaacaatggcctaaggtcagcatggcactgcaagaaacaaaccaaaaacctaaacccaaacccagccaagaaacagaaacatagtatgggtgctatatgcctttttcaaggtaattagctccccctgagtcccaggagagccctacttgagctctcaaacacaggagagacagtacagaatggcagcatgacttccaaataccagcatacagtgtgcagcacgcacgccctgcagacagtataggctgtcattgtttaaagcacattcttcctcacagcattgccctgagcatctttcattcagttggaacttaagcaggctgaatttcttcccaacagccaagctcactgcatctcctcttccctgctgcccatcagtggtttctgggcacctgatccaaaggatcagactatctagctgctccagttgcttctatgtgagttgctttagaggaatgactgtttaaagacccaagttcaagtgctagttcctccctaaacatgaagcctttcctaatcctaccacccctaagcagacttgattacctcctttctggggccaccactgtaccctaatacaggactgaggcacatgattttgcaattcctttttcttttttccttttttttttttttttttcttctgagatggagtttcactctgttgcccaggttggagcgcaatggcgcgacctcagctcactgcaacctctgcctcccaggttcaagcgattctcctgcctcagcctcccgagtagctgggattacaggtacccgccaccacgcctggctaatttttgtattttcagtagagacggagtttcaccatgttggccaggctggtcttaaactcctgacctcaggtgatctgcctgccttagcctcccaaagtgctgggattacaggcgtgagccaccatgcccggcctgcaattactttttccaagtgtctatctctggcagtaaactgtgagctgagggcagggcctgtgtcatcctctgtcgtattccttctgcatcatgctgtgtctggcatatagccatgggaatgaattaacaaaagaacaagcaaataagagaacagactgatgacctaaatgcccatgacaacaaaaaatatgggtatgaaccccaaatccaacattttgcaaatcaacaaagactctgtacgatgggaaaaatacattacattgacattctccagagagcaagacgtggactcaacccttgaatagtgacactgctaggaaacacgacctaactgaacctaggagaaaggagccacactgtattgaaaatacactgatttcttcaggaagtgacagaggcaaaaataaacaggctcttctgcaaggcaaggatgagaagaaccgtgcagagctgcttgctgtttccacaggaaacaaggcagcagatgccaagagaggctggaacctgaagaaaaccaccagctgagatctgtgaaattctgtaacagtgccattacctccaagagtctcttcctctggagctccttgctttgtccctccatcatgtgcaatccagaaaggaccaccaggtctggctgaaactcctccaggctagacacaaacacctccagcatattcatggccccgttggagaggccatgcagggggcagatgcaaatggatctaattctgcctgtaatggtagttagcgcccctctttcctcacaaagtgttgtattcattcctgtaagcaatctcttctcaatgtatcatcctgccctcagccagtaagtcagcaaaacctctgcgtagtgactcactggattcccagcccaagcctgacaatgggcttctctggggagatctggtaagagagaatgtggaaaaaaaaatggacaaatcccttggaatttccctattgaggtcagagacaagctgggaatggatttctgttgagagagctgagcccagggctactgccactagactaggctccctccttggacctaggaaaatgtcacctcacaaagtttaatggaagtccactgctttgtatgcagaagaggcataggaaagaaaaactgaagtgtgaagcttataaacccaaggatggagacactctctttgtgcggtgaactgtgctgtctccttaactacatacgaggcacagctgtccaatacaacatcaaagtcttgctgaagacgtaagactctccactctgtagtcaccaggaaaaatgacaaaccaggaatcacaaaggtccccagttcctgctgtgggtgccaaaaaaactgacacgaatctggaactcatggcagcaatacctcaggggctcatctttagcaattccagacccttccagtccacagtcaggtcattcttttatttatttattattattattttttgagacggagtctcgctctgttgcccagactggagtgcagtggtgcaatctcagttcactgcaacctccgcctcccaggctcaagcaattctctgcctcagcctactgagtagctgggattataggcgcccgcctccacacctggctaatttttgtatttttagtagagacggggtttcaccatcttggccaggctggtcttgaactcctgaccttgtgatccacccgcttcagcctcacaaagttctgggattacaggcatgagccaccacgtgcggccaggtcatcttttcatccaagctgctcacaatgtttccgcacaccaaccaatctcttaatccttaccacaatgatcaggcagtaaaaactattactcttacttcccatttgggaaaactaaagctgagaaactcaaaaacttgtgtagcattaagtatgaattgcctacgtcaacgctgtgtccctaattttcagaccctatccttctttaattcccaactgattctagtaagcacccgaaagagaaccagaacatgttacaactcttttttctacctggagaaaggcataattctcaagaaataacatagttcatatcttatgttaaagttaattactctagtagagaagattctcttaattgacttggaagtagttcactgaagagtattaagtgctgctttaaggtaccaattagtctgtttagatgcttgagtctttaatgtgtattaacaatgtgttgaatcagaaactcaagagtctgagttctgagcagagggaaaattacagcaggaaatacacaggatcaaagtatgtccaagtatttaatattctctcagaaaccagatgcctaatctacgtaacatataaaatctgctgggaagaggggatgggatgcagtggatgtggatttattaacattagaacatctgatgggaaacaatatagtgatgttaaatacaaaacacttccattcacacacccaaggaaaaataaaatgctccagagaaacttgccagaagcttggaatcaaccccaagcagcttggaagagtcagtcagaaaggcctagggcagaatccagcacagagttgaatggatgctacctgcctttctcttgtcttagtcataaaggaaaactttatatatgtgtgtttaacacgttttcacttttatttgagatgcttgctttcctatgacctgatttatcttgggttcggagcaattctgcttgtagacctgggaattttcttccatgttataatactcagtctcccttgagacaacggccagtatcagctcagtagaaccaataggtcaggaaactttcagtatggcaaaaacaggatcctgctaatttacaaagataaatttccggcacagtcacaccccaatctgacaatacacagccccttgactggtcttgccaccattacttactcatttccttacctgcttgatactctaaaatgaggtggaactcatccacttcctgcaatgactctggtggaacaaagacattgtcatcaagaagctcatgtagctttggaccaactggaccgcaaagaagaacctggaggcaagcaacacgaagtccatcaggagccccgttcctttccccacagaacctcaacagcaccccaggacagtacattcaggctgattctaatcatttcaacaaaatattggaatccaaatctaattttgaaagctgttggtctggaggtgtgcggcagaaggcatgtcaccagggctaaggcctctggagggtatggccataatgtacccagaactgagaggctgacaaaagaactgtgtcacagccgtcaggcacctatgcagctgctacatctcattccctctgctgcggactgcacgtttgtgtcacctccccaaatttagatggtgaagcccaaacccccatgtggcttatttggagatagggcttttggaaggtaattaatatgaaatgaggtcataagggtgaggtgaggtcctaatcagatagaactggtggccttataagaaaagagagagagatcaatctctctccccccaccgcatgcaccaaggacaggacatgtgggaacacattgagaaggtggccacctgcaagccaggaagagacttctcaccagaagccacaccttgctggaaccttgttctggggctttccagtctccactgtgagaaaataaacttctgttgcttgagcccccaagtctatggtattgtgctactatggcagccaaagcagaccctacccccactttctttactcactcacaccttgtgcaggcaaacagacatgggatgttgtctgcaacaaagctgccagatgaaaactgtttgagtttttatacagtataaaaaaagtttctggatcaccatatcctcaaccgggtgacctcatttgtggaataaaattctctcccattactgaactgttaagtgaataggacagcctttccaatatgagaattaaagagcatcccaactgagagacttcaggggaaggtgctctgcaacttttccaaaacctttttcttcaactccaaccagagcctccctctggctattctttctagaagccatttcgtatctgttcctgctcctcaactccaataaaccgctgtttttgacacaacattcaaggccaggctagcagattcaaaaccactgaacaatgaggacggcactgagatttaaaggaaagtccacagagattatcagcactgcttcatgattttttttttttttttgagacagagttttgctctgttgcccaggctggagtgcagtggtgcaatcatagctcaccacagccttgacctcccaggctcaagcgaccctcctgcctcagcctcccgagtagctgggactacaggcataagccacaccacctggctaattttttatttatttttaatttttttgagacagagtctcactccgtcaccaggctggagtgcagtggcacaatctcggctcactgcaatctccacttcccaggttcaatcaattctcctgcctcagcctcccaagtagctgggattacaggcgcgtgccaccaggcccagctaatttttctatttttagtagagacggggtttcaccatgttggtcaggctggtctcaatctcgtgacctcgtgatccacccgccttggcctcccaaagtgctgggattacaggcatgagccaccgcgcctggcctaattttttatttttatttttaatagagacaagacctcactatgttgcccaggctagtctcgaactcctgagctcaagagatcctcccaactcagcctcccaacttgctaggattacaggcatgagctaacatactcggtctgtttcagatttagtatgtcccacccagaagcttcaaaaggcattaacttgctaattaactgcttatatagactgctttgtacagaggtactttcgtgttatttaagaaatcccaccttctggataaaaacatactcctctcccttttctgccttgacacatgcccattacaggccaattctgaaaaagtcttgccccaaccactttacttcctttctctaattcttggctagtgcttcacttccaagatgagacaacaagggccataggccatatttaccctcctgcctgaaacaacaaaaaagacaaaatatatgaaacaatggttttcaaaacattgtgtgaacatcagacaataaaggacgatccctaaaaaacaggactaaactggccaggtgtggtggctcatgcctgtaatcccagcactttgggaggctgagacaggcagatcacctgaggtcaggagttcgagaccagcctggccaacatggtgaaaccctatctctaccaaaaatacaaaaaatttagctaggcgtggtggcacacacctgtaatcccagctactcaggaggctgaggcaggagaatcacttgaacctgggaggtggagagccaagatcatgccactgcactctggcatgggcgacaaagtgagattctgtctccaaaaaaaaggaaacaggaataaacttagtaagccctacaaatgtcttagcatattactgtaaaagaatttccaggtatacggaacctgaaagaatttatcaccagcagactcgcaccacaagcaatgttaaaagaagtccttctggcagaagggagaatgacatgagatggaaatatgtttttatatttttttgagacaagagttttgctctgtggctcaggctggagtgcagtggcgtgatcttggctcactgtaacctccacctcctgcgtttaagtgattctcctgcctcagactcccaagtagctgggattatggacacacaccaccacactcggctaatttttttttttttttttttttgtatttttagtagagatggggtttcaccatgttggctgaaacaacctgaccacgccaggctggtctcaaactcctgacctcaaatgatctgcccgtcttggccttccaaagtgccggattacaggcgtgagccaccatacccagccaaaaatatggatctaaacaaagaaatgaagaacaacagaaatggtaatgctagataagtacataagattatttttcttattatttaaatctctttaagagataactgaagagaagtactaacaaatttaatgtgaggtttgtaacatgaggaagtcaaatatctcataataatagtataaagattggagggagagaagtacaggcctacctcattttattgtgcttcactttactgtgctctgcagatactgcagtttttacaaattgacagtttgtggcaaccctgtggtcccctatgggcaccatttttccaacagcatgtgctcacttcgtgtctctgtcacattttggtagttctcacatttcaaaggttttcattattatgtctgttatggtgatcagtgatctttgatgctactattataactgttttgggacaccacagatcattcccacataagacagtgaacttaatcaataaatattttatgtgttctgaccactccatggactggctgttcccatctctcgccctctccttgggcctcactaatttcctgagacataacaatattgaaattaggccagttaataaccctacaatggcctctatgtgttcaagtgaatggaagaatcacacatctctaactttaaatcaaaagctagaaatgattaagcttagcgacgaaggcatgtagaaagctgagtaaagcctcttatgctgttagccaagttgtgaatgcaaaaagtccttgaaggaaattaaaagtgctactctagtgaacatacgaatgtaagaaagcaaaacaaaacagaaacaaaaaacagcaacaaaaggaaagcaaaacagccttattgctgatatggagaaagtctgaatggtctggatagcagatcaaacaagctacaacattcccttaagccaaagcctaatccagagcaatgtcctaactcgctccaattctatgaaggctgagagaggtgaggaagctgcaaaagaaaagtcagaagctagcagaggttggttcatgaggtttaaggaaagaagctgtctccacaacataaaaatgcaaggtgaggcagcaagtgctgatgtagaagctgcagcaagttatccaaaagatctagctaagatcactgatgaacatggctacactaaacaacaggttcgatgtatacaaaacagccttctgttggagggtaatgctgaagaagtacgtaaaattattgtaagaagatgccatctaggactttcagagctagagagtagaagtcaatgcctaccttcaaagcttcaaagaacaaactgactctctttttggggctaacacagctggtgactaagttgaagccaatgctcactgaccattctgaaaaatcctaggattcttaagtatgatgctaaatctactctgcctgtgttctatatatataacaaagcctgaatgacagcatacctatttacagtttaataggtattttaagcccactgttcagaactactgctcagaaaaaaaaaaaaaaaaatgtttgaagtatcactgctcattgacagtatacctagtcgcccaagagctctgatggaaatgtataaggagaaggatgatgttttcacacctgctaatgcaacatccattctgcaacccataaattaagaagttattttgactttttttttgagacagtctggctctgtcgcccaggctggagtatagtgagtggcacgatctcagcccactgcaatctccacctcctgggttcaagtgattcttgtgcctgagcctcctgagtagctgggattacaggtgtgcaccaccacacctggctagtttttgtatttttagtagagacggggttttaaccacattggccagactggtctcaaactcccagcctcaagtgatctgcccacctcggcctcccaaagtgctgggattacaggcgtgagccactgcacctggctggaattttgtcaagtctattatttaagaaatacatttcataaggctatagctgccatagataataactcctctgatggatctgggcaaagtaaactgaaaacttctggaaagaatttaccattctaaatgccattaagaacatttatgatttataggaggaagtcagcatatcaacattaacaggagtttcaaagagattgattctaaccctcttggacgccttttgagattcaagacttcagtaaactgcagtaactgcagatgtggtgaaaacagccagagaactagaattagaagtggggcctgaagatgtgactgaattattgtattcttcatgataaaacttgaatggataaagagttgcttcttatggatgaacaaagaaagtggctgagatggaatctacttctagtaaagatgttatgaatattgttgaaatgacaacaaaagatttagagtattacatacacttagttgataatgacaaatagcaggaaggtttgagaggactgactccaatttttagaagttttttaatttttcatttttagagataggaatttgctctatcacccaagctagagtgcagtggcacaatcatagctcacagtacagtagcctcaaactcctaggcttaagagatcttcctgcctcagcttcccaagcagctgagactataagcatgcgccaccatgcctagctaattaaaaaaaatttttttttagagatggggtctcgctatgttgcccaggctcaagtgatcctcctgcctcattttcccaaaatgctggaattacaggtgtgagccactgtacctggcctgattccaattttgaatgaagttccactgtgggtaaaatgctatcaaacagcatcacatgctacagagaaatcttttgtgaaaggaagagttaactgatgtggcaaacttcattgttgttttaagaaattgccacagccaccccaagcttcagccaccaccctgatcagccagcagccatcaacatcaaggcaaaacactctgccagcaaaaagattatgaccgtctgaaagctcagatgattgttaacattttttggcaaccaagcactctaaaattgtgtacactttttttcagacataatggtactgcacacttacttgacgatagtacggtgtaaacataccttttaatgcactgggaaacaaaattcatgcgttttattttattgcagtatttgttttattgcagtcgtctagaaccaaacatgcagtatctctgaggtatgcctgttatcacttgaaagtagaccgtgataagctaaagatgtacagtataaaccctaatgcaaccactaagaaaaaaagaattatacctaataaagtcagagaagataaaatgaaatcatagaaaataatccaaaagagtacagaaaaagagggacaaagatagagatggggcaaacagcaaacaaatagcaagatgttagatttaaacctaacctgatatatcaataatcacattagatgtaaatggtctaaacactccgattaaaaggcagagattgtcaaagtggattaaaaagcaagccccaactatacgctgtctataaaaaatacactttaaggtaaaaagatgcaaatagattaaaagcacaaggacagaaaaagatataccatgccaatactaatcaaatgaaagctggaatggctatttcaatcaaaatagatttcagagcaaagaatattatgaaatgattttatttatccctagtaatgataaaggaattaattcattaaagggatgtaacaatcctaaacatttatgtacctaataagagtttcaaaatacataaagcaaaaagttacagaactataaaggaaatagacaagtatccaaaattacagttggagacgtcaacatacctcttaataactgacagatcaaatagacaaaaaaaaaaaaaccaataagaatatagaagacttgaacaacactatcaatcaacttcatctaattgacatttacagaacactcgacccaacaacagaaaggcttatgtatattcttgaagctttcaagtacacacagaacctcaccaagatagaatattctgcaccatgaaaaaggtctcaaaaacttagtaggattcaggtcatagaaagcatattttctgaccatactggaattgaaatagaaatcagtaacagaaagacatctggaaaatccccaaatatttaggaactaaataacatacctctaagtagtccatgaatgggctattaaatggcacatctcaataaatcaaagggatattagtattttgaaatgaatgaaaataaaaataatccatcaaaatctttgggatgcagctaaagcagtacttaaggggaaatttatagcactaaacccctatatgagaaaacaggaaaggtctcaaatcaatgattgtagcttctcaccttaagaaactagaaaaagagcaagtcaaatctgaagcaagcaaaatccaatgaaaatagaaaaacagagaaaaataaattcaccaaaagctaattacttattaaaaagagcaataaaatttataaacctctagccaagctgatcaggaaaaaaaagaagatacaaatgaccaatatcaggaatgagaaggaaaacatcattacaaattgtagagatcttaaaggaataatagaataccataattaactttatgccaataaatccaacaacttagatgaaacaaattccttgaaagatacaaactactaaagctcatttaaaaaaaaaaaaggaaaatctggatttccctatatctattaaagaaatcagttatttaaaatcttcctacagagaaaaccctgggcctagaaggcttcactagaaggcttaaattctataaacatttaaggaagatacaataccaatgcgacactcactctgttttaaaaattgaagaaagggccaggtgtattggatgaatccaagcactatggaaggctgaggcaggtggattacttgcaatcagaagttggagaccagcctggccaacacagtgaaactccctctctactaaaaaatacaaaaattagctgggcatggtggcacacacctgtagtcccagctactcgggaggctgaggcatgagaatcacttgaacctgagagacggacattgcagtgagctgagatcgccaccactgcactccagtctgggcagagcgagactccatcttaagaaaaaaaaaaaattgaagagaagataggtgtggtggctcacacctgtaatcccagcactttgggaggctaaggcaggcggatcgcttgaggtcgggagttgagactagcctggcaacatggtgaaacctcaagtctacaaaaaatacaaaataattagctggctgtggtgacgtgtctgcaatcctaaatactcaggaactcggctgaggtgggaggatggcttgagcccaggaggcagaggttgcagtgagccgagatcatgccactgcactccagcctggatgacaaggccagatcctgtctctcaaaaaaaaaaaaaaaattgaagagggggaaacactttccaacttattctacaaggccagtattgccctgacagcaaaaccacagacattacaagaaaagaaaaatacagaccaatattattcttgggcattgatgtaaaaattttaaacacaattttagtaaactgaatatgtgaaaaggataatgaatacatcagaacaaagtaagctttatcctagagatgcaaggttggtttaatatgtgaaagtcaatataattaccatatatcaaactaaaaaacaaaaaaccacacaataacctcagtaaatgcagaatttgacaaaagcatttgacaaaataaaataactattcctaattcttgcctaattccacaagtatatatttttttgagatggagtcttgctctgtcgcccaggctggagtgcagtggcgcaatctcggctcactgcaacctccgcctcccgggttcgagcgattctcctgcctcagcctcctgagtagttgggactacaagcgcctgccaccatgcccagctaattctttgtatttttagctaagacagggtttcaccatgttggccaggctggtcttgaactcctgacctcaggtaatccgcctgcctcggcctcccaaagtgctgggattacacaagtatattttttaaaggcacggttcctctcctgaaatttggcttctattctatcattccactaaacctgcctttactatattcaccagcgtctatttcaaagatgcaatatagcatggctattaggagaatggattctgaagcttgactacttgggttcaattcccactctactcattatcaggtatgtgattttcaccagttttaacttctccatgcctcatttttcctatctgcaaaatggggataataaaaagacttcccttatagggccctatgaagatttaaattggttcatacacatttaaagcacctaaaacttaaaacagtgcctggtatatggtaaaaaactatagaaggaagtgccagctataattaccacctctggaaaatacctagttcttaatctctgtagttctcagatgatctctcagtccatgttgagaagcatttcagaaagttaaactgagtctctttgagagtgcatacagggtgaagtaaaggcagagcctgacacttgaatcctgactctatcatttactagccaggtgcccctgggcaccttacttagcctctctagacctctgtctttgaaatcataagactgttgtgaggattgagtaacagaatgcttctctttcctcagtctcctaccaaagccagacctgttttattagaatgccttccaatcagactggtcccaggaccagctactccagagaccaagagcaaatgctggtcccaggggaggtcaatactgaaaggtcaatcttgtactcagccatgaccgtcctgggtattgtcttcccagagggcagaattatttctcaggatcaggagggtggcttcttaggaaaccatgaaaactcctgggattctgatgggaatggcctgggctctctctaaagggcttatgatcaatctccttttcttccacccattagctggtaatatttccaaaggtcagccctggaatttctaatcttctctatttgggagttaattacaatttataaacataatgactgcaaaagtctttattttctttttattattctttcttaaaagtattttctaccctaatatttcatgagaactttgattcctattaaaatatgaatgttcacattttaatatcctctctaaactgaaagcacatctatctccaggtgtatagtgtggctccatatgaatttttccctgaaactgctgatgacctatccgtatttctgagttcatctctggcttctggttccaccactctgactcacatttctatttttaggctggtcccccaaaactagaagactgttcacagtctgttttctagtgttagcggccacaaccattctgcactgatcaaggttatttactccataatcatctttgataaatctcttctttgttccccatgtattgtagtaggttttagatacatgtttctcctctctggctgctctaatccaaaccttaatcattatacaggaaaacagcgataactttcttgttggcctcccccttcaggcctattctactcatagcaagagaaacttcttactcaggtgttactgtgaacatggcaacgatttttaattctacttaaaccaaacaatttaagtcttgaagacactcccctactgactctcatctagtggcttttattttttggcactctggatccaggctcaccaacacggccaaccgttgttttccctcatgacttgtataatccttagtctcaaggcccacatgctcctaactattaaatgatatggtgcctaagaacatgggttattgggtcagactgcctgggttaaatttctcattccattaccaatcagttgtgaacctctgtgtgcctcaagttttctcatgcagaaaggaagaacaatggcagtaccgactagccttacagggtttgttgcaaggattagataatctatgcaaagcactaaagacaatgtcaggcacagagtaaacactcaaagtattagttactactatctcctactattactgcttcctaacaaaagacccagggtctggtacatagtaggtgatccataagttgaatcaaggaatagatactcattcttgctcctaaaattattgaaacactagggaaaggcataggttttaatctaaaaacttgacctacctttaaatctgagttggctgcaaatttctgtccaattaaagctgcatttcctcctacatagtgctgtaagagagttcaaggcttttagacagtattttaatacaactatatcacccaagtttaatcattttttattttaaaaattaatttatagtccatttcccaaaaacattttgaggtgattttacatcaaaggacacacagatgaagtgaatgcaacacagaaatagaaagtgagtaataagatgaagaaaataaataggacaaccatgaaaatgagtctgattgctttaactgttgatcaaattcagctctgagcttacagacagccagaagagacacaggaaacaggaaaagtgtggacagggcttatcgtctacattatagtccttctaaaatgaagaaaaatttcactatcctgtggaaaaatcattcagtagatactataatgaactaaaatctaactcttgagtgaggcacatatggcctttatctaacccatgttttccttactaccttcatctcctgcccttcccttccacaccctgcttacagctctccaagtcagccttcccctgtctctgtgcctttggcacatgctgtttccttccattaggacaccctccctttctcatatactaggtaaaaccctgatcactttccaagaatcagctgcagtgtcacctcttctgtaatgccttctctgttccccttacaccccactgacatctcagccttcacaaccgccctcaccagataggattacagatctcttcctacccctataacctgaacaaacctctaatgcagctcttgtctgcttgggctactatcatctgggtacacaactaggtccttcggggcagggactgtcttcttctgaagtgttcagtaaatgtttgttgctaaattttgagaaacgaagaaacacactgatgtgttgggaaacataaaagttttcctgggagtaaattctaaagataatgggcccctaatataggacagtactttcccttaaacaccacatctctcagctgaggacctggagaacaaataattcaaggttggtgttccatgttgctaaggatggatccatatgccttggaaatctgacacataacagctaaggctgctgttctattataaaagttgaaaagcctgatagtgttacctgggtggaatgctactatcccagcttcctagtcctcagcccacgcagaggcatagactaaaccaggggtgtccaatcttttggccgccctaggccacactggaagaattgtcttgggtcacacataaaatacactaacaataacgacagctgatgagctattaaaaaaaaagggtgggggggaggttaaatctcataatgttttaagaaagtttatgaatttgtgttggaccacattcaaaggcatcctgggctgcagactggacaaggttggagtaaacaattctagatggtagacatcactcttatcccaattttgtgctgactaacctctgaattcaggtgggacagtaatagctttttagagataatttaaaactttctgtgatatgtaggctgaaatttggccctttaacatgtcagccttaatgttttattcaaccacgatagttagaatttactaaaaaaaatcttgggaaaatagtaagatatctacaaagtggatttcagaattttcatataatgtttatcaacctgccttaaactataaggaagtatgaaaaggcactcctctagtgaaaggggttttacaatgttaagaaataacctggaccatcacaaagctagatcaagttgctgtaaaaatttttttcatcaagaaataaaggcagaatcaagagagaagagaaatcaaactggtggtttaaattccgtaatcataaagacttttgagcagtgaactcatcatgttagaactatcgagattctctcataagagataagaatctcactactgatcccagttgtcaaaatgataactgaaatcttaacttgctgtcacctttagaaactcagctaggtaatgcctatgtccatttctaatgttcaaataggcagcttcgaagacaaaaaacttatttttaaaatttttttgagacagggtcacaccctgttgcccagactggagtgaagtggcacggtcatggttcactgcagccttgacctcccgggctcaggtgatcctcccacaggcacatgccaccatgcccagctaattttttgtattttttgtagagacagggtttcaccatgttgcccaggctggtctcaaactcctgggctcaagcaatccacctgcctcagcctcccaaagtgctgggattacaggcgtgagccactgtgcccggcctaaaatcttaagtcatcaaaataaaagtagtcacaaaggtttgcctgtgaaaggtgccaattaaaaatggcattaagagcttccctggctagaactaccaaaccagactgggtgcccagccaaagggaggtttaaatgaggaggaagaatggggtgggggcaagacatgggagataaccaaccaaccaaaactcagcctcaagaggcatgagggtacatgtaggagcaggcatactggggtgaggtaggaagagccatggttgggtctccagccccagcactgcctcttattccacgtgaacctccaggaagtgcctggaccatgcagggctttgtatataatcaccaggtgaacttggaaaccactaaggttctaacttcgacaggttctaccttgcagaccagtggttctcaaaaggaggttctcagacctacaggatcaaccaggaaacttgctggaaaggtaaattcttgggtcccatcccacatctactgaatctgaactctggtagtaggcccagaaatctgtgtttcaacagcctctccaaatgattctgacacatgctcaagtctgagaaccatcaacctagacccacagttttcaaccaggggtgattttgctcccctcctcttcaaactggaatgaaaagttgcttgcttgcttctaggaaccatattaaaaaggcatctttttccacccttaatttactattgctgaaccaaacagacctgggctcctgggaactctgatgcaacctgggcaatgtcgtgaaaagtttccttatcactgaagaagcgctcagcagctgctcccttccccatgaagtgaatgaaggcttcttccagatcattccttgaatgcagaatgctgtgatctttcccattcccaggactaaggccaagtgcctgcaagagcttcacccctgagagcaccacatcaacacatgcattgactctagaaggaggaaaaaaactgtgtgaaagcagcagaagcaccaagtagccattttgcatttaacaaaaggaaaatgtttctcagaaccttattcaacagaaaaaacaggaagtaggtctgaaacctgaattgggaagtaaacagcacatggcaggagaaaaattactttaactggatttatgtattagcatcagaacacaggactcttcaataatttggcaaacttttacactagttacaaagtgagaagataggtgcttagcatttcagaacaaagctactgtaacaaaaatgtaacatttctgagaaaaacgctggcagagccaaacaggattcatgctggccgtgtgacttgggcaagtcactaatttctctgtgcctcggtttcctcatccacaaaatggcaataatatgagcatttaactcatagagctatggttaagattaaataagtgaatgtatacttaggaacagcaattggcgcagagtaagcaaaatatgtgtttcagtcaaaggctaggtatcaggcatcttccctctaaaaacaaatgaggatggtaagatacaataaattcctaaatgcctgagtactcccagctgaaaccctgcctcttagaatttagtggtgttttacagacttaggcacacctgcagcattttaagaactcaccctttggccagtgttcacaggactgacccatgaacgttaaagacctgccactcctggttgtctcgatggaaattataaagtacaggttgaatcccttatctgaagtgcttgagatcagagtgtttccgattttggaatatttacatatacatgagatatcttgggaatgcaacccaagtccaaacacatttcatatatactttatacatacagcctgaaggtaactttatacaatgttttaaatacttttgtgcatgaaataaagtttctattccttacgtgtgggtggaattttcacatataagtacttaatatacatcagtggcatcatgtcagtgccccagagttttggatttcagagcattctggatgctcaacttgtactaaggttgtctggcatgacctctcctatgtgtgtatggagaaagtctgtcttacattttcagggtttctttgctaagtcatccctcttttaaagagaacgttcaaataattaaggtagctagatgaggtcttcccgcccctacccctatcatggtcatctttattcctgcctctgcctattgggatgtcattctggccagtgaggttggattaccacacaggcagctcccagccggcaaactgagaccacccctagtgatacgggtgactgggcttcagagttaattctgagcagctctgaaaccacaaggtaaactcattaataaaaatgtcccaatggatgagattttggtgtaaaatacatagttgtatttcccttttagtctctttcaaaaatgaagaggaatgagactgggatgaagaggaattttaccaggtatatttctacttttaacatgcttgtattccttttagaatttttaaaatgacataactttaaaaaggtttgtatgcagactagatattatttacatcacttaaggaagatttacaagggcaaggaagagacatcctccctcaagacacaaagagactgcatcctcattataagggtcctttttattaattcttcccctagggattcatgttttgaaaggagttttgcctatcaaatagcatttaaatactcagtttcttgttcaagacacacataatgactctggtcaactggagaagcataacctaagatttactatgcctttcagtgcataaaacatctagctactgtatttggcccttctctttaaaagagggatgatttctagtaaagaaacactgaaaatataagccagaacttctccatgacacacacagaaggggccattctggacatgcacgtggcagttgcttaaagatatgtttaaaatctttcctttcacaaccttcaatgttaagaaaccaaacacaccttgcaaactggtctcaattttacctcagacatggtgccctttatttctaatgaatgcaacattagattggtagaatcaacaggaatacaagtatctgtagctctcagacgccagtaggttcctaagtttcagacagtgagggcttgagtaaggagggataccatttcctccagacagcccagtctaaaaaaattgtatccaaatggatttgggtcccgagtctgaagagtaaaggttcagaaatggagggaaacctgtctttgaaaataactacttcaaaaactataaacaccctcaagcctgtaatcccagcactttgggagaccgaggcaggtggatcatgaggtcaggagtttgagaccagcctggccaagatggtgaaactccatctctaatgaaaacacaaaaattagctgggtgtggtggtggacacctgtaatcccagctacttgggaggctgaggcaggagaatcgcttgaacccgggaggtggaggttgcagtgagctgagatcgtgccatggtactccagcctgggcaacagagcaagactccatctcaaaaacaaaacaaaacaaaacaaaactataaacaccccactctccatatctagtactgctgagattttaaacagtctgactccttaaaatgagaatggggaaagctgttcagtatattttgtaacacaaggcaaaacccaacagaactaattttgagttacaaaatatcactatcatggaacattttccatccctcacctaatcataccaggaataccgggggaaaataaccagtttttcagactggttcacagtttacttgataactttttataattaaaaaaaaccaggctgagcacggtggctcacacttgtaaccccagcactttgggaggccaaggcgggtggatcacttgagcctaggagttccagaccagcctgagcaatatagcaagaccccgtctctacaaaaaatacaaaaattacctgggtgtggtggtgcacacctgtagccccagctactcaggaagctgaggcaggaggatcacttgagcctgggaggcagaggttgcagtgaaccaagatggcaccactgctcttcagcctgggtgagagagcaagaccctgtctcaaaaaaacactgaacatctactacatgccggatgccaaacaagtactttacatgtactttcttgttctgttttataatactttaaccagaataagaatctttctctgcactttctcaactcaatagcatcccaaaatgtaaaaagcatattacctaaggggctgtattgtcaaggggaaataaagggagacacagttaaagaatcagaagacaaaattatgctcatctgacatgcaagcagaagctcacacttcagtaaaaaatgtatattagatgactgtgattttggagaaaacacagatgaaacaactagaaaataggtcaagacaacagatgctgaatgtcaaaatgggttggggggctggcaaagagggcacagttctcccttctagaccataagtgcctctaaggcaaagacgatgtttcctatctcctcccttctgtttcatcacctgtaaaatgttttctaaggttttctctagctttacattatgtgcatcagctgttataagagctaatcgtaattgttaagacatagaactgtaaagaggcgggggaaaaatggctagggcagtggtccctgtgctgaaccctagctcctgcatctagatagaagaaaggcggctgatctttaagaagcaccccacgctaggcaggcattttcagatagattaaacctatttgcaaaatgcggtaagatcgctaattagtcatcactgctttcagctgagaagagtgaggccatggattaactaacattccaaagcccacagacaggcagagctgaaattcaaacccagatttatctgatgatactgaaacccacgtaggaagtatacacaagcaaagttgtacatgaagggattaaccttgtgtttggatacaataaagaattatctagctagaatggagaattcatacaggggagaagaccaagatatgtttcaaggttcagggtgaagccagttccaggggcaataaatattagcatgagggtttttttttttttttttttttgagatagagtctcactcttgttgcccaggctggaatgcaacggcgcgatctcggctcaccgcaacctctgcctcctgggttgaagcgattctcctgcctcagcctcctgagaagctgggattacagaaatgcatcaccacgcctaatttttttatttttagtagagatggggtttctccatgttggtcaagctggtctcgaactcctgacctcaggtgatccacccacctcagcctcccaaagtgctgggattacaggcgtgagccaccatgcctgccgggtttcatcatttttaaaccaatgaataggtaccagagtctgatttagaagcaggggaagtttcctagaaacgccttaaaactcctcctatcctttacttctttgaccccttttcaccagccccttaatgcactagcatttaagggctagtgcctcccagaattccacctttaccatttttaccttctcctcttctcttcctgggtgatcctatccagtctctggcttcaacctaagtgccagtgtctccaaaatttgcaatcctgtttctcaatatattcctaaaaaccagcttctcattttcagtagctgacagagaagcttcatctgaaatcccataacaatgtatgtacatttctcctcctctgaaatccaatttatcttctgaaacttgtttttcttaaatctctcttaatggcaacaacatggcatcaacaaggaaccagaaatgggaaagaccaggcttcaattgctcctctggcacttgatagctacaagatcttgggcaaataaatcaatgtgagaagactcggtgacaatatctgttatctgcctccctcataaagttgttgcattagtcaattttcataatgctataatgaattgcccgggactgggtaatttataaaggaaagaggtttaattgacttacagttcagcatggctgggaaggcctcaggaaacttacattcatggtggaaggtgaaggggaagcaaggcaccttcttcttaaggtgtcaggaaggagccgtgccgagtgaatagcagggaagagccccttataaaaccaaaggatctcatgagaacgaactcactatcaggagaacagaatgggggaaccgcccccatgattcaattacctccacctggtctctcccttgattagcttatggggattacaattcaagatgagatttgagtggggacacaaagcctaaccatattagttgttataagatatttaatactgggctgggtgtggaatcacagctgtaattccagcactttcagaggccaagatgggaggccaaggcctgatcccagtagttgaagaccagcctgagcaacttggcaaatcctgtccctaccaagaatataaaaattagccgggtgtggtggtacatgcctgtagttccagctactcgggacactgagcatgacaggtcaaggccacagtgagcttgaacatgccactgcacacgccagcctgggtgacagagtgagatgctgtctcaaacagaaaacaaaaactaaacaagatatccaatattaaaaacctgtcgtttttgactgcctttctttactccaccacatccaaactattattcaggttatctctcaaatctcacctcttctacatcattgccgagtttggttcgggctcctttctccctttacacaaaccctacaatggcctcttaaaccagtgtcaggatgtcaagatattcctccttatgaatcacattaaatggcattttgagtgtgtctgtgtgacagagagtgtgaatacgagtgtgtctctagagaagtcaaactacaacctcaaaatgagattctgatacaagtactacacctgctccccctcatccctcctatatccccctatctttgggctaaaaatcctctttgggtaataaatgatgagaagcagtgaaacagtttagaaccactgctcaaaatccacccttcacattcccaccaattctcaacaaagaacttgtcatcagttaactacttacaaacctttatggcttccccataaaaggcccttcacaatctggtccaacccttcgttctcagcatcatctctttacaaccctctaccataggattctcgctccaaaacaaggccgacctgttcccaaacaaaccatgtactttttcacatttggttctcttgcctaggtggacctgttcccactttggcttgaagaaatctcatttatttagtgtctgtcctatgaaagtcactgtagtaaaatatattttccaagatggtggcaataagatgccccattccaaatgttcttttcacaatgtgacactgatgctcctcccatcaaggtttgttctatgtcccctcccttaaaaccaggtggacctgtgactctggtagaagagttcctatgtgcttctaaggtaaggtcgtaaaaggcattaaggcttctgcctggtcctcgtgggttgttcctcttctaaccataattgttatggattgaattgtccaccccccaccaattcatatgctgaaaccctaattcccaatgtgactatatttggacgtagggcctttaaggaagtagttaaggttaaataaggtcatacgggtgagccctattccaaaaggacctagtgtccacataagaagaataagaggcaccaggagtgtacatgcgcagactaactgaaaagccagctggctgcaagctaggaagagaggccacatcggaagccaatcctgccaacaccttgatcttggactatcagcctccagatccacgagaaaacagatttgttgtttaatccacctaatttgtggtattctgttctagcagcccaaatgactgatacaataatatgtttccaacaagtgagacaggggccttgcttcacccatctctgtatcttaagaacctagcacagacctgacactaaccatgtagttggtgaatatctgctgaatgaacgcgcataaagcaaggaaggacaatttaatcccagcactttgggaggccaagatgggaggctggcttgagctcaggagttcgagaccagcctgggcaatatagcaagacctcgactctactaaaaaaaataaaataaataaaaaattggctgggcgtggtggtgcttgcctgtcgtcccagctactccagaggctgaggcagaaggatctcttgagctcgggagttcgaggctgcagtgagcagtgattgcaccactgcactccagcctaggcgacagagagagagaccctgtgtccaaaaaaaaaaaaaaaaaaaaaccccaaaattatagctaatatcgaatgctttttaaagcaggcactatgctagagagattacatgaatgatgtcatttaatcttcaggccaagtttgctctactttacccctcccggccccaacactccacagaaagtagtgagctacatggtagagggcctgcttttatgtggtggttatacataactctgagattacggcaagaaagtcaaatcgaactgagacagggactaaagttagtgtttacagtatcaatactataaagaaaataattacattcccaaggaaaagtacaaagaaaggaggtagtgtcatttggaagaaccttaaatatgcagtgtcactgaagtcaggggaagaaaagaatttcacggagaagggcgtgttcaatgcgtggaaggctgcagagtagataatgaagattcaaaaaggcaaatctgagaggagttgcagtacagtcgtgtggtttctagactacacggcgtttcgaaagtgggtaaaggcagacatcacgcgtcttcaagaagttcagaagaaagaggaagagtgttgtcatagtgggtaaggtcaagtatctttgattgcaaaacaacagtcgccagaagagaaggggctaaaagttggaacgaggaagaaggctcggagaaaggtgtcagacaaagcgggattagcaagaagctgttagggctggtcctaccgggatgagagaaaggcgcagaggccagccgagtggaaagagcagcggtgacgaaccgggttccactcagacgtccgacacttctcgccaaggggccagcgcggacagcagcgcctcccggggacctctgagaagccctgtttctgcgcggctccgcccgacctccaaggccgacctcggaggctcagagacccaggccccgttggcactcaccccactgccacgcggcgccagcgccggactggccgcacgataagcgcgtcccaggctgccgccaaccggccctcgggggagacgggtcccgggggcgcaggcgcgggccccagacacagcgagctccagagagagcgcagcgccgagcctggcagctctggctccagcaggaagacgcagcccacggccagcgccaggaagcccgcgtacgcggagccgcgccacagcgccatggggacccaggcgccgcacctgcgcgaaccaactcctttcctagcccgcgcctcttccgggctcggcgcgcgccgatgtcgacacaagcgctac

SEQ ID NO: 999 - DNA, 32420 bp, Homo sapiens; identical to SEQ ID NO: 998

SEQ ID NO: 1000 - DNA, 32420 bp, Homo sapiens; identical to SEQ ID NO: 998

SEQ ID NO: 1001 - DNA, 15366 bp, Homo sapiens
gaaaagtacaaagaaaggaggtagtgtcatttggaagaaccttaaatatgcagtgtcactgaagtcaggggaagaaaagaatttcacggagaagggcgtgttcaatgcgtggaaggctgcagagtagataatgaagattcaaaaaggcaaatctgagaggagttgcagtacagtcgtgtggtttctagactacacggcgtttcgaaagtgggtaaaggcagacatcacgcgtcttcaagaagttcagaagaaagaggaagagtgttgtcatagtgggtaaggtcaagtatctttgattgcaaaacaacagtcgccagaagagaaggggctaaaagttggaacgaggaagaaggctcggagaaaggtgtcagacaaagcgggattagcaagaagctgttagggctggtcctaccgggatgagagaaaggcgcagaggccagccgagtggaaagagcagcggtgacgaaccgggttccactcagacgtccgacacttctcgccaaggggccagcgcggacagcagcgcctcccggggacctctgagaagccctgtttctgcgcggctccgcccgacctccaaggccgacctcggaggctcagagacccaggccccgttggcactcaccccactgccacgcggcgccagcgccggactggccgcacgataagcgcgtcccaggctgccgccaaccggccctcgggggagacgggtcccgggggcgcaggcgcgggccccagacacagcgagctccagagagagcgcagcgccgagcctggcagctctggctccagcaggaagacgcagcccacggccagcgccaggaagcccgcgtacgcggagccgcgccacagcgccatggggacccaggcgccgcacctgcgcgaaccaactcctttcctagcccgcgcctcttccgggctcggcgcgcgccgatgtcgacacaagcgctacgtcacaagggtgcgccacggggccccccaaggggcggggcgacgggcggcgccaggacggagcgaggggggaccccacgcctcagtcccaggcctggcactgcggtgttgccgccccggaggaggtgggacaacggcggttgtgccagtccgggcgctgcacccccttcccggaactctaatcgtatccccaaatagagggatgggaacacatttgctttcgcagtaaaacgaaacggacagattgtgaagaagcggacaaacctcgcgttaatattcgaaccagtgggtgtccccattggcacggatcacacccccatcttttaatccctccctccgcccgtgtcccctcatttgctagacttgtcctcttccaggcctagtgctcggcgcttctgagaggaataggctcacagaatagcggcgctgccgagacccctggggtacgcgaggcagggggattccgcccctttggaaggtggccgagaccctcagccactaaaggacttcgtcgagacaggagagcccgcagagatcgttctcttctggataaccagattattccacaatcaaactttaacccttttgggggcgctgttccctttaacaaactctggaaaatgtacacaatcttgtgcacaacacgagagttatggacctgggttgagaaacgctgctttcttttgttcccccttggtgacatcacttaaacccagccctctcttcgctgatacttttctgtgcatgaggctaggttgagagacagtgaagctaggctgggtaccagctcattctcatcagccacaatgcccggcctagtcttgttccctggtttgtttccacttttccaattctctcggctcctgaccttggctttgtgtccagttttccactgtgaccctgacctttggacttggcagcgaaactttatttccctaactttgatcttgggcattagtcttcattctcctcagccccacctcatcagaacttccccatcctggtcatctaccttcccgcagttcatcctacccagcctacctgaccatgccatccctttcgacaaagatattcacacaggaacagatttgggctaccttggaaaagaagccaaagagccagtcagatctttatgaagccatgaaagccatcttccctagagttgcctgtcacttctctctccttagggagacatgtcagtcagttcctagagaaactgcttcttctcacaaccctcagctgtcaggtttccctggcacccagaggggactgagccagcagctgacctgaaaacagcgagtctgctgactgtccagcgatcatttccctctattgagaattttaaccaagtttctgttgtctgtagttatttgatattggctgtggacccacaaagtcacacaaggctaaaggtcagaaccagttaaatatgtttccaaggtgaagttttggggagcacaggaagctgaactgtgggaaggtgatagaacagacagatctagaggactaggagagtgctccacattaaagtgatgtggacagaaacctgcctggggctttcttgctcccacgagaggctgctaaacttccagcactttgcacctaattcttctgcttctttctagatttgccagaattgttgatttagtcacagagacaaaacaacagcagttgaacaaagtggatgtttatttctcatgtaaaagtctaaatggggtgttggcatgttgtgggctgtggtagcaagcttggccccctctggttgctatgggacctgctgtgggcctcttgctggttagtcactcagtgtgggtttgcattgtgggtggtgaagggggccagacaaggaaacgagagagctgacctcaattccaactgagaactgaagagtcaggagccgcaggaggtgaagaacagaacaccagggacagttgccaggcctggcggagcctgatgtggcttctggtcacatacagagtcacagggcccttaattccttctcatcggggctcaggggcaggcattcactgtcttggtgccacagtccctcttgaaatatttccttaacgaaaatcagaaaagattctgatcatctatctgttcagagagtctggaatcctttgcaagccaattgtttttctagaagttaggtttctggggacaattaaaacagctctgagtgggcagctgtggctcctttgcctaggctgaacaaagaggaaagggctgggctgggcaggcctcaagacaccccccgcccccacccaaattgcttccagacatggcctttcctattggttctctctcctaggaccttgaaatgagagaagaaaagcaatttggttctagaaaattcagaggcaaatggaggctccaggtgccccacccaagatcctgacctggaaggccagggagcagatcctgtatgaacacaaagaattagcagaatcctgtcagcttccaaattagctgaaggttttggctttaacataaatacccatcagcgtcacccccgcaatctgaaaggccttaaggggcacatttgttcccacgtggagcagaaactaaagtgggaccaaatggtccctgtgaaagctgggctaacccactttccttgcagctccaggcctctggggtttcatccaagctgctctttgaaggccacactgtgtcaaagcctttgttgatgccagggacacagcccaccacaggccatgcccaaaggccagagtcagagcacaattttgaagattacagaaaactccaaagagattgaagagatggaataaaggatcccagcccccgaaaagagaaagctttgtgtctgtagccatagcccttggcaatcagacatcctcctcactaatgtgaggtcaggaggggactagaagtgctcagaggatggactgcctctggccagtgcaggggagaggcaggggtgttgaggcacaggagccagatgagaggaacgtcagcagcaaagcagtaagaagaacatgagagtttcttgatagtaatagaacttcctacacagactgggaaccgggttgtagcttgaggggatgtgacaacatagtggcccggaattttcactttggaaattaactgctttggaccaggaagaagcgctgagcctagaaaggcaggaggcacaggactgtgtgggcttctgtctggcagggacctatgagcttcatagggcgaatgaatcggggcaggataaagcagaggcctccaccctcacagtgctcttagccatctcaggcttcccggaacactgctaccaggctgcctgctggagccctttacactcacaggccttcctgcttgggttctcttctgcaggctgcgtaaaccagtcctgttgtagcccttgtagcatctgctgtagtgatctggtttgggtttcagtattacttgcaatggtttggaaggaaatgggaagtttgccttctaactacattttctttttgattcaagaaccctagcagttctacaaccactgggcctaaaactaaaataaaggaaaaataaataaaaggaagcaaaaacatctaactgggatggcctggcagcattgccagagagagtcctcaggggcccatgcttgttctgtcttttgctctgccatccctagggtggacagcacggaagaggcagtacatcttaacaaaatcagggttctggatgaagggaggggtggtgaatggttgctgcaatcaacagttcatacttcaatggaaagaaggtgggatttgattcctggctgcaaatcttcactctgtcacctgctatctgtgtgccctcaggtaagtcatttaacttttctgttcttcagtttccttatatgcaaaataattcctactttgcagaatggttgtgggaggtagagttatcttaagacagtctagcacagtgtctgctacatgctggaattcaaaacattccctgctgttgctatggttggttctgagagctatatttaattttctttttagtctttcttgctggtctgtcactctcttactataaggaagacagccatttctgcataggtcactatgcagtagccttttctattttttgacggcttagcatctatgtaatatcccactgaatgaaaatactaaaatttatctattgtactatgaatagacgatttggagttttcccagtttttttactattacatacagtgttgctatgtatatgctgtggtacacgtgtatagccatttcttcagggtagaaacaaagtaacatttctgggtcatatgatatgcctgtcttcaactttactatataatatctgacatctttccaaagtggtatgccagtttatcttcccactggcagcatatgagaatttctgttgctccagctacactccaacagattcttaaagctttgtcattttgtagggtgtgtagtggtatcttactgtggttttgacaagtttccatttgttggttatttgcaagtatcttgcctccctcccagtcacttgtctattcattctttttataatatctttagtgagtagagttctatgaaaaattattcttatttatgtatttttgtagagatagggtctctctgtgttgcccaggatggttttgaattcctgacctcgagagatcctcctgccttggcctcccaaggtgctaggaatacagttgtgagctaccatgcgcaggcttaaagttcttcgtttttagtgtagttaccgttttgttctttttttattactactttccccttatcattggtgctttttgttacttatttaaaaaatcttcccatactcaggatcgtgatggtattttcctgtacaaccttctaagagctgtaggctttcacatttcatgtttaggtatttaatctaccttggaattgatttttgtgtgttgtgagaagaatgcttatagatacccaattgacccagtgccttttactggtcatttctcaatgactctgcattcccacctctgtccaataccacgtgtctatgtatgtgtggatctgttttggggctcttcaatctgttccattggtctatttgtttatcagcgtctcactgtcttgatatctgttaatataaattctttctccttactcttcaagagtgtcttggctatctttggccttttaaaattcccatatacatttttgaatcaacttgtcgccctccctcccaaaaaaacccaattaggatttttatcattctaggactatggtagatcccttcatttatttagatctacctaaatgtctcccaatatcatattagactttttgtggaggatttgtatgtctttagtaagttttattactaggcacttaatatttttagtatgcttattgaagtaaaattgatatgcattaagtgcataatatttaaagtatacaaattaataagtttaatatatgtatacaccctgaaactgttacaggaaaggggtccagatccagacgccaagagagggttcttggatctcatgcaagaaaggattcagggctagtctgtagtgcaaagcgaaagcaagtttattaagaaagcaaagtggtgaaaggactgctactccatagacagagcgggacgttcccgaaactaagaggaggaacgcatccaccctaggtacaatgcttgtatatatggagagatgtgctctgctacaagggtttgtgataaactattaattttcttaattatcgtatttggcaagaatcaatattattatctttcaagcaaaattaggaatgcctttgttccccagatattgggatatctggacactcccgagtctgggtctgttttagtaaacattattaatttgttcccttaaccgtaaacatctagaggctaagaatgcctaactttctgggaattcagtccagcaagtctcagcctcattctcctagccctcactcaaagtggagtcgctctggttcgaatgcctctgacaaaaccatcaccacaatcaaggtaatatagtaaacatatccatcacccccaaatacttcctcatggccctttgtaacccttccctcttactccttcctgcctgtacatcctcccactccctgtacctaggcaatctgctttctgtccctacagttcagtttacactttgcagaattttatataaatgggatcatacagtacatactctttttgatgtggcttttttcatacagcataattatttttgagatttatctaggttatagtgaatatcaactgttaattgctctttaaaaaacttttaacttcaaaacagttatatattcacaggaagttgccaaaatggtagggtctgtgtacccttcacccagtttctttcaatggatatatcttacataatcatagtgcagcatcaaaaccagtaaacggacattggtgcaaggtgtatgtatagttttgtgccgtcttattatatatggagattcgggtaatcaccactcaatcaagttgcaagaactgtcccatcaccacgaagatctccctcatgctatccctttagtcacacccaacccccatcctctaccattcctagaccctggcagccactaatctgctttgcatcactgtaattttgtcattctgagaaatgttataaatggaatcatacagtatgtgatcttttgagagcataatacccttgagatgcatccaacactgttgcatgtgtcaatagttcatttttgttatttatttttattttttgactgagtaatgttctgtggtatggaaagatcacagttagcttagtcattcactcattgaaggagaactccccaacaattgctctggacatgctggaattttttttttctgttctttgttcattcttgctcatggtgtgttacaaatatcataattctcctttttctctgtgaccttgtctctcagtctcccatcaaggagtgatgtctatttctccacttcttgaatctgggctggccttgccaatagaatatggcagaagtgacatcgttccatttctgagtcaaagcctgagttgttgccagttttgggcaattggttgttgccagttttgggcaattgcaaataaagctgcaataaacaatcatgtacagagtattgggtgcacatatttcatatctctgagagaaacgcccaggaatacaattgctgggttttatgtttagttttcttttacatccccacaggcagcatatgagagatccagtttcttcacatcctcaccagcacttgatattgtcactaatttaggttttgttctaatgggtgtatagtgacatctgtttgtggtcttagtttacattgccctaatggctagtagtgttgagcatctcttcatgtatttatttgccatccatatatcttcctcagtgaagtgtctcttcaggtttttttttttcttttttgagacagaggctcgccctgttgcccaggctggagtgcagtggtgtgatctcggctcactgcaacctctgcctcctgggttcaagcgattctccagcctcagccttccaagtagctgggactatctgtgcgcaccaccacacccggctaatttttgtattttttagtagagacggggtttcatcatgttggccagtctggtcttgaactcctgacctcaagtgatccgcctgcctccgcctcccaaagtgctgggattataggcatgagctaccgtggctggctgtctcttcaagccttttgcccattttataattgaattgtttgttttttgttattgaattttgagactatatatcatatattatagataaaagtcctttgccagatacatggtatgcaatattttcttccagtcttttcatcctcttaatagagcctttcacagaataaaagtttttcttcttgatgaagtgtaatgtgttgattattttttcttctatagattgtgctagtttattgctttttgttgctgaatagtattccattgtatggatataccattatttgtttatctattcatttgttgatggacattgggttctttctagtttttgactattacaaataaagttgctatgagcatttgtttacaggtctttttgtaggctttaattgctcttgggaaatatctaggaatggaatacctgaatcatgtaacagatgtatgttccactttttaacaaactatcaaattgttttccaaagtggttgtaccgttttatatacctaccagcattctattagagttctagttcttctgtttgcttgccaagacttggtacggtaagtcttttaaatttagccattctaataaatatgtaggtatatctttgtcttaatttttattttcctaatgactaatgatgttgagcatcttttcatatcttcattggtcaagtatctgttcatatcttttgcccatttttattagattgtttttttcttattactgaattaaaaaaatactctggatgcgagtcctttataagacctgtgatttgcaaatattttcttgtctgtcttttcattcccttacctgttatattggattagtggccaccctactgacctcatttaaacttagttacctttttaaagactgtacagtcacattttgaggtactagggattaggacttcaatatatgaattttgaagggaatacagttcagcccataacactccccaacaattgctctggacatgctggaattttttttttctgttctttgttcattcttgctcatggtgtgttacaagtatcataattctccttttctctgtgaccttgtctctcagtctcccatcaaggagtgatgtctgtttctccacttcttgaatctgggctggccttgccaatagcatatggcagaagtgacatcgttccatttctgagtcaaagcctgaggaggccttgcatgcttctactctctcttgcaaccctgcactgccacatatcaacaagacttatcaacaagcctgggatagcctgctagatgatgaaagaaatatggcccgcttgctcccatcactccagctgatagccaggcaaccctaagaagcaaagtcacctagctgattagtagctgaccactgacacaaaagtaagatcatctgagaccagaagacagcccatctgagctcagcccaaattactgacccacaaagtaataataaataaatggttattatttttatgtcactgaattttgaagtggtttattattgaacaaaagctacctgatacccatcttttttttttttttttttgatatggagtctcccactgttgcccaggctggagtgcaatggcgtgatctcggctgactccaccctccgcctcctgggttcacgcaattcttctgtctcagcctcctgagtagctgggattacaggcgcccaccaccacactggctaattttttgtattttcagtagagacggggtttcactatgttggccagactggtcttgaacttctgacctcatgatccgcccacctcaacctcctaaagtgttgggattacaggcatgagccaccgcaccaggcctacccttcctaagagtctttgctctggctcttactttcatctggaatactctgtgacttgatctttgcatgcctggctgctttatgtcattcatatctctgctcaaatacaatttcctcaaaaagggctacactgaccaatcaatataataagcctgtaggtctctacggcttctccctatttatttgtttatttttagagatgaggtctcactctgttacccaggctggagtgcagtggcatcatcatagctcactgcagcctcaaactccaaacacttgggctcaagcaatcctccctcctcagccttctgaatagctgggactacaggtgcatgccaccttgactggctaatgttttttttttaatttttttttagagaagggggtctcactatgttgcccacactagtcttgaacccctggcctcaagcaatctcctacctcagcctcctgggtagctgggattacaggtgtgagccacaatgcccagccatttttttttttcttacacagaaaagctccaatattcacttagatactgcagaaggaaaagagaggctgaaagggttggatcaaggaagtaggaaagggaatttctggggcatttccttcccccaatcccagaatagccacagaaatcacagtcaccaagagctgctgcttctgaataacatgacagtgatggtaaattttccaaaatgttgattgtaacagagtttgccacatgaccaaactggtggatcatagagtggacagacatcaggagctctggaaaaaaaattgctactcagtacctactcaagttgtaatggggagagaaatggactgatatgccggatttttgttgcagagagctggcaaacttgcagtaagtaactagctgcattcaaactgactgacgcacatagatggagccctgaaatccatagctccgttgaagaggcagcagaatttatctactccgacccaggtttgcggaatttatcaactccaacccaggtgctaggctgcttgtggtagggagtgaagccatcatgctgatggatttggtggtgacaaagcaggctgtcaggaagaagtaggtcccccagattctcccgggcaaggggacaacactggaaactacatgtggtagtttccagtatgttaggcttttccttctgaaacttggcaaagtagaatttgctgaaaagtaagcagtatagcttgtttttaatttcgtttctcaagaaaacccagctaagtctcatcatgactgtttactcttgtttcttttgggaaattaacttcttaatataactttgactaaagatatgtagatttgtggtatgaaaagaaaatctatctgttggatgatgttcccagtgaagtactatccatttgttattttaaaagttattctcttttgttctaaacagtaaatagtgccaaaactaagaaaaacatgtattatagtttcaacgtcaggctgacttgcctgcagatctgttcgcaatagactgtaatgcccctttaaagaaagatttagaaataaattattaaaagtattaattcatttaaaaaaatgtaagcatgaatggggacaagctggggagaatgatttgtctgctctttctgggagggtggcgagcaacatccatgagaaacctgcaggccttgccactgctgctgagagccagtgaccccaagggctgaccacttgggatgttagctgcttctagtccaggcactgtggtctgggcctgtggtataaagaagggctattgccataaaaggagatagacacaaccagcttcagttcatcctgcttcctgtctcagaattttttttttttttttttgagatggagttttgctcttgttgcccaggctggagtgcaatgaatagcgtgatcttggctcactgcaacctctgcctcccaggttcaagcgattctcctgcctcagcctcccaagtagctgggattacaggcacctgccaccacgcccagctaatttttgtatttttagtagagacggggtttcaccacattggccaggctggtctcaaactcctgacctcgtgatctgcccaccttggcctcccaacagaatttttttaaaaaagaaatatggtatgtctttggaaacccgagattcaaatcttagcaccctatatccccaccaccactaccattaacagtgcagtttggagcaagttgcttaatcttttccagcccagtttcccatttgtaaaatggaaagaatgacatccatataatgtagttgctggaggattcattattttattattcaacaattgtttattgagtgccagacattagtctagtcactaagacagacaaggtccatgttctcatggaattcatattctaacagggtaaggtcacaacaaataaataataaacaaatgaaaaatatcagatattgataagttttagacagaaaataaaatagggagctgggcatggtggctcctttctaatcccaaaatgagagaattgcttaagctcaggagttcgagaccaaactgggcaacagggcaaaacctcgtttctacaaaaatacaaaaattagctgtcccagctacttagaaggctgaggtgggaggatcatttgagcgcgggaggtcaaggctgcagtgagcttgatcacaccactgcacttgatcagcgtgggtgacagagtgagaccttgtcaaacaaaacaaaacaacaaaacaaacacaaaacaatacagattcactgtataatattatttagaaaatgcagaaaggtacaaatacttattttataataactcttaatcttaatattcaagtttttggtgtatatctttgcagagttttaaaaaaatgtgtgcacacacatgcgtcttcacagaaatggaactttgttattgtatatgctgcattgtaacctgcttatttgcttaacaatagaatggcgtctttaatatatccaaactttttacccagaatgatttttcatggctgcgtagaataccatttatttaaccaagcggtagagagttagactattcacaagttttgctattatgaacaactagggagaagcacttacacagcaaaatctgctgagtttctgaattgtctccttagtatagaccacgcaagtgaaactatcagatcccagggcgctcccgtgcggttgtcagatttccctcctgtaaagtggatgagtaaccccaccccacatgcactcccgtccacacagctcttgaaaggccaaaccaggcgacgctgtggcccagagagaaccagaagagagggtgcgtggggtgcacggcaagccattgagtctgtggccacacctaggcggagagagacgagctcgggtgagggtgggccgcgggatccacagactcctcttcgtgcggtggatgcatcaggctccgtctctgaacctcggtttccccatctgcagaatggggatgggatctcctggtgatggggatctgtggacgcggcgccctcgggggtgcacagaactaaggccggcctgcagcagcgacctcgggggctggtggggacggaagaccggacctcctggcccgaaggctgggcgcagcccccgcccgcccgcctcttcccgccggcgcctccccggggtggcagtgtggggagagtggcttggcgcccgcagggggcgccgcgagcccaccgcgagagcggccgcggcgcggggtgggtgccgaacgggctgcgcgccgcgctgctcccgacccgcgggtcaagtctggcgcctgggaggtccttgaattccgcgggatttgtttttccgcaaaaccaaaaacgccatccacttaacagatccgtgctaggaggccctggctcagtccttccaccaaacacctcggcccagccgcggctgtacggctcccaggctcccagtgtttcctccacgctttcaaacctcagcgctgaggtgaccgcctccgggcagccttcccggactaccccaggacttgggggcgtggctccacagcgggcctagttccgcccgtgtgctggcctcttccacgaccggcagtctttgaggatggggcttggcctccatccccttgaacccctcagcgtcgcaccccagagccactctgacccctggccaatgattataagtgagggagccacctcttctccctgcgtggcacaggccagggtccgcaggaaggggccttgctcatccccaatcttaagctccgctgagatgaaggaaccaagagcaggcttggcactgggagggcggctgtcccagtggcggggaggggagctctggatctgtgggggagtttgtgcagcgtgtcagcggggggtggggtggggggggtgggggcctgtggatgcccgcaggtgtttgtgtttgtgcatgtgtaagtctctgtgtgtatatatttgtgggaaagcatcttctaaattaagaatatatttgtgtagggtaaatggtcaagtcaaatagaaagtgacttcaatacttgttacttgatggtataaatacaatagccaaggaattcagtccagaagctcacatttgagggttagggattggtgctgtatttgttacaacaggcgtctaaccttggtcaaatctcttcctcatagtcttcattgtctctggtttgtttgtttgtttttctggtttgttaaatgatccttttttttttttccccgagacagggtctcactttgtctcccaggctggagtgcagtggcgcaatcaccactcactgcagcctcacctaccgggctcaagtgatcatcccacctcagcctctccagtagctgcgaccacaggcacgtgccactaaatgattattttttcaagggagaaatcatgcctgtcatacaaataaaaaatgaacaagtgtaaaag

SEQ ID NO: 1002 - DNA, 30239 bp, Homo sapiens
tccggcctcagggacgcaccggagccgcctttccgggcctcaggcggattctccggcgcggcccgccccgcccctcggactccccgggccgcccccggcccccattcgggccgggcctcgctgcggcggcgactgagccaggctgggccgcgtccctgagtcccagagtcggcgcggcgcggtgagtgctggcgtggcgcgggcggcgcggggtggggcggcctttgtctgctgcgggccgggcctggatcccgcggaggtccgcacgttcccgctcagggctgcaggagctgagcagggcgccttccctccgggctcctgctcccctgccctcccccaggtccgggcggcccccctcgcacaggagtcccgggaaccgcgggcgcccctcctgccctgggctgtggggcccgcggagagctgggggctcccggatcctaccccgcccccctttcctcgggttgagaggggcccgggcgccgtcggacctgcagaccccggaagctgcggaccgggccgggtgggtgaatgcgcttttgcaggccccgggtctggagcgggcatgggggcagatctgtcccgtgttgaagcttaacgaagccaccggccggcgctgggaggttagcggggtctcgggtcctgcagaggaaaacgcccagctccgggaggggagcggcggggagggaaggcgagtggttaggcgtgtccactctgcagggcccagcagggcgaaggtgtgggcgactggtgcacttccacaggcagccgtgggcagcatgaggggtcagattccgggaaggacaggtagagacggctggcaggggccacggggtgaataggtgttgggggtggggagggaattgggatgggcagtttgggcttgggaagcctcagggaggtggggggtgaggtgggatggagaggagatgcgggcgacggtggagggaggtggggaccccgagtgggggcacactagaagggaggggattgaattccagcgcccagggccctccctgcgaccgtttagctagcgaattggcaggtttggcagcctaaggcaggggatttatttctaagccaaacctgctctaatgagaaaagcgtgatagatgactcagatatgggatctatcactgagggaaaacattaagcaaatagtaaagcaaaaaagatttgtgtgtgtgtgtgtgtgtgtgtgtgtgtgtgtgtgtgtgtggcgggtgggggggtgttagttgtcttaatttagaaaaacgatttaccttcaaattggatgtggataattgtaaatgagtctgatctcttcattaaagcccggggtccttttcttataagcatgtcttcagcagttagtttctatattagaaagtaatgaagctgctttgtctttaagagagttctttatttagtgcggcctcctctagttccctctggcctcccagaagtccctaggaaatctgatgctgtgcagccttccttgtagtgtgggggactgcaaataggtgggacagtttgaggctgaggggaactgaagtctaaacttgaagtctaaacctgtccgatgggttgagctgatctgagtgcagggcaggatggagggctatggggctgtagggtatgaagtggctcatttcaagggagtattttgggtgagtacattttcctgatatctggagttcttgagattaagcactaacacttagggtaactgttgaccgtggaaatttacatacgtcaccgtcagcttactggagtatcctgatgtgaatgaaattttccttcatgactttgggtcagccctgtggacctcagtttttgttctgaggggttgtatggcaaggggacgctggcgggagagagcttcgttcctgcattaagtggcctcagtgatgcagtcagggtcccatgactgacctttggagttcttccatgtccttatggcattactggtggtttctcctgcctgcagtaagctttccagcttactctagactcctgtgctgtgagacatgagcttgtcagaggtaaggagcctgtgttaatgcaagtctcaggtgagaaggggtgttggaatctgaggaccctgttttccttcctgtcccctcttcagctctgtccaggcaccacccgatggagggttggctgaatgtctcatgttcatatacctgacagctggcttcggtgctttaatatttatggaaaggacagttatagaagtgtggtcccttcaaagtagtcctctggggtgtctgtgtccttattaggttgacttctgaaacttcctgtgagaattccatcattaaactttggctttctctggaggggtaaatctttgttctttggagtaggatttgagtttgacaaggagctggacaatgctgtttggagtcagagatgcagtgtgataagagagctgtgagttggaattccacagcacctaaagagactcctagaaaatgttgtagaacaagtggctggatggtacttggttgcacatacggggtttggggtctgtgcagaaaaatgaccaaatccaagcagcctctgagattatgaccacatgggggctgttaagctgtggatctgagtcatagggtcagggaaagaggaaaaatggcaaggaggatgacgttactgcccatgagcttatcctctgagtgggtggcgacttctcattgtccttttcccacatccccagggcaggagtgttagggaagtccaccagcaaaagggggagggcacacccagggcctaggggagggggagaggggtgaggactggtccacatgatttttgagaaattgcctttggtcttgttggctcagaatggaccccacacctggaagggggccacgtgtacagttatgcaacccttgcctgccacccccagttctaccgcccttgcagtgtgccagataggagcattgggttttcaggtttgggagtgggtagggttgtgctggaggctaaatagacattatctcatgtaatcctcatagtaatcctatgaggtagggtatcattaacaccattgtacagttggggaaactgaggcccagaaagggtaagtcacatgcccaaagacacacagccggcaaatggtggagctgggctgttgtctgcttccagaactggctttttctgctgctctggaggtaggcacaggttttacccctctttctggagcccggtaagatgtgccaagggtctccttagtaagtcagggaagactcatctggggaaccagagaaggggcaggcctgacctgggtgacccagtgactagtggccttcacagcatagtcagggcctttgctgagagttcttctcttccagagccctggactttatcatgctggggcttccaggagttccccctccaccctccagttctgaccagtgctcccagccagctgccccctttctccctttctttctctttgtggtccagagaatgaatgcctgctccacacaccttatgccattgggaatctgaccttctctaggcatagggagcttaatctgcgggaagtggagtgagaagcatttcttgctgggagccttggagcagggagagatactgtctctgggaggcaggggtcccaagttaccctagaggcaatgcaggctcctaggaactggggctgccttgtgggagacattggaatgtgtccctgtgggaatgctctgtgctaggggctatggcagcaggacggtaggagctcatggtacttggaactgtgaccaagcatctgcgaagaggaaggggcccaggaccactagaatgagtcagagccagagatggagtcgagttgtgcatttgctactttggagctggggcactgatagggctctaggtgaaaagtagggatacagaaggagtaatggtcccagaggcccagatgtgtggcctgacagaggaggtcttggccagggagagtggggtaggggcaaagtgttcgctcagtgcagaggccccatctaggaggccttgtccccatgcttgcggcaataataacagcaataataataattattactgcagttttggtactgggcactttcctaagtcctctctctctattgtcttattttattctcacagcagccctgtggggtagggattgttacccccattttagagatttggaattgggtctcaaataggttaagtcatttaaacttggtcatgtgttcagcaaggcatcggtgtcaggattgaaacccaaggctgctggcttctgagctcatgctgtaccctgggcaggcaaggcagcctggtgattccattcaataagtgaggaagagagataggagcatcagctggctcttagtcacttctgctggtggctgataattgagtgtgggcccttggccagccggccaccactctgggtccagatttccatctgtacaatgggcctggagctaggcgctggaccaggtgtaccgtaagaggccttctagctctgaggactggtggagattgctacactccgagaggggtctggtgcttagatggagaggggtcggcagagttgttctgctaagctgagcctctttcagggtagaaaccaaaggaatttggaggcaaggaggcatttaggcagatcacatctggagaaaatgcacccttccttgagtgcagtctggaaaggcttctggaaaggataggatttccagatatgtttaggtgggcacctagcaggactcagcagatattgagtgaatgcagatgtgtgtgccctgggcctgccagtgtctgacccgaaatctgcgctctgatgtggtctcatgtgctctcatccctttccttcctctccctattctccttgttgccatcccttcttttggctggacctcctctgggcccaatgtagctttcacttttttcagggctctgtgcctcctgtgtgtgtgtgtgtgtgtgtgtgtgtgtgtgtgtgtgtgtacacatttccacatgcatgtataggtcagttttgcagcccctgcacatgcctctagttccagggagaccttagccctgctttgctggccagccctgatgacatactactgtcctgactcacacagaaatcgcttggagaggaagaactgattcctgctcttgggtgggatcacgggactggggagtggtgcccagtggacagccttgaacataaaaggcccaaactgactcagattatcaggaaaaaggaaggcaaacagggaggctgttcccagggaactctagggaccctcccatctcttttctgaggctgctgcccatttatagagcacctagtattaactaggtcagttttgataattttgctcattgagtcctataatcatcctatgagggtaaggtttataatccccattttacaaatgagcaaactgaggctcagagaggatattttcataaagtttcattactaggaagtgacagagtctggatttgaacctgtctctccaactccaaagtcatcttcttaaacactagtgctaacttcttccatgaagcttcttgtgattacaccagcccaacatgcgatatggtcacagcatgggatggtggtcaggaccctttgatggttgaggagatgaagacccagaaaggcaaggggtttggcctagggagcctggcaagtgagtgacagagcctggtctaaagtccaggatatctctgttgttgctgttttccttttttcgttaattgcaaaagaatttacatgttcatagttaaaaacagagaagtgtatcaagtagaaaacagtagcaaactctcacccttattctgacactccagagttgcattcactctcaggcatccagatcctttccccatatacaaacatccatccatccatatatctatccatctctctatctaaacacacatgcattcattcgttcactcattgaatcgtgcattgagaacccattatgtgccaagccattgctagaattaaggatgcaatagttaaataaagcagatgtggttccttctcagggaggttctcatatatcatgaagaaaacagactgggtgcaatgaatgacagggtccttcttagagtggcagatctcttacctggcttttctgtcaaggtgaccctcagaatatggaggtgttaccttttatcttagtccatgttttactgctataacagaataccacagcctgggtaatatataaagaaaaaaaggttatttggcttgtagttctggagactgggaagtccaagggcatggtgctggcatctggcgagggccttcttgctgcattatcctattgtggaagggcatgtgagcgtgcagtacagacagtatgggggcagcacttacgcttttatcaggagcccacttttcctgtgataacagcattaatctcttcacttcttacaggccccacctcttaatactgttacagtggcaattaaatttcaacatgagtcttaaagcacccatgtcatctaggaagaagaaactgtatttgcagcaacactgtgaggtaggaaagggagtcctatgttgtaggaactggaagcagcccactgtggtgaggggcaagtaggaagaggtgaggctgggcaggtgggcagggccagggcagatggggctctgtaggctatggaggagctgcgatcttatcacaaggaaagtgaacagccctatgattaactattgaaggcagtgatataatttatgcttttatattaatagcaattattctggctgttgtatagagtatagattggagaacagaattgggtgggggaactagagaaggtgaacagactggtgaagaggcttttatagttatccaggcaagagatgatggtgacttggaagaccaggaagagaagcaggggtagagagaaatggagatagtgaagatatagcagacatatttgaggagtccttcagttacagataatagaaaactagctcaagcacatttaagaaaaaaaaaaaagacttgtttaagtacctaggcagtctatgtgtgcagcttgcttcaggaataggggcttaaatgatggttttagggctctatatccttctagcttccatctctgcctctgttcatttgtttggatcaattctttagattgttggtagcagacacatttattgctaacagtcccagaccgtatccttcttagtaatctcaacaagaaagagtcttttttgatggctgcagcagcaaggctctggggaagtctctgattgggtgtggcttggcttacagctcattctcgaactaatcactgagtgggggcagggcaggtttctccatgagccaggtcttgtaacatgcccaggccctaggctgggaggacagctccaccagtacagcatggactgggctccctgcaggagtgcggagccttgctaccagaaggggccagcatagaccaagagaagggcactgtagaataaaggacatggagcaaaataactgtgttaagactagctaccaaagacggagacgatctgctcggcattgaatttgcctctttgtcaaggaaagaaggagcagaagatgttaagaaggaattgaagtttaggccatacggggaggtgctcatctgttttaactgtatttgtcttctggcccctgggattgcctgtcctggtgtggggtgaacttggagacagaatctctgagaagctgtcagggatatttcaggccagtctagggtagaagagggttggacacgtgggtcacagtattccacagtttcctgctgtgcacagattcaatccgagtccccatctacgtccctcactacctcccttgcctcctctcctgagtctcagcctctcctggagtcccatcttcccagaatatgctgtggacatctcctcttctgtgacttttcatgctgtcccctccgccagatagccgagatgtctcctcctctgtgcagtccttactgagcctccccagcccccagtgaatggcttgaccctttcatccaggtttaagcctactgcctcgtccattcccacaataccttgtataaatgtgtaccaaaaaactggtcatattctattttaatgatatatttgtttcctaaaccttttttctatttttaatatgaaaatgtgggattttaaatatgccatttagcagctctgtaatcttgagcaagttattaaatctctccatccctgaatttactcctcggtgaaataggataataatagtacctacttcacagaattgttgggaagcttaaatgagttaatatgtgtaaaagcatttagaacagagcctggtgcatggctttcaacaaaactggcctatgttattattatttgataaaagcaaaataatatatataacatgggtaacttttgaagcataataataaacatacctcccaacttgagaatgagaacccctgtagttgaatatttatatgtacgattcttcatctccattcatattgcatgcatggccaatgcctggcatgtggatcatgaataagcatttgttgaatgaataaatgaacaaatgccagaagacttgagacagggaaataaccagttttatggggaagatggtagattatgggaacaacagatcgataatcttgttcttaatccttgacaaagtcctggaaccaatgagcacttgaagaagagcccactagtaggcacttgcatggcttcactggggttttgaaaatgcacttcttttcttgttcttctccagttgattggtccccagccagaagcagtgaagcttctcatgacagccctggggatgagatgggtagatgggagctgggtagcagcacaggtaggaacactcctaaccccggtgtactgaatggtggatggacattgatcatccagggacagatggtgctgtgggctttcctattcctgtcctctccctgaggaccttgatgacacccagacaccagcagagagaggagagtaaccttttcagatgatattcattcattctttttttaatccaccaacaaattattgagcattgtctatgcaccagaacagtcaaaagagtacttcaaaagatcacgacagggttacacagcattgtaaatatagttaatgctgccgacttatacacttaaacctggataaaatggccaacttcatgttatatatattttacaacaatgaaaaaaatgttgtggcagttggaggaatggactcagtttaactgggtgaaatggaatagtaacaaatgaaatatcctgtaaaactcctccccattctgaactccatcagaagaggatggcagaggtgtggattagcagcaatgagtgtgagtgacttctgatggttggctacagatttgatagtctgttattttgggttattttggtgaatggtgtgacatggctgctcaatggtgacttcgtcaaggaagatcaaatacttgcagggctttgataaggaagggggcagactcattctgtgtggtccaaggggtcacatgaggactgttgtgggctgtattgggagacaaatttgggctaagtataaggtagagcttctcaccgatgaacgctgtccaaaagcaagtggatagcccatgcaggccatgggtgcccatcacgggagggcaaacagagattgtgtgtatgcggtgggtggggggaggggcagggaaaggttccctgttctgatacttgatcattaatttctgcagtttccccagaatttgttctcatggcatcatctccctcagtgaccccacctttggttctgtcaccaccactgcacgaatgactgccatgtccctctgttctgagctgcagctcagtgtgtctgggagtccataggacattttggtgtggatgatccatagtcgagctcagtaggaactgatcttccccctccacgtgcttcatctccaggtctccttgttatgtgtgtccatgtttgcccattgctcaagccttcagtgccctcttgacaccttcagcccctccctcaatacaaacagtccccaagcctggtcacttctacccttgacatttgtccaaagctgggctcaggcatcactcggtgactctgatgagatagtctcctgttcgtattttgagatacctattttagatgtggtttccttttgtggctctgagcagtggcaatgctcatcgggtacggagacggggaagagaaggagggaaagtaagggtgggatggctccttagttagttcagatgctgtaagaaaggcccaaaatagcaatgacttatgctggaagagatgtttatttctcacccatgtgaccatctgggtatatccagggctgatactacagtccctcagggttcttctgtctgctgctctgccgtcctcagggtgttgcctttggcagtatgatcgccacacacaccacatctatgttccagccagtgggaagggggaggggaaagggaggggagggcatgcttctctctttcagggcatgacccagaagctgtacacatcagtgtacacattgcatggccacactcagctgcaagtaaggctgggatctgcagtcgttagctgagtggccgtgtgcctaactaaaaatgctatggaagaaggggagagctgggtgtgctggcagcacctgtagtccctgttactcgggaggctgaggcaggaggatcacttgagcccaggagttacaagggtgcagtgggttctgattgcaccactgaactatgatggtaccactccagcctgggtgacagagcgggaccctgtctcttaaaaagggagaaaatgggtgtaagtggacaacaactagcagtttctgccacagtcactttgtgcatttcagtgggaactgtgtggctgtgaactggttaagccttaaggatatagtccctgaaagcttcaagtactgataaagttccactagcatccacaaagcttttcttttataggtaggaacactgagctcagagaagttgcctagttaagattgcataacaaagtgtcagagctgggaccagaaccccacactttgggctcattttctagaattccagggtgatctggctgaggggcagacaggcagtgtcaggaggacgggtctctggagttcaggaaagggttacctttcccagcgcggctacctggggagctgctcatgacttttcagggatcatctctggggttatcatgcctctgaggtgcctccaattcgccctgaccatatcataaatagtatactataccaaactgcagtgatctaactgcatgtcccccttccctattagaatctgctccttgaggacagacgtgtaccttagttatctctctgcccctagtacgtccctaccaggaactccgtaagtagtgaaatgaattactaaagacatgaatgcatgtggattcaaggactccttcggttgcagacaatagaaacttagttcaaactggtttaagggaaaaaaaatgattggctcaaatatctgggcggtctaggtctgcagcttgcttcaggcatagctggatccagggacttgtctgacattttcagaactttgtgtctttctgaccctttttgtccctttgtgggaagtgttgcccaaggagcccctgcggggattgggaggaagtagggggttaggaggaagtggagtgatgtgggtgattatggtggggggcaaggagaccctcttgggcatccccaggcccagggcattttggccctgagcccaggtgcagtctggatttgttgtagctttctgagggcacatcttgggtcatctcttgggagcctccctgtggccctgcttctgcagggttggatgcccttgctgtaccttaggctgaggacagcctgacccctctctcctgctgctctgtgaaagccgaaggtgctctgtggttttgggatagagcaggaaggagaaggacgaggagtgggcactggcaggtgactcaccgggacgggtggcacatgctgactccagggcaggtcccggctggggatgagattcccctttgtggaaaacatgggtggagggggtggtacgcaggcagcatgaggcctgcgtggctccacgtggctctgggtcccgggccgaccagctctgtgttcacaggacactctcccattctccagggagcacttcctttctgagctctgtctctttctcctgtcctcagctcctccaggcccagctgtcagcgtaggggtctctgggtgccgtggactcttctggtctctttgcttctgggctgtcaaactgcttctctccagggcaggtttccaggatccagagtctaggaaaggaatgaaagggagcaagtccagggcgcagccctggaagtccctcatcttccctctggagggaagcgcagctcggccctgggagagcctgggtaggtctgatcaggggaggtgccctctgctccctgtacctgcccagagtggcaggaattagcctgatatatgaaggagacaattatatgaagagtcttgagtaccaggcagaggaatggggtctgacttctatagtgaatggggagccatgggaagttcttgagcaggggagggacatgagcagattcctgtcttaggtcctaagagaaggcaccttagagaatggggctggcagggaaagagaggagcaagcagggccagtgaggggggtgatgggtcagggtgggagatggaagcttgagaagcagtgtggagagtgagggaggcggcccaggaagaacccacaggccttggttctgtctggggttaaagagaggcagggagatgtggaatctgggcgttcgttcatccttagccctggtgcttcccgcaggggttgggcaggtcctgcaggcagctgcctgctggatcttcctgtgggcctcagggtggcccttgtggggcaggatgtggtgcctgccaaaggtgctttatgaatggagccggggaaggctgctgactcagcaggcagtaaggctttgaggccggaagcgtctggaaaggaagtggctgctcagggcttccccactgtagacagctgggagagaaggggggctggccaggatgcacatggtttggctgagggactcccttggcccagctgctgggggtgtgtgtgtgtaggagtggagggtggcggggggcgggtgtgcctggctgggattggaaggattgaggctgggcgcctggaatggaattgaggctagcagctgttgatgaggtttgctccgtggaagggtggaaaggtgtagcagaattggactctttttggctgtgctgactggcaaattacttgacattaacaaagtcacttatctgggctttaatttttttttttttttttttgagacagagtcttgcagtatcgcccagactggagtacagtggcgcgatttccactcactacaacctccgcctcctgggttcaagcaattctcctgcctcagcctcctgagtagctggtattacaggcctgagccaccacgcccagctaatgtttatatttttagtagacacagggtttcaccatgttggtcaggctggtctcaaactcctgacctcgtgatccacccacctcggcctcccaaagtgctgggattacaggcatgagccaccacacccagccatgggctttaattttttaaagtcctgcaaaaataggaccaagtgttacagcctatctcccagggtattaggaggacgtgaaatcatttctattcttgttgatcagtgttggttggcatagatgtggcttgatcaggacatggcacaaatgtttaggcagcagctgtgggactcagggacaaggtgtgtgcagcctggagggtggctgggattgggagcagggctggatttagggatgtctgcccttctcatccccagctcaggcctgacctgcagccacagacttgcctcttactcagtcctgactccagccttgaggtcatccccaagtccttgcctcttccacttctgatctgtcttggtcactcaatacagatgtgttaagctagcaaatgttctctctctgcattcccacactcatacacctagtcgcctcctaaaactctgtcctagaagcttctttgcaaatactgctgatttcacacaagctatactgaacccttccattttctctgcctcagtgaatgctccaccctgtcactgaggctcaaaaccacggccaacctgactgctctttctctctacccaagtcctcagatactgtcacttttacccagacatgctttgtctcctgtctggcccttcatttattccaccactataccttcctacagggatggctatattagcctctttttttatttttattttttgagatcgagtctggctctgtcacccagtctggagtgcagtggtgcaatcttggcttactgcaacctctgcctcctgggttctagcaattctcctgcctcaccctcccaagtagctgggattacaggtgcccaccaccatgcccagctaattatttgtatttttagtagagatggggtttcaccatgttgttcaaaccggtcacaaactcctgacttcaagtgattcgcctgcctcagcctcccaaagtgctgggattacaggcatgagccactgcactcagcctgaaatagcctcttaactggcctctcccttgccctgatacaatccagtctatgctgaggagctagagtgggttttaaacattgttacctagattatgtgtgattaaaatgctccccagtgattcccattactcatagaaaaacccaaattcctcactggtctctcaaagccctgcttgatctggctgaaacataccctcccatcagatagcgggtggaggtgctgtcagattaatcttcatgaagctcagctctgaccgtgtatttcccttattcaggaagcttcagtggctctcaactgcctttaggatacatttcacacctgtcagcccatctctaagtctggcccccacaggagctcctgctctgccctaccagctactgtctgccaaattgatctgcacacatcctagccccagagcaagccaaccttgccttcacttgccgccttgcctcctcttccttatatttggatactaacatcttagctgaaagggtggatcccagctgccccctaccccatcttccctgtcaggcctccccagggactccctgccaagcatctgtcaccaagattcctcagcagggggcccggtgggatatgggaatgaggacctcccagtgggcagttgcagccttccccactctggtccaggagagatgaggcaagagatggtctggggagaacctttggagacaaaggccttgcgtcctctttctcccaggcaggggcagccttccaccacggggagcccagctgtcagccgcctcacaggaagatgctgcgtcggcggggcagccctggcatgggtgtgcatgtgggtgcagccctgggagcactgtggttctgcctcacaggtgagggtagcagcatggggacgggaggggagggacagtgattgtggcagttggggagggggtgcccacgcctgttaggggtcctgccaagccagctctggctagcagggccataccttacttccacctgtgggatccagtaggcaactcacgttactgttcttagcctccatttccttgtctgtaaaatgggaacatgagtgctaaatgagatcgtgctatttcttgaatacactgtgtgcgccccctcccaggacctttccacttgctctttcctctgcctggaactttctgcccctaaacgtctgcatgactggatcccatattttgtggaggtctttgctcaatgtcacctcctctcaaggctctcctagctcccttgtataaaatagcacacctccgctcctccctccctatccctggcctccctgcgttattctgcctagattcgcccccacctggcgtttgcttgcttcctccctgttcaaagagcagggtccatctcagggccagagcggctgttgcatagtaggtgcccaataactgtgtagaataaacgatgtgactctccccacacggtgcttggcacacaggaagcactcaataataatagctactttaataacaatatcctcatcacatttcaaattctcatcagcatctctgctctgagacggcttcctccgtggggaagacaaagctgagggtctggcgccatcttgtggccataaagaagtgcctgtctctacccacggctgctctgatttctctagagcaagaaagggttttgtctgggtgacttaccaggtttcattcccccaaatgtcccctccaaggggcaccctggttcgactgacagggcatgagaactggcctggggcaccaggggtttcagcaagagatccaaggctagcttaagaactttagagatctctaggtactgcaaagattatgatactgagtatgattcacaataaaaataataaccataaagtcaatgttatttttctaaatgcaggaaacctttaatgagtgctgtattcaattagcattgtttcaaggttgatcttcccacattttgagtgtgcctgctttgctagtgctcgaagcacacaatctaaccattaccggagaatggtagtgccagggtgggggggttcgcttcccctcctcccctcctcctcctcctctttttttttttttgagatggggtcttgctctgttgccaaggatggagtgcagtggcgcgatctcggctcactgcaacctccacctcccaggttcaagcaattctcctgcctcagcctcctgagtagctgggattacaggtgtgttccaccacccctggctattttttagtagaggtggggtttcaccatatctgctaggctggtctcgaacgcctgacctcaggtgatccacctgcctcggcctcccatgccgggccttttcccctcacttctgactcatcagcaagtcctgttgattccctcctaaataaaccttgaatctgatccctctcttcttctctactaccaccctttgaagccacaccaccctcacctcttacagggacagctgaaaccgcccctaactggcctcccccttgccctgccacagtccagtctccacagaggagctagagtgagttttaagcattgctactcagattatgcgtgattaaaacactccccagtgattcccattactcatagaaaaagttagattcctcactggtctcttcaagtcatctttggtctgggtgggacatgccctcccatcagatgtgtctgccacactggacgctccccgatattttcacacagcaaggccagtcttgcctcagggccttccacctgctgtttcctctacggggttctctgtatgtcagctctttttcattccctataaatttcagcttaattgctttaaagagcatgtgcctcaccaccatatttaaaggtacgggtattctttcttgtataaaaacaaatcgtgtttcgttaggaaaagaaaaaaaaagaaaaaaagaaaaagcacttgtgattctctctcctccagagaaaccactattgacatttttggtggatacttttttggactccccaatttataacattacttacgctcatggggaaatgcacatggtgcaggcaggtgtaaagtacctgccagatttttgaaaagctgttgctttacttactaacctgctggctccttttcctcacataccttagtcacatgctgacgagaatctgtgtgcccatttgtctctctctcccattaaaatgtaagttctgtggggatgtgaccgtagtattgctctctgttgcatttctgacttttatgcttggcacctgtaggtgctgactatattcttgactgaatgaggtcctaagacaataaattactttgggtctcaggcctaaaaggaggggtggacagggcctggggttagcaggggcagggagcgggactagggaggcccacccctcctcagtcccccttatatgttctccactccccctacccccaggagccctggaggtccaggtccctgaagacccagtggtggcactggtgggcaccgatgccaccctgtgctgctccttctcccctgagcctggcttcagcctggcacagctcaacctcatctggcagctgacagataccaaacagctggtgcacagctttgctgagggccaggaccagggcagcgcctatgccaaccgcacggccctcttcccggacctgctggcacagggcaacgcatccctgaggctgcagcgcgtgcgtgtggcggacgagggcagcttcacctgcttcgtgagcatccgggatttcggcagcgctgccgtcagcctgcaggtggccggtgagcaccaggagggggacgccttccccttagttcaccctccattccccctgcagcccaccccctgctgcaccactgctcccagaaccccagtgctgattcctgtactcagccccatgcatccttttcgtcctctgccattgccctgcccttgacccctgccctctgtcacctccagctccctactcgaagcccagcatgaccctggagcccaacaaggacctgcggccaggggacacggtgaccatcacgtgctccagctaccagggctaccctgaggctgaggtgttctggcaggatgggcagggtgtgcccctgactggcaacgtgaccacgtcgcagatggccaacgagcagggcttgtttgatgtgcacagcatcctgcgggtggtgctgggtgcaaatggcacctacagctgcctggtgcgcaaccccgtgctgcagcaggatgcgcacagctctgtcaccatcacaccccagagaagccccacaggttgctttgcttaaatgtccccttgggggaggggggttctgcttctgtcggcaggggttgggagctccgaatctggccccaccttcaatctcccagaacagcaagttgcctcctaatgatagggagaaagataacggggaggtggggatgttcactggaggggttgggggcggagaaatcacaggccttcttaaggctctcctgacttcaaggctctggaagcctctgggaagaatggagccacatctgggtcagcagaggggtgggcgaaggaaaggagtcctgatggcaggattcaccagggctggagctggtgagagtcacctgccccaggcctggccctgggattggtctggtcaggccaagacccacctgctgtgattgttctcagaagattggggagactccatatctgagagtcctcagacttaatctgcttttgcatctaagaagaaaataggaagatggaacagggtctgggaattgatgggggaagagtttgggggactcgggtggtagcctagagagtcccatttctcctcaccaccctgcccctctgaccccgcccccaggagccgtggaggtccaggtccctgaggacccggtggtggccctagtgggcaccgatgccaccctgcgctgctccttctcccccgagcctggcttcagcctggcacagctcaacctcatctggcagctgacagacaccaaacagctggtgcacagtttcaccgaaggccgggaccagggcagcgcctatgccaaccgcacggccctcttcccggacctgctggcacaaggcaatgcatccctgaggctgcagcgcgtgcgtgtggcggacgagggcagcttcacctgcttcgtgagcatccgggatttcggcagcgctgccgtcagcctgcaggtggccggtgagcaccaggagggcgacgccttccccttggttcaccctccattccctctgcagcccaccctctgctgcaccactgctcccagaaccccagtgctgattcctgtactcagccccatgcatccttttcctcccctgccattgccctgcccttgacccctgccctctgtcacctccagctccctactcgaagcccagcatgaccctggagcccaacaaggacctgcggccaggggacacggtgaccatcacgtgctccagctaccggggctaccctgaggctgaggtgttctggcaggatgggcagggtgtgcccctgactggcaacgtgaccacgtcgcagatggccaacgagcagggcttgtttgatgtgcacagcgtcctgcgggtggtgctgggtgcgaatggcacctacagctgcctggtgcgcaaccccgtgctgcagcaggatgcgcacggctctgtcaccatcacaggtaagggcagatgaacagctggggaaggacggagcgagtaactccctctttactggaccctaacgtggaatttccataggtttgggtggccagaagactttcaaaatccctttcatagacttcaggtgctcacactcttccccacaagtccttaagggactcgagctgataagaaccatttataatgtttgccttcctaagagtgcttttcgtggcacttatgcttcttatgcagaggacaaggtacctgcccgaaatttggaggcatgggcaggaattctggggcagccacaaggtgtggcccaggggacttggtgtgggtgtgctttccagcaggaactcctctgagtggtaggaaggtattctgggtcagtgggcgccatctgattctgaagcctgagtgacagctggccctccctagttagtccccaacacctgagtcaacgtcagctcttcttcctgcagacttgcgctccacccaggcagccgttggatgggcaggggctgtctctgctgcccccgtgtggtcaaacaccagatagaggccacccctttagtgattgttagtctctggtttccaggttctagcctcgtgggcacctcttgtgcctgagggtgtgaagagggttgaggtcaagagccgcagtctccatctgtgtttggccctgagaggcctctggtcagtcacttcctgggccgacgtgctcagtctggctcttcagtatctctccctggccaactgagctttcccagggacctcgccctggtgcacagtgaggtcaggacagcaggttttgtctgtctggttctcctcttgtcttctgatgacttccatctgcccctcagcccatccaagttctgatctcaccccaagtttccaggtctgcatgcacctcaggactcacttattcctgtcctctccctcttgagacctatgtggtccccacttctgacaagctcggagccagggcccgtcacatcgtctgcttggagttcaggctcactcctccttctctcttacgtgtttccttctggcaaggttgtgctccttctgcccaccccttccccaagatggaaaacactcccttcctgtgctctccaggagagagtagctgccctgagctcttgaatgttctgagacatgtccttgaccttttagagaacagcatatggtttggtggtgaaaatgctgttcacaggcgaaaagaagaaatagaagatagagtgatcttggcagaggatatgaagctttcagaggagggagggtggtagtgaggacacctccaggggcaaatgggagctgagaaggccttgaaggataaggggtctttgtggtcatttgcaccctgggctgagctggatatttgcgatgctgtgcagaaaggacttatgagtataaatgtgattgcaaagagaatgtttatctcacctaagagaaaattctctattttaaacttgagtagctaacatttaaagtgatttcaaaaaaatttagggctgggcatggtggctcacacctgtaatcccagcactttgggaggccaaggcgggtggatcacttgaggtcaggagttcgagaccagcctgatcagcatggtgaaaccctgtctctactgaaaacacaaaaattagctgggcgtggtggcatgcacctgtggtcccagctacttgggaggctggggcaagagaattgcttgaacctgggaggcggaggttgcagtgagccgagacagtgtcactgcactccagcctgggtgacagagcaagacactgtctcaaaaaataaataaaataaaaataaagtgatttcattgaggccattgttgccaagcacatttcacagacgaagaaactgaggtccacagagaagggggaactttcccaaggtcacagactggcacagcggctctcaatctttgggggtcagacccttctttgaaaattggataaatgatcaatgcagcagtttgcacataactctggagggttcgctgcctctctaaactcctccgtgggtctgtagacctgggctccagtgccctgcagtgaggagatgagccatgatcagaatccaactttggcctctcagcctaatttcctctccttcccaccagccagcctcctgtttctgttagagcaggtctggcctactttggagcccttggcctgtattttgcttcgggcagctttgtatcatgtcaaacattctgggattcagactttcagtcctccagctggtctctcccgtacctgatgaagttagtgaagttgtgtgctgtgcagagcctcttggagggggatttatggagcaagccctagagacgtggcctgagcctgtcctttcttgggtgaacagggcaaatgtaatttgtgttccagggacaccaccagttaagggggaacatagagaccctctgcttgagtatttccatggctctgccccctcctctgctgtcagagccccatgatgggatttccagggtggttattgttttttaatgtgtgctctgtggatgggccctcttggccacatcagctgctgccctccttttctgcacacctctcttcatcactggggtgatggatccctgtgcttccaatggccagagcagcagttttgccagcagtgcctattgaaggtgacatctgcagatccatgcacgaggtgcatctatgctggggtctctgccgccaaagggtccatagcaccgcgcactgcactgacagggcctcctgcagaagctgctgaggccctgggtgtgcatcgtctccagacagcaaaggaaagcagcactgtcttttgtcaggcttttcctctcaagacttctccctaggacccagctgggtgcaggggctgggctagaggatggtatgtaagatggagtcacacaggctgtgctcagaacagctcctggccctacccagctttgggtcctcaacttcatccctcttgacgtgacagctctaagaggaggggcctcagtgtttcatgttaatatccccctggcaaggcccctgcagacctacctgactccttggggaaactccaagccctcactccagccccgtcagtgacctcatctgtatgtaggactcagcgaacattttctgtaaatggccagggagtaaatgtttttaggcatcgtgggccacacaccatctctgttgctgctgcttctccttctgttcctcctccgccttcccccatctttttttggtaaccctttacaaatgtaaaaaccatcactagtttgtggactgtacaaaaacaggccacaagccagctttggcccatgggctgtagtttgctgccttctgatccatagaatgggagatgtcaccaggtagggctgaagcagtcaaaagagggcctctggaggaggtgaatattgagctaagcagagaatttgggaaactgatagcattagtgcagaggctggaaggagccagttgcttctggagagaatggttaggacaccagtttggctgaagctgaggctcctacagtagaattagaaaacttaggggagggtaagcagcagccaacttctagaggtccttgaatcacgcttgaagcttgaagcattattctaaagtcactagggagccatagaaggtacttgagcatcaattcaaccacaggctcttcagcccttcctggttgaggcgtgtccacatcagccagggttgtatcagggtttggggagtgtatggcgaagggactgtaggaacttaagtgagctttattcatagtgttagggcccagtgagggtgggagcccctgttcacacttggagccaatggtgctgtcctccgggacatggggccaggcatgacagtctcactgttgctacttttcctctcagggcagcctatgacattccccccagaggccctgtgggtgaccgtggggctgtctgtctgtctcattgcactgctggtggccctggctttcgtgtgctggagaaagatcaaacagagctgtgaggaggagaatgcaggtgagtgtgtgtgtatgtgtgtgcgtgcgcatgcacacttatgtgtcttggggtatgttgctgtctttgatgtcaatagagtgtcactttctagtgacagaacgagtgtgtgtgtgcagatggggctggatttgtctgtgtgtgaccttgagtctacgtcttgtgtgtgtgaacaagcgtgagcctgtctgtccatgtgcagataccacaggatgaatgtggatgagtgtgactggaaggtggtgggagtgtaaggccaagtgctacaaagggatgagtgtgtgccaacaagtgtgcctgtgaaagtgtaagtcagtcacgtgtgtgtgagagagcaggccagagcatggaagctgtgcggcacaaatgtaggcatgccaggggcgtgcatggcactgggggtgatcgtgcctgccttggagtgagtttgaagcagctgccatttgcggggctgagggtcagcccgagctggcattggtgactggtaagtgggtgagaggacattggtgggtggtgagttgaccctggtgggtaaacagatgcatgagagtagatgggtagtcagaggctggggatggctggaggttgggaaggagagggaagaagagtggtcagttggcagataggtgagtacttgtgaggtagacaggtggaaggatgagcaggtagacggctggttggttacatctgttggaggttgatggttggcagggctactgagcgagcggatgggtgaggtgatgggtgggtgggctggtggagggtaggtggatggtctttggctgggtgtgtggcgggggctccaggttgagtggatggtctttggctgggtgagtggtgggctccaggctgggtggatggtccttgactgggtaagtggtgcactccaggctgggtggatggtctttggctgggtgagtggtgggggcgccaggctgggtagtttttggctgggtgagtggtgggctccaggctgggagccccttcatgttgtcacaggctcggctctgctgtgctctgctctcgggctctaacccgtgtctagcatttggtccgcaggtcaggcccactcaggccctgttcaccagcttcctgcactctcaggtgggaaagtgctggcatgaaaatgggcttgcaaaagatttttgtttattctgagttcttgcctttgcaggagctgaggaccaggatggggagggagaaggctccaagacaggtgagtctgaacttggagctggccctcttggctgggagagggacatatgggaaaggagagaggactctaggatctggaggggccagatttgctgtaaggtttgaatgaaatgtgttctgtggactcagacctccccaccccggtgagtctgctctttgcccagagttaggcaggaagtggatcacccagttccctcccaggtgtggcttcatttctcctgccaacctttacccatctgccagggccgattccacctgattggccccacaccgtggagtctggtggcttcctaggggtgggagcaggggctccggagatagggagtctgggtttaagttcctgctccatctcaggtaaacagagtggccttgagcaagatgctttgcctctctggcttcggtttcctcttatgtaaaatgaggataatcacagattcataggttgtttgaattattaattgagataatgtatataaaggacctagtatcatatctagtgccaagtgcttaatactctggagtcctattactattaggcaaacagcttaagacaatactgttctagttacagactgtgtagctttgggcaaggtgccttgctcctctgggcatcagtttcccatctgtaaaatgtcatcctgaccctgccctgatggcaccagagggctgttttgaagctctttcaggtgactggagagggaggtacttgcaaaggacataggagcatggcacagtaagctgggggcccagcttgggtgggtgccaaggcactggtgcccatggccgactcccaggggatcctgggctgggagaggcaggtttccgctgagccatttgggatggttccagttaatgccagttccctccccacccccgcagaaggaagggcaggagattgacacttggggactgctataaattatgccaattaattctttgcctgttggtgcccagcgtggcaggcgtagagacagctctgggatcagacctcattcttcatgctcagaggcagatgtagttggcagaagggagggagtgaggagaagagtgtgggtgatggagttggtcagtctcattccacatggtcccaggcccacctgcaaatctgccagcctcctttagcttctcacatcaccctgtgtgtacattgggctcagggcacttccgcatctccagctggaggtggagggctcgagggttgtcccattctatagatgcagaaaactaaggcccagagaggagaatgacaagccacagagtggaactgggacctgggactggggcttgggacagcaacctagggccccttcccttgtgctatgaagtggtcccactctgctgacttgtcccgccccttccagccctcactcctccctctgcctgactccctaccccaccacttcccatggttcctccctcaccgtgtgcgccttcctttttttacagccctgcagcctctgaaacactctgacagcaaagaaggtaaagacacctgggcttgaggttgtgtctgtgtatgcacacatctgtgtgtgagaggctgagagggtgggtaggcatcatcctttcactagtgacctgaggccccctctgcagaagagcagcctcaacttccccctggtgagatggcagagggctgagtaaccaaggtcccagctgctctgatgggacccaaatacgacagaggcttaagcaggacaggagtttattcctccttcctgtgatagtgtgagcataggtaatcgtaaaaccactgatgacctggagccaggttccacttacctggattctgccctcttcaacttcaagctttcactcctaggtctaagaggctgtttgtgctcccacgccccctccagagccaagagggagagaaaggaaggatatgtttccttctagagcttgagtggaagtagcctgcatcacttccgcttacattccattggtcagaacccaggcatatgagccctaactcaggggaggctagaaaagtgttcagctgggtagccatgtccctggcgcacagtgggtggttagtaaatgtccatagtcattattgggcctattgttataatgtcagtgatgacatttggaaatacaggagataggtcatttccttcctgtttttcagaatcaaataaccatagaagagctgggcagatggagataaaaagtgtcagcttaggccaggcatggtacttcacacctgtaatctcagcactttgggaggccgaggtgggtggatcacttgaggtcaggagtttgagaccagcctggccaacatggtgaaaccctgtctctactaaaaatacaaaacttagccgggcgtggtggtgcatgcctgtaatcccagctacttgggaagctgaggcgggagaatcacttgaacctgggaggcagaggttgcagtgaactgagattgcacctgtgcactccagcctgggcaacagagcaagattccatctcaaaaaaaaaaaaaaaaaaaagtcagcttggttttgaagagttgctggagaatgtggcctggatgggcaaaccagtttgcttcctaaccctgctccttggtgaggcagcctgccccctcagtctctggccatgctggacaaccacagaggcagtgcccagatgggggagctcttctcctctccccagggacatacagagccccaagaatgggtgagggagagggcaggggaagggcccaagcccttcttcccaagtctccattcagcttcagatgcagagtggggtctgaaagatgagtctttgggatggccctccacatggagacaggaagcccaagggaaggaggagggcccctgccgtgtcactctcagggaaaccagtgtggaggggacactgggaaggctgcctgctggacgagggagttgggccaggccttggagggtggatgggatggacaaacaggagatgagaagggaaaagtgttgcacgtagagggagagtggagggaagtgtatcgggctgtgggcctgtgggtactgagagggggctgcgtgaggtggtccccctcaggtgccccggcgtgcctggcacctgcatctgtgtctgggcctccagggccgtggtcagcacgggggctgtccgttgggctgctgtctcacacacactccccacttgaagtctgaccaggtgcttgggcttctggcataatcccaaaaatagatcttctggcatctaatgcttttcccttcccttttttttcttcccatcatgaaatgaagatgatggacaagaaatagcctgaccatgaggaccagggagctgctacccctccctacagctcctaccctctggctgcaatggggctgcactgtgagccctgcccccaacagatgcatcctgctctgacaggtgggctccttctccaaaggatgcgatacacagaccactgtgcagccttatttctccaatggacatgattcccaagtcatcctgctgccttttttcttatagacacaatgaacagaccacccacaaccttagttctctaagtcatcctgcctgctgccttatttcacagtacatacatttcttagggacacagtacactgaccacatcaccaccctcttcttccagtgctgcgtggaccatctggctgccttttttctccaaaagatgcaatattcagactgactgaccccctgccttatttcaccaaagacacgatgcatagtcaccccggccttgtttctccaatggccgtgatacactagtgatcatgttcagccctgcttccacctgcatagaatcttttcttctcagacagggacagtgcggcctcaacatctcctggagtctagaagctgtttcctttcccctccttcctcctcttgctctagccttaatactggccttttccctccctgccccaagtgaagacagggcactctgcgcccaccacatgcacagctgtgcatggagacctgcaggtgcacgtgctggaacacgtgtggttcccccctggcccagcctcctctgcagtgcccctctcccctgcccatcctccccacggaagcatgtgctggtcacactggttctccaggggtctgtgatggggcccctgggggtcagcttctgtccctctgccttctcacctctttgttcctttcttttcatgtatccattcagttgatgtttattgagcaactacagatgtcagcactgtgttaggtgctgggggccctgcgtgggaagataaagttcctccctcaaggactccccatccagctgggagacagacaactaactacactgcaccctgcggtttgcagggggctcctgcctggctccctgctccacacctcctctgtggctcaaggcttcctggatacctcacccccatcccacccataattcttacccagagcatggggttggggcggaaacctggagagagggacatagcccctcgccacggctagagaatctggtggtgtccaaaatgtctgtccaggtgtgggcaggtgggcaggcaccaaggccctctggacctttcatagcagcagaaaaggcagagcctggggcagggcagggccaggaatgctttggggacaccgaggggactgccccccacccccaccatggtgctattctggggctggggcagtcttttcctggcttgcctctggccagctcctggcctctggtagagtgagacttcagacgttctgatgccttccggatgtcatctctccctgccccaggaatggaagatgtgaggacttctaatttaaatgtgggactcggagggattttgtaaactgggggtatattttggggaaaataaatgtctttgtaaaaagctt

SEQ ID NO: 1003 - DNA, 30239 bp, Homo sapiens; identical to SEQ ID NO: 1002

SEQ ID NO: 1004 - DNA, 9132 bp, Homo sapiens
tatacattgtaaacaccacatttatttgtctgaggcttgcaaacctctggtaagaagcacagaacgcagggctctccttcatgctgccctgggccccagctcgccaggcatgcaggacagagctggcagatgagtcagaaatctttgggagcagcgccagggaagcagcaggccctgctccttcccatgcccaatcccgccagcacgggcctggactgcagccaggaaggtgggccagccaggatccccaggtaacttcgccacagggacctcttcttggagctgccttcccttccctccccatccctctccaatccccgcagagcttagagcctgggccacatgcttggtccctcacacaaggaccaaaccagctgctgtcaggctgtttctgtgggtcctgtctctccagtcaggaagccagcagggcagggcaggcctggctctcctcctggaatcacaccgtgcacccagctcagcgctgggcactcagctggggaccgggatggacaaagccttgtccagagaaccactgtaggggagacgtgcatggcagccggactcagcctcctgcagcctccattcatgggctcttggctgggcctgaaatttgttagggcctcaactctctgtggtgcagatgaacacctcctcctccaagaggcccctcaggcttggtgccaggcttgggactgggctctggaaagtcagccaaggctgctacttcaaggccctgaggacagcctccagcttcatggccatagccaggtcgcccttcaccttcagccgtccactcatgtaggcccccaggggccgcagctctctgcatagcagggcccgcaggtctgcctcggccatctccaccaccacatcagggatgccatcaggcaccccgtgtcccactcttcctcgtcctgtggggcaaaagaaaaccgagtgtcagtaggggaatggaggaacgtgaaggagatctatgggggtgggaggggctggtatttcccattgggaggagagtactggttaagagtttgggttctaataccctgggtttgagtcttattggctgtgtgaactcttggatcctcagtttccaaatctgtgatgataattcctttagagatgacaattcctaaagcataggctcatggtgagaagtgggtgagataatgtacaaaaagtacttggcacagagcctgacaggcagcaggcctgtaacacgggcaggcctcttggtattggaagcctggctgcattgtcctgcggatggcggggagaccagggcatagttaatgcctggaaatggtgtctgagcccctgcctgccatgggttcaccccaaattattggcaggagcagggggcagtctacgagagcaccactggggtaggtaacaagaaacctagcaagctggatgggaaggagaggcaaggagggcagcggcacctgtagtgaggtccaggaagtaggcgctttgggtgccgctgggcaggacgacattgaactggtagcaggccccgacttggctgaccagggcctcagacaggaagggctgtagagcagtcagtagcccctccgccagaggctgcttcggactggacctggcaccaacttgaggggcaggtggctcaacttcactcaccatctccacggtgtctgctgggggtggccaacagggttggggaaggaggcagagaggaggtcatcgtgttgccaaggtcaggaccactcactgtggcctctgcaccttttgtggcagtttcctcttagatccccttcaggcctctgttcaacttcctcctctaccagaaaggtgcccctgagttttcagcctaaactgcaaactcagtttctaaactactccagcctcagatataaaattctttccagctgcccttctggtgatgtcgcctcctcccatggaggctgccaatggcctctacacactcagacacctggcctcctctcactgccttggctgtggtcagtgtgggctgaacatctgtgcagggtgtgtactgcacagagctgctgggatagtgagcaaagtctgtgctggcaccaagctggtaaacacccccgctctcctccccagggctcctcacctggccccggggacggggcacctcctgccattgagttcatgcttcctcccaggaagtgcagggccagctgctggagggtgctgtccaggttgggcccagctgggctgtcctggggcggctggagcacggcctccactgccagctccacgcggtctacctccagcccccaggccctggtcacatcgttgatctccagctggaggacagtgtgaggagaaatgtaattaattcaacaaacctttcctgagcaccttctttgggcagactgtgtggccgtgcatggacatggaggcaccacaccgcccttgagacactcctagcctgggaacacaggcagagggcaatgacctttcagctgtggtaagtgccaagacagaagcaaggcctgtggtgagcccccagcagaggagggtggtgccagcaggagggagtcctcaggtggaggaggacccttccagcaacaggaacagcatgtgcaaaaccccagacaagaaaacctggcatgttcgtggagctgcgaggaaccagagttccatttagctggaccctcacatgtcggctgaggactggagacagctgaggggtcagaggtggggtgtttctgcttactttgatttattctgaggcaacaaagagccccagggaggagtttgagcagggaggtgatacagcagacttgctttaaggcaagatcctcctggctgctgtggatgctggattatagggggctgaggggagggatggagaccaaggaagacattgtttcaaaatacagccaaggaatgatgcagctctggcgagggtggaggggagctgtgaagccaagatccactgagggaggcatgcctctatcaactgtactgagccacaacagggcactagagaagtgcaagcaccaggctcggggctgcctcgatgtgtgcaatgatatgagagggggcgggagtggggaggagtcaggctcctgaatggatgagtgtggcattcactagagaggacacacgggggtgggaagggagggatggcaacttttttttttttttttactactgtaagcttgaggtgtctgtggggcagtcaattgtccagtaggcagctggagaaatggcccagggtacagaagcatcagggctagggcaggacattgtgaataatcagcatccacaggcagcagacagcccagatggatgagctctcccagggaggtcacagatgagaagaggccagtgatgaaaccctggaaactcaagggcaggagaataagtggcagtaaccagggatgacagggaaggaggaagtacagggggttctgggggctgggggctgggtcgaccatgtcaaatgctgccaccaggtgatgtaagggaagggctgagaggtgcccactgggctggcatgtgggaggtcactgtgatgttggccagcgctgtcttgggagcccaaggaggccaggatgaaggatgtaggggcaggggctgggagcatggatgaaagtcttgcagaagaaaaggggagaaagggagtgggagctagagggcactgtggcaaagggagggcacatttctacacagaaaggagaggtgacagagagagagtgcatggagtggagggaaggcatcctgggatagcagggggcccacagcactgcgcagtacagggatgagcctcagagaggggaggcagaagggcaaggaggcaggaaagcagcacagaggcaggtgggtttgaaggggtgaaactggaggaagcagagtgctcatcctagagtttttctcctgagtgttaggaggcaaggcctgctgcagagagcaatgagcagtggtggggctggaggagggcagtgaagggctgaggcagctggcctggagcactggcaggtaaggagtggtaactggctaaggaaggtccagcaagtgagaggtggggactctgatttctctagaagaaaatcaggcaaaaaggggcatgtgaataagtgtacgcctgaaccagggcctgagggcggtgtgctggacctcctgaggttctgtctcaaccacaggcacagctctcactctaccaggtgctcactcagtctgggaaatgggacttaaaggactctcacatcctggtgtggaactgacctccccaaactgcctgtctcacatcaaaacaatgtgcaacaagactgagatcagttttctcttcctaaaggtgaattaacacggggcatggttttatgaataaaagttgttatccacttgctatctgagttgtgttagatcaagcactggattgaggggcgatggtgggatggaggcaggtggtctagctatggctcagctctgcccttgaccatagctctcagaggcaagtcaaattatttcttagccttagcttcctccctccaaaataaaacagtagtaccgacttgcagcaaaaaatgtcaagctcagaaatgctgggccagacaaaaggactttgtaaaccataaactgctaagcacgtaagagctactgttaggatctcaaatagtatttcctcaggaatttcccctcgctgcttccagtgggacctccaggactggcatttatcccattcccccgactgtcctctaaccttgattccccagggcaaagcagagccaagaggaatggggagaaatgtcacctacattcccctgtcaggacacaagaggaagcacaagttgagtgtggctgcaggggacacaactctgcatgtgtatttatttctaccccatcttgtagcagaagagatttagggcaaactccaatatacacatggagaagaggcaggaaaaagatccaaatgtcctcatgttcctttgttctgttccaaacaaggaaacaaaaatcacaagcatgcacacgctgcatggtgagcctggaattccccagcaggtgactgggctgggagggtccctgctccatcacccatctgcctgccccatgagtcaggcccggaatgagagctgtagaagccagtgtcatcatggcagagcagtgaggggtaaaaactaaggggcagaccccaagaatgtctgccggggccacttcctcttctcagggacaagtttgcccaggatcgttatggtctacgcccacctgccattcctcaactcatggccccacccaggcactggctcttcaaaggtggttacactattgggacatatggtaaactgaggcccagagtggtctgactcttttctcaaagtgacctggcaggtggagccaggccggtgccacccctcaagctccgtcttgtgaggggctgcctaccagaagctggtcgctgatcttgagcttctccatctggatctcccgcagcggcctcttgagcagggccttggtcatggcgttctgggctgtcatgcgtgtggctgtgttcaggtctttcacagtcatcaccgacagcaccgggtcccagatgcgaaactggacatcggctcccacggacagcacagccccgtccttagaggccagctgttgggggaggccatgagagagagacactcaaggggctgggggtgcagggaggtcaggcccactggggccacccagcttgaaccacctgcttggcagctagctcctcaagggcaaatggtgtcaccaagtatgtagggttaggtgtatgaagcaaggatgtcctcctagcttccatcaattttctggtctcttcttcccccttcccccctcagatggtgactcacaggctgaggtcctggcaccacagtacattctggacaggcccccagttcctctgtcaaggcagctgagaagcccctcaccttgcagggagggacgttgaaggctcgtgtcctcagatccaccctctgaaaggagtcaatgaagggcaagagcagaaccatgccaggtccctggggggtgcggatccggcccaggcggaacacaatcatccgctcgtaggtgggcacaatctgtccacaatggcaagggaaagagttgaaagtggtcagcctaggctggccaatgctgtctgcctaggtcccttcctcacttctctcctcctcacctgggtcacagttaggtatccctagcactgtttccagatgagaaaaccaaggctcagggaagctaagtgactgctcaaaaattgcatagccctaagtgaaatagtgaagatttgaatgcagttctgaataactccaaaggccatgtgtcttaactactgcactgtattgacttgatccttagagaaacttttcatctctgtggtctgaagttagacatgactcataccaggaaactgtctgtccttggattagttaggagaaaaggctcggctgccctaacagcacccccggggaaagggctttgtcaactttaggtccctggacctcctagagaagtagtgatgtccaaattgagaaatgaaggcccagagaggcaaagaaacctgttcaaggtcacatggcatttgtttctgtggcagttttagaactaggatataaggccatttaaggacccccttgcagaccacaccaaacccagaggttttctagagagggactgttgcctagggctacacaaagggcaaggcctccttgggcttccaccttcccccagctttcacgtgcgatgctgaactatagctccatggttcatccttttcccactgtaccaccccttatggaaaatgaggcctgaattcctattatgcactaccagctgggctaagttgggtgttttcatttctaatttattctaacccaaagagaagataatttggcaaagacatctgcgtgtaccttaaagccagtgtccagatcccaggacttaggagtttgggacttgcttctaccccctactggctcccagtatgactttagacaagcccaagccttagtttcctcccctgaccaatgtgaatgaatggttcttgcctagcccattacacaaaggggtaataatatttagggaaaggggacagaggataggcaaatttattcatcaatgccaaagctctcagtgtggcccaaccaccctgggggctgacccagccagccttaccttcagggcaaaccagccagaaatggggaaggtgaccaacagcagcaagaaccccaggaaactgatgaggccatgacagaggcaggagggccagctctggggtacatctgcaggtgagagcagaggtggtcaactggacctgcacgacagctgccaagcggagtgaacttgggcaagtgtaccttacgcccaccttcccctcgagaggctccttccttctcagggctctcaatctggctccttgcctaatattcccgtatctttgggcagctgcaagttagggtctgttccctcctcccatacatcaacactcatttgtcccaagtccaacaaccctcacaaggccttattctctgctaggcaacagccattcaatctcagaatccagtccgcgtgatgatgctctcctcactggactgagtaggggtcaatcctctcgtttaatttatattgcctacccatacctggcatggagccaggagcacctgggcatctgtaaacatgcactgaatactgctggcaaaacacattcctcctataccatcagccccagaagtgtgctttccaggagtccttatgaagatgatgccttagcctacagggataaatcataaatagcttatcaacgggagccacagatgaggaattagattattattttctattccacacccaactttaatgccttaatgaccattaaaaaatgcctatttcacgagatggcgccactgcactccagcctgggggacagagcgagactccatctcaaaaaaacaacaaacaacaaaaaacaaaaacaaaaaaaaaccctgcctatttcaattcaagaaaattgttaggggtcggggtcaggggcagggctagaaagatgaggcttatccaagccaaatgtcctggcccctggagattcaggagcccaagttgggagcaaagccgagacagctccagaatctgggatgaggttatttgccgctttcctcccaaccctggacaggaagcagtcgggagccctgctccattcttccaggaagccctgccctctgggctaagccccagagcactgaggctccactttgtgcctggctctgatccaccaggcctctcaagagacttctggatagggagagctttcaggacaggaaggccagggagggatcaaatccaaggttaggcggttaggctgaacagcgtgggatctggcctgtaggccaaaggagccacagaagactttgagggcaagacagaagcagggcagatccaacaggcagctgaggacctgtcattttggcctgcacatccaggagatgcctagttcccgggcttctagaggtgccccctagggcgaaaattcttccatttccctgcagcaggtgcctttagggtgctggtggcctcctctgcctagacctcggtttcttctatgcgaaatagaaacctgaaacgtcttcccaggcctaaagggctgataagagccgaggacaaatgtggtgaggtgaggttttggaagataggagcaacgctggctggctctggggccaaagccccatgaccctagggagggcggatcggcgctagcaccaggcgccgggtccagccccctctccacatcgtatccctttctcagtcccccctcgtagggtgcgacggcaccgggccggccgactcctcggaggcagagattcgggcctgggggttgccggccggtcccccccggctccgccgtgccaggcggccactcaccggcccctgtccccacgccgccccgctccggggacaagcagcccttctgcgagcccagaaagccgaagctcgactgctggaagcggtcaaaatcacccaggggcagcgcccggtacccagacctgccgagcatggcttttgacaggagacacgccccgcgcctccgcgcggcgccctccctggccagtgggccctacgcggccccgccctcctggctgctgcttccggcttcacccgcgcggccacccgcggcggcgc

SEQ ID NO: 1005 - DNA, 9132 bp, Homo sapiens; identical to SEQ ID NO: 1004

SEQ ID NO: 1006 - DNA, 9132 bp, Homo sapiens; identical to SEQ ID NO: 1004

SEQ ID NO: 1007 - DNA, 25691 bp, Homo sapiens
gcctgttgcttattcattcagagtgggaaagcgccagccgagcggccagccagtgcggggctggccatgtaaggcccacaggcggtcctgcccgcccggtgccctgcggagagcctcgtgcagccctgggcaccgcccctgccctgccctgaccccttggccttgaaatgctgtcatcggaggagccgtcccgctcgggacaaggccagcatggacaaagctagagctggggcaagcaaggagccttcctgtcctcgaggccgtgggaagagaagcacgcccagggggccactcctgagagcctctctgtccaccaggcctctgcagaggggtcaccatggctctggcccgaggcagccggcagctgggggccctggtgtggggcgcctgcctgtgcgtgctggtgcacgggcagcaggcgcagcccgggcagggctcggaccccgcccgctggcggcagctgatccagtgggagaacaacgggcaggtgtacagcttgctcaactcgggctcagagtacgtgccggccggacctcagcgctccgagagtagctcccgggtgctgctggccggcgcgccccaggcccagcagcggcgcagccacgggagcccccggcgtcggcaggcgccgtccctgcccctgccggggcgcgtgggctcggacaccgtgcgcggccaggcgcggcacccattcggctttggccaggtgcccgacaactggcgcgaggtggccgtcggggacagcacgggcatggcccgggcccgcacctccgtctcccagcaacggcacgggggctccgcctcctcggtctcggcttcggccttcgccagcacctaccgccagcagccctcctacccgcagcagttcccctacccgcaggcgcccttcgtcagccagtacgagaactacgaccccgcgtcgcggacctacgaccagggtttcgtgtactaccggcccgcgggcggcggcgtgggcgcgggggcggcggccgtggcctcggcgggggtcatctacccctaccagccccgggcgcgctacgaggagtacggcggcggcgaagagctgcccgagtacccgcctcagggcttctacccggcccccgagaggccctacgtgccgccgccgccgccgccccccgacggcctggaccgccgctactcgcacagtctgtacagcgagggcacccccggcttcgagcaggcctaccctgaccccggtcccgaggcggcgcaggcccatggcggagacccacgcctgggctggtacccgccctacgccaacccgccgcccgaggcgtacgggccgccgcgcgcgctggagccgccctacctgccggtgcgcagctccgacacgcccccgccgggtggggagcggaacggcgcgcagcagggccgcctcagcgtgggcagcgtgtaccggcccaaccagaacggccgcggtgagtacggccccggcgcccctccggccgcgcgtacccctggccactggaaactgctccgggccccccgggcccctccttagaacttcctggaggcctccccggagctgctaagcacggagcagcgccccctcccgacttcccccgacccagccaacagcacccccctggcatctcacctcccagcttaacccgcacccaggcatcatcagtgccaggggttggccaggcaggtgtgggctctgatcctggctttggtggagggactagccgagctttgggaggaggctcgccttctgcacttggcttgggtcatctgaggacaaaaggaaggagcccctcatccaccttctccctcatttcaatgagggcatctccttccccccttagagatgttctatgccagctcacagggtgaggcaaggagcatcagaaacctgagtcttcagggccagaaaggccttaagggatgcccctggaggtgtggcaggctgcccattactgggcatgtgtgaggttggcttgagtgcgcaggaggttagaggggagcgtgtgctccaggcaggagtccggacttcctcaggggagtctgcaaggctggggcaagagagaccagtcaggcactggcctgggtgcagaatttcaggggctaccaaaaaacacagtagttgagatgagtaatattgagatgtatttttttaagtcaaaattaatgcaaaaaaaaaaaaaaaaaaaaaaaacctgtgataaaggaaatatccagattttaaatagagtcagtaatagtggtatgccgagccatattggagcctgaggctaactgaaaaatcagcaacacggatcctgtctttatttgatatttggatattttgttcattacagatagttttgcattaatttttattttaaaaactattgtgttaaatattacttatctccgttactgagtttttttggcaccccctaaaattttgcaccccgaggaaaaaaaaaaaaaaacacctcactggcctcattcccctcaccctagtcctggccctggcggagagccccagctgtggacaggactccctctggcttttcagggggtgaacatacgtcctcctcttgggaaggcccaagccctctgcacatgaggacacagtggaaaggcagcttccacacatgctgttagcagacagggctactgtgacaagggctgactggtgggtgtggccagtgctggacggccatcagccattctctgctgtcctagaatccccctccctgctaccctctccatacaggcagcttttgggccaaggttttctactcagtccccaatacttatgcagtccaactctgccttgcctctttcaagctgtcgtcagtttcctctacccataattctctgctccccattgaggttgctgtgcctggcccaccaagtaagggctgactgagccctccagtgcctcagagtataggtgctagtgccccagcctcctcctcagcctctgtcagcagagggatgatgctttgtctccagccaagctgacctcagtgaggggctgctgctcatggggtgcctgtctccctgggtactgctggaggccaagactaggggagaggagcgtctccactgggaacactcactctatcacatccaaggtgtcgcttttgagttgtgtgctgaatcccactttaagaacctgcaggagctcaggaaaaatcagatggcaggtccttctgtggtgtgatgaaggatgcatccacctgctctggtccttaccaggtacttgcagcatccctgcagaagggcgcattatagccatgcatcagctgctctagggccccttggagaataggatgttttacctagagggtgctaaacttttgcagtggcttttcttagaatgcaagacctcagcatgaggctcagcctgatgggccccacctctgggcagagaaaactgagctctcaaatgccacaatattggcagaggcatgcctgggacttggcatctgggcaccaagtcagtgggtcttctagggcctgtctttgggctgttagttcttaaggaagccagttgattgagaggggaatgggacagggcaaggccatgtctgaagtgggggtgcttggtgcttagcagacctctggccactaccctgagccccacagttcattttgggtcaaaaacatttctcccctgaaggtagcatcctaggtgccaagctgagtgtactcacatgcatcaagtccaggcccttccctggggcagtctaccaggaggggcatctcagtgctgtgattaggcaagcattggtggggccaggggctttgtgagcccagaggagggccctccctgtcaggggctagggctcagggagacttccacaggaagcaatgtctaagcattgctgcaagggatggtcatcagcaccatccaggtgccccttcccctaatcattgagggtgtggggtgggagtgtgttttttgctggggaggggattgcaggctagtttagggctcacaaagaggccagagagggagcagtagtctctcccatcattggttcctccctccccaccctgctaggccagaccgtggaaaatcccagcccagggaaggccaagccttgtgcttgagatcagacccccaggcctggtgtgggagcccaaggcggattctccgagactgacttcattcctcctggccacacacccaggggtctgaggctgggcgctggcagcctgtgagtgtgtgtgggcgtggacgtgtcctcacaacaccaagcacatgtgagcaccacccacctccctccatgggtgggtggtttccaagcgcctgtcctgagcccagtttcttcctcgggtacctgtgccctcttccttcctaccctgggcactgagactgcccaaggcttcctgcagtaccattctctccaactctgaaacatgaaactgaaaagaaactagaggaaacagaggcccagagagggtcacatactttgcctggctctcatagcaaatccttgaagagaggcctggagggtggccagccacttcccaggcccagctgggtctcctgcactgtgtcggctccctcgatgtgaccactcctgctattaccaaccaggccctcctctcctgggatcctcgcctcagctcctgcctccctggagtttcagcttgtctgagctgggggtcttagtgccacctaagaagccccacagccccagaagaccaaagctcccctcccaaggccttaccctcgcaccccccgcctgactcaccggctctggcaatcctgtgaaaggaacatggaacaggcagccctgggcatcctcccagggcatcttggatggctgtgctagccttgcctgacgtgtgtcctctatccctgacttcacatggccaatcagaggccaggagagaaccgcagctgcctcctccctggtcccttgctcccagtctctccctcttcagtctgtcctgcatgtggggcagataaacccctgcagtctgaccaggttactcctctgctcaagaagattctgtagctcctcagggcctttaggacaaaatctagtgtctcagcccagcactccagagttagaggcacctccttcctgtcctttcttcctccttttctcaagcctccacagcccccatgggaccatgctgctcgtgggcctagatgttacacctccctagacacatgcaagggtgtttctagggtacctccttctctgtccagcctcctgcacccaagaggccagacctgtctggaccctcagtccctgagagcagccctggctgcctgctaccacctctcctgcctgagcccctagctcacctgggcctgctccaccccacctccacaggctgcctgcccacctctgccctccaggtcactcgccttcccctgcagagtttggagtagatgcagggaaggaccaaagcaggcttcacccaacaagcttccagagttagagcccagaggcagggataataataccaacttggccatttgctgaagaccacttcctgggcttactgacttcaatgtgcagtttcattcatcctcacaacctcctaatgaggtgcagattatggtcctcctggtgtagatgagaaaacaggcctagggaggtggcacagaagggtacagccgagcttgaattcaaactgaacctgtgctctctgcatcacagtgagatgacccaggaggatatcatgttcagcctgcgggcagggtggggcagggcatgagcatggacccctctgccagctttgcctctgtggtcctcacctcccacatctgcatccagaggaagaattatgcttgcatttgctgagtgcgttatacatcatctcctttaattcccaggtcctagccaggtactgttatttgtcccgtgttacagatgtggtgacgagctcacttgctgacttttagtagtggaaccaggatttgagtctgtgtgactctctatcctgagttcttaacaaccatgcatttaaaaaaaaaatttatatattattgcttatcttgtacacctcatttattcactcattcatttggtcattcattcattcaacagatatttgagtgctagattctgggcactggttgtgacagggtgagatgggacagtgagtgtgaaagactttggaagcagagtctctccccagtgtggggttagggtgtagcctggtcatggtcattgcagattccagaacgtttgtgtaacaaacactcatatggtgcatactaagtgccggacactgttcttggagttttgcagttagaatcacttaatccctgtgacaaccctgggattgttatccccattttgcagatgaggaaactgtggccctgagaagttaagcgacttgccctggaggcagaatcacagatcagcatccctccttccttccccgaagttgtctcagattgttccttcagaaagaaaaagagtcttcaggcttagaaagctgtgtcggatcagacaagctgtggaaacggagggttctgggccctcctcctgcctccctgtttctcctttgagagtcatcagtgtctgaacaaacaagtggagtcctaagcagcctcattccaggcagacttcctgtctcctctcttatcagccacttgcaaggcaccttctctctcccctgctctcaaactggaccatccctgcaagaagagacagctcctgttttcaataataagaataagaatatctgatatttattgaacatacactatgctaagcattttatttttctcatttaattcccacaacagccttgtgagataaatagtattatcagctctattttatagatgaggaaactgaggctcggagaaattaaccaactcacccaaggtctcagggttaatgagtggccaagcttagacctaggctgactgtccaatccagtgggccctggcctcactctgttccgtctcttagggacgggtgttttatattctgtgtcacctgtctctgtgttcactgttcccctgaggtgtaaacacctgaaaaaaaccaaatttgggtttttgcctcaagtttgcgggccccacagagttgctggggatggtggcagagcagggttgggagccattagtaccattatgggcaccaggttactgctagacttggcctgggagctctggctttttgtcctctctccttcctcctaacctcaggggtcctcactgcagcatcctctgctctcagaaggtgtacccctctccagtagctccctagtagctcctgagtccattctacctcctttctaagctgggaacacatggaagacttcccaggacagtggctgacatgggcaggagaggaaaggggcagggagggagctggggtccgcccaggcggcccacacctccttccaattgctgtgcccagcattcctgcagaagagcagtcagggttgggatgctggaaagagaggtttagacttgcccctcccctggccctgacctagccgcctcatttccacaggcagctggaccaagggccttctttttgtcgggactcatgatcacagggtgagggttgggtctgggtccctctccctcttgctgatgggcacccagaaaccaggcattgcagtaccacttggaaatggggagaggggtgtcagaatgccaaagcaggaagagacacaggatgggaaagcgaggccccagaggcctttgccatccaaacctcaagagacaacccatccttccccctgcttgtgggccagctggaaccacaggttttccaaacccaacgcaaatctttctgcaaaagaaaggactctgggaatcgattccagaccctgcttgacaatgaagtctgtgctcacacaggcagtgccaccagacgttttatggagtatgggcattggctcacgcacttgccaaggacatacaggtgctaggccctgagctgggcgtggagaatttcaggggcatcccagaaccctccctggcctcactgacgtctcagcctggcagtgagaaaacagacacctggggtggagagtggcccaagtccatgtctgtctttgccagctctcagcacccactgtgcacctgggagacgtgcaccagaagctgagtacaggcaaaagataataccactcacccctgccctcatgggctcttgcctggctgcagaaggcagatatcatctcgtgaggaaatagggcagatatcatctcatgaggaaatagtcatttaacaaatatttattgagcgacttactgtatgctgggcaccgttctagagctgggtattcattcgtgaaaagaaagagacaaaattcttgcccttgtggatcttctattttcatgtataaacataataaatatgtaaaaaaaatagaaggtactaagtgctgtggaaaaatagagataggtaaggaagatcgggagtgtaggagagggacaggttgcaaaggtggtcaggcctcatgaaggtgacacttgagcaaagacttgaggcatatgagtgagccatgcagctgtctgcaggaagagcattccagataggaagacagccagtgcaaggccctgaggcaggagttccctggggttttcaggtgtgctccagtgtggttagaacagagtagagtggaaatggaggtataacaggggacaggtcagagaggtaatggggtccgggccatggggagcttgtcggccattgtaaggggtttgccttttattttctgtgcatcccttttactcagcgtttgagctgagtagaagcatgggtccctgactgctaaacagggcccctgactgctgtgccaggagtggacagtggagagtcagccaggggaaccgacaggaggctgttccagagagtaggaagagtggtagcaatggaggaagccagctttagggtatgttcttgagatagagctgaggggatttcctgctgggttggatatggggtatgaaagaaagagaggtgtcagggatcacacagtggtttatggctggtgtggctggaaggatgcaattgccttgagctgagatgggaaggctgtgggcagcgtaagttttgtaagaaatatgaaaatttcaggtcactgtgcagggcctgagagggcaaggagggaacccctggagtaactgaagcatcaagggaagcttctagaggtggggtagggggcaccaggcagggcctgcaagggcggggagggctcaggggcaggggttgggttcacgctgggaggaaatgtgcattaggtgtgcagagaggcagcagaggcttggcctctgagcagggagctgacctccgcattggttagcattgtctgcctccccctcagcccagcctgcctcctgggcagctggcgcaatcaagcacacacttacaaatcccttctgtgagtcaagcccttctgctgctgtctctccccattggtggggtggacaggtgagtgctgtaaaagggtgcagggtggtggtggaggggtgttcaggactgacagggtgggctttggagctaaagactgtgtgcctctgcataggtagagctggtgtgtgtgtgtgtgtgtgtgtgtgtgtgtgtgtgtgtgtacgcgcatgcacatgcatagctgggaattccaggacaagggcaccatggagtcagggggtaaaaaaggttggggtatgctgccagagacctgcctactgatccttaggattaagagttctggaaggctaggtaaggtcaaaccacagacggctttagctgccactctgagacttctaggcttgattctgtgggcaatggggagccattgaagaccctgggcctggcttgatggctgtcctagctctcaggcttgagctgggttacatcttcattatggggcaaagtggaatctgcagccaccttgcctgcctgctcaccaagcaggtgtggcactgccaggccagtgctgacaagttaatttcctgattatgagataatcatttcctagggaatcgggcagccagctcccgccgtggaggcctctctggctcatctttattcaaggccctgctctgcagagctttctgcttctctgccacctaggggctcctctggagtctggctgcgctagccaaaacatcccgctcagcacatatttcacaagcaactgaccagttcctcctggactttgtttatcctccagccctgggctcaagagattagggctcttttgcattccactttccatcatttgcccctcatgaggaggaggcttggagaggaaagattccagagacaaggtttactgaacccacaaaaaagaggaagccaagagggaaacaggtgaggtgtggacgagcaatgggaaggcagccacagggctctcagcgccaggcagcctccctccaggaaccgctgggcaggagggaacagatttctaatgaagcaggaaggatttaggtcagaaggtgggagaatttcctgactgctaaagtatcgtctgtaggggttgtgagagggctcgggctcttgcccaaggctggggaatgaactgaacagctcctaaaaagtattttaatctccaagtgtttatcgatctatccaacctgtgttcaggggccagctagttcagtctccctcatcatccagatggggaaagtgagcctcagaaaggggactggggagactggacaagacagtgaactcacctctggagcttcccccctgagaaggccccagctgcatcccaccagggaaggggcagatggtctttgtcctccggttcccgagggcgggcacgggagccgtcagcaactccagacccagcattgagcaggaggacagggtgggcttgtcccgagcacacaggccccaagagtcagtgtgacaggttcctcctactgtgctcctgcacactcccacagaggaagctccaggggcagagccaggatatagaacattggttctgtcttctcggctccgtgtcttcactgtcctggaggtttgaagggcatgctatagctaaaaggcttaccccacatcagtggctggctgtctccctgtggaatgaatggccctgggaccgtattccctcgcacgcagctcctccccagccgagcatcctggctttggccatctcaagggtcttcgctgccccgtgactcagcatccctgccatcctggcccaggctctgtgcagcctgcatctgaggaagaatgcccacagaggccggcacagggcctcaggccccgagtcaggtggaggacaattagaagtggaagaatggaggccatgaagcctgaagtggggctgggtcaacccaaggccacacagaaggcctatgacacagtagggcaagaccccaggctcctgtctccctcctgggagcaagaaattgatggtggccagggttttcctgggtagtctgagcaagcccatccacccagtctttgggtggtgagacccgccccagcctacccccaccagtggtgctgggggcttgggagaagactgagcagggctgtaggtgacccagggagctggctgcgtaccttcatcaggcccaggaggggcacgtacggccgttcactgtagcgtgtttgtggagcggggagttagaggtgacctggaggtctaaaacaggaggctggccgggtgcggtcactcacccctgtaatcccagcactttgagaggccaaggcgggtggaacacttgaggtcaggagttcgagaccaggctggccaacatggtgaaaccccatctctactaaaaatacaaaatttagccagagcacacacctgtaatcccagctgctcaggaggctgaggcaggagaattgcttgaacccgggaggtggaggttgcagtgagctaagatggcgccattgcagtccagcctgggcaacagagctagactccgtatctatctatctatctatctatctatctatctatctatctaggtagatagatagaacaggaggccagctagaagggacatagaggatgcacatcgtggaatcctatgtagcagtgacaggcagtgaactagatagaccttaaaagtttacatggactgggctcggtggctcaccccataacctcagcactttgggaggctaaggtgggcagatcacctgaggtcaggagttcgagaccagcctggccaacatggtgaaaccctgtctctactgaaaatacaaaaattagccaggcatggtggcatgcgcctgtggtcctagctacttgggaagctgagatggaaggatcacttgaacccgggaagcggatgttgcagtgagccaagatcgcaccactgccctccagcctgggctgatggtttcccctgtatttggagtaagcaaaaagacctcatttgactgggtgcggtggttcacgcctgcaatcccaggactttgggaggctgaggcaggaggatcacttgagcccaggagatcaaggctgcagttagccatgttcacgccactgcattcctgcctggacaacagagcaagaccctgtctcaaagaaaaaagaaaaggtggaggtggcgtggggagctggatatgtaccttcaccaggtccaggatcttcctttaaaatgcatactttttgaggtgagggctgatcacacagtctgataataactggacttcacccaacattggccactctgcttggagggcctgttgtaccctacaagccaaaaattgcagaccagcctccttactcctacactgatcgtgtccactagcccccaactcaatcaacccttctttatccccttccaacatcacataatcccccagccccaagccctgcagaggggccaagagcccaagcctgcaggcctggctgctgacgaaatgtcccctgggagagctgcccagagaaggagccattgttccttcctggaaaaacataccagctatgggagggggtctgctattccctgggacctcggcaaggatcctgagggtgaggcgggggggcctggcctgaactcctgaggctgctcctttccagcagcttccccgagctgctgcctcttgtgtcacccccatggccatgagggtgtgacagaggtggagctcagagagggagtcacaggaggccctggtgattgttagagatgtagaacaaagaaacttacaaaataatggtaagagtgattccatttaagttctagaaaaggcataactaatctacagtgattagaagcagagcagtggctgcctggggtggcggaggcggggagaggacttacagggaaggggccagagggtgacagaaacaatccacagcttgattgtggtggaagccacacggctttatacatttgttagaacttatcaaactgtacacctaaaatctgtgcatttcactgtgtatagagtacagctcaaaaagtttatttttataaaaagagtgacaggaggagtcctgggagggcaaggagacctaggatctcctcctggggtaccccagctccctgtgtgaccctgtgcagatttatgggcctgagcctcagtttcctccggtgcttccaaagacattatgtgccttggtgtcttgggggcaggacatggaaaacactttgggttgcctagaacagtcattaaagaggctctcctgacagagcctgaggggctttggaccagtcagtcaccctcaaaacaaaagttgctccactgagggcgagtaggactcagggcctgcccatagaatgccatctggagcggaggagacacacacaggttagtatggtgaaatctaagtgtagatcaatacagatggggtggtgagagaggagaattttgtgcagtctgagatatcattgcaatcaggggagacttcccgcaacaagaggcccctgcctgagcctgagattcctcaacagtaagaggaagaagatgatcatctgtagcgagggtcaaggctcagattgtgaccagcagccccaagctgtttgtccttagtctctcttccaattctccacatgcagtactctacaaatgcccctcctccataactctggcacttataaccctactccactcagttttaatcagacttgatgatatcacagcaattcctgtttttttttttttcctttagctgaagagctttagtccatcatcaggggacaaacagaaatgagactgagattcagaattgctgataggcatcagacctccgtctgtgaccaggatcagggctcggtgtgtgaccagcatcgggactcagactgggatcaggaacagggcttggtgtgtgatcagggtcaaggctcagggtgtgcccagggccagggttcagtatgtgaccaaggtcagcgcttaatgtgaccagggtcagaggtcagtctgtgaccaaggtcagggtgcagactgtgatcaggcacagggctcagtgtgtgtacatagtcagggctgggagaggccaggaacagcattggccctcactggccccacctggcctcttcctcccgctcctccaacttccctgggttgcatagccagctcatgaaatagcctagataggaagggtcaggccacaaaagctttgtggagccatctgtgcagtatttcttgaaactgggcctggggtgggggcagcaagctgtctgatgtcaaatgctgggtctcctgagtcttaaggcccagctaccccaccctatacgcagctgagggaaaggcactgggtgatggggaaggggcccatccctctcatcctcacccctcccccagaggcttccagggtccagagagtgagaaccagctcccagctggcttgagggcctatgggtcccttgggaaatgactgcaaacattcctaggggctcaagtaacagggcctaggctggccaagaagtcccccaccagccaggagccacctcatcctcacccacccttgtactccaagcttcctcatcattccaagtaggtgagatcaccctggctgcctggaccaggctcccccatgaggcccaggccccagggagagcaaagctagggtctgggaactcagggtggtgtggggtgggggatatgctggcagacacttctgccgatggcttagaagccagccttcccctccttggcctcatcttccagacctaaaagctgatgagagggtcttggcagcaggaaaggggtgggaaatccctccatgggactcaagtcctcccaccttgcctgctctcacccttcctgaatccctcaagagcagaggacttcaaagaaactaagaggagcttacagcctcatcttatcacttacctgacagaatccctgaggccagagaggagacggaattagaggccccagaaccactcccctttaagtcagtggctgggctgggatagagcccagggccctggagtcccccctgcccacacccactgctgcccgcacccaccccagcccacaccccatcacgaacagaggagatattccctcttcattccaatgcagaatggagtctggacacctaagtttggtttctgcttattcctagtaactcctgctcagactcctgcatgcccagggaggaaggtggaggggcaggaacaggacggacaggccccgggctctggcacatcctggggaacaagggaccacaaggacgggggcagtctccagacttcccctgggcgcttgaccccaggccttgcaggggagagagccagggcctccctcaggttggtggccggaggttgcagacagaggagggtgtggtcaggtctagggtgatgatggcaggaagtggtggcaggtgatggggggcgggggtatggggaggagtggctgcaccaggcagaaaggaatcctgagaaggtcaggctgggtgcccaggctgagaatcctgccctgtcagcagcctgctctggggaagtgttttccttctagcccatcccttcctgcccaccctgactcctgccagcctgcatccacctggctctgcccatgaaccttcagggacacactccaggccagaagcccagggctctcttggtggtttacaaagaatgctgactgcagggatgagaggaacggagggtgtctgggggctgctgtccagaggcctggggagtaaggactcgagggagtgcctctgtcaggaaattacatggttcactcattcctgcctccaggtctttgttcatgctgttttccctgccgtggacaccctttcccgctctctgattctctaaatcctgccccatctcccagatcttgttcatgtccaagcttttccaggaagtcttagcagctcccacaccgcagagctcgagatgtaagctcttgctgcctgacttccctgaccccacacctgggcccaggacctaacacccaaggagaatggcaaagggttttggggtatgagaggatgtttggggtgtgaggaggtctctgggcattagcagtggccaacctgatgctctcaatgtcatgctcttcctccctccccccttctctcccactgcccactccaggtctccctgacttggtcccagaccccaactatgtgcaagcatccacttatgtgcagagagcccacctgtactccctgcgctgtgctgcggaggagaagtgtctggccaggtaaggagctgaggcagaagtgtagagtgttgggatagtccccgggagtcacccagaacccagcctagctgtggctgccagctaggctgtctgcaagctgatgaccctggccaagtgccccagcctcccaggaccctgaccgtttcatcagtgagccttgcctgccccgagggagtcaggaggggaggggagcaagcgggggcccagcatttctgtatactgtacctcactatacaaggaactccacttttactgtggcacttcatctttatatgagccctgaaggcatgggttaccccctcaggaaactgaggagcaatgaaaggaactcaaaccttttggatctgagctgtttaatgagaaggttccttttgggagcccaggcttccagtggtcatacagggacccaaggaagtcctattgggtggatgtacctgcaggatagagcccaggagtatggagccatgtccacagaggacagttgtggctttggctggtccaggctgcctctgcctagtcacagcaggggcagtgagcccgggggacaaagaagtttcagttatatgttgcactggaaagaggggaaggagaccagtttccatgaacctagaaggtgagcacagctggctcgccattattcatgggtgatcctgcctctcgcagtgtttgcttctaatttataagcagttcatattctgctggaacataggtgctttgcggatacctccctgggccaaaataattagttaagattatgttatctgcttcttttgttaatatccctttatgttgaaagcacctatttttcttaattacctgctttttggacatttgaactctctgtttagtttgactttttactatctaggaaactctttagaatctcaacattttctcatttctagaacttctagttcactgccactctaagtagctgatcataaacccttatctgtctgtaacaagataaagagcttgaactagaatgtaactcaactcactccttcattgagaaagtcttgctttaaaaaaagaaaaagtatccgctgaactaagcagagtgattaggaatgttgtcgatgtacattctggtgcaagttcccaatcccatcccagactggcatcagtgtgggaactgcccctggtccagggaccgcaggctgagtaccactcagccagcctgtctgggcagttcttgtcttgtttcagttgtcttggggaagagagcataatggtcctgctggaattcctccagcaatgaggaacttacagcctccatgacagcccttccagtcttaagagaattagtcaaagtcaaactattaacatcactgcctcttcatgaaggatcctgagtgcccggacctgcgctcccagctggggagaggaggcagcctgtcctctgtcctggagggtctcctggtacagctggagagaacagccctcacctgtaccccagtgacagaaccaagacacgagtgggaaaagagccagaaggactggttcacaggccagggctgctggaggtcagaggagggagggatcagcaagggctgaggcctcagaggaggtgggcgtgggagttcagacctggagaatcctgcaaaactggagccctggggcaggagggccctctgagatcatttcaagtatgggccgcaggctggtgccagttcacatgctgcaggcagaacccagagaagaaaagggaccaattccaagtctcaccaccagtttgtggccaagctgggcctagaacctagacccttatggtttcccacggtgtgctgagccgaacagaagggcaggatttaactgaacagagggaaggaggatgttttgtttcaacccagacatagacagattccaagcctcccccagacaaggctgagggcctttcatcctggcagacagtctgagccgcctgttgtccagacattctctcaaagagagcgctaatccctacgactggccaccgctcccctctggccttaggatcggaccttaatgagtgccagggaagagcccctgaggccaacagagttagctgtcagccgtcagctaaagaggggaggggccttcagccaccccttcctgttcctaccacacatgtgtgtgcatgtgtgtgtatgtgtgcatgtgtgtgtgtctcccctcactgcagcccctcgttcctctttccacccttttccttttgtcacaaggcctacctcagttggaaatctggagtcagcaggtgacttgcgagcaggcaattcataccagacccatgttccctgaatggaaaagggcaggttgccagcctgaagccatgcaatcagggagaggtggtctggacccagtgcaagatgtagatggtatcgggctgtgctgcagtcagtgctgttagagctcacaggcaatccggatcctctatgtagagcaatcagggcagacttcctggaggaggggacttttgagttgaccctaggatactgggtgagttttggaattctgggtcaagcaaacagcatgggcaaaagtatgggtcagggaaaaagttcagcctgtttggaaaataggctttgaagcaggaacccagggtgtgtgggggagtggaagggcagatgggactagaaaagtgaagaggctttgaccagaggacttcacgtctgtttttcaggcccacacccaagacatggcatactttggtcaacaattagggctctgtcttgttgtcagagacttatcagaatctcctggataggacttttttttttcttttttttagaaagggggtctcactctgttgcccagactggagtgcagcagcacaattatagctcattgcagcctcaaattcctgggctcaagggatcagtctccaagtagctgggactacaggcataagccaccttacctggctaattttttaattttttaaaaatttctttaattaaattaattttttaaattttaatttctcactatgttgcccaggctggtctcaaactatgggcctcaagtgatcctcctgcctcgacctccaaaaagctctgtaattacaggcatgagccaaagtgcctggcccccgcaatagggctgtttttcagtggcccttcagagattgctatgtgctcctgcacctaggggctgaccccagctgagtcacctgcaggtatcagggacactgccatgcttggtaccgctttagaaagatgctgttggcagctggcggccacatggtggaggccagaaaggaggggacagccaggatttcacggggtcagaagacagaggaagaggcctgagcctccgccacagttcgaggagacagaggagaagatcttcagggacaaggagtggggctgcagaaccagtggccaagggctgggggtggggctgagggggcccatgctgggttctggtgtcactgtgccccaaccccccctcatctcccccgccgtccctgcagcacagcctatgcccctgaggccaccgactacgatgtgcgggtgctactgcgcttcccccagcgcgtgaagaaccagggcacagcagacttcctccccaaccggccacggcacacctgggagtggcacagctgccaccagtgagtggggaggggctgggcccgtcctcttccacttctcctctgggccagggaccttggtgcctgagctcccctcccaccatgagcactctgggagacacagatactggattagagggcccggggaggtgttacctgccaactcttttcactggggcaagtgtttctcagagaagccttagccaaagctaggctggaagatggatatagaaggattggtctcaatcagggatggaaatgtctagaatacagggcattgcccagtgaggccattacaggtgggagcccaaaaaggaagtgaggggtctagagcatgtgctgtcctggagtgacccagctaggtggggagcacagaggggccaccccgcagtactcaggagacaggagaacctagaccagccaggaggctgtgccacagcagggtcacctgagcccatctcaggatggggacaggatgagaggcccagggaagactaggccctcttctttctccttctctcctctgcccctaggcattaccacagcatggacgagttcagccactacgacctactggatgcagccacaggcaagaaggtggccgagggccacaaggccagtttctgcctggaggacagcacctgtgacttcggcaacctcaagcgctatgcatgcacctctcatacccaggttgggctggagagatggggtttggggcatgggaggataaggagttggggaggcaaagagcgaggcccgctgaggcccggcaagtgccaaggcttctggccactcagctctgctcacagtgaaggtcttctcaccagtcctcaggctgccacactgccctgcagggactgttccctccctgccccagcccctttcccatgttattccaggtgatctgctcgtggagagaaggaaacatcgcaacagtctggagagcaacacgtcctattggcctgttcacccacccatatccctctttccatcagccaccctaaatatccacaaactgtccatctgtcctgtctctttttatccattctgccatccatctcgtccctcccacctggctattagatatctgtctttcctctggtccatctagccagtggctttaggaaggtgtggacccaccctgagcagttgccctgggccagggtcaggggagaaacccaggggaaggtgggccagaaactcctgaaggtgggcgtggggtggctctgggaaacaagcagcatcacagccgctcctcttgtccctttcccagggcctgagcccaggctgctatgacacctacaatgcggacatcgactgccagtggatcgacataaccgacgtgcagcctgggaactacatcctcaaggtgggcctctgggtctggggctttccctccaacctgatgttcatgtccaatgtccccccgttcctgaaagaagcttcagcctctgggcctgttcccttctccccagctgccgagcagaggcagcatctgaggcatcacttgaggtttaggcttcccagccgaagatttaggtctcaggctgacatagcctctctttccataaagaacccagggaacctttgccccagctgtggtaatgccagaggcagtggtgatactgtctccctaagtgacagaggaccagggagagcaagaaagacttggagagccatgtggtctatcttcctgtcttcggacagggcagactttgtatcatttgggagacagatgagaggccctcagctccttatagggacccctgcaaagccaagggctcctgtgactaagacccttttagcctgaacccctcctgctctaatggacactcactccatcacctcttcccttggttgagggaaaagtagaaaagcatattaacaacacacatccagacttggtacatccgtgtaggccaggttgtcatgggcccacctggggaagccatgtctcagcctcctccacacaggtataaaatgagtagggatcattccaccagttcatctggacccactcagaagcagaaaagcagctcagtaaaggcagagcagtgaagccaggtttgcaggcggaggccttccctgcagaaagtcagcaggtggagagatgcatccggcagcggttctctgcagttccctcctgagtgctcttcagcaggctccaagcttgctcctccagggcctggggttgtccagtatattttttcttttcctcattcatccactcaatcaacatgtaggaagtcccctctgagttctaggcactagacacacaaaccacataagcaatgcagttcacagtccctgccctttgggagtgtaccaggatttgaaagttgcatccctgcatctgttcttagatgttctgcaaataaagctggccctaccctagttaatccaacatttaaaagtgttgtatcccaacagctccttttcagacaaaaagcacagatcatacttgggccatcatctcagtgaatgttgggcacgtggggctccagagcaggggatcagacaggccctcgatcagtcacctagacagggatgcatagggaatgactttgagccttggatttggggagaccaggtgttgaatcctggctcagctcctcattactgcattccctcgggcaggatccaacctctctgaccccaaatgccccatgcggggcccacctggcataggctctagctctagggaaacatccaatcttctgataagggggattagatgatgttttcttggattaccagctgcctcttctttcccctctgtgtctctctagcagtgtgtctctgttctccctctctctgtcacctctctgtctgtctgtctgcctctttaccaccttctctggtgagcagttgaggtgcagcccccctgactagactccctttctccctgtttctcttcttcctcaggtgcacgtgaacccaaagtatattgttttggagtctgacttcaccaacaacgtggtgagatgcaacattcactacacaggtcgctacgtttctgcaacaaactgcaaaattgtccagtaagagtttgcccaccacccttcctggctccgtccctttcctgcctggggagcaggcaaggccacctgagatacctaagatacctgcactttaggtcaccttgatggccgaacgcagctgcagcagggcccatcaaaaagagccttgtccgtgccaaccccaagctgagtgtttacggtggggctcaggccgtagggtgttgatctggggctgcatcctgtggctccctgagatgtcccaagtgaaaaccagcagaaggcagagtcatttgatgcaaggccatgagctctgcagtcccagttccacagcttcctcgctatgtgacattgggttacttccctgagctactttcctcaactataaaataggtatttccacataggctggcaatgaggatctacaggcctgatgtctgcatgttcacagtggcacacagtgaacagcagctgtgatcattagtgtccttttcaagtggactggattaaacagtcacagattagaagtgattctggttcaaaggagccatcttcagtccctaggcccccattgtagaagaagtgcctaaaatctgggcttgggattttggcacatgctgctgggtagggtcctcagtctttctcctgattccccatgtgaagtagtttgcagagggaccccttgcttacaagctcacaaggaaaccccaccacactccagatcgaagcaacccttttccattaaaaaaaaaaaaaaaaattagtcctagagctttcagctttagttcatcaactgggagaaaggtggtagagatcttaaggcccagagaggtatctttccctaaaagtgtgtacttattaatggatggcaggtatgagagattaagcctatgactatggtcagggtgtggtgtatggccagggtcaggattcagtctgtgacaagggttagggctcagtgtgtgacaagggttaggactcaatgtgtgaccaggatcaaggctcagtgtgtgaccaggatcagggttcagtgtatacctagggtcagggcccagtgtgtgaccagggtcagggctcagtctgtgaccagagtcagggcccagtgtgtagccaggctcagggctcagtgtgtgaccaggatcagggctcagtgtgtgaccaggatcagggcttagtgtgtggccagggtcagggctcagtctgtgaccagagccaggctcatttagagacagccctctcacacttggttgctaccatcaacctaactgttcacagcatgctgccaccacatcatgaatattaaaaatgggaacagcagcctccagttcagtgcagagattaggttcctcatgagtagaatgagatcagaattccccagggcacacagcatgtttgaaaggacgaactcctgtcccatcactggcagtttggctctttagcaggcctgggtttccagcacattcctgctcctcagggcctgtcttagccattcaagacccagggtcacctaagtggtagaagccattctagggaaggaggaggaaggaagaagggggtatccaggaaacaaaggaggctgctgggggctcggggaggcagggaatccctcctgctgctgggaaagggggatgggaacagaaacagcatcccacgtgccaggcgcctggagcagccaggagggctgtcggcagggcagatggagaagcagcctgcgcggccctcccagctccccgggggcctgtgggcagcagggggagccaaagcccttccttccaagagctctttacataagtgcttggaaaggccgggccttattagagtgtctcagtctctgtgaccctgaccgcaggcaggcagctgggccagcgtgcacaggaagctggacagagcgttcccagaaaggccacgggactgacgcctgtgggtttccatcgtgtttctggaggaaaaaggaggcttaaaaaaaaaaaagtactgagttagaaaaaacaagaaagtatttccagacagtagcagctctgctaatggcctagaaaacaatctgggactagggcatggggaggggaatgtgctgagactgtgccctgggtgggtgggagtccatcaaacccctccttttggagctgggctgagggggtcggaactttctcttgagggaaatgtaggcccatgcctgccctgccacgagggatctgggctgtgggagggacgccctggctgaggaggccacgggggcctactttgcagcccctcattgacccactgtctttccttcctcagatcctgatctccgggagggacagatggccaatctctccccttccaaagcaggccctgctccccgggcagcctcccgccgaggggcccagcccccaacccacaggcacggaggggcatccctccctgccggcctcagggagcgaacgtggatgaaaaccacagggattccggacgccagaccccattttatacttcacttttctctacagtgttgttttgttgttgttggtttttattttttatactttggccataccacagagctagattgcccaggtctgggctgaataaaacaaggtttttctac

SEQ ID NO: 1008 - DNA, 10320 bp, Homo sapiens
cattggaaaatgattaatttatttataattcatttggggatagttggttaatttgctttaaagttatgttcttacctctcaccacacatgaagacaaaatgaagagtttaatataaaaagtgaaatcataaaatctcagaagaacatttaattgaaaatttatatgttcctggtgaaggcagcggttatgcaacaataaagtccaagaccataaagaaaagattaataatctgacagcttaaaaatgaagcatcaagaaagtattttaaaaattgatggaaatgacaaattagttgcataatatgtgacaaagagtgatatatgaaaaggtgctaaatatacatcttataaaccaatactaaaaagatgaacattacaatagaaaatagtcaaagaatatgaacagaaaatttaccattcattcactcaacaaatatttatcgagcacctcttctgtgccagacaagtttacacatgggacacagcagtgaacaagacaaaggacaaaggtccctgccccaaggagcttacattctattggagaggggcaaacaataaacaagtaaattatgaagtattttagacggtgataagtactactggcaaaaaagaaaaagaagggttaagtaaggcgatcaggagtgaggcatggggagctcaggggctggggaggtctcatcaggaaggagacatttgagcaaagctttgaacagattcaggtagttgaccacacagagcaggggaaattgccatggtgcggcggaggggcaggagaaggccaagttggctagaacagaaagagcaagggaccaagtggtgaggaccctggaggccttgaacaggactttggcttttaacctgagaaccattgcagagctttaaggagaagagtgaaattttgacttatgtctcaaaaaggatcattctggctaccatcttgagagcagacttttggggtacaaaggtaggagcaaatagaccatttaggaggtcagcaaacacatggcaacatgttcactctcacgggtaaccaaaaaaatgcaactaaaaaaatgtattcacctgtttttaacctatccaatttttaatgttcttttagaaaacagtactcagtatcagtaagggtgaattaccttcgggcaggtaaatgggaaccacctttctgggaccagctgggtattctgtgccaaagcctcaaaaacactcaaaccctttcaccagaaatccaacttctaataaattaatctaaaggtctaataatcgccagtacttattgagtgcttgtatgcaccaggctctgaactaaacgcgctccatattacccccatttaaattcttaccattattcctgtcttacagaaagaaaaaaggcatggtgagtcacacagttcacaaatgagggctagaaccaaacccaggcactgtgacctgctacacaggagaggcagatatgaagatttcttcaagggtgcttattacagcatcatttataatagcaaataaagtacccaaaaaaatcaacaaaggaggtgattcattcagttatgatttgtccacataagtcagtcattaaaaatctggttaaagaaaactcgtttccgatccagccaggtgctgagacaggcagaactttccagagcttctccttggaagctgccagctgctgtgatgtcctatttcttgatccaggtggtaatccagaggtgtgctcacgttgggatcattcatcaagtggtacacctaggatttgtggacttttgtgtgtgtgtatgctatactcatgtttttaaaagttatttttggccgggcacggtggctcacgcctgtaagcccagcactttgggaggccgaggtgggcagatcatgaggtcaggagatcaagaccatcctggctaacatggtgaaatcctgtctcacctaaaaaaatacaaaaaaattagccgtgcgtgatggcaggtgcctgtagtcccagctacttgggaggctgaggcaggagaatggcatgaacctgggaggcggagcttgcagtgagccgagatcgcaccactgcactccagcctgggagacagagcgagactccgtctcaaaaaaaaaaaaaagttattttaaaaaatttaagttgccaggtgtttctcctcctacagggacacaagaaggctgtggagcaggattcttgggccagggatgaggccctagttatgtagacccaaggctggtagccaccacttgctccacgtggaaatggctctcaagattctgtggtctgagaaagcctggtccttcccatactgcaggaaggaaatgctatgcaggaagcggctggcctcctgggcagatagaaatgaaggtactccccgaccccacaccctaccttcccattccaaccagtgggttgacatttccacctctaagtgaaactggcaatctgactgcaggcccaggatccaggtccagtcctgagggagacaaggtcctaacaggggagggactcaccgctccggaacagagagggtatcttgcggagtgggggacaaagtcttgacctcctcttcatccaggcaggcaggagctcctgtgatcaatatgaatattgaaacggcagttaccttgaaacaaggaaatgttcatcaactgttattacacaaacaaagcagcttgtaaaatgacataggcactatgatcctaattgtttttttaaatgagtgggggggtggagcctaaaacaatggtttttctctaggttacagaatgaattactttttcttttttactctgtattctaaatttcctataattgacctatttcttttgtaatctgagattaaaaattgtattacaaaaaaacttaagggagagattgctgatatctcatctttcatcaccctgtggccctttcctttccagaacccagctgggcaaaactagtctccactggccccaagggcctgctccttctgttacaggaaagggttcccgatccaggccccaagagaggcttcttagatctcacacaagaaagaatatggggcaagtccacagagtaaagtgaaagcaagtttattaagaaagtgaaggaataaatgaatggcgactccataagcagaacagccccaatggctgctggttagctgtcatctatgattatcttttgattgtatattaaagaagggatggattattcatgagttttctgggcaagaggtagggagttcccagaactgagagttccccttccttttagctcacatagggtaacttccggatgttgccacagcatttgtaaactgtcatgcactggtgggagtgtcttttagcatgctaatgtgatatgatagtgtacaatggggagtgaggacaaccagaggtcatgatcatcaccatcttggtttgggctggcttttttttttttgagacaagagtttcactcttgttgcccaggctggagtacaatgacgtgatctcggctcactgcaacctctgcctcctgggttcaagtgattctcctgcctcagcctcccgagtagctgggattacaggtgcgcaccaccacgcctggctaattttttgtatttctagtagagacagggttttaccatggccaggctggtcttgaactcctgagctctggtgatctgcccgtctcggcctcccacagtgctgggattataggtatgagccaccatgcccagccatctggctttttttttttttaattgcattctgttttatcagtggagtgcttgtgacctgtatcttgggcctcctgtctcatcctgtgactaccaaggcctagcctcctgggaatgcagcccagtaagtctcaggctcattttacccagtccccattcaagatggagcccctctggttggaatacctctgtcacttccatcaccacatccagtctcaccccacaccacctccccttctccagctccactaccaacccccaccagggggaaatgagtaaactgcatgagctctgagaaagcagaaaaaaagccacctcatgaaggtgaaccaaggactgagtcgctgacagacagagatggatgggtaaatgggcagacagacagacagacatggagactgaaatagaaatgcctcccaaaggtcacagagagtcagtgccacgtcttcacctccacccaggactatcacttatacacccccaccagcctgggcacccactggaaacttggcaggtctggctgctctctgtgatgactgcagtcagcacagggcctggtattccacagatacccagggaacatgctgagtgagtgagtgagtggatgaatgaaggaatcgttcattggtagaagcatcagcagatagagatgacaggagggagtgtgaaagagagttgaggaagaacagaaacagatggagacagatggaggctgcaagtcacagacttggccacagatagaaaatgaacgaataaggtggagggaggttactgcagaaaatttaaaagctatagaaagccggtcgtggtcatgtgcacctgtagtcccagaggctgaggcaggaggatggcttgagcccaggagttcaaggctgctgtgaatccactgcactccagcctggggaacatagcaagactatgcttttttaaaaaaaacaaaaacaaacaaagaaaaagctagagaaacccagagagatcccagtgaaagttaaatttacagacaaaaagaaaaggagagagagagcacaagccctcccttaacttgtcaggatgttagcagagagaaccaggggttcctgccttagtttccctcctagatttgcaggtctctgctggactgtgtcccaagggcctggcgccctgcttggttttgtcagttctctccctcgggcaggggacagtttcctcttacccccacagcatgccagctcagggccctcccacccagaaggccccagacaactatgcagaatccccccgccaaggcaggtccctgggagaagatctctctccccagctggtcctcattcctgcaatgacaatcggctcctgtctccactggctctgggctcagggcccccgggttggataggggttggggctggaagtggaggtagagacaggagcctgcttgccccagactctggggaggggtgaaagtcagagaggggagaagctctaaggggctgaggcggcttcccgcctccacagagcccaacctgaatgcccagagtactgtatcagcttggttatttccaaatcccctgggagccgtaggggaggggacccagagagctgggaggaaaaccgactgggaagtagccagagccacagaattctcctgggtcctagagaagggtgggttccttccacccccaaccccattagtccctcgaaaaggctctgacctcacctcccccacttccggagtggagttccagccctgaagaaacacttccaaacccatggctctggccccctcctcaggccccctcctcggctacctcggccctggggactgggtcccccaccccaccgttgcgccagatgtggctgcaggggaggggtaggcacggggcccagctggcagtggtcactcggtggtcctctccctgcagagtcagcactttctgtgccagctcgcccagcctcctcactcagcacttcctccagcccgctttccagaggcagcagctgcctgggttgggtcttggattcccagtgctgccccaaacccatctacagcgcagcctggaagatggagggtttgggtgctctggggccttccctcttggcatccccactatcacagaaaattccgacccaccatgggcctcctagtacgtccctctgcaaagcaagggaggaatcccacagctcctgacccctctctgctccccagacccgctgctggtcaggcctgctgcttcctggttcccccatggactttccagaactcagccttccatgacagggtcacaggaccctggctgctccgtgggagccccggcaacacagagctgagcacgtggcaggggcttaataaagtcatgcgcaatcaacaggctctttcatccttctatcaccacccctccgagggtcccttgacaccggttcctagtgccaggaactggcaacaagcttcaagcacatgcctgggtcttaaaaatgtgggtgtgaatcccagcctgcagggacaggcggagagagaagctgcccttcaccccagacagctctggctcagctcagccttcgagtccacgccctcatttgaccccagctctgcaccctccataacctgcccaggtctcttttaggaccccaccctgcaggtttcaacctaaggatgccaggacacctccagccaccaaggcaaggccttgcccagcatgaggagaggtgatggaaggcaggctcccctgggctcacagaactgctgggcctgtcagccactgcaggagacctaaacccaagtagaatgaggtcagaaggagggagtagagaggaagggagaggacagctctggtggaggggccacctctggcccccctgcacaaggttcaccctgagcaaggaaagatgctgaagacagataaaaacaggaaagacagaggaagtgggagtgggggtcaaccccaagagataaatccctcccttctctcacaagtcaagaggaaagaaggaaaatagtggccacatgtctggctctgtgctggggacttttcataatcctctcattccatcctctcaaatatgccacaagaaaggtatgattacccccaggtcacagacgggactctgaagctctgagagcttaaaaagcttccccggggagtggctgggccaggccaggtccctagctcaagtcatggtgtggacccccaggtctccatctcagcagggatggctggcaggagcgcagtcctggccaggggagtctgtgcagaggcccaggctatgttcagagcagagtttattcaaatagagcctaacaggaaacttggctcctctgactcactctgattcgaccttattaagaaaaaaagagagaggagcaggagccagcatcgggtaaggtttcacgccaagagctggctctgaggcccgctgagtggaatggcatgtgccctgatccccccacatccaaagccttgaggcagcccctgccctgctgtccgagtcaaggcgaggggtcctgccttcacgttagggcaactgagttcccttcctcacagccatcctctgtcctccctccactcctcttcccttccctccctgcctaggggtaccctgaggcctgtttccatttctccccctcctctgctgcagcagctgcccatctggctggcgggagggccctacaggaccccagggattccaagcagctgaggccaacactgcagggggcaagcaggagggagggaaggcttaaccctccaggtcccggccctcagtaagccctgcctcagcatcttgcttggtgtcagtcacaccagtggctctttggaggaatcttgtctggagtctgagatggaaaccccatgctggggagctgaggtgtcagcgttgacaagttgctggccaggaggtattggaagccccctacctctgggctggattctgggcatttaaagggtagagacatgctggagtccaagcctcagtcctgaagaacagtgcaatgggtgaacaaatgctgcctggcaaggatggggttgggaggtctatagttcccaaagaatgtccactctagttgcctcctctctaggtgggctccaggcatttccaaaataaagaatatacaggagccaaattaaggacaggtccttcataccttgtttataagcccaagagggcaatttctgcccttcggttcccaggaacacggttggagaaggcagcccaggggaggccagaagagcagtatttggagtgtgatttcttggatgccaaagcgttcaaacttctgggaccccctcctatccctgccattcccagaaggaacagagaatctcccaaagcactctcaggagccatctggcctaatcttccattggtaagccgtggcacctggatcagatagagtaagggactaagccacacagcaacaggaccaggccaggtctccggaacccccttctgttgttcaatgcttactggcttctctgcctcacagtgacccctgtcccatatcaaagacagcccccagtttcattttatccatgtgtacactcaagttattcccaggctatgcagagccaagagatgtaggacagaaaccatacgtgatgtctgggaagttgatctctcccaggatctcacaagtgcttttcagctcagggatacaccccactcttcagactgggaaagtaagcccctgaggtgtgccacgagggaaaaggtgcagctccagtgcctctcttcgcaggcccaagagctgcggtgcacctgggacctggaattagagagtggtccctgttcagcatctccccgaggaggcccaccaacaaagagggtgtgtcttttttttttttttcttcctattgagggtgtgggataatggtggaaggaacatgcaaagagggtgtgtcttaattagcactggctttagggaacaaggaaaagggagaacccgggagtacgggaaggaggctggggcagacaggagtcagaggcccattccagcccaaacgagaagccagtgagcaaggtggagaccagggatgctgtgaccaaagcagagaggaatgggcggggtggtgctgacaccccagccccgttctgcctgccagagccccacttaccaggcccgagtccccagaggtcccctcctactccctgctcgattcccttcctcagaggcaggtctgtggcttggctgggaactccagggactgagggagcactgcagctgtgggaccggcgcatagctaaaagccggcgggccatagggccccgcggaggaggccccagcaggcggaccaggaggccgaagcctcccgacgctcccagcctgttgcttattcattcagagtgggaaagcgccagccgagcggccagccagtgcggggctggccatgtaaggcccacaggcggtcctgcccgcccggtgccctgcggagagcctcgtgcagccctgggcaccgcccctgccctgccctgaccccttggccttgaaatgctgtcatcggaggagccgtcccgctcgggacaaggccagcatggacaaagctagagctggggcaagcaaggagccttcctgtcctcgaggccgtgggaagagaagcacgcccagggggccactcctgagagcctctctgtccaccaggcctctgcagaggggtcaccatggctctggcccgaggcagccggcagctgggggccctggtgtggggcgcctgcctgtgcgtgctggtgcacgggcagcaggcgcagcccgggcagggctcggaccccgcccgctggcggcagctgatccagtgggagaacaacgggcaggtgtacagcttgctcaactcgggctcagagtacgtgccggccggacctcagcgctccgagagtagctcccgggtgctgctggccggcgcgccccaggcccagcagcggcgcagccacgggagcccccggcgtcggcaggcgccgtccctgcccctgccggggcgcgtgggctcggacaccgtgcgcggccaggcgcggcacccattcggctttggccaggtgcccgacaactggcgcgaggtggccgtcggggacagcacgggcatggcccgggcccgcacctccgtctcccagcaacggcacgggggctccgcctcctcggtctcggcttcggccttcgccagcacctaccgccagcagccctcctacccgcagcagttcccctacccgcaggcgcccttcgtcagccagtacgagaactacgaccccgcgtcgcggacctacgaccagggtttcgtgtactaccggcccgcgggcggcggcgtgggcgcgggggcggcggccgtggcctcggcgggggtcatctacccctaccagccccgggcgcgctacgaggagtacggcggcggcgaagagctgcccgagtacccgcctcagggcttctacccggcccccgagaggccctacgtgccgccgccgccgccgccccccgacggcctggaccgccgctactcgcacagtctgtacagcgagggcacccccggcttcgagcaggcctaccctgaccccggtcccgaggcggcgcaggcccatggcggagacccacgcctgggctggtacccgccctacgccaacccgccgcccgaggcgtacgggccgccgcgcgcgctggagccgccctacctgccggtgc

SEQ ID NO: 1009 - DNA, 11406 bp, Homo sapiens
tatacattgtaaacaccacatttatttgtctgaggcttgcaaacctctggtaagaagcacagaacgcagggctctccttcatgctgccctgggccccagctcgccaggcatgcaggacagagctggcagatgagtcagaaatctttgggagcagcgccagggaagcagcaggccctgctccttcccatgcccaatcccgccagcacgggcctggactgcagccaggaaggtgggccagccaggatccccaggtaacttcgccacagggacctcttcttggagctgccttcccttccctccccatccctctccaatccccgcagagcttagagcctgggccacatgcttggtccctcacacaaggaccaaaccagctgctgtcaggctgtttctgtgggtcctgtctctccagtcaggaagccagcagggcagggcaggcctggctctcctcctggaatcacaccgtgcacccagctcagcgctgggcactcagctggggaccgggatggacaaagccttgtccagagaaccactgtaggggagacgtgcatggcagccggactcagcctcctgcagcctccattcatgggctcttggctgggcctgaaatttgttagggcctcaactctctgtggtgcagatgaacacctcctcctccaagaggcccctcaggcttggtgccaggcttgggactgggctctggaaagtcagccaaggctgctacttcaaggccctgaggacagcctccagcttcatggccatagccaggtcgcccttcaccttcagccgtccactcatgtaggcccccaggggccgcagctctctgcatagcagggcccgcaggtctgcctcggccatctccaccaccacatcagggatgccatcaggcaccccgtgtcccactcttcctcgtcctgtggggcaaaagaaaaccgagtgtcagtaggggaatggaggaacgtgaaggagatctatgggggtgggaggggctggtatttcccattgggaggagagtactggttaagagtttgggttctaataccctgggtttgagtcttattggctgtgtgaactcttggatcctcagtttccaaatctgtgatgataattcctttagagatgacaattcctaaagcataggctcatggtgagaagtgggtgagataatgtacaaaaagtacttggcacagagcctgacaggcagcaggcctgtaacacgggcaggcctcttggtattggaagcctggctgcattgtcctgcggatggcggggagaccagggcatagttaatgcctggaaatggtgtctgagcccctgcctgccatgggttcaccccaaattattggcaggagcagggggcagtctacgagagcaccactggggtaggtaacaagaaacctagcaagctggatgggaaggagaggcaaggagggcagcggcacctgtagtgaggtccaggaagtaggcgctttgggtgccgctgggcaggacgacattgaactggtagcaggccccgacttggctgaccagggcctcagacaggaagggctgtagagcagtcagtagcccctccgccagaggctgcttcggactggacctggcaccaacttgaggggcaggtggctcaacttcactcaccatctccacggtgtctgctgggggtggccaacagggttggggaaggaggcagagaggaggtcatcgtgttgccaaggtcaggaccactcactgtggcctctgcaccttttgtggcagtttcctcttagatccccttcaggcctctgttcaacttcctcctctaccagaaaggtgcccctgagttttcagcctaaactgcaaactcagtttctaaactactccagcctcagatataaaattctttccagctgcccttctggtgatgtcgcctcctcccatggaggctgccaatggcctctacacactcagacacctggcctcctctcactgccttggctgtggtcagtgtgggctgaacatctgtgcagggtgtgtactgcacagagctgctgggatagtgagcaaagtctgtgctggcaccaagctggtaaacacccccgctctcctccccagggctcctcacctggccccggggacggggcacctcctgccattgagttcatgcttcctcccaggaagtgcagggccagctgctggagggtgctgtccaggttgggcccagctgggctgtcctggggcggctggagcacggcctccactgccagctccacgcggtctacctccagcccccaggccctggtcacatcgttgatctccagctggaggacagtgtgaggagaaatgtaattaattcaacaaacctttcctgagcaccttctttgggcagactgtgtggccgtgcatggacatggaggcaccacaccgcccttgagacactcctagcctgggaacacaggcagagggcaatgacctttcagctgtggtaagtgccaagacagaagcaaggcctgtggtgagcccccagcagaggagggtggtgccagcaggagggagtcctcaggtggaggaggacccttccagcaacaggaacagcatgtgcaaaaccccagacaagaaaacctggcatgttcgtggagctgcgaggaaccagagttccatttagctggaccctcacatgtcggctgaggactggagacagctgaggggtcagaggtggggtgtttctgcttactttgatttattctgaggcaacaaagagccccagggaggagtttgagcagggaggtgatacagcagacttgctttaaggcaagatcctcctggctgctgtggatgctggattatagggggctgaggggagggatggagaccaaggaagacattgtttcaaaatacagccaaggaatgatgcagctctggcgagggtggaggggagctgtgaagccaagatccactgagggaggcatgcctctatcaactgtactgagccacaacagggcactagagaagtgcaagcaccaggctcggggctgcctcgatgtgtgcaatgatatgagagggggcgggagtggggaggagtcaggctcctgaatggatgagtgtggcattcactagagaggacacacgggggtgggaagggagggatggcaacttttttttttttttttactactgtaagcttgaggtgtctgtggggcagtcaattgtccagtaggcagctggagaaatggcccagggtacagaagcatcagggctagggcaggacattgtgaataatcagcatccacaggcagcagacagcccagatggatgagctctcccagggaggtcacagatgagaagaggccagtgatgaaaccctggaaactcaagggcaggagaataagtggcagtaaccagggatgacagggaaggaggaagtacagggggttctgggggctgggggctgggtcgaccatgtcaaatgctgccaccaggtgatgtaagggaagggctgagaggtgcccactgggctggcatgtgggaggtcactgtgatgttggccagcgctgtcttgggagcccaaggaggccaggatgaaggatgtaggggcaggggctgggagcatggatgaaagtcttgcagaagaaaaggggagaaagggagtgggagctagagggcactgtggcaaagggagggcacatttctacacagaaaggagaggtgacagagagagagtgcatggagtggagggaaggcatcctgggatagcagggggcccacagcactgcgcagtacagggatgagcctcagagaggggaggcagaagggcaaggaggcaggaaagcagcacagaggcaggtgggtttgaaggggtgaaactggaggaagcagagtgctcatcctagagtttttctcctgagtgttaggaggcaaggcctgctgcagagagcaatgagcagtggtggggctggaggagggcagtgaagggctgaggcagctggcctggagcactggcaggtaaggagtggtaactggctaaggaaggtccagcaagtgagaggtggggactctgatttctctagaagaaaatcaggcaaaaaggggcatgtgaataagtgtacgcctgaaccagggcctgagggcggtgtgctggacctcctgaggttctgtctcaaccacaggcacagctctcactctaccaggtgctcactcagtctgggaaatgggacttaaaggactctcacatcctggtgtggaactgacctccccaaactgcctgtctcacatcaaaacaatgtgcaacaagactgagatcagttttctcttcctaaaggtgaattaacacggggcatggttttatgaataaaagttgttatccacttgctatctgagttgtgttagatcaagcactggattgaggggcgatggtgggatggaggcaggtggtctagctatggctcagctctgcccttgaccatagctctcagaggcaagtcaaattatttcttagccttagcttcctccctccaaaataaaacagtagtaccgacttgcagcaaaaaatgtcaagctcagaaatgctgggccagacaaaaggactttgtaaaccataaactgctaagcacgtaagagctactgttaggatctcaaatagtatttcctcaggaatttcccctcgctgcttccagtgggacctccaggactggcatttatcccattcccccgactgtcctctaaccttgattccccagggcaaagcagagccaagaggaatggggagaaatgtcacctacattcccctgtcaggacacaagaggaagcacaagttgagtgtggctgcaggggacacaactctgcatgtgtatttatttctaccccatcttgtagcagaagagatttagggcaaactccaatatacacatggagaagaggcaggaaaaagatccaaatgtcctcatgttcctttgttctgttccaaacaaggaaacaaaaatcacaagcatgcacacgctgcatggtgagcctggaattccccagcaggtgactgggctgggagggtccctgctccatcacccatctgcctgccccatgagtcaggcccggaatgagagctgtagaagccagtgtcatcatggcagagcagtgaggggtaaaaactaaggggcagaccccaagaatgtctgccggggccacttcctcttctcagggacaagtttgcccaggatcgttatggtctacgcccacctgccattcctcaactcatggccccacccaggcactggctcttcaaaggtggttacactattgggacatatggtaaactgaggcccagagtggtctgactcttttctcaaagtgacctggcaggtggagccaggccggtgccacccctcaagctccgtcttgtgaggggctgcctaccagaagctggtcgctgatcttgagcttctccatctggatctcccgcagcggcctcttgagcagggccttggtcatggcgttctgggctgtcatgcgtgtggctgtgttcaggtctttcacagtcatcaccgacagcaccgggtcccagatgcgaaactggacatcggctcccacggacagcacagccccgtccttagaggccagctgttgggggaggccatgagagagagacactcaaggggctgggggtgcagggaggtcaggcccactggggccacccagcttgaaccacctgcttggcagctagctcctcaagggcaaatggtgtcaccaagtatgtagggttaggtgtatgaagcaaggatgtcctcctagcttccatcaattttctggtctcttcttcccccttcccccctcagatggtgactcacaggctgaggtcctggcaccacagtacattctggacaggcccccagttcctctgtcaaggcagctgagaagcccctcaccttgcagggagggacgttgaaggctcgtgtcctcagatccaccctctgaaaggagtcaatgaagggcaagagcagaaccatgccaggtccctggggggtgcggatccggcccaggcggaacacaatcatccgctcgtaggtgggcacaatctgtccacaatggcaagggaaagagttgaaagtggtcagcctaggctggccaatgctgtctgcctaggtcccttcctcacttctctcctcctcacctgggtcacagttaggtatccctagcactgtttccagatgagaaaaccaaggctcagggaagctaagtgactgctcaaaaattgcatagccctaagtgaaatagtgaagatttgaatgcagttctgaataactccaaaggccatgtgtcttaactactgcactgtattgacttgatccttagagaaacttttcatctctgtggtctgaagttagacatgactcataccaggaaactgtctgtccttggattagttaggagaaaaggctcggctgccctaacagcacccccggggaaagggctttgtcaactttaggtccctggacctcctagagaagtagtgatgtccaaattgagaaatgaaggcccagagaggcaaagaaacctgttcaaggtcacatggcatttgtttctgtggcagttttagaactaggatataaggccatttaaggacccccttgcagaccacaccaaacccagaggttttctagagagggactgttgcctagggctacacaaagggcaaggcctccttgggcttccaccttcccccagctttcacgtgcgatgctgaactatagctccatggttcatccttttcccactgtaccaccccttatggaaaatgaggcctgaattcctattatgcactaccagctgggctaagttgggtgttttcatttctaatttattctaacccaaagagaagataatttggcaaagacatctgcgtgtaccttaaagccagtgtccagatcccaggacttaggagtttgggacttgcttctaccccctactggctcccagtatgactttagacaagcccaagccttagtttcctcccctgaccaatgtgaatgaatggttcttgcctagcccattacacaaaggggtaataatatttagggaaaggggacagaggataggcaaatttattcatcaatgccaaagctctcagtgtggcccaaccaccctgggggctgacccagccagccttaccttcagggcaaaccagccagaaatggggaaggtgaccaacagcagcaagaaccccaggaaactgatgaggccatgacagaggcaggagggccagctctggggtacatctgcaggtgagagcagaggtggtcaactggacctgcacgacagctgccaagcggagtgaacttgggcaagtgtaccttacgcccaccttcccctcgagaggctccttccttctcagggctctcaatctggctccttgcctaatattcccgtatctttgggcagctgcaagttagggtctgttccctcctcccatacatcaacactcatttgtcccaagtccaacaaccctcacaaggccttattctctgctaggcaacagccattcaatctcagaatccagtccgcgtgatgatgctctcctcactggactgagtaggggtcaatcctctcgtttaatttatattgcctacccatacctggcatggagccaggagcacctgggcatctgtaaacatgcactgaatactgctggcaaaacacattcctcctataccatcagccccagaagtgtgctttccaggagtccttatgaagatgatgccttagcctacagggataaatcataaatagcttatcaacgggagccacagatgaggaattagattattattttctattccacacccaactttaatgccttaatgaccattaaaaaatgcctatttcacgagatggcgccactgcactccagcctgggggacagagcgagactccatctcaaaaaaacaacaaacaacaaaaaacaaaaacaaaaaaaaaccctgcctatttcaattcaagaaaattgttaggggtcggggtcaggggcagggctagaaagatgaggcttatccaagccaaatgtcctggcccctggagattcaggagcccaagttgggagcaaagccgagacagctccagaatctgggatgaggttatttgccgctttcctcccaaccctggacaggaagcagtcgggagccctgctccattcttccaggaagccctgccctctgggctaagccccagagcactgaggctccactttgtgcctggctctgatccaccaggcctctcaagagacttctggatagggagagctttcaggacaggaaggccagggagggatcaaatccaaggttaggcggttaggctgaacagcgtgggatctggcctgtaggccaaaggagccacagaagactttgagggcaagacagaagcagggcagatccaacaggcagctgaggacctgtcattttggcctgcacatccaggagatgcctagttcccgggcttctagaggtgccccctagggcgaaaattcttccatttccctgcagcaggtgcctttagggtgctggtggcctcctctgcctagacctcggtttcttctatgcgaaatagaaacctgaaacgtcttcccaggcctaaagggctgataagagccgaggacaaatgtggtgaggtgaggttttggaagataggagcaacgctggctggctctggggccaaagccccatgaccctagggagggcggatcggcgctagcaccaggcgccgggtccagccccctctccacatcgtatccctttctcagtcccccctcgtagggtgcgacggcaccgggccggccgactcctcggaggcagagattcgggcctgggggttgccggccggtcccccccggctccgccgtgccaggcggccactcaccggcccctgtccccacgccgccccgctccggggacaagcagcccttctgcgagcccagaaagccgaagctcgactgctggaagcggtcaaaatcacccaggggcagcgcccggtacccagacctgccgagcatggcttttgacaggagacacgccccgcgcctccgcgcggcgccctccctggccagtgggccctacgcggccccgccctcctggctgctgcttccggcttcacccgcgcggccacccgcggcggcgcgggcgcaggaagaggaggccggccggggcccgcttccgccgtcgcatggctccccctgcgctgggaggaccgaactgcagcccagggctactgggtgtgatcggcgttcctcggaccccgctggggtcatcgcctcctcccctcttctcctactcagccctagaaaagctggaggggaagctgggcacggtggctcactcctataatccatcaatttgggagactcaggcaggaggatcgcttgaggccaggaattcaggaccatcctgagcaacatagtgagagcccatctctacaaaaaatttttaaaaattagcctggcgtgggatgcctgcctgtggtcccagccacttgggaggctgaggcgggaggatctcttgagtccaggagtttgaggctgcagtgagctatgatcgtgccactgcactgcagtcggagcgagagagcaagatctcatcagggtttacaggaagccaatcttctccaggatcaaggacatgctatatcagccttctcagcactccttctctcacactggaggcaggacatgccatatctggactttgggtttctctgggacatagtctgcaaattattcctctttgtgaacccacagcccagcaagcagggactggcatagggcaggtctcaatacttatttgttaagtaatggcctggccaggtcaccgtgatcaaggtggagtaggaaggcctgaactttggcacaaaaagaaagaagtttcacatgcagacttcggggagcatgggagtgtaaggaagaaggggatagcacagagctacatgagggcaggggccccagagcaccacagaggtgaggccctcagtcctgcaggtccagaaagagcatgccccttgatccaggtacctggaattaacttgcctctccagggcttgagaaaacctgaatgcaactcgtgaatttcctttgagaagtgttaacttccaacaggactttggggtagtctgggagcaggctatcttccaaagcaagcaaagaaatgaataaagcttccccagctctgcctcctcagccaatcgcctctggcctccgaagccccatcctgccatagcccacttccaggtcccttgtgcagatggctgcccaccatatttggctttcatggactgattctctaaaggcctgggagtactgaccaggctggagggaagggcaggctcctgaggccttacagtccctaggaagttgcgtatctgcccaacccctgctctccaccctgcagactgtaaggtttacaagagccaggccctatcatcatcctttctagtctgtttctaagttggaacagagtacggaatgggtacacaggagccagcacagtggttgcgatggtttaagtttgaagccggggcgctgacccagtgaggtcacctggaactgtgcccctttccccttaccagctgggagtctgacatgcttttccattggcgaagacctagctggctctcccctcaccctcttcatacccgctctccagctctccccctccctcctgcccccaccacctcagatccaccagcctttccagctgtcactcaaggcatcatcctgctccctcacctccagtcactggcttcccaggatctctgaatcaagtccctcctctgcatcccacagccactgtcctagaccagggcacctgctcctaggttgtcagagtgactgtcccatcatgcacagctgatcgtgttgttccctggttccaaatccttcagcaacttcccatcactcacagaactggttcaatctcctcagctaggatcttgtcctagcacactccttgggtatcatttctcatgaattccctcttaaatctgaaaatggccaaaattagttcccaaacaggcttttgcaagagctatcttttctgtttcaagtgtcccccgtaccccaccacctacaaccctaaatccctggtgaatttccactgcttttgcaggtcccagctgtgggctctcctttccagaatgtctccgtttgcaggcttgctcttccattacatctacggctcttagaaagcaggggctgcgtgtggctcatctttgtacgcccagctcccggcaggacgtggcacgaagcagtgccagtgtgaacggatgaatggatcaaagccgggagcagggctgcccccctgcagctctgccctacctctcccgctttaccgtaagtcagcggtaggtctgcagctctccgcctctacctcctccccgctctgggcgtgtctttaaaaccca

SEQ ID NO: 1010 - DNA, 9132 bp, Homo sapiens; identical to SEQ ID NO: 1004

SEQ ID NO: 1011 - DNA, 9132 bp, Homo sapiens; identical to SEQ ID NO: 1004

SEQ ID NO: 1012 - DNA, 10494 bp, Homo sapiens
cattggaaaatgattaatttatttataattcatttggggatagttggttaatttgctttaaagttatgttcttacctctcaccacacatgaagacaaaatgaagagtttaatataaaaagtgaaatcataaaatctcagaagaacatttaattgaaaatttatatgttcctggtgaaggcagcggttatgcaacaataaagtccaagaccataaagaaaagattaataatctgacagcttaaaaatgaagcatcaagaaagtattttaaaaattgatggaaatgacaaattagttgcataatatgtgacaaagagtgatatatgaaaaggtgctaaatatacatcttataaaccaatactaaaaagatgaacattacaatagaaaatagtcaaagaatatgaacagaaaatttaccattcattcactcaacaaatatttatcgagcacctcttctgtgccagacaagtttacacatgggacacagcagtgaacaagacaaaggacaaaggtccctgccccaaggagcttacattctattggagaggggcaaacaataaacaagtaaattatgaagtattttagacggtgataagtactactggcaaaaaagaaaaagaagggttaagtaaggcgatcaggagtgaggcatggggagctcaggggctggggaggtctcatcaggaaggagacatttgagcaaagctttgaacagattcaggtagttgaccacacagagcaggggaaattgccatggtgcggcggaggggcaggagaaggccaagttggctagaacagaaagagcaagggaccaagtggtgaggaccctggaggccttgaacaggactttggcttttaacctgagaaccattgcagagctttaaggagaagagtgaaattttgacttatgtctcaaaaaggatcattctggctaccatcttgagagcagacttttggggtacaaaggtaggagcaaatagaccatttaggaggtcagcaaacacatggcaacatgttcactctcacgggtaaccaaaaaaatgcaactaaaaaaatgtattcacctgtttttaacctatccaatttttaatgttcttttagaaaacagtactcagtatcagtaagggtgaattaccttcgggcaggtaaatgggaaccacctttctgggaccagctgggtattctgtgccaaagcctcaaaaacactcaaaccctttcaccagaaatccaacttctaataaattaatctaaaggtctaataatcgccagtacttattgagtgcttgtatgcaccaggctctgaactaaacgcgctccatattacccccatttaaattcttaccattattcctgtcttacagaaagaaaaaaggcatggtgagtcacacagttcacaaatgagggctagaaccaaacccaggcactgtgacctgctacacaggagaggcagatatgaagatttcttcaagggtgcttattacagcatcatttataatagcaaataaagtacccaaaaaaatcaacaaaggaggtgattcattcagttatgatttgtccacataagtcagtcattaaaaatctggttaaagaaaactcgtttccgatccagccaggtgctgagacaggcagaactttccagagcttctccttggaagctgccagctgctgtgatgtcctatttcttgatccaggtggtaatccagaggtgtgctcacgttgggatcattcatcaagtggtacacctaggatttgtggacttttgtgtgtgtgtatgctatactcatgtttttaaaagttatttttggccgggcacggtggctcacgcctgtaagcccagcactttgggaggccgaggtgggcagatcatgaggtcaggagatcaagaccatcctggctaacatggtgaaatcctgtctcacctaaaaaaatacaaaaaaattagccgtgcgtgatggcaggtgcctgtagtcccagctacttgggaggctgaggcaggagaatggcatgaacctgggaggcggagcttgcagtgagccgagatcgcaccactgcactccagcctgggagacagagcgagactccgtctcaaaaaaaaaaaaaagttattttaaaaaatttaagttgccaggtgtttctcctcctacagggacacaagaaggctgtggagcaggattcttgggccagggatgaggccctagttatgtagacccaaggctggtagccaccacttgctccacgtggaaatggctctcaagattctgtggtctgagaaagcctggtccttcccatactgcaggaaggaaatgctatgcaggaagcggctggcctcctgggcagatagaaatgaaggtactccccgaccccacaccctaccttcccattccaaccagtgggttgacatttccacctctaagtgaaactggcaatctgactgcaggcccaggatccaggtccagtcctgagggagacaaggtcctaacaggggagggactcaccgctccggaacagagagggtatcttgcggagtgggggacaaagtcttgacctcctcttcatccaggcaggcaggagctcctgtgatcaatatgaatattgaaacggcagttaccttgaaacaaggaaatgttcatcaactgttattacacaaacaaagcagcttgtaaaatgacataggcactatgatcctaattgtttttttaaatgagtgggggggtggagcctaaaacaatggtttttctctaggttacagaatgaattactttttcttttttactctgtattctaaatttcctataattgacctatttcttttgtaatctgagattaaaaattgtattacaaaaaaacttaagggagagattgctgatatctcatctttcatcaccctgtggccctttcctttccagaacccagctgggcaaaactagtctccactggccccaagggcctgctccttctgttacaggaaagggttcccgatccaggccccaagagaggcttcttagatctcacacaagaaagaatatggggcaagtccacagagtaaagtgaaagcaagtttattaagaaagtgaaggaataaatgaatggcgactccataagcagaacagccccaatggctgctggttagctgtcatctatgattatcttttgattgtatattaaagaagggatggattattcatgagttttctgggcaagaggtagggagttcccagaactgagagttccccttccttttagctcacatagggtaacttccggatgttgccacagcatttgtaaactgtcatgcactggtgggagtgtcttttagcatgctaatgtgatatgatagtgtacaatggggagtgaggacaaccagaggtcatgatcatcaccatcttggtttgggctggcttttttttttttgagacaagagtttcactcttgttgcccaggctggagtacaatgacgtgatctcggctcactgcaacctctgcctcctgggttcaagtgattctcctgcctcagcctcccgagtagctgggattacaggtgcgcaccaccacgcctggctaattttttgtatttctagtagagacagggttttaccatggccaggctggtcttgaactcctgagctctggtgatctgcccgtctcggcctcccacagtgctgggattataggtatgagccaccatgcccagccatctggctttttttttttttaattgcattctgttttatcagtggagtgcttgtgacctgtatcttgggcctcctgtctcatcctgtgactaccaaggcctagcctcctgggaatgcagcccagtaagtctcaggctcattttacccagtccccattcaagatggagcccctctggttggaatacctctgtcacttccatcaccacatccagtctcaccccacaccacctccccttctccagctccactaccaacccccaccagggggaaatgagtaaactgcatgagctctgagaaagcagaaaaaaagccacctcatgaaggtgaaccaaggactgagtcgctgacagacagagatggatgggtaaatgggcagacagacagacagacatggagactgaaatagaaatgcctcccaaaggtcacagagagtcagtgccacgtcttcacctccacccaggactatcacttatacacccccaccagcctgggcacccactggaaacttggcaggtctggctgctctctgtgatgactgcagtcagcacagggcctggtattccacagatacccagggaacatgctgagtgagtgagtgagtggatgaatgaaggaatcgttcattggtagaagcatcagcagatagagatgacaggagggagtgtgaaagagagttgaggaagaacagaaacagatggagacagatggaggctgcaagtcacagacttggccacagatagaaaatgaacgaataaggtggagggaggttactgcagaaaatttaaaagctatagaaagccggtcgtggtcatgtgcacctgtagtcccagaggctgaggcaggaggatggcttgagcccaggagttcaaggctgctgtgaatccactgcactccagcctggggaacatagcaagactatgcttttttaaaaaaaacaaaaacaaacaaagaaaaagctagagaaacccagagagatcccagtgaaagttaaatttacagacaaaaagaaaaggagagagagagcacaagccctcccttaacttgtcaggatgttagcagagagaaccaggggttcctgccttagtttccctcctagatttgcaggtctctgctggactgtgtcccaagggcctggcgccctgcttggttttgtcagttctctccctcgggcaggggacagtttcctcttacccccacagcatgccagctcagggccctcccacccagaaggccccagacaactatgcagaatccccccgccaaggcaggtccctgggagaagatctctctccccagctggtcctcattcctgcaatgacaatcggctcctgtctccactggctctgggctcagggcccccgggttggataggggttggggctggaagtggaggtagagacaggagcctgcttgccccagactctggggaggggtgaaagtcagagaggggagaagctctaaggggctgaggcggcttcccgcctccacagagcccaacctgaatgcccagagtactgtatcagcttggttatttccaaatcccctgggagccgtaggggaggggacccagagagctgggaggaaaaccgactgggaagtagccagagccacagaattctcctgggtcctagagaagggtgggttccttccacccccaaccccattagtccctcgaaaaggctctgacctcacctcccccacttccggagtggagttccagccctgaagaaacacttccaaacccatggctctggccccctcctcaggccccctcctcggctacctcggccctggggactgggtcccccaccccaccgttgcgccagatgtggctgcaggggaggggtaggcacggggcccagctggcagtggtcactcggtggtcctctccctgcagagtcagcactttctgtgccagctcgcccagcctcctcactcagcacttcctccagcccgctttccagaggcagcagctgcctgggttgggtcttggattcccagtgctgccccaaacccatctacagcgcagcctggaagatggagggtttgggtgctctggggccttccctcttggcatccccactatcacagaaaattccgacccaccatgggcctcctagtacgtccctctgcaaagcaagggaggaatcccacagctcctgacccctctctgctccccagacccgctgctggtcaggcctgctgcttcctggttcccccatggactttccagaactcagccttccatgacagggtcacaggaccctggctgctccgtgggagccccggcaacacagagctgagcacgtggcaggggcttaataaagtcatgcgcaatcaacaggctctttcatccttctatcaccacccctccgagggtcccttgacaccggttcctagtgccaggaactggcaacaagcttcaagcacatgcctgggtcttaaaaatgtgggtgtgaatcccagcctgcagggacaggcggagagagaagctgcccttcaccccagacagctctggctcagctcagccttcgagtccacgccctcatttgaccccagctctgcaccctccataacctgcccaggtctcttttaggaccccaccctgcaggtttcaacctaaggatgccaggacacctccagccaccaaggcaaggccttgcccagcatgaggagaggtgatggaaggcaggctcccctgggctcacagaactgctgggcctgtcagccactgcaggagacctaaacccaagtagaatgaggtcagaaggagggagtagagaggaagggagaggacagctctggtggaggggccacctctggcccccctgcacaaggttcaccctgagcaaggaaagatgctgaagacagataaaaacaggaaagacagaggaagtgggagtgggggtcaaccccaagagataaatccctcccttctctcacaagtcaagaggaaagaaggaaaatagtggccacatgtctggctctgtgctggggacttttcataatcctctcattccatcctctcaaatatgccacaagaaaggtatgattacccccaggtcacagacgggactctgaagctctgagagcttaaaaagcttccccggggagtggctgggccaggccaggtccctagctcaagtcatggtgtggacccccaggtctccatctcagcagggatggctggcaggagcgcagtcctggccaggggagtctgtgcagaggcccaggctatgttcagagcagagtttattcaaatagagcctaacaggaaacttggctcctctgactcactctgattcgaccttattaagaaaaaaagagagaggagcaggagccagcatcgggtaaggtttcacgccaagagctggctctgaggcccgctgagtggaatggcatgtgccctgatccccccacatccaaagccttgaggcagcccctgccctgctgtccgagtcaaggcgaggggtcctgccttcacgttagggcaactgagttcccttcctcacagccatcctctgtcctccctccactcctcttcccttccctccctgcctaggggtaccctgaggcctgtttccatttctccccctcctctgctgcagcagctgcccatctggctggcgggagggccctacaggaccccagggattccaagcagctgaggccaacactgcagggggcaagcaggagggagggaaggcttaaccctccaggtcccggccctcagtaagccctgcctcagcatcttgcttggtgtcagtcacaccagtggctctttggaggaatcttgtctggagtctgagatggaaaccccatgctggggagctgaggtgtcagcgttgacaagttgctggccaggaggtattggaagccccctacctctgggctggattctgggcatttaaagggtagagacatgctggagtccaagcctcagtcctgaagaacagtgcaatgggtgaacaaatgctgcctggcaaggatggggttgggaggtctatagttcccaaagaatgtccactctagttgcctcctctctaggtgggctccaggcatttccaaaataaagaatatacaggagccaaattaaggacaggtccttcataccttgtttataagcccaagagggcaatttctgcccttcggttcccaggaacacggttggagaaggcagcccaggggaggccagaagagcagtatttggagtgtgatttcttggatgccaaagcgttcaaacttctgggaccccctcctatccctgccattcccagaaggaacagagaatctcccaaagcactctcaggagccatctggcctaatcttccattggtaagccgtggcacctggatcagatagagtaagggactaagccacacagcaacaggaccaggccaggtctccggaacccccttctgttgttcaatgcttactggcttctctgcctcacagtgacccctgtcccatatcaaagacagcccccagtttcattttatccatgtgtacactcaagttattcccaggctatgcagagccaagagatgtaggacagaaaccatacgtgatgtctgggaagttgatctctcccaggatctcacaagtgcttttcagctcagggatacaccccactcttcagactgggaaagtaagcccctgaggtgtgccacgagggaaaaggtgcagctccagtgcctctcttcgcaggcccaagagctgcggtgcacctgggacctggaattagagagtggtccctgttcagcatctccccgaggaggcccaccaacaaagagggtgtgtcttttttttttttttcttcctattgagggtgtgggataatggtggaaggaacatgcaaagagggtgtgtcttaattagcactggctttagggaacaaggaaaagggagaacccgggagtacgggaaggaggctggggcagacaggagtcagaggcccattccagcccaaacgagaagccagtgagcaaggtggagaccagggatgctgtgaccaaagcagagaggaatgggcggggtggtgctgacaccccagccccgttctgcctgccagagccccacttaccaggcccgagtccccagaggtcccctcctactccctgctcgattcccttcctcagaggcaggtctgtggcttggctgggaactccagggactgagggagcactgcagctgtgggaccggcgcatagctaaaagccggcgggccatagggccccgcggaggaggccccagcaggcggaccaggaggccgaagcctcccgacgctcccagcctgttgcttattcattcagagtgggaaagcgccagccgagcggccagccagtgcggggctggccatgtaaggcccacaggcggtcctgcccgcccggtgccctgcggagagcctcgtgcagccctgggcaccgcccctgccctgccctgaccccttggccttgaaatgctgtcatcggaggagccgtcccgctcgggacaaggccagcatggacaaagctagagctggggcaagcaaggagccttcctgtcctcgaggccgtgggaagagaagcacgcccagggggccactcctgagagcctctctgtccaccaggcctctgcagaggggtcaccatggctctggcccgaggcagccggcagctgggggccctggtgtggggcgcctgcctgtgcgtgctggtgcacgggcagcaggcgcagcccgggcagggctcggaccccgcccgctggcggcagctgatccagtgggagaacaacgggcaggtgtacagcttgctcaactcgggctcagagtacgtgccggccggacctcagcgctccgagagtagctcccgggtgctgctggccggcgcgccccaggcccagcagcggcgcagccacgggagcccccggcgtcggcaggcgccgtccctgcccctgccggggcgcgtgggctcggacaccgtgcgcggccaggcgcggcacccattcggctttggccaggtgcccgacaactggcgcgaggtggccgtcggggacagcacgggcatggcccgggcccgcacctccgtctcccagcaacggcacgggggctccgcctcctcggtctcggcttcggccttcgccagcacctaccgccagcagccctcctacccgcagcagttcccctacccgcaggcgcccttcgtcagccagtacgagaactacgaccccgcgtcgcggacctacgaccagggtttcgtgtactaccggcccgcgggcggcggcgtgggcgcgggggcggcggccgtggcctcggcgggggtcatctacccctaccagccccgggcgcgctacgaggagtacggcggcggcgaagagctgcccgagtacccgcctcagggcttctacccggcccccgagaggccctacgtgccgccgccgccgccgccccccgacggcctggaccgccgctactcgcacagtctgtacagcgagggcacccccggcttcgagcaggcctaccctgaccccggtcccgaggcggcgcaggcccatggcggagacccacgcctgggctggtacccgccctacgccaacccgccgcccgaggcgtacgggccgccgcgcgcgctggagccgccctacctgccggtgcgcagctccgacacgcccccgccgggtggggagcggaacggcgcgcagcagggccgcctcagcgtgggcagcgtgtaccggcccaaccagaacggccgcggtgagtacggccccggcgcccctccggccgcgcgtacccctggccactggaaactgctccgggccccccgggccc

SEQ ID NO: 1013 - DNA, 9132 bp, Homo sapiens; identical to SEQ ID NO: 1004

SEQ ID NO: 1014 - DNA, 10782 bp, Homo sapiens
cattggaaaatgattaatttatttataattcatttggggatagttggttaatttgctttaaagttatgttcttacctctcaccacacatgaagacaaaatgaagagtttaatataaaaagtgaaatcataaaatctcagaagaacatttaattgaaaatttatatgttcctggtgaaggcagcggttatgcaacaataaagtccaagaccataaagaaaagattaataatctgacagcttaaaaatgaagcatcaagaaagtattttaaaaattgatggaaatgacaaattagttgcataatatgtgacaaagagtgatatatgaaaaggtgctaaatatacatcttataaaccaatactaaaaagatgaacattacaatagaaaatagtcaaagaatatgaacagaaaatttaccattcattcactcaacaaatatttatcgagcacctcttctgtgccagacaagtttacacatgggacacagcagtgaacaagacaaaggacaaaggtccctgccccaaggagcttacattctattggagaggggcaaacaataaacaagtaaattatgaagtattttagacggtgataagtactactggcaaaaaagaaaaagaagggttaagtaaggcgatcaggagtgaggcatggggagctcaggggctggggaggtctcatcaggaaggagacatttgagcaaagctttgaacagattcaggtagttgaccacacagagcaggggaaattgccatggtgcggcggaggggcaggagaaggccaagttggctagaacagaaagagcaagggaccaagtggtgaggaccctggaggccttgaacaggactttggcttttaacctgagaaccattgcagagctttaaggagaagagtgaaattttgacttatgtctcaaaaaggatcattctggctaccatcttgagagcagacttttggggtacaaaggtaggagcaaatagaccatttaggaggtcagcaaacacatggcaacatgttcactctcacgggtaaccaaaaaaatgcaactaaaaaaatgtattcacctgtttttaacctatccaatttttaatgttcttttagaaaacagtactcagtatcagtaagggtgaattaccttcgggcaggtaaatgggaaccacctttctgggaccagctgggtattctgtgccaaagcctcaaaaacactcaaaccctttcaccagaaatccaacttctaataaattaatctaaaggtctaataatcgccagtacttattgagtgcttgtatgcaccaggctctgaactaaacgcgctccatattacccccatttaaattcttaccattattcctgtcttacagaaagaaaaaaggcatggtgagtcacacagttcacaaatgagggctagaaccaaacccaggcactgtgacctgctacacaggagaggcagatatgaagatttcttcaagggtgcttattacagcatcatttataatagcaaataaagtacccaaaaaaatcaacaaaggaggtgattcattcagttatgatttgtccacataagtcagtcattaaaaatctggttaaagaaaactcgtttccgatccagccaggtgctgagacaggcagaactttccagagcttctccttggaagctgccagctgctgtgatgtcctatttcttgatccaggtggtaatccagaggtgtgctcacgttgggatcattcatcaagtggtacacctaggatttgtggacttttgtgtgtgtgtatgctatactcatgtttttaaaagttatttttggccgggcacggtggctcacgcctgtaagcccagcactttgggaggccgaggtgggcagatcatgaggtcaggagatcaagaccatcctggctaacatggtgaaatcctgtctcacctaaaaaaatacaaaaaaattagccgtgcgtgatggcaggtgcctgtagtcccagctacttgggaggctgaggcaggagaatggcatgaacctgggaggcggagcttgcagtgagccgagatcgcaccactgcactccagcctgggagacagagcgagactccgtctcaaaaaaaaaaaaaagttattttaaaaaatttaagttgccaggtgtttctcctcctacagggacacaagaaggctgtggagcaggattcttgggccagggatgaggccctagttatgtagacccaaggctggtagccaccacttgctccacgtggaaatggctctcaagattctgtggtctgagaaagcctggtccttcccatactgcaggaaggaaatgctatgcaggaagcggctggcctcctgggcagatagaaatgaaggtactccccgaccccacaccctaccttcccattccaaccagtgggttgacatttccacctctaagtgaaactggcaatctgactgcaggcccaggatccaggtccagtcctgagggagacaaggtcctaacaggggagggactcaccgctccggaacagagagggtatcttgcggagtgggggacaaagtcttgacctcctcttcatccaggcaggcaggagctcctgtgatcaatatgaatattgaaacggcagttaccttgaaacaaggaaatgttcatcaactgttattacacaaacaaagcagcttgtaaaatgacataggcactatgatcctaattgtttttttaaatgagtgggggggtggagcctaaaacaatggtttttctctaggttacagaatgaattactttttcttttttactctgtattctaaatttcctataattgacctatttcttttgtaatctgagattaaaaattgtattacaaaaaaacttaagggagagattgctgatatctcatctttcatcaccctgtggccctttcctttccagaacccagctgggcaaaactagtctccactggccccaagggcctgctccttctgttacaggaaagggttcccgatccaggccccaagagaggcttcttagatctcacacaagaaagaatatggggcaagtccacagagtaaagtgaaagcaagtttattaagaaagtgaaggaataaatgaatggcgactccataagcagaacagccccaatggctgctggttagctgtcatctatgattatcttttgattgtatattaaagaagggatggattattcatgagttttctgggcaagaggtagggagttcccagaactgagagttccccttccttttagctcacatagggtaacttccggatgttgccacagcatttgtaaactgtcatgcactggtgggagtgtcttttagcatgctaatgtgatatgatagtgtacaatggggagtgaggacaaccagaggtcatgatcatcaccatcttggtttgggctggcttttttttttttgagacaagagtttcactcttgttgcccaggctggagtacaatgacgtgatctcggctcactgcaacctctgcctcctgggttcaagtgattctcctgcctcagcctcccgagtagctgggattacaggtgcgcaccaccacgcctggctaattttttgtatttctagtagagacagggttttaccatggccaggctggtcttgaactcctgagctctggtgatctgcccgtctcggcctcccacagtgctgggattataggtatgagccaccatgcccagccatctggctttttttttttttaattgcattctgttttatcagtggagtgcttgtgacctgtatcttgggcctcctgtctcatcctgtgactaccaaggcctagcctcctgggaatgcagcccagtaagtctcaggctcattttacccagtccccattcaagatggagcccctctggttggaatacctctgtcacttccatcaccacatccagtctcaccccacaccacctccccttctccagctccactaccaacccccaccagggggaaatgagtaaactgcatgagctctgagaaagcagaaaaaaagccacctcatgaaggtgaaccaaggactgagtcgctgacagacagagatggatgggtaaatgggcagacagacagacagacatggagactgaaatagaaatgcctcccaaaggtcacagagagtcagtgccacgtcttcacctccacccaggactatcacttatacacccccaccagcctgggcacccactggaaacttggcaggtctggctgctctctgtgatgactgcagtcagcacagggcctggtattccacagatacccagggaacatgctgagtgagtgagtgagtggatgaatgaaggaatcgttcattggtagaagcatcagcagatagagatgacaggagggagtgtgaaagagagttgaggaagaacagaaacagatggagacagatggaggctgcaagtcacagacttggccacagatagaaaatgaacgaataaggtggagggaggttactgcagaaaatttaaaagctatagaaagccggtcgtggtcatgtgcacctgtagtcccagaggctgaggcaggaggatggcttgagcccaggagttcaaggctgctgtgaatccactgcactccagcctggggaacatagcaagactatgcttttttaaaaaaaacaaaaacaaacaaagaaaaagctagagaaacccagagagatcccagtgaaagttaaatttacagacaaaaagaaaaggagagagagagcacaagccctcccttaacttgtcaggatgttagcagagagaaccaggggttcctgccttagtttccctcctagatttgcaggtctctgctggactgtgtcccaagggcctggcgccctgcttggttttgtcagttctctccctcgggcaggggacagtttcctcttacccccacagcatgccagctcagggccctcccacccagaaggccccagacaactatgcagaatccccccgccaaggcaggtccctgggagaagatctctctccccagctggtcctcattcctgcaatgacaatcggctcctgtctccactggctctgggctcagggcccccgggttggataggggttggggctggaagtggaggtagagacaggagcctgcttgccccagactctggggaggggtgaaagtcagagaggggagaagctctaaggggctgaggcggcttcccgcctccacagagcccaacctgaatgcccagagtactgtatcagcttggttatttccaaatcccctgggagccgtaggggaggggacccagagagctgggaggaaaaccgactgggaagtagccagagccacagaattctcctgggtcctagagaagggtgggttccttccacccccaaccccattagtccctcgaaaaggctctgacctcacctcccccacttccggagtggagttccagccctgaagaaacacttccaaacccatggctctggccccctcctcaggccccctcctcggctacctcggccctggggactgggtcccccaccccaccgttgcgccagatgtggctgcaggggaggggtaggcacggggcccagctggcagtggtcactcggtggtcctctccctgcagagtcagcactttctgtgccagctcgcccagcctcctcactcagcacttcctccagcccgctttccagaggcagcagctgcctgggttgggtcttggattcccagtgctgccccaaacccatctacagcgcagcctggaagatggagggtttgggtgctctggggccttccctcttggcatccccactatcacagaaaattccgacccaccatgggcctcctagtacgtccctctgcaaagcaagggaggaatcccacagctcctgacccctctctgctccccagacccgctgctggtcaggcctgctgcttcctggttcccccatggactttccagaactcagccttccatgacagggtcacaggaccctggctgctccgtgggagccccggcaacacagagctgagcacgtggcaggggcttaataaagtcatgcgcaatcaacaggctctttcatccttctatcaccacccctccgagggtcccttgacaccggttcctagtgccaggaactggcaacaagcttcaagcacatgcctgggtcttaaaaatgtgggtgtgaatcccagcctgcagggacaggcggagagagaagctgcccttcaccccagacagctctggctcagctcagccttcgagtccacgccctcatttgaccccagctctgcaccctccataacctgcccaggtctcttttaggaccccaccctgcaggtttcaacctaaggatgccaggacacctccagccaccaaggcaaggccttgcccagcatgaggagaggtgatggaaggcaggctcccctgggctcacagaactgctgggcctgtcagccactgcaggagacctaaacccaagtagaatgaggtcagaaggagggagtagagaggaagggagaggacagctctggtggaggggccacctctggcccccctgcacaaggttcaccctgagcaaggaaagatgctgaagacagataaaaacaggaaagacagaggaagtgggagtgggggtcaaccccaagagataaatccctcccttctctcacaagtcaagaggaaagaaggaaaatagtggccacatgtctggctctgtgctggggacttttcataatcctctcattccatcctctcaaatatgccacaagaaaggtatgattacccccaggtcacagacgggactctgaagctctgagagcttaaaaagcttccccggggagtggctgggccaggccaggtccctagctcaagtcatggtgtggacccccaggtctccatctcagcagggatggctggcaggagcgcagtcctggccaggggagtctgtgcagaggcccaggctatgttcagagcagagtttattcaaatagagcctaacaggaaacttggctcctctgactcactctgattcgaccttattaagaaaaaaagagagaggagcaggagccagcatcgggtaaggtttcacgccaagagctggctctgaggcccgctgagtggaatggcatgtgccctgatccccccacatccaaagccttgaggcagcccctgccctgctgtccgagtcaaggcgaggggtcctgccttcacgttagggcaactgagttcccttcctcacagccatcctctgtcctccctccactcctcttcccttccctccctgcctaggggtaccctgaggcctgtttccatttctccccctcctctgctgcagcagctgcccatctggctggcgggagggccctacaggaccccagggattccaagcagctgaggccaacactgcagggggcaagcaggagggagggaaggcttaaccctccaggtcccggccctcagtaagccctgcctcagcatcttgcttggtgtcagtcacaccagtggctctttggaggaatcttgtctggagtctgagatggaaaccccatgctggggagctgaggtgtcagcgttgacaagttgctggccaggaggtattggaagccccctacctctgggctggattctgggcatttaaagggtagagacatgctggagtccaagcctcagtcctgaagaacagtgcaatgggtgaacaaatgctgcctggcaaggatggggttgggaggtctatagttcccaaagaatgtccactctagttgcctcctctctaggtgggctccaggcatttccaaaataaagaatatacaggagccaaattaaggacaggtccttcataccttgtttataagcccaagagggcaatttctgcccttcggttcccaggaacacggttggagaaggcagcccaggggaggccagaagagcagtatttggagtgtgatttcttggatgccaaagcgttcaaacttctgggaccccctcctatccctgccattcccagaaggaacagagaatctcccaaagcactctcaggagccatctggcctaatcttccattggtaagccgtggcacctggatcagatagagtaagggactaagccacacagcaacaggaccaggccaggtctccggaacccccttctgttgttcaatgcttactggcttctctgcctcacagtgacccctgtcccatatcaaagacagcccccagtttcattttatccatgtgtacactcaagttattcccaggctatgcagagccaagagatgtaggacagaaaccatacgtgatgtctgggaagttgatctctcccaggatctcacaagtgcttttcagctcagggatacaccccactcttcagactgggaaagtaagcccctgaggtgtgccacgagggaaaaggtgcagctccagtgcctctcttcgcaggcccaagagctgcggtgcacctgggacctggaattagagagtggtccctgttcagcatctccccgaggaggcccaccaacaaagagggtgtgtcttttttttttttttcttcctattgagggtgtgggataatggtggaaggaacatgcaaagagggtgtgtcttaattagcactggctttagggaacaaggaaaagggagaacccgggagtacgggaaggaggctggggcagacaggagtcagaggcccattccagcccaaacgagaagccagtgagcaaggtggagaccagggatgctgtgaccaaagcagagaggaatgggcggggtggtgctgacaccccagccccgttctgcctgccagagccccacttaccaggcccgagtccccagaggtcccctcctactccctgctcgattcccttcctcagaggcaggtctgtggcttggctgggaactccagggactgagggagcactgcagctgtgggaccggcgcatagctaaaagccggcgggccatagggccccgcggaggaggccccagcaggcggaccaggaggccgaagcctcccgacgctcccagcctgttgcttattcattcagagtgggaaagcgccagccgagcggccagccagtgcggggctggccatgtaaggcccacaggcggtcctgcccgcccggtgccctgcggagagcctcgtgcagccctgggcaccgcccctgccctgccctgaccccttggccttgaaatgctgtcatcggaggagccgtcccgctcgggacaaggccagcatggacaaagctagagctggggcaagcaaggagccttcctgtcctcgaggccgtgggaagagaagcacgcccagggggccactcctgagagcctctctgtccaccaggcctctgcagaggggtcaccatggctctggcccgaggcagccggcagctgggggccctggtgtggggcgcctgcctgtgcgtgctggtgcacgggcagcaggcgcagcccgggcagggctcggaccccgcccgctggcggcagctgatccagtgggagaacaacgggcaggtgtacagcttgctcaactcgggctcagagtacgtgccggccggacctcagcgctccgagagtagctcccgggtgctgctggccggcgcgccccaggcccagcagcggcgcagccacgggagcccccggcgtcggcaggcgccgtccctgcccctgccggggcgcgtgggctcggacaccgtgcgcggccaggcgcggcacccattcggctttggccaggtgcccgacaactggcgcgaggtggccgtcggggacagcacgggcatggcccgggcccgcacctccgtctcccagcaacggcacgggggctccgcctcctcggtctcggcttcggccttcgccagcacctaccgccagcagccctcctacccgcagcagttcccctacccgcaggcgcccttcgtcagccagtacgagaactacgaccccgcgtcgcggacctacgaccagggtttcgtgtactaccggcccgcgggcggcggcgtgggcgcgggggcggcggccgtggcctcggcgggggtcatctacccctaccagccccgggcgcgctacgaggagtacggcggcggcgaagagctgcccgagtacccgcctcagggcttctacccggcccccgagaggccctacgtgccgccgccgccgccgccccccgacggcctggaccgccgctactcgcacagtctgtacagcgagggcacccccggcttcgagcaggcctaccctgaccccggtcccgaggcggcgcaggcccatggcggagacccacgcctgggctggtacccgccctacgccaacccgccgcccgaggcgtacgggccgccgcgcgcgctggagccgccctacctgccggtgcgcagctccgacacgcccccgccgggtggggagcggaacggcgcgcagcagggccgcctcagcgtgggcagcgtgtaccggcccaaccagaacggccgcggtgagtacggccccggcgcccctccggccgcgcgtacccctggccactggaaactgctccgggccccccgggcccctccttagaacttcctggaggcctccccggagctgctaagcacggagcagcgccccctcccgacttcccccgacccagccaacagcacccccctggcatctcacctcccagcttaacccgcacccaggcatcatcagtgccaggggttggccaggcaggtgtgggctctgatcctggctttggtggagggactagccgagctttgggaggaggctcgccttctgcacttggcttgggtcatctgaggacaaaaggaaggagcccctcatccaccttctccctcatttc

SEQ ID NO: 1015 - DNA, 10782 bp, Homo sapiens; identical to SEQ ID NO: 1014

SEQ ID NO: 1016 - DNA, 10320 bp, Homo sapiens; identical to SEQ ID NO: 1008

SEQ ID NO: 1017 - DNA, 6402 bp, Homo sapiens
cagctcagcgggtcccgctcgaagtctgtcggtgccaccgcctgcatttgcaaaaagagtttaaaggcaaagacacgccttccccccccacttcagccgcgcgcctttccttcccccaaattcctcaaagatggtttgtctcacgtgttgcagggcgtaaaagcggcttgcattcaattagcagcgaagctcgcgggcgctggcgggacaggcgcgtgagggtgagttcgcgtgaatgtgtgtatgcgtgtgcgagaggagaacggtaagtgtcccgggtgcaggtgtgcccgtgaaaatgcgtgtgaatgtagcaggggctgaacacattgatgcgattattacctgaccatggatgattgtaaactgtgaaggtcggctatggggagggtgtgagggactgtgtgcgcgaatgtgtttgaacgtggggtgggggaggtggtgtgatcagggacagtaacaatgccagcggctgtgtaaatgtgggggtacgtgggttatgggggtgcagtaggctgcgaagagcccagccaggacagtgggcgtgggatgccccttatgaccgacgtgtcttggccttggggagggtctccgtggctttaacaaaagtagaccaagcaggaggcgggagaggctatgcgcgtccccgccaggcccgggagtgcgcaaggactttctccaacctgcagccagagaggtgggggaaacggacgcaaaaggaaaaattgaagtggtactttggggccaccaagtccccaaacttacctgtccctttctttgccccccgccccccgttttccccacagccacaacacatgcgtgtatcttgcttgggctatcttccctgctctgccacgccgggtctggagaaggggtttcagccccaggacatttactgagagtcggcgaatattgggtaagcaatgggggccaccccacaaccttgacccaggtggggttaggtccagcctagggcacctgatggggtgcggggctggtgggggtgctgtctggcaggaaccgggaagggagggaagggaccctcccagaagagcaaaggcagagtgaaggagcaggttcccaaagacaagttgtgggaggggctctgccaaacctgacaggcgctccaaatgggggcagggagtctgtgcaagttcgtttgtgtgaccgggcttaaggtgttatggggagggggtccttaggcaccgcagagctgtggagaaaggcgcagaatctttcatcttctccagcttcattagctagtggcagccccatgacctgttggctgaggacgcctctgcccaatgggagccgcctgagggacctgagaggaagctctagtgaccgctttcccaacacacctggtccaaacatgggggagaacctccttccccgtaaggaaggttggcagagcagcccttcttctcccctcacaggagctgcagccccgggcaggtgactttggccttagatgcagtagggcatggggatgggcttccccagatcccacatctcaagtcgtgcagtgcaggtcctcctattgcttctctgctgggtttcggtcacagtggagggctgtatgcacacacaggcacatgcctgtgttcttgtgggtgggtcggttcgtgtgaggacttgtgtccttgtgtctgtcaattgtcacaatggacaggaaagcgctttgtaccgtggtggaaaacacgtacaaatgctggttaagagaacaatgaggtctgcagggtctattgtgtccatgtctgggtgcatatgtgtttgtgagtttaggaaatgtgttgtgagcctcctaattgagcatcaggtcctctaaacccctgcagaagttggcggtttgattatgaagccccgcgtctgtttgtattgttgtgtgcctgcatgggcgtgtgtgcgagtgctgtgcgtgggacaaaggttccagggaggacagccagtcacggacaaaaatgtccttcttgggtaggatccatttcaccaggttaaacgaaggcttagaaacacagagaggggtacgtgaggagcccgctggagatgggcgagctgcggagcccacggaggggccagctccagcgtgaaggaaggagtaggaagagaaaaaagggcgatataccgggccgctggaaaaggaaattagggccctgggagggagcatccgttgaacctcgagatttttattgaccttcacttcagagaggctcctggccatagaggaggttaccggagccctggaactagtgctaaacgggcttgcggaggcacagcttgataggggaggtaagctggggttcagtgagtcaccttctttcttcttcacctggcttccatctgcaggagccgcgatgttcccccttcgggccctgtggttggtctgggcgcttctaggagtggccggatcatgcccggagccgtgcgcctgcgtggacaagtacgctcaccagttcgcggactgcgcttacaaagagttgcgtgaggtgccggaaggactgcctgccaacgtgacgacgcttagtctgtccgcgaacaagatcactgtgctgcggcgcggggccttcgccgacgtcacacaggtcacgtcgctgtggctggcgcacaatgaggtgcgcaccgtggagccaggcgcactggccgtgctgagtcagctcaagaacctcgatctgagccacaacttcatatccagctttccgtggagcgacctgcgcaacctgagcgcgctgcagctgctcaaaatgaaccacaaccgcctgggctctctgccccgggacgcactcggtgcgctacccgacctgcgttccctgcgcatcaacaacaaccggctgcgtacgctggcgcctggcaccttcgacgcgcttagcgcgctgtcacacttgcaactctatcacaatcccttccactgcggctgcggccttgtgtggctgcaggcctgggccgcgagcacccgggtgtccttacccgagcccgactccattgcttgtgcctcgcctcccgcgctgcagggggtgccggtgtaccgcctgcccgccctgccctgtgcaccgcccagcgtgcatctgagtgccgagccaccgcttgaagcacccggcaccccactgcgcgcaggactggcgttcgtgttacactgcatcgccgacggccaccctacgcctcgcctgcaatggcaacttcagatccccggtggcaccgtagtcttagagccaccggttctgagcggggaggacgacggggttggggcggaggaaggagagggagaaggagatggggatttgctgacgcagacccaagcccaaacgccgactccagcacccgcttggccggcgcccccagccacaccgcgcttcctggccctcgcaaatggctccctgttggtgcccctcctgagtgccaaggaggcgggcgtctacacttgccgtgcacacaatgagctgggcgccaactctacgtcaatacgcgtggcggtggcagcaaccgggcccccaaaacacgcgcctggcgccgggggagaacccgacggacaggccccgacctctgagcgcaagtccacagccaagggccggggcaacagcgtcctgccttccaaacccgagggcaaaatcaaaggccaaggcctggccaaggtcagcattctcggggagaccgagacggagccggaggaggacacaagtgagggagaggaggccgaagaccagatcctcgcggacccggcggaggagcagcgctgtggcaacggggacccctctcggtacgtttctaaccacgcgttcaaccagagcgcagagctcaagccgcacgtcttcgagctgggcgtcatcgcgctggatgtggcggagcgcgaggcgcgggtgcagctgactccgctggctgcgcgctggggccctgggcccggcggggctggcggagccccgcgacccgggcggcgacccctgcgcctactctatctgtgtccagcggggggcggcgcggcagtgcagtggtcccgcgtagaggaaggcgtcaacgcctactggttccgcggcctgcggccgggtaccaactactccgtgtgcctggcgctggcgggcgaagcctgccacgtgcaagtggtgttttccaccaagaaggagctcccatcgctgctggtcatagtggcagtgagcgtattcctcctggtgctggccacagtgccccttctgggcgccgcctgctgccatctgctggctaaacacccgggcaagccctaccgtctgatcctgcggcctcaggcccctgaccctatggagaagcgcatcgccgcagacttcgacccgcgtgcttcgtacctcgagtccgagaaaagctacccggcaggcggcgaggcgggcggcgaggagccagaggacgtgcagggggagggccttgatgaagacgcggagcagggagacccaagtggggacctgcagagagaggagagcctggcggcctgctcactggtggagtcccagtccaaggccaaccaagaggagttcgaggcgggctctgagtacagcgatcggctgcccctgggcgccgaggcggtcaacatcgcccaggagattaatggcaactacaggcagacggcaggctgaacctccgcccgtccggcccgcccattcccgacctccacctagggtgcctgggagcagcagtctagggctggcaggacttatgtcccccgtccccaaccttcacctactcctcccccttactactccccaaccttgactaccagggacttctattagggagtgggccgatttcaccagtccctgctacccacggctgccattctccctgcgggctgaatccccttccccgccaagcacagtgtttatcttaccccatgcaagactccacccgcagacggtgggcgatatctatgtccctccattcccgtcgcgattatctgcgaaatccaccccgcagcccgccccaccgtgggctctggagccagaggaaacgagcgaagactttggaaacctcgcggtaacgcggtggtttcgggggccagccaaggccagtggagtgctgtggggtcccacctcgacccctcctcctccctttctttctttcctttttttttattttttaattttatttatttatttatttattttttgacggagtcttggtctgtcgccaggctggagtgcagtggcgcgatctcggctcactgcatcttccgcctcccgggttcaagcgattctcctgcctcagcctgcctagtagctgggactacaggcgcgcgccaccacgaccagctaatttcttctatttttagtagagacggggtttcaccatgttggccaggatggtctggatctcttgacctcaggtgatccatctgcctcggcctctcaaagtgctgggattacaggcgtgaggcaccgcgcccggcccctcctccctttcaatccctactcccagaagccgggattcgtggcaacccctagtttttagttccaaagcctcctgccggcagggaaccaaatccttctgtcctcccacccccaccccacttctggccagttggagtccagcccggtgcctggggcgcctttcagctccgcgctcagattttcctgttttcgttgttttcaaagacagcgacatttcgggtctggtgctaacacccccttcccagcctctgggaaaatcgagtgtgtgtgtcggggggtagggagggaatgcgttttctgtcgtctctctcctaacttaaagcgccgcaggaccgcgcgccccttggcggctgagcctgtggacttggtcgcgggccaatttcgttgtccgtgtgttgggctttccggaggtctgtgcgcccaacagcgccgctcccgcggctccacccgacccagaccctagctggaaagcgccggaggcggaggaagctgactgtggcctcccgggccgcggctctctggagggctcgcgccctagttcgcacaaagcctgctcgtgactgtgcgactgtgcgacgggatccggatggagccgagcccctccgtcctcgcgtctcggtcctcgcgtcgccccgccccacccgcccctgcttcggcgggaatcgtgtttgcccggcgtgtagtccctgacaagcgtgccctgtaggagaaaagtctgtgtcctgtgaagtgtgaccgtgtagtgtaggggggcgggcgggggggcggatgggcggggagggagggaaggggaggggcgcggcgcggcgactcggggcggggttcttttttccattttgaaagaaagcgtcggggttggggtggggggagtttcagtcctcgggatcagccctctccgcgaagcgcagcacaagcgcgggcctgggacggagtagccccccggagcccgtgcccttttctaaacgcgtctgtatgcagtcaataaaacaatcgatttgaa

SEQ ID NO: 1018 - DNA, 2907 bp, Homo sapiens
tgagacagagtctcgctctgtcgcccaggccggaatgcagtggcactatctcggctcactgcaacctctgcctcccgagattctcctgcctcagcctcctgagtagctgggattacaggcatgcaccaccacgcccggctaatttttgtatttttagcagagacgaggtttcaccatgttggtcaggctggtctcgaactcctgaccttgtgatccgcccgcctgggcctcccaaagtgctgggattattacaggtgtgagccaccgcgcctggtcagtactcttatttatgcctttttttcttgaggcacagagaggttaaatagcttggctaaggacacacagtcagtacataatggagtctgacgctaggacctgcccgcctgacgactacatagaacctgtacaaggaaaggccggaggagggagtataaacagggcctggcttccctgaggagtgatctttcgactggaaattagaaaaggaaagcagcttcttgagggtgtggggctggagagaacatttgtgtgtgtgtgtgtgtgtgtgtgtgtgtgtgtgtgtgtgtgtgtgtgtgtgtgtgtctgtgcgcgcagaagctgaaagatgggaagtagtgagtgttcaggggcttctgactggagggcagccttggggaaggtctccgcagccttaaccggctgctatgctggggatgtttgatgcccatctgggccccggctttcttattctcagaggcccttcccacatctttaggcaagtccattaaatcctccgcgtgccacattaaaatacaagggcaagtacaactctgagtgcagttgcaacagaatcgtttgcacaatgtcgcatgtcttaaacattcaatcaaacatcgattacttccaattttgcagttttctttgcccctgttagcgccaacagatttttttttccagatctcagacatttattttaataggcccctgacaaagtcataagactcagagagaagggagagtgggagaggtgtataggaaggttttgtgccagggactagtcgctcaagaattaggagacgccctgggcactggaaactacgcagcgcgaagtagggacagcgcctgtgttgtgtagtggaccagaggttgctgatacctgggacatagactgggtgggcacgggaagtaaagcctcgggactttggttaagcgcgccccactggcgtatcgcgccgcgggactgcagagccgtgagcagcggtcgccttggtgcagggttccagccacatcttcctcgcccagccagcaccctctgccgttgacccgcctctgcgcccggcaagcggcttccagcagggggcgcgcgcggaccaggcttgggccctagaacagcgcggatggagtcgctggagcaagtccccagatccaaccggtttcaaccctccccaccctcccgacgctccgggttcgcgacgttgaagttaagggtcgatccgcagaaagcggccaggggctccagctctccattcctgggtctgtctggggtcggctccagcctggttagaagccttagtctggattcggcagattctgaatctgggaccctctgcgctagcggcttggaaccttgtcaccctcccctcccccacccctacttccacacacctgattagttgtctgtttctttaatgatcaaagacgtgggcggcggcgggatgaggtcttggttcccggctccacagccctccctaactgtcattattaacgttataaacattagacccgcttctgcgcgccggacggcgccggacgaggtgcgcgcagtcttctagctgagctcggaggcagatccagaagtcgcggctcccaccccaggcctcggcggactctgcctggggcgactcgggctccagccctgcccgggcgggcactgggctctccagggtcgaaggcaggggtaaggggcgtctttcccccagggcagcctccgggaacaaaagcatttgctgtagagtgagctagagcctccgggcccgcgggagtcagctcccgcccaggggtggtcaccgcgtccttaaccaccccaggagccccgtctccctgccgaactccttggcttctgcaaccctgtcaagacagcaaggaaagggggtcttccctggtcctcgggccccgaagtttcggggttgcttataggacgggttcctgcagtccagggaagctctgggcagatagcgagcccattctcccttccattacccagattctgcctccctgcggaaggcaaaaaagaaagaaagaaaataggtaaaaaccggcggagggccttgagcctccccgcctggcgcccctcactcagtcccgaaaagtcccctggacacgccatgccggaccggactcagctcccgctgctgggcccctgcctccaaatatccttcccaggcacaggctcccaagaccgccccctcagggttcccaacacccggacaactgcccaagacgccgctccccgcccccacccccaccttgttcggcagacaaagaagggtgtgctggccccgccgtctgcctccttctcccgaccccacaaggcctagaaacctcagggactcaccccgggctagggacccaatcctggctgtcccaccacaggatccccggcagggacgggtcacagtgctctcacccctcgaccattttcgaagacaccttccctgaaaggcgccttgcgccctccccatgggtcggcggggggggactccaggcccgagcaggcggtgtgaagttctgtgttctgaactggggctgagcaagatgcgatggtctcagcccgctgggccgcccgtagcgacggcaggagtaggggagagggagggacgcttggagtgtgagcgcaccagtctgttcatatttaatttacaaagcagc

SEQ ID NO: 1019 - DNA, 6555 bp, Homo sapiens
tatatcagcccagatccaggcaaaaatggtagggagggtgcggcgctctgctaacactatcaattatgcatcatgttgaacgtggcttcggggaggaggcggctagcagcggggggtgcgggagggaagggtccgcgcgagctcggctgcgcgcagctcagcgggtcccgctcgaagtctgtcggtgccaccgcctgcatttgcaaaaagagtttaaaggcaaagacacgccttccccccccacttcagccgcgcgcctttccttcccccaaattcctcaaagatggtttgtctcacgtgttgcagggcgtaaaagcggcttgcattcaattagcagcgaagctcgcgggcgctggcgggacaggcgcgtgagggtgagttcgcgtgaatgtgtgtatgcgtgtgcgagaggagaacggtaagtgtcccgggtgcaggtgtgcccgtgaaaatgcgtgtgaatgtagcaggggctgaacacattgatgcgattattacctgaccatggatgattgtaaactgtgaaggtcggctatggggagggtgtgagggactgtgtgcgcgaatgtgtttgaacgtggggtgggggaggtggtgtgatcagggacagtaacaatgccagcggctgtgtaaatgtgggggtacgtgggttatgggggtgcagtaggctgcgaagagcccagccaggacagtgggcgtgggatgccccttatgaccgacgtgtcttggccttggggagggtctccgtggctttaacaaaagtagaccaagcaggaggcgggagaggctatgcgcgtccccgccaggcccgggagtgcgcaaggactttctccaacctgcagccagagaggtgggggaaacggacgcaaaaggaaaaattgaagtggtactttggggccaccaagtccccaaacttacctgtccctttctttgccccccgccccccgttttccccacagccacaacacatgcgtgtatcttgcttgggctatcttccctgctctgccacgccgggtctggagaaggggtttcagccccaggacatttactgagagtcggcgaatattgggtaagcaatgggggccaccccacaaccttgacccaggtggggttaggtccagcctagggcacctgatggggtgcggggctggtgggggtgctgtctggcaggaaccgggaagggagggaagggaccctcccagaagagcaaaggcagagtgaaggagcaggttcccaaagacaagttgtgggaggggctctgccaaacctgacaggcgctccaaatgggggcagggagtctgtgcaagttcgtttgtgtgaccgggcttaaggtgttatggggagggggtccttaggcaccgcagagctgtggagaaaggcgcagaatctttcatcttctccagcttcattagctagtggcagccccatgacctgttggctgaggacgcctctgcccaatgggagccgcctgagggacctgagaggaagctctagtgaccgctttcccaacacacctggtccaaacatgggggagaacctccttccccgtaaggaaggttggcagagcagcccttcttctcccctcacaggagctgcagccccgggcaggtgactttggccttagatgcagtagggcatggggatgggcttccccagatcccacatctcaagtcgtgcagtgcaggtcctcctattgcttctctgctgggtttcggtcacagtggagggctgtatgcacacacaggcacatgcctgtgttcttgtgggtgggtcggttcgtgtgaggacttgtgtccttgtgtctgtcaattgtcacaatggacaggaaagcgctttgtaccgtggtggaaaacacgtacaaatgctggttaagagaacaatgaggtctgcagggtctattgtgtccatgtctgggtgcatatgtgtttgtgagtttaggaaatgtgttgtgagcctcctaattgagcatcaggtcctctaaacccctgcagaagttggcggtttgattatgaagccccgcgtctgtttgtattgttgtgtgcctgcatgggcgtgtgtgcgagtgctgtgcgtgggacaaaggttccagggaggacagccagtcacggacaaaaatgtccttcttgggtaggatccatttcaccaggttaaacgaaggcttagaaacacagagaggggtacgtgaggagcccgctggagatgggcgagctgcggagcccacggaggggccagctccagcgtgaaggaaggagtaggaagagaaaaaagggcgatataccgggccgctggaaaaggaaattagggccctgggagggagcatccgttgaacctcgagatttttattgaccttcacttcagagaggctcctggccatagaggaggttaccggagccctggaactagtgctaaacgggcttgcggaggcacagcttgataggggaggtaagctggggttcagtgagtcaccttctttcttcttcacctggcttccatctgcaggagccgcgatgttcccccttcgggccctgtggttggtctgggcgcttctaggagtggccggatcatgcccggagccgtgcgcctgcgtggacaagtacgctcaccagttcgcggactgcgcttacaaagagttgcgtgaggtgccggaaggactgcctgccaacgtgacgacgcttagtctgtccgcgaacaagatcactgtgctgcggcgcggggccttcgccgacgtcacacaggtcacgtcgctgtggctggcgcacaatgaggtgcgcaccgtggagccaggcgcactggccgtgctgagtcagctcaagaacctcgatctgagccacaacttcatatccagctttccgtggagcgacctgcgcaacctgagcgcgctgcagctgctcaaaatgaaccacaaccgcctgggctctctgccccgggacgcactcggtgcgctacccgacctgcgttccctgcgcatcaacaacaaccggctgcgtacgctggcgcctggcaccttcgacgcgcttagcgcgctgtcacacttgcaactctatcacaatcccttccactgcggctgcggccttgtgtggctgcaggcctgggccgcgagcacccgggtgtccttacccgagcccgactccattgcttgtgcctcgcctcccgcgctgcagggggtgccggtgtaccgcctgcccgccctgccctgtgcaccgcccagcgtgcatctgagtgccgagccaccgcttgaagcacccggcaccccactgcgcgcaggactggcgttcgtgttacactgcatcgccgacggccaccctacgcctcgcctgcaatggcaacttcagatccccggtggcaccgtagtcttagagccaccggttctgagcggggaggacgacggggttggggcggaggaaggagagggagaaggagatggggatttgctgacgcagacccaagcccaaacgccgactccagcacccgcttggccggcgcccccagccacaccgcgcttcctggccctcgcaaatggctccctgttggtgcccctcctgagtgccaaggaggcgggcgtctacacttgccgtgcacacaatgagctgggcgccaactctacgtcaatacgcgtggcggtggcagcaaccgggcccccaaaacacgcgcctggcgccgggggagaacccgacggacaggccccgacctctgagcgcaagtccacagccaagggccggggcaacagcgtcctgccttccaaacccgagggcaaaatcaaaggccaaggcctggccaaggtcagcattctcggggagaccgagacggagccggaggaggacacaagtgagggagaggaggccgaagaccagatcctcgcggacccggcggaggagcagcgctgtggcaacggggacccctctcggtacgtttctaaccacgcgttcaaccagagcgcagagctcaagccgcacgtcttcgagctgggcgtcatcgcgctggatgtggcggagcgcgaggcgcgggtgcagctgactccgctggctgcgcgctggggccctgggcccggcggggctggcggagccccgcgacccgggcggcgacccctgcgcctactctatctgtgtccagcggggggcggcgcggcagtgcagtggtcccgcgtagaggaaggcgtcaacgcctactggttccgcggcctgcggccgggtaccaactactccgtgtgcctggcgctggcgggcgaagcctgccacgtgcaagtggtgttttccaccaagaaggagctcccatcgctgctggtcatagtggcagtgagcgtattcctcctggtgctggccacagtgccccttctgggcgccgcctgctgccatctgctggctaaacacccgggcaagccctaccgtctgatcctgcggcctcaggcccctgaccctatggagaagcgcatcgccgcagacttcgacccgcgtgcttcgtacctcgagtccgagaaaagctacccggcaggcggcgaggcgggcggcgaggagccagaggacgtgcagggggagggccttgatgaagacgcggagcagggagacccaagtggggacctgcagagagaggagagcctggcggcctgctcactggtggagtcccagtccaaggccaaccaagaggagttcgaggcgggctctgagtacagcgatcggctgcccctgggcgccgaggcggtcaacatcgcccaggagattaatggcaactacaggcagacggcaggctgaacctccgcccgtccggcccgcccattcccgacctccacctagggtgcctgggagcagcagtctagggctggcaggacttatgtcccccgtccccaaccttcacctactcctcccccttactactccccaaccttgactaccagggacttctattagggagtgggccgatttcaccagtccctgctacccacggctgccattctccctgcgggctgaatccccttccccgccaagcacagtgtttatcttaccccatgcaagactccacccgcagacggtgggcgatatctatgtccctccattcccgtcgcgattatctgcgaaatccaccccgcagcccgccccaccgtgggctctggagccagaggaaacgagcgaagactttggaaacctcgcggtaacgcggtggtttcgggggccagccaaggccagtggagtgctgtggggtcccacctcgacccctcctcctccctttctttctttcctttttttttattttttaattttatttatttatttatttattttttgacggagtcttggtctgtcgccaggctggagtgcagtggcgcgatctcggctcactgcatcttccgcctcccgggttcaagcgattctcctgcctcagcctgcctagtagctgggactacaggcgcgcgccaccacgaccagctaatttcttctatttttagtagagacggggtttcaccatgttggccaggatggtctggatctcttgacctcaggtgatccatctgcctcggcctctcaaagtgctgggattacaggcgtgaggcaccgcgcccggcccctcctccctttcaatccctactcccagaagccgggattcgtggcaacccctagtttttagttccaaagcctcctgccggcagggaaccaaatccttctgtcctcccacccccaccccacttctggccagttggagtccagcccggtgcctggggcgcctttcagctccgcgctcagattttcctgttttcgttgttttcaaagacagcgacatttcgggtctggtgctaacacccccttcccagcctctgggaaaatcgagtgtgtgtgtcggggggtagggagggaatgcgttttctgtcgtctctctcctaacttaaagcgccgcaggaccgcgcgccccttggcggctgagcctgtggacttggtcgcgggccaatttcgttgtccgtgtgttgggctttccggaggtctgtgcgcccaacagcgccgctcccgcggctccacccgacccagaccctagctggaaagcgccggaggcggaggaagctgactgtggcctcccgggccgcggctctctggagggctcgcgccctagttcgcacaaagcctgctcgtgactgtgcgactgtgcgacgggatccggatggagccgagcccctccgtcctcgcgtctcggtcctcgcgtcgccccgccccacccgcccctgcttcggcgggaatcgtgtttgcccggcgtgtagtccctgacaagcgtgccctgtaggagaaaagtctgtgtcctgtgaagtgtgaccgtgtagtgtaggggggcgggcgggggggcggatgggcggggagggagggaaggggaggggcgcggcgcggcgactcggggcggggttcttttttccattttgaaagaaagcgtcggggttggggtggggggagtttcagtcctcgggatcagccctctccgcgaagcgcagcacaagcgcgggcctgggacggagtagccccccggagcccgtgcccttttctaaacgcgtctgtatgcagtcaataaaacaatcgatttgaa

SEQ ID NO: 1020 - DNA, 7149 bp, Homo sapiens
tgtcggggtttcatcagagctagggagcgacagtcgggaacagcgagtctgccgaagccggctgttgtgtgagggtgtgagacggcggggcggtgaggggccaccgcggcttgggggatagtgcgtgtggggttgaccgtgtgtctgcttgagaggctgtgaagatatggggggcagatatgggagaaatgctcgggcctgaagtccccagcccaccgtgctcaagagtagcggacgttttgccaccatccttgtctgtgctactgtctgctgcagcttccgtgccccgttctcctggagcaggcaagacctggagtgaggtgcttgggtgcgctcgagagagcttccccctgctccacctgtcccgcggtgcgcgcaggccaacgcgtcgggcagtgggcttcaagcgctggtttagccacaaaagaccagaagtaaagagttccggcttaagaggctgggcagggctgcggtgggctggggaggggggtgtcccttcccagcacgccctgcagggctgtgcgttctggtgtcgggttagactagcaggcggggcgggggggttggggcggcggggcgggggagactagggcttatatcagcccagatccaggcaaaaatggtagggagggtgcggcgctctgctaacactatcaattatgcatcatgttgaacgtggcttcggggaggaggcggctagcagcggggggtgcgggagggaagggtccgcgcgagctcggctgcgcgcagctcagcgggtcccgctcgaagtctgtcggtgccaccgcctgcatttgcaaaaagagtttaaaggcaaagacacgccttccccccccacttcagccgcgcgcctttccttcccccaaattcctcaaagatggtttgtctcacgtgttgcagggcgtaaaagcggcttgcattcaattagcagcgaagctcgcgggcgctggcgggacaggcgcgtgagggtgagttcgcgtgaatgtgtgtatgcgtgtgcgagaggagaacggtaagtgtcccgggtgcaggtgtgcccgtgaaaatgcgtgtgaatgtagcaggggctgaacacattgatgcgattattacctgaccatggatgattgtaaactgtgaaggtcggctatggggagggtgtgagggactgtgtgcgcgaatgtgtttgaacgtggggtgggggaggtggtgtgatcagggacagtaacaatgccagcggctgtgtaaatgtgggggtacgtgggttatgggggtgcagtaggctgcgaagagcccagccaggacagtgggcgtgggatgccccttatgaccgacgtgtcttggccttggggagggtctccgtggctttaacaaaagtagaccaagcaggaggcgggagaggctatgcgcgtccccgccaggcccgggagtgcgcaaggactttctccaacctgcagccagagaggtgggggaaacggacgcaaaaggaaaaattgaagtggtactttggggccaccaagtccccaaacttacctgtccctttctttgccccccgccccccgttttccccacagccacaacacatgcgtgtatcttgcttgggctatcttccctgctctgccacgccgggtctggagaaggggtttcagccccaggacatttactgagagtcggcgaatattgggtaagcaatgggggccaccccacaaccttgacccaggtggggttaggtccagcctagggcacctgatggggtgcggggctggtgggggtgctgtctggcaggaaccgggaagggagggaagggaccctcccagaagagcaaaggcagagtgaaggagcaggttcccaaagacaagttgtgggaggggctctgccaaacctgacaggcgctccaaatgggggcagggagtctgtgcaagttcgtttgtgtgaccgggcttaaggtgttatggggagggggtccttaggcaccgcagagctgtggagaaaggcgcagaatctttcatcttctccagcttcattagctagtggcagccccatgacctgttggctgaggacgcctctgcccaatgggagccgcctgagggacctgagaggaagctctagtgaccgctttcccaacacacctggtccaaacatgggggagaacctccttccccgtaaggaaggttggcagagcagcccttcttctcccctcacaggagctgcagccccgggcaggtgactttggccttagatgcagtagggcatggggatgggcttccccagatcccacatctcaagtcgtgcagtgcaggtcctcctattgcttctctgctgggtttcggtcacagtggagggctgtatgcacacacaggcacatgcctgtgttcttgtgggtgggtcggttcgtgtgaggacttgtgtccttgtgtctgtcaattgtcacaatggacaggaaagcgctttgtaccgtggtggaaaacacgtacaaatgctggttaagagaacaatgaggtctgcagggtctattgtgtccatgtctgggtgcatatgtgtttgtgagtttaggaaatgtgttgtgagcctcctaattgagcatcaggtcctctaaacccctgcagaagttggcggtttgattatgaagccccgcgtctgtttgtattgttgtgtgcctgcatgggcgtgtgtgcgagtgctgtgcgtgggacaaaggttccagggaggacagccagtcacggacaaaaatgtccttcttgggtaggatccatttcaccaggttaaacgaaggcttagaaacacagagaggggtacgtgaggagcccgctggagatgggcgagctgcggagcccacggaggggccagctccagcgtgaaggaaggagtaggaagagaaaaaagggcgatataccgggccgctggaaaaggaaattagggccctgggagggagcatccgttgaacctcgagatttttattgaccttcacttcagagaggctcctggccatagaggaggttaccggagccctggaactagtgctaaacgggcttgcggaggcacagcttgataggggaggtaagctggggttcagtgagtcaccttctttcttcttcacctggcttccatctgcaggagccgcgatgttcccccttcgggccctgtggttggtctgggcgcttctaggagtggccggatcatgcccggagccgtgcgcctgcgtggacaagtacgctcaccagttcgcggactgcgcttacaaagagttgcgtgaggtgccggaaggactgcctgccaacgtgacgacgcttagtctgtccgcgaacaagatcactgtgctgcggcgcggggccttcgccgacgtcacacaggtcacgtcgctgtggctggcgcacaatgaggtgcgcaccgtggagccaggcgcactggccgtgctgagtcagctcaagaacctcgatctgagccacaacttcatatccagctttccgtggagcgacctgcgcaacctgagcgcgctgcagctgctcaaaatgaaccacaaccgcctgggctctctgccccgggacgcactcggtgcgctacccgacctgcgttccctgcgcatcaacaacaaccggctgcgtacgctggcgcctggcaccttcgacgcgcttagcgcgctgtcacacttgcaactctatcacaatcccttccactgcggctgcggccttgtgtggctgcaggcctgggccgcgagcacccgggtgtccttacccgagcccgactccattgcttgtgcctcgcctcccgcgctgcagggggtgccggtgtaccgcctgcccgccctgccctgtgcaccgcccagcgtgcatctgagtgccgagccaccgcttgaagcacccggcaccccactgcgcgcaggactggcgttcgtgttacactgcatcgccgacggccaccctacgcctcgcctgcaatggcaacttcagatccccggtggcaccgtagtcttagagccaccggttctgagcggggaggacgacggggttggggcggaggaaggagagggagaaggagatggggatttgctgacgcagacccaagcccaaacgccgactccagcacccgcttggccggcgcccccagccacaccgcgcttcctggccctcgcaaatggctccctgttggtgcccctcctgagtgccaaggaggcgggcgtctacacttgccgtgcacacaatgagctgggcgccaactctacgtcaatacgcgtggcggtggcagcaaccgggcccccaaaacacgcgcctggcgccgggggagaacccgacggacaggccccgacctctgagcgcaagtccacagccaagggccggggcaacagcgtcctgccttccaaacccgagggcaaaatcaaaggccaaggcctggccaaggtcagcattctcggggagaccgagacggagccggaggaggacacaagtgagggagaggaggccgaagaccagatcctcgcggacccggcggaggagcagcgctgtggcaacggggacccctctcggtacgtttctaaccacgcgttcaaccagagcgcagagctcaagccgcacgtcttcgagctgggcgtcatcgcgctggatgtggcggagcgcgaggcgcgggtgcagctgactccgctggctgcgcgctggggccctgggcccggcggggctggcggagccccgcgacccgggcggcgacccctgcgcctactctatctgtgtccagcggggggcggcgcggcagtgcagtggtcccgcgtagaggaaggcgtcaacgcctactggttccgcggcctgcggccgggtaccaactactccgtgtgcctggcgctggcgggcgaagcctgccacgtgcaagtggtgttttccaccaagaaggagctcccatcgctgctggtcatagtggcagtgagcgtattcctcctggtgctggccacagtgccccttctgggcgccgcctgctgccatctgctggctaaacacccgggcaagccctaccgtctgatcctgcggcctcaggcccctgaccctatggagaagcgcatcgccgcagacttcgacccgcgtgcttcgtacctcgagtccgagaaaagctacccggcaggcggcgaggcgggcggcgaggagccagaggacgtgcagggggagggccttgatgaagacgcggagcagggagacccaagtggggacctgcagagagaggagagcctggcggcctgctcactggtggagtcccagtccaaggccaaccaagaggagttcgaggcgggctctgagtacagcgatcggctgcccctgggcgccgaggcggtcaacatcgcccaggagattaatggcaactacaggcagacggcaggctgaacctccgcccgtccggcccgcccattcccgacctccacctagggtgcctgggagcagcagtctagggctggcaggacttatgtcccccgtccccaaccttcacctactcctcccccttactactccccaaccttgactaccagggacttctattagggagtgggccgatttcaccagtccctgctacccacggctgccattctccctgcgggctgaatccccttccccgccaagcacagtgtttatcttaccccatgcaagactccacccgcagacggtgggcgatatctatgtccctccattcccgtcgcgattatctgcgaaatccaccccgcagcccgccccaccgtgggctctggagccagaggaaacgagcgaagactttggaaacctcgcggtaacgcggtggtttcgggggccagccaaggccagtggagtgctgtggggtcccacctcgacccctcctcctccctttctttctttcctttttttttattttttaattttatttatttatttatttattttttgacggagtcttggtctgtcgccaggctggagtgcagtggcgcgatctcggctcactgcatcttccgcctcccgggttcaagcgattctcctgcctcagcctgcctagtagctgggactacaggcgcgcgccaccacgaccagctaatttcttctatttttagtagagacggggtttcaccatgttggccaggatggtctggatctcttgacctcaggtgatccatctgcctcggcctctcaaagtgctgggattacaggcgtgaggcaccgcgcccggcccctcctccctttcaatccctactcccagaagccgggattcgtggcaacccctagtttttagttccaaagcctcctgccggcagggaaccaaatccttctgtcctcccacccccaccccacttctggccagttggagtccagcccggtgcctggggcgcctttcagctccgcgctcagattttcctgttttcgttgttttcaaagacagcgacatttcgggtctggtgctaacacccccttcccagcctctgggaaaatcgagtgtgtgtgtcggggggtagggagggaatgcgttttctgtcgtctctctcctaacttaaagcgccgcaggaccgcgcgccccttggcggctgagcctgtggacttggtcgcgggccaatttcgttgtccgtgtgttgggctttccggaggtctgtgcgcccaacagcgccgctcccgcggctccacccgacccagaccctagctggaaagcgccggaggcggaggaagctgactgtggcctcccgggccgcggctctctggagggctcgcgccctagttcgcacaaagcctgctcgtgactgtgcgactgtgcgacgggatccggatggagccgagcccctccgtcctcgcgtctcggtcctcgcgtcgccccgccccacccgcccctgcttcggcgggaatcgtgtttgcccggcgtgtagtccctgacaagcgtgccctgtaggagaaaagtctgtgtcctgtgaagtgtgaccgtgtagtgtaggggggcgggcgggggggcggatgggcggggagggagggaaggggaggggcgcggcgcggcgactcggggcggggttcttttttccattttgaaagaaagcgtcggggttggggtggggggagtttcagtcctcgggatcagccctctccgcgaagcgcagcacaagcgcgggcctgggacggagtagccccccggagcccgtgcccttttctaaacgcgtctgtatgcagtcaataaaacaatcgatttgaa

SEQ ID NO: 1021 - DNA, 7430 bp, Homo sapiens
actcaaatcggggtattgatctccacggaagccccaaaccctcgccatcgagagacccccatggcccggggtgatggctgtggggcttggtgctcccagagagctcagtggctacagaatgggtggggattctgcgtgtctcccggagcctgaacccctttcctggttatggccggtagctgtctccagggctaacgtgggcagcgcaggggggcggaaaccgggttttagccaaatgcctcgacatcgccgcgcctccgcctcctcgtcgctgaaagaaatgtcggggtttcatcagagctagggagcgacagtcgggaacagcgagtctgccgaagccggctgttgtgtgagggtgtgagacggcggggcggtgaggggccaccgcggcttgggggatagtgcgtgtggggttgaccgtgtgtctgcttgagaggctgtgaagatatggggggcagatatgggagaaatgctcgggcctgaagtccccagcccaccgtgctcaagagtagcggacgttttgccaccatccttgtctgtgctactgtctgctgcagcttccgtgccccgttctcctggagcaggcaagacctggagtgaggtgcttgggtgcgctcgagagagcttccccctgctccacctgtcccgcggtgcgcgcaggccaacgcgtcgggcagtgggcttcaagcgctggtttagccacaaaagaccagaagtaaagagttccggcttaagaggctgggcagggctgcggtgggctggggaggggggtgtcccttcccagcacgccctgcagggctgtgcgttctggtgtcgggttagactagcaggcggggcgggggggttggggcggcggggcgggggagactagggcttatatcagcccagatccaggcaaaaatggtagggagggtgcggcgctctgctaacactatcaattatgcatcatgttgaacgtggcttcggggaggaggcggctagcagcggggggtgcgggagggaagggtccgcgcgagctcggctgcgcgcagctcagcgggtcccgctcgaagtctgtcggtgccaccgcctgcatttgcaaaaagagtttaaaggcaaagacacgccttccccccccacttcagccgcgcgcctttccttcccccaaattcctcaaagatggtttgtctcacgtgttgcagggcgtaaaagcggcttgcattcaattagcagcgaagctcgcgggcgctggcgggacaggcgcgtgagggtgagttcgcgtgaatgtgtgtatgcgtgtgcgagaggagaacggtaagtgtcccgggtgcaggtgtgcccgtgaaaatgcgtgtgaatgtagcaggggctgaacacattgatgcgattattacctgaccatggatgattgtaaactgtgaaggtcggctatggggagggtgtgagggactgtgtgcgcgaatgtgtttgaacgtggggtgggggaggtggtgtgatcagggacagtaacaatgccagcggctgtgtaaatgtgggggtacgtgggttatgggggtgcagtaggctgcgaagagcccagccaggacagtgggcgtgggatgccccttatgaccgacgtgtcttggccttggggagggtctccgtggctttaacaaaagtagaccaagcaggaggcgggagaggctatgcgcgtccccgccaggcccgggagtgcgcaaggactttctccaacctgcagccagagaggtgggggaaacggacgcaaaaggaaaaattgaagtggtactttggggccaccaagtccccaaacttacctgtccctttctttgccccccgccccccgttttccccacagccacaacacatgcgtgtatcttgcttgggctatcttccctgctctgccacgccgggtctggagaaggggtttcagccccaggacatttactgagagtcggcgaatattgggtaagcaatgggggccaccccacaaccttgacccaggtggggttaggtccagcctagggcacctgatggggtgcggggctggtgggggtgctgtctggcaggaaccgggaagggagggaagggaccctcccagaagagcaaaggcagagtgaaggagcaggttcccaaagacaagttgtgggaggggctctgccaaacctgacaggcgctccaaatgggggcagggagtctgtgcaagttcgtttgtgtgaccgggcttaaggtgttatggggagggggtccttaggcaccgcagagctgtggagaaaggcgcagaatctttcatcttctccagcttcattagctagtggcagccccatgacctgttggctgaggacgcctctgcccaatgggagccgcctgagggacctgagaggaagctctagtgaccgctttcccaacacacctggtccaaacatgggggagaacctccttccccgtaaggaaggttggcagagcagcccttcttctcccctcacaggagctgcagccccgggcaggtgactttggccttagatgcagtagggcatggggatgggcttccccagatcccacatctcaagtcgtgcagtgcaggtcctcctattgcttctctgctgggtttcggtcacagtggagggctgtatgcacacacaggcacatgcctgtgttcttgtgggtgggtcggttcgtgtgaggacttgtgtccttgtgtctgtcaattgtcacaatggacaggaaagcgctttgtaccgtggtggaaaacacgtacaaatgctggttaagagaacaatgaggtctgcagggtctattgtgtccatgtctgggtgcatatgtgtttgtgagtttaggaaatgtgttgtgagcctcctaattgagcatcaggtcctctaaacccctgcagaagttggcggtttgattatgaagccccgcgtctgtttgtattgttgtgtgcctgcatgggcgtgtgtgcgagtgctgtgcgtgggacaaaggttccagggaggacagccagtcacggacaaaaatgtccttcttgggtaggatccatttcaccaggttaaacgaaggcttagaaacacagagaggggtacgtgaggagcccgctggagatgggcgagctgcggagcccacggaggggccagctccagcgtgaaggaaggagtaggaagagaaaaaagggcgatataccgggccgctggaaaaggaaattagggccctgggagggagcatccgttgaacctcgagatttttattgaccttcacttcagagaggctcctggccatagaggaggttaccggagccctggaactagtgctaaacgggcttgcggaggcacagcttgataggggaggtaagctggggttcagtgagtcaccttctttcttcttcacctggcttccatctgcaggagccgcgatgttcccccttcgggccctgtggttggtctgggcgcttctaggagtggccggatcatgcccggagccgtgcgcctgcgtggacaagtacgctcaccagttcgcggactgcgcttacaaagagttgcgtgaggtgccggaaggactgcctgccaacgtgacgacgcttagtctgtccgcgaacaagatcactgtgctgcggcgcggggccttcgccgacgtcacacaggtcacgtcgctgtggctggcgcacaatgaggtgcgcaccgtggagccaggcgcactggccgtgctgagtcagctcaagaacctcgatctgagccacaacttcatatccagctttccgtggagcgacctgcgcaacctgagcgcgctgcagctgctcaaaatgaaccacaaccgcctgggctctctgccccgggacgcactcggtgcgctacccgacctgcgttccctgcgcatcaacaacaaccggctgcgtacgctggcgcctggcaccttcgacgcgcttagcgcgctgtcacacttgcaactctatcacaatcccttccactgcggctgcggccttgtgtggctgcaggcctgggccgcgagcacccgggtgtccttacccgagcccgactccattgcttgtgcctcgcctcccgcgctgcagggggtgccggtgtaccgcctgcccgccctgccctgtgcaccgcccagcgtgcatctgagtgccgagccaccgcttgaagcacccggcaccccactgcgcgcaggactggcgttcgtgttacactgcatcgccgacggccaccctacgcctcgcctgcaatggcaacttcagatccccggtggcaccgtagtcttagagccaccggttctgagcggggaggacgacggggttggggcggaggaaggagagggagaaggagatggggatttgctgacgcagacccaagcccaaacgccgactccagcacccgcttggccggcgcccccagccacaccgcgcttcctggccctcgcaaatggctccctgttggtgcccctcctgagtgccaaggaggcgggcgtctacacttgccgtgcacacaatgagctgggcgccaactctacgtcaatacgcgtggcggtggcagcaaccgggcccccaaaacacgcgcctggcgccgggggagaacccgacggacaggccccgacctctgagcgcaagtccacagccaagggccggggcaacagcgtcctgccttccaaacccgagggcaaaatcaaaggccaaggcctggccaaggtcagcattctcggggagaccgagacggagccggaggaggacacaagtgagggagaggaggccgaagaccagatcctcgcggacccggcggaggagcagcgctgtggcaacggggacccctctcggtacgtttctaaccacgcgttcaaccagagcgcagagctcaagccgcacgtcttcgagctgggcgtcatcgcgctggatgtggcggagcgcgaggcgcgggtgcagctgactccgctggctgcgcgctggggccctgggcccggcggggctggcggagccccgcgacccgggcggcgacccctgcgcctactctatctgtgtccagcggggggcggcgcggcagtgcagtggtcccgcgtagaggaaggcgtcaacgcctactggttccgcggcctgcggccgggtaccaactactccgtgtgcctggcgctggcgggcgaagcctgccacgtgcaagtggtgttttccaccaagaaggagctcccatcgctgctggtcatagtggcagtgagcgtattcctcctggtgctggccacagtgccccttctgggcgccgcctgctgccatctgctggctaaacacccgggcaagccctaccgtctgatcctgcggcctcaggcccctgaccctatggagaagcgcatcgccgcagacttcgacccgcgtgcttcgtacctcgagtccgagaaaagctacccggcaggcggcgaggcgggcggcgaggagccagaggacgtgcagggggagggccttgatgaagacgcggagcagggagacccaagtggggacctgcagagagaggagagcctggcggcctgctcactggtggagtcccagtccaaggccaaccaagaggagttcgaggcgggctctgagtacagcgatcggctgcccctgggcgccgaggcggtcaacatcgcccaggagattaatggcaactacaggcagacggcaggctgaacctccgcccgtccggcccgcccattcccgacctccacctagggtgcctgggagcagcagtctagggctggcaggacttatgtcccccgtccccaaccttcacctactcctcccccttactactccccaaccttgactaccagggacttctattagggagtgggccgatttcaccagtccctgctacccacggctgccattctccctgcgggctgaatccccttccccgccaagcacagtgtttatcttaccccatgcaagactccacccgcagacggtgggcgatatctatgtccctccattcccgtcgcgattatctgcgaaatccaccccgcagcccgccccaccgtgggctctggagccagaggaaacgagcgaagactttggaaacctcgcggtaacgcggtggtttcgggggccagccaaggccagtggagtgctgtggggtcccacctcgacccctcctcctccctttctttctttcctttttttttattttttaattttatttatttatttatttattttttgacggagtcttggtctgtcgccaggctggagtgcagtggcgcgatctcggctcactgcatcttccgcctcccgggttcaagcgattctcctgcctcagcctgcctagtagctgggactacaggcgcgcgccaccacgaccagctaatttcttctatttttagtagagacggggtttcaccatgttggccaggatggtctggatctcttgacctcaggtgatccatctgcctcggcctctcaaagtgctgggattacaggcgtgaggcaccgcgcccggcccctcctccctttcaatccctactcccagaagccgggattcgtggcaacccctagtttttagttccaaagcctcctgccggcagggaaccaaatccttctgtcctcccacccccaccccacttctggccagttggagtccagcccggtgcctggggcgcctttcagctccgcgctcagattttcctgttttcgttgttttcaaagacagcgacatttcgggtctggtgctaacacccccttcccagcctctgggaaaatcgagtgtgtgtgtcggggggtagggagggaatgcgttttctgtcgtctctctcctaacttaaagcgccgcaggaccgcgcgccccttggcggctgagcctgtggacttggtcgcgggccaatttcgttgtccgtgtgttgggctttccggaggtctgtgcgcccaacagcgccgctcccgcggctccacccgacccagaccctagctggaaagcgccggaggcggaggaagctgactgtggcctcccgggccgcggctctctggagggctcgcgccctagttcgcacaaagcctgctcgtgactgtgcgactgtgcgacgggatccggatggagccgagcccctccgtcctcgcgtctcggtcctcgcgtcgccccgccccacccgcccctgcttcggcgggaatcgtgtttgcccggcgtgtagtccctgacaagcgtgccctgtaggagaaaagtctgtgtcctgtgaagtgtgaccgtgtagtgtaggggggcgggcgggggggcggatgggcggggagggagggaaggggaggggcgcggcgcggcgactcggggcggggttcttttttccattttgaaagaaagcgtcggggttggggtggggggagtttcagtcctcgggatcagccctctccgcgaagcgcagcacaagcgcgggcctgggacggagtagccccccggagcccgtgcccttttctaaacgcgtctgtatgcagtcaataaaacaatcgatttgaa

SEQ ID NO: 1022 - DNA, 12695 bp, Homo sapiens
agaatgccaaccagtgcccttttgtgtactgggacatatactcgtgattaaaacaggtaacatgaactctgactttaaaatgtattgtagatataaatgctctaagctagaaaaggttttccacatccacagtcaatgatgggagcctttcattcctcagaaataatccctttttaggtcatcaagaaagggtacaactgctgcagctcatgatgcaatatcttcatgagcccagagcacatacaaatcctaagggaactaccatagtacagcgctcattcttggcaccagaacaaatgaaacacactctatcctgcacacacctgccagagcaggccactttcctcttctgtgagatttaaaaagctccccaaaatgttattactcccatccccaatacacagaaaatagggaaaaggctgtttccagttcttggcctttaaacaactctaaatgtcagtactcacagtggcatattacaaagtaataaacagtgctcaattgagggcaaaccacatattgagctaatgaagagctcactgtggttaggattcgatcaaacgtaatagcagaacataagcacattttatctgaattctggaatgaatatacatgctgcaataacattaaaaaagcatggcagcctgttccaaaccagccagaatagttttgtgcaaattagtgggtctttgtgtgtttgaattcccaccacctaagggcaaactcgatatgcatactaatgacctacaattatcaaattaaaaataaaaatgctaaaggatgccagaaagaacatcagggaaagaccaactctcccttaactttttacaaataaatttaaacggtaaattagaaacacaaataaatgtgagtggctctagcattcaaatggagtaaatgaattgtgtaggagatgaaccccgtaactttttgttgttgttgttgttttaaatttcttgaccagctcttagaagatgatgatgtttatctccctgttctcggctgcctggtagaagaatggcacgcagggtttgctgggcaagcctgggtgctcctaggtgtcctgcatgacaggagacagctgcacgatctgctgtacagtggggttgtcatggggagaaccctccctggccgctcctggtgcaggctccacgttgttgtccaggctcacttcataaaaaacttcggagagagggaggcgggggtctgagcacagtgcgagcctcccctgcccctgcctgcccaccccgcctgagagctctactcaccatcctgctcaccggcagccccaagttcctggggggctggggcccctggagtgggctcatcagcagggttctgggcagcgatgaggaatttgccatgcccctcatggttgcccacaaggggcaacaccaactcttgcagctccagcagcttcacctgaagggaggggtgctcagctcccaccctggagcctgcaccagcgcccatgcccacccccaaccccgcagagatgttgcacgccctaccttcatctcctcctccttctgggccagcctgatgacatcctccatctcctggtgccgcgtgtttggcactgccccctggctttcatatacggtgaaggactctcctgtgagaggacacagctcagacactagggtccctccgacggccctgcagctccccgtgcccgtgccctggcctcccgctcactcatgccgtctgtcactccagaaggctggacgaatccaagctctcgtctctccacctgctccgtcccgtccgccttctccttcgggaggtccataaagctgctctggagccaaaataatggggtcacatctcgggagtgacctgttctgccccgcccccacttttcttggcccatgccaggactcactccctttcagcttcaccatggcctccttcagggcccggtagctctccccacacacaaactcacccccactccctggggctggggcctctgcctctggctccttccaggcgaaggccaacagatgagccaggtgcaggcagcacagccttcacaccttccgctgcccacatagccgtgcctgctcctcctgggaactggctccagcagaggtgaaaaatgccacttgaaggcaagaggtgagtattcttgtaggggcatagacagaacaaatgaggcagggaggtggagaacaaccccttcccttggggcctcagagagtgcacctgttggtcacaggtgacaaagtgtctgaccactggctcccggaaggggtgaggggccagagcaatcagaaggtgggaaaaccaagagcataagggggtctgggagggaccacagaggaaggtggcaaagcggggcagggaaagtcaggctcaccgtggcctcccggctctccaggtcctctgggatgtttggcgtgggccgaggcgcctcctcctcctcactgtccagatgttgtcctccatctcctgtagggaggtggccagaggggtcctcagacaacccaacaagggaggtactgtgggcccacctctgtccccaccctgactgtgtaaccctgagccagcctctccccagaggggagtgagctgctgttctttatttttccttttaagaaccaagatcttgctatattgcccaggcacagtcccactaccggtcggtgcgggagtcctgacctgctccctttctgatctggtccagttcattcatccttaggcaacctggtggccccctgctcccaggaggtcaccatattgatgctgaacttagtgcggacacccggttggcataacgaccagctgttctaaaggtctcttccaacccctcaatcctatgctgctaacagtccccccttcctcctggggctctctcctcttcctctgagtggtctcctgtaccttctccagggagagccacgaggcttagctgggtctctagctgttggttctggtggctggcagcttctaggtgctcctaaggggacgggaaacagagtgagaaggcacggaggttgccaggtcatccccctcggggccccgtcctcagcaactccctcccctgggtctcctgcaacttttgtccggccatctcagccaccgctttgccccaagcttcctgctgctgcagctggtccacgaactgggtctgcagcagtaactgcctgtgcagcgcctccttctcagaggtcagctgctgataggtggccatgtactgctgcaggtgacccaggtactagtctcgctgctgctgcagactctgagactcttggctcttcagctccacctgcaggaagaccctgggcatgagggcacatggcggctggcttccagattctgggcccattaatagggtagcgagggcaccgtggggctctgtcacctgcccaggaccctggtcccttgctccaggcctaagaggcttcctcccttgcctagaaccccatacctccttccccagcctcaaatctcatgtccttcttcccaccatttaaactgtaggccacagactggtggaaaagcagagggagccaaccaccatctgctaagtgtgctacatgcctaatgctttccaggtattctctcattcaatcctcagcacctctgcaaggaaaatgctaacttccttttgaagtcacagaaacagagacttagagatgaacagtagttgaatggtgaccagtggaacccaggccagaatccagtttgaatctaaggaggcttttttgttttgttttgagacagtgtcactctgtggcccaggctggagtgcagtggtgcaatctcagctcactgcagcctccaccacgtgggctcaagcgattctcgtgcctcagcctcctgagtagctgggattacaggcatgcgccaccatgcctggctaattttttgttgttgttgttgtaattttagtaggggtgaggtttcgccacgttggccaggctggtctcaaactcctgacctcaagtgattctcctgcctcagcctcccaaagtgctgggattacaggtgcgagccaccgtgcctggataaggagcctcttgtaccactgtctcttcccctgtgattgggggctccatgtctctagctgggatgatgatgtccagacctgggaggagcccagggctacccacctctaaaagtcagagggcaggaagcaagaaacagtcatagagctgcactggagggtgctggggtcacctgcctcccagctggagctgcctttggcctggcacctcccctccccagaggctggtgcccgcctcccagcccttcttggatggggtggaggttaccatctccttcacctcgtctagcttctcctgcagctcctttacttgctgctccaactgcagtgcgctctttttctcgttgttctggacagagagaagcaatcagtggccatccactgcagctggagacaccagaccttggtgtctgcctcccatatcaccaggaagggtggaggcaggttagaaaaatcatcccttctcccccacagccatcagagcagagcccgatgagctgtagctcacaggtgcctttagaagtagcatttcatgtgagggctacactggcccattttacaggtggggaaacaaaggcctggagggatagggatgagggcaggctccccaggtggggcaacccaccagatcctcgaagctgcactgtggctcggccagctgcttgtcgagcttgtggttctgggagagcgcgagcctctcctcctgcttttgtagcctctcctccttcttccacagcctctcctcctggtcccacagcctcttttcctgcttttgcagcctctcctcctcctttcgcagcctctcctcctgtttgcgtagcctctgctcctgctttcgcagcctctcaccctgctcctgtagcgtcttctgctgctcccgaagcctctcgttttgttcacacagtctctcctgctcccgcactctctgcgcctcctgctctcggagcatctcctcctgctcctggagtctctgcttttgttccttgctaaggagactcaaggcctgattgttttccacctgggactggagctttccctccagaccttccacctcctgcctcaggtgtttggcctcatcttgtagctgttccaccacagaggtcactgctgggggcgccagggatgggggctcagctgagaaatgaagcagacaataagggcctctggattccccaacccctctacccacatccccctcaaaaaaaaaaaaaaaacctcctcttgatgcacagctcctctcaggcttcccaaacttggcctcactgctaatcattcctcgcacccaatggtagccaatttccaagccactttcacatagagagcactgtgggtggctgacaacgggcactcctccctctttgctgatggggaccctgaggctcatggagatgacaaaacttgccgtctcctggcacagacctctttccctctgcctcaaagcccttccacccacccacctccctggggcattctaagccacccccacagacctctgatgccagtcctgctccgaggtcacaccagccccatcttacccatctggtttttgagttcggacaagctcctctccagctcctgtatccgatgtatgtcacgcttcttctcttccttcaatgttcgagcctgcccaaagcacaggggaaagggccctggagagaggggctggtggctggacaggctaccatctcattctctgtccccatctccacaaagcccagacccatgaccacctctggctgtactattcccattttacagatgcccagaaagatccagtgacctatctaaagtgggggctgaagggtcagacctcacctccaccgacattttccacatcctctcctgccaccgggccctctctccttttatgtgtttagcatattcgtctcgctctagctggacttgttttagtgactctgtcacctgcaagaaatgggcacagaagttaggaagggctgtcactggtcctcacctgctcctggccacctggggtcatcttccttccacatccctccctctgcaaagcctcacctgtgtcacgtgtgcgttcagcagcgcccgctcctttatggtctgctgtaaccaccgctggaggaccgcttctctgcagctcgaggactggatggtgaagagtgagaagttttgatctggggagctcaggcagtgccccttaaaagggctaggctcaatatacaactcggtcagtaaaggtcaaggcatttccaagcccgtggcctggttattaaaagaactcagtaaagttggaagggagagggaaagagatagaatttacagctggctaacagaggcccagagagatcagataatattgctattgttattactgttattactaccactgtttgaaccgttatggagtgcttcaccaggttccatgctagcaatcccatttaatcctcacaaccaccatatgagacggttactaggattacctctattgtgtagatgaaaaacatcgagtgttcaaggttaagtgcttgcctaagatcacttagacagagctgggatttgaacacccaggtctatcctattctctaagcccatttttcttgctgggggtggggacacagataggaagggggaaattaatcttttgttcactttttgaaaggatgatacattcatatagtccaaaactcagaaggtacagaagggaggtgtctccaggcaccctgttactctctcctgagttttttatgaatgcttgcagacatgtttttgtatattatcatagtacacacacacacacacacacacacacacacacacacacccctttcctctctctacagaaatggtaacatactaaaggtgctcttctgtaccttcacagaacaactacccaataccccacctaggacttggccaaggccacagccaggaaagggcagggcaggcacttggcctctgagctctgcatccagtgctcactccccacagtgccccccaactcacccacagcagctgactcagccccaggctgcctctaacaaccatacacaaaagtagtgagaaatgaccatgctgccttctgggcaggacactccatcctgcagaagggacctttaggctcactcctctatctgggaagccaggctgccaggggatggggcagctggttggactcaccctgtcctcttcctgctgctgtgtagacacagcacagagagcccgctccaattcttgaatacgctgtaaggagtattgcaggcggccagccagatccttggactcttctgtaatgagagaggttgagatggggcccaaaagactccccctaaagacctgtcaaagtgccaggttgaaggatgacgggatgcccagattcccaccttcgaagtgtcgggcagcacgtttagtatggtaaagggtggtcttcaagtctgccttttccaatgtgaggatgttgattgtctggaattgaacgtttgggagaaaagccaaggaaatgctgaaagagaaggaaagaaacattctccagaggacaggagaaagctccccaccctccactcacctctaaccgctccatttgtgctttgtgtatttcattgtttgttttctttgcctgtaggaagaggaagacagagctcttatcacagggaggcagagatggcacagcaagagacatgcccccagaatgccaccaatgccccaggacaggcccacccatgggaccaggttatcagggaccctgtggggatggggtggaatctgatgggtgagccttcttccccaggctgggagtgggcaagatgagactggcgcctctgcatctgagtgtcccccaaacccagcagtcatgttgtgagcaaagaaatcacgttacttcttccagctgatgttccacttgtttcttctgctgtttctgtggggagagtcaaattcaggtgactgagagtggccccctcaactctattccccagacctggaagcggtaggcagggtccaggaatggattttaaaggcaacattctcagaaccaatggcaacacaaactggtcaaccctcttcaagctcccaaggacagaggacttgggtctttgttggtttttgcccacagccacagaactcgaagtctgaatctggattctcttgaaaggacagtaacataaacccctagagagggagtctcaggaaggcccacccttctgccagcttgtgatttagaaaggtgccttcattcaacaaatatttactgaacacatacgggccagctacggttcttcacagcagatataggatggaaaaggacagacaggagcccttggccctcaggtttccattctaggggcctttaaatctcaggctctcagagctaacagagaactctgatgctctacctcctccagaaacacaagcccaaggaggacaggtggcttgtccagactcaaagcaaattagggactgagtcagggcagaaatacagggcccctgacaaccagtcaggctagcgcttccctgagaggtgacaacctcagggcgtgtgtggcaaggactggagcaggggtgtctggagaagagagagtcggcaaagagggcagtgacagaagagccatgctgcgtgctccttgctctggggtccctccaggtgaggcctgggtgctccagctccccatttgcccttggcaccaggggcccccagcccctttcttcagggccccaaggggaaactaaagcccaggattggcagcatggaatcaggggaccccactggacttaccaatgattctatgttttcattgagttgactgattgtcactgagcttgactccagggctactgctagttcttggtactggctctgaggcacatgcagagaggaggagttggaagaggattgtggggagaggtagagagaacaatcattagggctggggtgtgtgtgggctgtctcagctggcagagggtcacccagcccccactgtgagaggaggttggagggctggcctgcaaagtcactgcacctcagcccagggcctcttacttccagatccttcagggtaacagatgatgcaggagtaataaaaatgagaaattaaaaaaaaacttacatgggaaatagttatgtatatggagaaagtataaaaacagcaaggagccgggcacagtggctcacacatgtaatcccagcagttcaggaggctgagacaagtggatcacttgaggtcaggagatcaagatcagcctggccgacatggtgaaactgcatctctactaaaaatacaaagagtagccaggcgtagtggcaggtgcctgtaatcccagctactcaggaggctaaggcaagagaatcacttgaacccgggaggcagaggttgtagtgagccgagatcgcaccactccactccagtctgagtgacagagtgagactctgtctcaaaaaaaaaaaaaaaaaaaaaaaaaaaaaagagcccaaatcccacgtgcctgctctgtacgttattcccagattacttttaaacttttaggcgtcaccatttccaagataataaaagacgcggggaaggaaaaaacccaatcaatcaagcaggtgaagaagcagacagaaacaggctgaaggttaatggcagcaacataaaacaaggcagaggccaagcatcccccaagccagagaagcctcagggccatgcacagctgtagacagcaagccagagaggggtcttggcactgcctcaccttccacttgtccaatgggggagcactaccccattggagtggttaaggttggacacccgcaccttcagaatgtcctgaatctacaggaggtgacaagggaaaaacaagggcagggggtgaaagacagaagtggcttagagagaagcaagaaagtcagggtaggaggaagatgtgggttcaggaaaaggaaacgctgaagaagagcagaggagattaaaaccatggcctgtgccattcttccaaatggccacctgctgccttgccaggggcaggaaaaaatagatggaaaagtcccccgagtgacgcagtcacagagtggagtcagctgaccaatgcagatcttaatacgctcactggacccctctcctcaggcccaggacatgggcgatgaatctggtagagctccagacctccacctccattaaaaaaaaacagactcctgagtaagagttcacttgaactaaggggacttcagctaaaaaacaagtttgaaagacactgatcttatccagtatcatcttacagaggaggaaactgaggcccagcagaagaagtgatttttctgtggtcacccagcaagctggtggcaagttagaccttctcttgctcctagtgccttgggctctcctcaccacaccctgggcccccttcagtgactcctagagggacagcctgatggcaagtggctgtactcattagcccagcttccccttgcgagtggggatcaggaaaatcaaacagcaatgaccatttcctgggtatcctgggtgtttacagcaggccacgtactgggggttaacatgaaaacaacaacaataaggaatctcatttaaacttcacaaatggaagtcaaacaatactacccctattttacagatgtgaaaagagaggcccaaagagctcaagcaacttgccataaatcagatcgctagcagatgaagaagcaggattcaaacccagaattcttaaccagtacccagcaatctcaacaattaccctctactgccccttgggccccctgtccccaggagcctggccagccaagactcacatccccaggtgagtggcaaccaccggaagtggttgtctcagggctactgtcagtttttttcttttttgtctttgctcctgctggaataccagggctcttcctttgctgatattcttttagctgtgggaaagaagagcagtaatactcatgagaactaccagcccttacagccacaccctccttacagtttttgcaaaatactcttatacaccatctgatttaatgccaccaacaactgtacaaggtgttgtcacaatcacttaagtgactgagagggatggatattatggctaaaaaaaaaagtgtgggggggcaataatggaacttaaactcagtcttctgactccaagctctggggttttgccatgaatcagcagctgccggggaccaaaaccagacgcagaggtagaaaagtaaacattacataggcatgaactacacgctgtgtggtttagagtcatacatcctcaaatgcctgttagtgtgaagaagtgcaccagtatctctcaaacttttatatcaatgtgtcctcatggcagaaggcagcttttttgttaaatctgggaatttatcagaaagaggacaacccaagtctcatttcagagagaagtctggtatactcttagaaacctatgtgagggtcacccctaagtacattaatgttttttctctctcaagagaatcaagggaaactgatgcttcagaaagatctcccacatttatcctgtggcactcaatgtaccctaagttgagatgatatgaggaagattcaagctgtcaagttcagtttcccaagacctattccacagaagatgagcaaatctcacttcagagaccactgactgaagggcagtctggtcccagaaccgtggagaattagaatatgaggtggagaactcggaaaaaaatgttaaagtctctctggagagtagaagcctgggagaaaaccaaaccaaacccattctcccattaccacccagagatactgtcaacgttttgagctcacaggggaagtgtaggcttttcacactgtcgatgtctatgtgaagggagtaaggcagcctgaaacctcttgctcctaggtcccatggtccccatttcccttctagctggaaatttgtgctgtgaccagaggaaccagaaatggggtgagaatgcttaggggactgggttataagatcaaaggccggtcttgcagcagtaatgacagttcctaggaggactgtgacatcactacattccactcctcctgggggtgggggaaacctcatcagtgcaatggctgagttgccgatccacgatgggggaggggggacgtggggctgggacccaggtccttggagatgccagtccagagagcccagggaggtcgggcttgggtcagcaggaggggagagcagagtctgctcagggaaccccaggagtcaccagcccaaagtcaccccgggatgactggcgatgctggggggttggggctgggggacccaggtccttggagaggtgagcccaaagaacccagggaggttgggcttggggtggcaggacgtgagggctgaatatggagcaggtatccccagtagtcatccgcccaaagtcaccgcagggtgattggcgagggcagaggctgggctgcttgctgaaggggcggggctgactgacaagacgttggtggggggagtccagaggcgccggggtaggggggcccagcccggtgtgcctcaggagtggtatggactctgggagtggtcttgtcatcagaggggatctctggctaggttggggggccatgacctttttcttggctttttacctttttcttggctgctgccaatttattctgtcgagattcttctaacatcatggggtggggagggaggtagggttggggccacatcagcgaacacctccagtcacctacaaggctgctgtgtgact

SEQ ID NO: 1023 - DNA, 28589 bp, Homo sapiens
tttctcaggaacaagtttattgcagggaacacactaacctctttcataatagccaaaggcataaaaactacaaaaatatctggctctcgagtgtgggcagctcagtgtgggacctggtctgagtcatgacttgggctgccctgcaggccagaggcccgggagctttccggccactccccagagaggtccgtggcgctgagggggtgaggaagtgccttggctgcttccacagcgtgaaggccaaggctgaggtggagctgggctggagtggttccagagaaggcttcatcgaggcccttcaaggctgatggcagagccagggtagggagacgcctggatgtggctgccctggctcaactggctcctggaccaaggccctaacccaccagtttctttctccagaacccctgctggctctcccatagccaagtgggtggagcagagccctcctgaggctcccagtgcagacagacctccacccaaccacagtgatccggaggacctgctggctgcatggctggtgtgatgctgggaggagagccggggagggaggaggatggtaggcaggaacatgcctcagcacagatgggcaggtgggttgaccttccctgccctcagggctgggcaccattggcacccaacagggccgtcttgcggaagacctgcagggttgggttgtgcagcagcgtgtaggccagaccccagcgagccctgccgcggctggccccgggcctagctcccttggccatggagtcctttgtctgtagcagctgcatccctgagagagacggactttctgtgagtcactcagcaaacacccagccaaccctccctggccctcagacctgatcagagagcctgaaaatcccaggcgtgtgcaggtcgtgaggcttaggatgtcccctgcaggcagcacatggaagtggggggtgaggtctgtggatggactggaagctgggtgggacaagggtctggagctggcttagtgtcccctccctacacacacttctgggcagaaggaaaggaggagtcatactccctgccccaagggagaagcgggggcagtgacggagccccttaggaaggcagctgtttcattctctctgtgtgcacacatatggtgtgtgtatgtgtgtgttcatatcatggaaaaaatcaccctgagatcagaccaggaggggtgaccaaaggcagccaaggaagagaggaagtgagaattttcctggcgctcactctgtgtgctggggaggggcacacatccttcctagaagaagctgggtaggctctattcccccattcccagtgggagggcgcaccttcgtcttcctcccctggtctgaggctgtcctggggggctgccatggtcctgggtaggaggctctgcgcttgcaggagcagggagcagaaggctgtcatggctggatgcgactggctgacttcaatcttcaagaagtttcggtacgtgtagtagcctggggtggggtggcggatggcaatgctgggggagcaggggccacactggaggcatccagacatcccctaacacacacacagggagtgcacgtgcactccctgcatccaagcatgtcgacacaccaagcacgtggcacattggctgcatgggcacgtgtggacctgctagaacaccccacatccactgcacgtgctgcagggccacaggaggcacagcgcaggggcacacaggtggcacatgcagctacaggcatcggtgtgaactgatcagctggcacggccctggggcagggcagatgccttcctcactgcttgggtagcctgagcaatcctccagccccgcccagtgaccttaccggggtcgagagtggcggctctcggtggcagcaggctgaggtccatctggccaaggtggatggcgttgtagagggcagagaggagcactcgccaggtggccaccatggcacccaccagcacattgagggggaagagaagaaaggtggctgcatagagcactcgcctaggatgggagaagaaagctgaggcaggccgttccccagagctccctccccagggtcagtgtcagacctggatgcccagaactgctgtgtatttactgagtgcctaccatttattgctatgtcttctgtgcaccccaccctgggcaaggccttctctctttcaacccaccatgctgggagatgggaaactgaggcccagagagattgggagacttagccaaggctgtcagctattcagtggcagagctgggctttaactctaggtccatctgagtctttctatgaccctgatgcctcccacctcccttttctgggtcccctgtctgctaattccaagttcccctgggagccaaggttctcccacagacttgtcatctgacagggaactcccttgctacaaagtggggaggggcatggttttaaggaaacagaggatccaggggagagcagtaccgattcccaaagcaagaaaggttcacgggggtacttccagccccatgccgggtatgtagagaggtactttggagtgggctgagccattgtcccttttctctatgggtaaggcaagctctttctactatcatctgggttccttgatagagagaagggatagatggcagtggagggaggacacaaaaagagagagacaccgaagaagaggcgagggcctgagggagccacaagcccagatgccacctcaccggttggtcagctgtgggtgtccatcatgagtctccaggaagacccaatgggctgccatgttctgcaggatcacagccagggccaaagtcagccagaagggcctgccagtggggtggggaggtggtcgctgttagcggacctctaaggagtccctgagccctccatgtcttgtttcactcaccacgaggactccagggaacggaagagcaggaggttcctgccatggagcacaggcatgagcaccaggaaggccagggccgtggttcccaggaagaagatgatctgctgcaccaggagccctgccaggggcgggagtggcagggggacagaaaacaggttccatgaaaactggccatccccgctgcccccagaaccaagggctttgggattgggcaggcctggttttagatctctgctctgccactgcctagctatgctgccttgaacaaatcactttacttcattgagcctcagtttcttcctctgtaaaatggggataatagtccctacctcagaggctgttgtaaggatccaatgagataatgtctgtggaaactcttaaaatcacaaaatactttgcaaatgttatttccctccagtttctcctgagtttgagttactgggggataaggctacatattaaactgatgtttgcattccttcaagccagagcctggcatacggtaggtgcccaaggactgtctattgaaataatctggccaactgattagagaatgatgtctacaaaagggcctggaggcataagggctaccaagaagagacgctatgacttttgtcctagtaattcatctactcctttaccatccttctcctcccgcaaggaggtgagaatggaaggaactggagggagagatacaaggcccttggatgtgcaacccaggccacagcccctcaccattcagagtgcttttctcactgcagtacccaaggggagagtcagaaacttggggctggtaggggtcctggaaggttatctggtccaactctctcagggcaggaccccctttgcagactgcaacaatatccatggaactctgcttgcatacccccagtgacagggatctcattacctttgtaggtagccaaatgtgacacagccctttcttaagctggagcgcagtggtgcaatctcggctcactgcaacctccacctcctgggttcaagcgattctcctgcctcatcctcccgaatagctggaactgcaggtgcacaccaccatacccggctaatttttgtatttttagtagagacggggtctcaccatgttggccaggctggtcttcatctcctgacttcgtgatccacctgcctcagcctcccaaagtgctgggattacaggtgtgagccactgagcccagccaggaatgtaccattttgaatttgacacctccagacctgggtccacccccatgtgaatacttggtggcacccagggttcatctccatgtggagggtacacactcaatttcccgagggctcctgtacccccatcctgaataagcttcttaagggcagggaaggcaggggggtccctccttcttgctgctgccccagagcattcccagacaaactctgagggcagtacttgctgagcactcttctccccaactgaggccagtgtctgaggggaggcccaggccaaggctgggtgtggcgggcaagggaggctcaccaaggcagataaaggctgtctggtaggcactgaagctcatccaacagaatatggcttggcgggagggatggggactccgatgcaagggactcaagtccagggcagctcctcggtgcagagctcgaaggttggtcctggggtgggagccagggaggcagagacctcagggagcaacacactcttcctaaatcctcctctgggccagcaactggccaaactcccaatagaatttcaactcacagccatcagcagggaagcccagaactgtgggagccaggaggaggccactaacccaagatatctggaagaggtgatatctgggtagtcttaaacagtgaacgaggaatacaaaacgaggcagaaggctcaacctgagccaagtcagaaaagtgagaaacaacagtgagaatggaagtgacacacagcacagccaacaggtaaagaggcaaggcaagcacaggctgaggagccttgaatgccagaagaaggaggggtgacctgtggaaaaagatccctgggaagagctctgagacctggcaagtgcgcaggagacatgggccagttctctgacatgggtaagtgctcgggctgccccttccacctgccctgggccttcagtgctcctcaccactcaccgctgcagggcaagcaaggtggcatggcgagacccgtaccacctctccagtgtgctatgccaccaggctacccctcacctacactctcacatggcagggccaccccagcctctgttctcgtccacacagtcctcacctcctatctccttccattcccgggcaggtgcagcttccccaggccaccttccctctcatccagcccacccggtggcccctactcagggggcaagctccactagctgccctgagttggtggtgccctatgtccctcacactcacagacgtttccccaaccagacaggaaggcccaagggcaggacccagccccaccttctcccactgcagcgcagccacgcacaggtgggctccatgacagcccgggccggcagagcccttccctccctccaggcccagggcctccccgcaggcccacaggactcccactccttccccacctcggcgctgggtgagccagagtctgtcactcacctgtgtgtcaccagtgagcgcatcaggaccaggaaggtgagtaagcaggacaagaccaaggctgagatgtagcacactggtgggcagagaatgagcaaagtgagaggtcagggtctggagagtctcctggaggcctcagaacccctgccagggtggtgccttgtggggagttccccctgccccaaactgaactctgtgtggaagcctcttggccccacccccaggtctcagatgcagtgtaagccaatgacttcggccaccccattcttcccagtgacatacagtggtcaagagatgaaaccagctctgagtctgcagacctagtcctcaccctgctgttgctgcttctattgctgtgggacctccatccaacctggcatctgcctccagcttcactgcttcttggccatgtggccttcaggagggcactccttctccccaggcccccatttgctcgtgaacataccgcacgccgttatgctgcccagctctcaggataatgtgagccataaggccccatccacgtctgcactaatggtcttcgttcagggcatagagggtgtgagtccacatcggtgtggactgagtccatcagaatagggaggcagccgctgtcacccagctccctcaccctctccctggccatgcacacaatgagtgtgtgcatgatggtgtgtcatgaacaagcctgggtgtttaagaatttcaggggtgcaggctgcaactctcccaccttacgtccacatccagtcttgctctggactgtaacagcaaccccgcaaggttagacagaagaactgttcccactgggctgaagaggaagctgaggctcagagagagggcttcgcccagacagccatgctgctaggaatgatagagtgaggtgtgtaaccatttctaagcagatccagaatgagcctgagatgcctgcaccctgatctcatcagtcagtccagggaagtgttcctggtgcccgtgtcaccaccagaatctcaaggacggggagagcaaacacagaaaaggtgagtgctagttccacatagccacagggattagagtggtggatctcagcaccgatagcgcctttaggatcacctggagctgctaaaactcgcccatagcccagcctgcacccaaaccagttaaatcagaatttctgtgggtgggacccagccttagcctgtgaaagcaacactggtgattcagtgtgcagtcaggactgacagccactgctctgggggctttccaaaggcagagccttcatgatttatttccatcagaaatgaattgaaatcaaccaaccaaccaatatttattgggtgcctactacagtggtgatcaaactttgcttgcatgagaatcactgggactgtgatcccaacactttggaaggctgaggcggtggatcacctggggtcagaagttcgagaccagcctgaccaatatggtgaaactccgtctctactaaaaatacaaaaattagccaggcctggtggcgggcccctgtaatcccagctactcgggaggctgagatgggagaatcacttgaacctgagagacggaggttgcagtgagccgagattgtgccacggcactccaccctgggagacagaatgagactccgtctcaaaacaaaacaaaattagccgggcctggtggtatgtgcctgtaatcccagctactcgggaggctgaaatgggagaattgcttgaacccaggaggtggaggttgcagtgagccgagattgcaccactgcactccagcctgggcgacagagcacaactccatctcaaaagaaaaaaaaaatcactgggagggctgttcactcaaagaggctgggccccactctgagagtttctgattcagtaggtctggcacagggcttgagcaacgggaatgttaaagccaccaggtgcttcccagattcagccagggctaaaaatgatgctacagaaacctaggcccttctgctggtccctagctccctcctccagggccctcgcagggacacttttctcagaagcaaggttgggagaaagcactgtgcatgcatagctccagcctctgtggtcccccttctggagccagctgggctgcagcgagggcacattctggaccatttgctgccaggaggtgaacagcccgcctgctgagcctggcctggtgagtgtacaggctaacacagggttgaagggttagcagcccccttggccacaggcctggcctttgatctccatccatctacctcctacctctctctccctccactggttcccaacttgggcacccccaaaccccagcactcacacaatcttcctgctctttgccacctctgggatcctgtgcctgccttcttctgggccctgctttgggggatagatctgtcttccctcatgtgattgagggcctcaagggcaagtgttcctttttcactccagcactcattttgcagttggggaaattgaggtcaggagaggtaatgcactttgcccaaggtcactcagcttgtaagtgatggaacagagattctaatctagtttgcctgactcagtctgagctctctgtgagtgatgccaggcttatggtccaagtgctgggtggcagtcctaacagaagctctgagctcagaagacattagctccttaggcgaaggacagaccaagggacactggagcccaggttgcgggatggctttggccgtatctgtaatcctcctgggcctcagtattcctcatctgcaaatttaaagagtaactgttgctctgtttggcccaagaagattcaaagtgggagcctttgagcttggaaactgcaacatgcaattaaaaatataagacatgatgagtggaagcagagtcctttgccctggatgtgtctcattttgtctttgagcctcaatgtcctgccctgtgagctgggatcaatgatgctgacctacagggtcactgtgagcaagggtctgaggttggttgtgggctgacctggaccatgtctgcacctgcctatgaaccagattgcaaccagctcagaaaatctcctgggagaggacattttcagctcacccggaacttgtcacctgtccagtttgttgccctcagcagcagttccagggcagcctctagtacgggaactgaggtgctcacggagatggtggaggtggtcagggaaggaagtggtcactccgtgcacctctgcccaccccccactccctgccccgccatgaccagcatgcccaggtctgtaggataaggatgatgttaatggtcaggtacagctgcggagcagctacacctccacctgcaacgctggcagcccacgctctgaccacatgttactcctcagaagccgggggcccatccgtcccagcctggggtccccaagtaagcagaaggcgcatgcctcctgagtcctcagcaccgggctttgtcccaaggtgatggagaaggcccccgcctaggcttcaggagccctgcgttctcttggctgcactctgccctgctggatggcctcaggcaaatccttccccatgtgtcaagtggggacacttctcagtcccctccacagcgctgttgggagcgcccaggaggcagagtaagtaggtggctgcaggaggcatcagaccacagaaggggaagccaagatggttccctggttcaggagctcattgtcagaggagggaaggagaaaggagacggccccaaaagacagggagtggggaagagaaagcctgtgccctgcccaacgccagacccctgccacgaggattcgctcagaaatcctcaccatctcccttcgccgtctcttccctccttccccaccctcagctcccccatcccatggccttcctcatctccatgcctggatagttggtcagagacactgggggtggtgggggaagatgccacagaagcaggcaagggacaggagctgctgagatgtcccttcaggtttcatggaagctcagaactggaagcgccaactgccacaatttggagatgaggcaatcgagacccagagagaggaaggaatgtgtccaagggcccccagtgtgtccatggctgactagggcatagaccttgggtctccccgctttcattccccactgcagccctcaggggctccctggaggcctcaccttccagagcccacagatggtgcttcaccagctccaccacctcctgcttgtcctcggagagcacgattccaaagccggccagcaggtaggagacatccgtggtgacccctgccctcaccttctggatagtgggtaccacgcccaccagcagcagcagggccacctggaagagccccacagtgagggccccatcccaggaaagggttttctgtgctaacaggggagacgctggggaagaaactggcagcacacaggccccagccacatgcccattgcccatcagtgttcttatctgccccttagagcagggatctcacgcctctaaatgaggacattacagacaggtgcaatcacagcctaataggccaaaggcatgccttcgagcaccgtaacttcatatagtcagccctgcgtatctgtgggttccacatccacaaccaaccaattcaatcaagcgcagatcaaaaatatttggggaaaaaccctcaataaaaaataacaattcaatacaaataatacaaataaaaaataatacagtaggacaacttcttcttttttttttttttttgagatggagtcttgctctgtggccaggctggagtgcagtggcgcgatctcggctcactgcaacctccacctcccaggttcaagcaattctcctgcctcagcctcctgagtagctgggactacaggcccgcgccaccaccgccagctaatttttatatttttagtagagacagggtttcactacattggctgggatggtctcaatctcttgacattgtgatccgcccgcctcagcctcccaaagtgctgggattacaggtgtgagccaccacacccagacataggacaactgtttacatagcacttatgttcgatattataagtactttagagataacgaggtatactggagaatgtgtgtaggctatatgcaaatactacaccatcgtatatcagaaatttgagcctttggattttggtatggaggggtgttcctggaaccaacccacctcagatactgagggatgactgtgtctgcacctctatctatttacccatcatctatctatctaaactttggaatgtaaaatttctggtttttctatgttgtgaaagtaaatgagcacaggaattaaagctggacagacttggattcaaacttaggctacgctgagatattagctgtgcagaaacttggccaagtcaaattcacctctccaagcttccattctccccatctgtaaagtggagaataatcatacccatctcccaggattttaattgttgttgttggttttttcggggttttttttttttcggaggtggtgaggcagagtttatcaaacatgttgtcttgctaaatcttcccaattactcaaagaggaaaattattctattttctcctttttacagatgagctaacaggttcagagaggttatataacttgcccaaggccacacaggaggtaaatagtggagctaggatttaaattcgtgtttatgtggcctccaaaattaatgctccgagtcacttcatgagtccaagagtgaacaccccggcccttctgggtaggccagaactcccaagatggcctgcagcacctggtcagggttctggatggagcacctggagagctgggttgggccggaactgctccaggcttgggggttgagggcagggctccagaggcagatggcagtacagggtgagggacatacctggtaaatggccgtccctgtcagtgtagctgaaagcaccagcttcagcgggagatggaatcctgtagtcctcaaaggaaggagtatggtgaacagcaccactcaggcccgggagccctcctccctcccaaggggcccaggaaaagggccagcaggaccctaaatgaccaaggccaggccagggtcttcccgctgtcccaagctggtagttgtccctcttgatgacaaggattctggggagcaggagccagtcctccactgcagccattctgtgcaagggagggtaacgtcccctgtcacgctcggcctcagctcccaaccccatacctggctgtggagtgtagatgcagtgtctcaagcagacgcgggcccaggacaggaagccatgcttggaggtgtggtagctgcagaaagacccaggcaggtgcggggtcctcaggggaagcccattccctgagggccagccccagaggctggtcattcttcccctctgcccctgccatgctgcccagtgccagcttcccaagcacggctgctaaccagcccaatccattggcccacaaagggtgtgtcagagaccccacctgcttcccagcttcttcctgcaaaggaggttcctcagatattcctcagagtagctgctctgcagcccctgtggagacagacaattgaacaagcagatgagatctgcctcgacccattcgtgggtccctggctcagggaactagagtgttcaccaagcaggtgctccataaaaacctgttggccatggcggtggtggtgagtgtggatggggctgacctgtggggatgaggtccgtgccctccaaagcttcccttttctctctcacaaatacaaggccagtctcctatcaaagaaccatcaatgccaggaagttcttcctaagatctgtctccaactctcgcctgctttactcagtcacatctcttcaccgtttcttcccacccctagccctctggcctctgctagctgaaactggggcaaagggaagcttgtgtcccacgggcacatcctagaccaggacacagaagagggtcattccaggtcagacaccctcaggcttctcctgctgccactgcgcaagggagatcacaagggtgaccagatttgtctaagccacattccaggccttaagctgcctgtgaagtagcagaggcccatgggaagatggggtgagcccctgcctggaatcactgggagaacacaggctgttgtcacttgttgccatgacaaccctgggatcccgggcaggagtgggtcagctcaaagcttgatgggggtcctttgagacttaaacctctttgaccaaagtccaaagaggattgtacacctctcaagcctgggaggaaaggctggcaatggagagagagatggggtggtggaaaccctggaagagaaggtaaaggggcatgcctcaggcactgtgtcgtcccggggggccgctcccttttcagagccagctgtaaacaggaggggacacaggcttcctcgaggggtgttggcctcaataggcaggagctacaagcgctcagaactccctgcctgccacgtgggagccgagtctggagtccgtgggccttctcggaccagagtagcccaaaagggacccggggttctccatcctgcctagggatctcactcactctctggattcagtctgaccttgccgagttaacacccggtcccagcccctctgctgagctccagactttgagcagtacaccctcaggaccaagcatcatcccaggagcacctgctcctccctccaccttccctgggccagcagctggcaccaccacctacctgctggctggccaggtgcctcccatcaagcctttccttcccctgccctgtctgaagagaagccacgccctttggcctctatgtcttaagactttctcctgagtctgttcttctttcccctttgagggtctctgcagagctttcttcctcctcctctctcaccagaaagaagtagtggaccccgccccctgcaccacagtcccaacacccggtgcaggtttcacattgcactgcaggtgttttgtgccgcatctgtctcccccaccacactgggagctcctggagatcagacacaagtccatcagctccaagtccacagcactgagcccggggcctgacatatggtaggtgcttagaaggctttttagtgagattgaagtatcttctaagaattctcttttaccatgatgcattcatccatccatccttccttccatacatctttccttcgatccatccatccattcatccatctattcaaaaattcaaaaatatttgctgagtatctattaagggccaagacccacccagtgctgcaaatataatgaacaaaacagacacaaaactatctcttcccctttactcatgctctttcccgtgcctacaatgcctgctccttattctctcatcactctagatctccctgtccttcaggcccttgtagagtctacctcctctaggaagccctctcagccctcccctttatctgaaattattcaaccacatccaacctagagttgactcataatggagttctgccctgggtgcttcctgaatcatctcattatgtgcagaactcggattaggcacaaggctccaggctgtctctccagccagatctcagtgtttcacagacagagatatgactctcctggcttctgactcagttctgctttgttaagtccctactattcacacagcccagtgccgcgggtatcctgggtgccagtcaagggcccagtccagcttttgcctagggagggaggactaagcagtcactcagcaaacattttctgagcatctattctgtgctgggccctacatcaagcacggccatgtatctgggaccacagatacgggggagtagggctgtcttgggtgctgaggaagagctcatcccaggcctgcccctttaccttggagcctgctcctgtcctacggctgaagcttctcaccagctgcacagggtaccaaaggctcaggaatccgaggcccagcaggagaggcagggaggccagcagggagtagtacttgtagatctggacagacaaacacccagacagactactttccaccttcttcccccagccaagaaccagaatccgttgcccttcccacctcacactgggccctgagggtggtctggggggccatgggaaggcttcagctctatggttcccaacctgccacccagcgcaaacctgcccacttccccttctcgagccctgcagagatgctcacccctcccccaggctcctggatccccacgggcctgagaggagccaagaggaggagatcacttgattccctcctgccccccactggaaaggacacctctttctgtttctgtgttcccggagcattaggaacagttctgaaaatcacacgaaagcctgcctttgcctacatatagttttcaacctgagcatcaggaaagtctatgccctactcctcagggctgaggccttcctgggggtgggctttttgtatactcattcatttatttgttggttcaatatacttttattgagagcttagtatgtgccaggttctaggtggtgaaaaaaagccaccaagttccccctctcaaagcaacctcttagtcttcacctccaccctgagggactggtgttatcagctccatggacggatggagaaacggtctcagaaaggtggcactgtttccccaaggcacttggtaccacctggcatcattttgtttgcgtgtcatgtctgcccttctgaagtgacggctcttgggaggctagggactgtttgtcttgttcatagctgtagtccagtgcctggaaatgtccctggtacaaagtatgtgcttcaaatatgttgttgaatgaatgggtgagtgaatgaatgaagtggtgaagctggattcacactcaggttgtctggctctaaagcctgtaccatcactctttgagttctagactggacagcttcacagccccagccagcagccagtgagcaaggtcctgaggttccggaattctcctctcagccctcttagaccatccctgacttcgcacttgccggcctccatcaagcttcactcccattccctctccagcctgaccaaagggaagctgggggatcactaacacaggcattgggggtgggggccatttcaggctttctcttccccctactctgcccacttccccttctccgccacctcctagacttaaagttcctgagggctgggcccagccaccttgttccctgcctctcctgcagagcagccaagcttggaaggggcacatgtttgaaggcatggaatcccatgcacaatggaaggctgcagggcggcccatcatagaatcagagctcaaaggaggcactgtggtttgagtaggttgctctgtgcgcccctctgccctaggccattgtgatcagcggttaccttgggcacctggggacactctgccctctgccagacctggaccccaaggtgggcccaggacagcgtgctgccgagcaggtgtgcagctgtgtggccagccgtggcacaggcagccagagggtagtagagggcagcataatagaacagtcccagtatcttccaggcccctggaaggtgaaacaagcagagagacccatgctggaggggcagacatggggcctgcagtgagcccacccaggcctctcttcggtctccagcttccaagcccttcagcacgttcagtgggcaagaacactaggttcaaatccaggctctgactagtctcaactctgtgatcttgggcaagttacctcttggagcctcagttttcccatctgtaaaatgaaaataatcacagtatattagcaagggcaaaatgagaaggtggatatataatgcttagcatggtgcctgagcaaatactcaatttaagatactacttccctggctctcagttcctccattgcaaaatggggctaatatgcatactttgtagcatcgttgtaaagactggatggtctaaaaaggtcacgtctcaggatagcagcccatctcattgacagctgttcctgttactctcatctccttgagccaagcttaaaactccgagaccccaccctaccccatcccatcacaccaaccccagggcctgggggtcagtgggtaccttggctgggtgctgaggcgagagtcaggaagggcaatgcgtcctcgtcggggagcagcaaacacagggagctcaggaggaccatgaaaacagcagcaggcactgcccggggcctgtccccagccaagaaatccacagggctagcacagaggcaaggacagggcaggagggagttgctcagcccctgcacccccattacctcccagctgtattccataaatcaaggaggtggagtcagtcccactttctagatgggggaataaggccccttcattcattcattccatagatatttgtggagtgcctcttatctaccaagctctgggccccgtgccaaagggacttgggacacacatacagtgggaagaagccctaagactgctcctccgcccaccctggaagctccaggaagcagccacctccacactaattggtctgtctgagctggcaaaccttcagagaactcagcgagtcacaacatccttgtacaacagccgccgccctgggctgggtgtggacccggggcagagggcagacagcgggcatagctgtcccaggcatcacccttctgggctcagggcaagccactcagacccacagcttctgcactgcagcttgcattcatgctctgagaggttcattctccctcaaacactgccccagccagggcaagctctttctggggccaaccagagaccccaggctggttccccacaaaaccagcacagcaagacctgcctcggtgcacagtctgggtctgggatgtgaagctgtctacaccaaggagccacccatcacctgccccaaccctttggtctctcgcacactagcttgcccagccccatctcctcaggatcatgcctgtccaggctctggagtcacagggctgaaggagataggagaagaaagctccagctataggggctagatgtcagtccccataaatctgccttcaagcattagggtccaggtgataccctcagggaagatgacggtcaagatggcattgggatggtcacgtcaatccacacatggagggctgcctgagaaggtacactctgacgctgggtcctgtcaggcttgtttccctagggtctgggttggagtcctttctcccaggcgggcttgagcgagtccctcccccttcctctgggggtcctgactaaacctggagacctaggtgggggtgaggaaagctccaggctgagggcgatagggatgtcattaaagccagagctgccttttaggtacctaacaaatcacccaccctcccagagggaccctgtcagctgggtcccctgagtgggggtgcccaggccatggtacaaacctgggcaggccgggcctgccacgcacacagtcaggccagagctggcggcgcctcaccagcatggccaggagcagcagcacaaggatctgaaaggagagtgcagaggagggcttggggtgcccaggcctcccctgagggtctgagtttgagggcttggactcaggccccaggatatcccctacctgcccagtgcacactcatgtgacatcttggggactggtcaaggggtgacagacatctggaaggttggacttgcatcctggtttgggcctccaagctgggagaactcccagatagctccccccacccaggatcttccagggccccccttcaccagccccagtggggaacacaggtcccactgcccaggctggcagcagcttgcaagccaggttcaacttgggttggactcactgacagcgaggccaggcaggcgtggtacaggccgggtggtatgctggtgtggcaggagggcacttccctgcagagcaaatgaaggctggctcaggcctgcgtcaggcccccctgggtgtgcagatgggtctggggttcaagactgttcacactgaggctttacccactacctccctcaaccctctgatccctcctacacaagccttcccagtcccaccttctcagggtcattctggggccctcgtgtccctgtgatgtgccagccccatgccaagctctggggttataagactaaaggacatgggaagctcccaggggaagcagagtagaccggctcggcctgatcacttattctcttttttttttttctggagggacagggtcttgctctgtcacccaggctggagtgcagtggctcgatctcggcttactgcagcctcagcctcctgggctcaaaagatcctcccacctcagcctcatgagtagctgggaccacaggtgtgcaccaccatgcctggcatttttttttctgtatttttagtagagacagggcctcaccatgtcgcccaggctggtcttggatttctgagctcaagcaatcctcatgcctcagcctcccaaagtgctgggattacaggtgtgagccactgtgcccggctgagcacttattcttgctcacccagatgcttcctgtccttcaaggcctcccctctccagggagcccctctgactgctcctggtctcacagacgtcttctcagaactgcagttgagcacactacctgggtcaagcagtcaagggtttggccctgtgattcgccctctactcactgccatctgaggttggtctgtgactaaaatgatctcccctggtccctctcttttcctgcttccctctcattgagagcctccatggacagccatgcaggttgcccactgcacaaagatgctcagccaagggaacgagcaggccaccctgctcaccaaacccagcacctgctgagctgaatgcacctaactggggatccctttctctaattccacagaggctccctatggcctggcaatggtcctgcactcaccctggctgagcgcagaggtaaacccacagtggagataggggtcactgaggacaatgaaaccctccgcttccccagcagaatcatgtggtggagaaagggagtgaggcaggagtcctgagctcagggctggccctggccctgggagagtaggcaggactgggtccctggtgagcagtagagctccgggttttcccagcttgggcctgggagagccagagggagggtggcagcatgggtgaggccagtggggtctggtgggcgagggcctgagatggagcctgggctgccgccagtccctgcctgcacagagggcttagccgcccaccaaaacgccctccactgtatgaagagaggcatcaaggctgcattatccaggggagtgcagagccctgggatgctctgctgggtcagctcggtctgtcctgctcgctttctctcaggaaatcccagcgggtgagcggtgggaaagaaaccagtcacttggtggagaggcagagtaagtcagctctgggcagcttcttggccaggagaccagcctcttcccaaagtagaactgggatcgtgagtagcagccacactgactccagtgtcagctccccacctccagctccaaggcctctcactctggtgcgtagggcagccctccctctcagccggcatctccccgcatgactaggtcccgctccacctttacacctgggcccggcagggacttggaaaactgtccctggagtagtttgaccattttcctatggaccttaccccaaaccacccctacccccagaaatgccctccagggccctgcctgggggagcctctggccctttctgtatcacctgaggtccccatctgacctctcagctcagtgtgaggggtcagatggggatctcaggtggcatagaaatgagcaaatatttggctagtggcttgtggccccactttttgtgccatgggacaggcaggatggcacagacataaagaccttggagagggtggtgagcttgatcctgggacaggcacagcaggtgctgaaggatgcagaggagggagaactttgggcaaaaggaggtggtatctgattggagtttaaaaaatggttagtggctgggagcagtggctcacgcctataatcccagcactttgggagactgaggcaggcagatcaaccaaggtcaagagtttgagaccagcctggccaacatgatgaaaccctgtctccactaaaaatacaaaaaaaattagctgggcgtggtggcacgcacctgtaatcccagctactcgggaggctgaggcaggagaatcacttgaactggggaagcggaggttgcagtgagccaagatcgcaccactgcactccaacccgggcaacaagagcgagactccatctcaaaaaataaataaataaaagttggttagcatctctttaggcaaagaaggggagaggcagctccaggtggagggaagtgcatgaggaagcagagaggcaggcgacaggcagcgtggctggggctgggcaggccttccagtttgattgcagcccagaggtcaggtgagatgaggttacagcaagcatgggaggccccaggaagccactgagggtgtttgagccattgaatgttctggattttaggacatttctgtggctgactccactgccatcagtgttcatccaccccaactccagcctgagagtgctggggcactgggcactccggagttcttcaaagctctgatgcaacatgtccccagggtgtctgactcacacagacagaggtgaacccaagttcatttccttgggattcccctgagctcccaattttctgctcccactttgagggcagggggatggcaggcagctcaattggtttggctaagtaagtagattcaaacaaatctctttattcttatggatgtcatgccctgcagtgggagaaagaagctgaatcttctagatgtcacccacatgagggactggactccccatcacccagtgcctgacatacacacaactttattctgagacaacagctatagaccacagctacatttacaggcacctggcccccagccagtgcccaggccctgaggctcccaaggacacagcttcagattagagccttcacctaggtcagaaaccatcctcatgggttcctgggcctgtcctcattctggtctctcgcaggccacacatacacagcaggatatgtggagcccacaggctctcggtcagtcaggcaagatgagtggggagcacgcccttgctgactgcaggctattttccaggtggtcagaaccctgagtcctccaaacaacagctccttccccgaggcctgggtggagcctctgtccctgctggatgacccaagcccagccaggccgcagccccagcccctggggaggcacgcaaggatttttccttctcaagtttcaggttttgatggagaacagatgtgcacacatctggctcggcaacccccagcctcacctttctacttctccaaaccgtcagacagagcagggagataagggatggggccaggcctgggaacaacaggggagaactggctctgggtcctacacaggcaagacatcctggcaggaggtgggggacacagaaggggcccagctcctccaccagggtgcccagactaaaccccggtagaatggacccaggcaaagcagctgtggctgggttctcaggccaccctggggcgggctgccttcctgctcccaccctcacctgggctggcctgagcacttctgctaaagggaataggctctcctcatcctctgagaccatccaaagacaacaagggtgcttgtttcctcagtgacttctcaccaggctttctccctttggttctctgccttccccgaatcccccagcctgcccagagaacttgacacttggaaacaccacacccaaatgctcaccacagagaccaataaccccttgaagggaggtctgcttgcctcaactgctctcagcagcttctccatcctggctatgggccagaatcacccagggagccatccctgcagatctgaatcatctgtatttttaacacgtcacacatcatacctaaggtgaccagccttaggtgtcttaacagcagggtgagggatgttgttctcatgtaacagaggcagagactgaatgaaccccagagaggctgtgacttgcccaaggtcacacagcaaatgagtggcagagccagacctagcagcccctgcccaggagctgctccctggccagttgcaacctctgccatcaccccattctgatggctgacagagtgaggtggggtggttccacacttacccctctggctggagctcctcgcccccctggggctcatcgatgtaccagctgccataggagtagtcctctgtggccccgggggaggtctggttccctgctggctgggacgacattctctggcccttctcctttgaccccaggcgagagaaaaaaaaagccactacagatgtgaaaagaggcttaaaagagaaaaaaaaagaaagaaagacggaaaacccaaacaaagaaacatttctctttaatcctgaaggttactttcttacttttagctctctgggaaaagcccgtctgggactgagggcctgagcaagctggcacgggaagaggacagggcctctcgtgtcccctcctcccttcccgcccatcgcactggtcctgcagagatagctgtccccttggggccccggggctcccgctggcgcatctgtctgaccaaccaccagcaggcgtgtgttcaaaggaccattttcaaagaaggcttgtccagtctgagctgcctaaagagacgccccttccttcccctttcccaagcccacctagacagacccacagacacaccagaagggaggcccagggaggaaggagttgcagagatgaaagggtaggcagcccacggccagctccgcactgcctgcctgggccctcccagctgggctcccttgagcccctcccccagcctcagcctgcccctttctggcccctttgggcctcggtgatggaaatacaccataatccttgacaaagcccccctcctgggggaggaggccccagcaccattggcggcctgagccctgcaagggtgtggccaggagccacccccacccccgcacctgacttcacacacatacctgccttcagcgcctgccccagagctcccaagcccctgcccgccacatctgcagtgccgcacacagacaggagaccagcattacagcaacaaccgagtgagacggaccgctggggctgggctggggcggaggcagggaaggggaatctgtccgtttcttctcctagggtttccatgaaggaggcaacatgtgtctcattggtaaaccctttttgttcctacaagttgatttcacaaggagataactcacccccacaaggcggaaattagctctttaaacacaaaccagacccacgggtaggcaagaggagccccgcctgcctcctgctcctcctggagtgaggttgagggtgagcaagggaaggtctgggccagggaggagggctcctccgcattctccctccccaggagcaggaccctgccccagcctggaggaaggggcgagaggcagaagaaggtagaaagcagttctcaggccactgtccctggtggaggtttaggcccctaaaactgtgagggtctctgtccttccaataccctacaaggggcttcggcttggaccctgtcagctaaggcagtcattcaacagcttttttaagaagacattattcatttagtcttttaacttaaatttattgaacacacactatgtgccagcactgttctgagccctgaggcaggagagatgacagttcagcggggacacagccagataactaaatcccctccaaagtctgagggttacaaagggaatcacaggttgagctggtctgtaccatgggaaaccaaatttagtccaagagcatttggggatggggggagattcctgaagaaaagaacctttccgtggtgatctgaagggcaggggaaagtccgctgagcagagggtggcaggctcaggatggggatgggggtgggggaaagtgtgttccccacagaggaaacagcacgggtgaagtctcagagtagacagggcttgaaatcctggaggctctctttcaaattcccaagcctgcagggcaggattaggggctgagcaccctgctagcctgagttcctcccccttcttcccaaatggcccttcttgcaggaagagggctctgttgctctccaccatcccacagagatatcagcatctgctgactcagagctgaacccgagctttatttgatgtaatgaggagcccacactggcccttctgatcccagggatgcgggaaacttgccttccaggcgcgagtgtgagctcccggagggcgggactctatccctcccacccctcctcctgccttcccctgatgctcagcgcctggcccttgggtaagagggacttcagaaattgagcttggcaaagccattgcttgttctggcggccagtattcatttgtgggcctgtcctatacaggcggctgctgtgccctgaggttcaccagctgggcttcccagagtccccgtgcccacaccagaggccagcaagcccttccctgctcaggggtctcagactgttaccttagggagcagccaactcccatctgattttaaatccacctccaaccattggagtccagttccagacagggagcccactccctctacaaggcagcagtgtcaggggttagacatccttgcctatcagaaaccatgccctttggccaggtgtggtggcttacacttgtaatcctagcactttgggaggccgaggcaggtggatcacctgaggtcaggagttagagacccagcctggccaacaaggcaaaatcccatctctactaaaaatacaaaaaattagccggacgtggtggcgcacacctgtaatcccagctactagggaggctgaggcaggagaatcgcttgaacccagggggcagaggttgcagtgagccaagatcgtgccactgcactccagcctggacaaaagaggcaaactccatctcaaaaaaaaagaaagaaagaaagaaaagaaaccatcctcttccttggaggaagcctaactctgccttccccaggctggtttggcagcgagcaagatgagtcaaggcctgcaccaaatggaacctgatgtatggtagggcttaggggagacaacaccagaggggaagtgaagtgggggaagagaagagagacgggagttggctgtttgagacaaggtggtcagggaaggcctcactgagaaggtggtgtgttgctgataccagaggggagagagggaggtaccagttgggcactgtgttcatctgtttcgcattgctgtgaaggaaaacctgactctgggtaacttagaaggaaagggggtttatgtggctcacagttctgcaggctgtgcaggaagcagcacggcaccagcatcagcttctggggagggcctcaggaaacccacaatcgtgatggaaggtgaaggggggtcaggcaggacacttggcaagagagggagcaggagagatgccaggcacttacaaatagccagctctcacatgaactgatagagcgagaactcactcattaccacagggagggcaccaagccattcaggagggataccccgcaatgacccaaacaccacacaccaggcctcacttccaacactggggtcacatttcaacatgagatttggagggcacacacatccaaaccatatcgggcactgaagaaaggcaatcaggttgcctgaaggagcctccatctgcccaggggctgcagccaggctggcagaaagggaccccagctgagcccaggcacagtcccttccccaccccccacggagagcccagtgccaacaataccacctccctcctcatgggaagacacagaggccaccaagggaggccctaagcagaggggaggaaatggtgagcttcgtccttttcccctggtgggggcctagcaagcagagcgcagccttgtgcctggtactttggccagggcatagctggaaggtccagaggtaagggccaggtttctgcatggcagtggagaacgcctggttggggaggccacctagccggatttgaaccctgggactggctatgtggccttgagtgagtcttttcctctctgtgggtctcactgtcctctctcaaatccggcctggagattctccagttgtgaactctccccacaaggcccccgtccctgcacaccagtaaccagttgtaacaagaaggtcacagagagtggttgtgacttcctaggtgcccccattgcctcccacctgccccctcctggcccccagctgccctgcccagtctggtgcgggcagggtgggcaggctgggttgaagatccatggatagcgggtggccgcgtggctcaagctgcaaggtgagcccacttcttgagcccaaggtacctcctcagcttggggctagaatcgcttggagctcccatctgcaaaatgggaggctcggctctgagctgttaagaaagatgctacctgggaagacggcaggaggcaagaagtgttaggaagagaaggatggtaatgatgtgcccctgaagaatttctccaaaggcctgggcagcagagtcaagggcctgccctctggagctggctttaaaggggcactgatacccaggaaggcccagccctgccctcaggagagcaaaagtgctcaaaagacagaactgccaaagcctgaggagcggggagggaaaggaggagatggcttgggcagtcttgcaggctccctggaggagggggcctggagcagggccctgaagccatggaagatctggaatggtaacaagaatgaattgacacgtgtctcaggagtgccaagaagggaagtctgagagacaaggagagagtagcataagggtcagggcagggctccctcgctgtgaccagcatgaacccacgtgggcactcagatgaggctgatgccagtatccaaggagcagctcaaaccagcaggtctcccaactgggcacagattggcgggtggctaagccctgctcactatgggaggaggtcctaaaaagcttctggactctgagccagtgaaggccatctgccatttgggcttggcacagagctgctatgcccctcgggttggagctggcccatgaaggccttgggacagggcttccttcctctcatgtttttgttcaagttgattaaacctgaggaatttttgcatccaggagcagaggcccacgtgcatttctgcgggagcctgtgattatcaaatcctcaaagggcaaagtgccaagcttagaagaagctaacagcaggccagaaggaatggggaaggccagcagcatccccagaacctcagaaacatcccctcaaggactcccagatctcccagagaacctccagaatctcagcaacatttctgagtttcagtaatgccataagaagccctgcaacctcagtattgcccccaagaagccccagaccttcagtaacacatcagaaccactgcaacacctcaggacactcaaactctggcaaactcaaactctggcaaatcaaccacagattggaacaagatgttcaaaagcctgtgaccatttgcagaaaggccagagacccccgttgctctccaccctcccatctcagcccttgactctgagtccagcagcaaacccaatagtttacaatactcaaacctcaggtacacccccaacttcgatagcacggaagagaacacgcaagagaggcgttccaggagtggggggatggccactgtgcccacctgtgcagcccagtccccttgagagtccatgaataagcagccgagagagtcaacctcatgcgggcccgtgagcttggggtgtgccctcagtggcacagcacactcacacacacatccaactgcccttcgcacacatacgtgcttaattctggcaccagaccaagtctgactccacacagtgggctggaaggcagtgtcgtcggctgccgtgctcacggcaggaagagtatgggtgactctccacctcctgtctctctacctcctacctcccctgccatgtgggagggtcagaagcaccatctgatgtgcccttcctgcaattctcatgcccccctcaccaacagcatcatcataacat

SEQ ID NO: 1024 - DNA, 29565 bp, Homo sapiens
tttctcaggaacaagtttattgcagggaacacactaacctctttcataatagccaaaggcataaaaactacaaaaatatctggctctcgagtgtgggcagctcagtgtgggacctggtctgagtcatgacttgggctgccctgcaggccagaggcccgggagctttccggccactccccagagaggtccgtggcgctgagggggtgaggaagtgccttggctgcttccacagcgtgaaggccaaggctgaggtggagctgggctggagtggttccagagaaggcttcatcgaggcccttcaaggctgatggcagagccagggtagggagacgcctggatgtggctgccctggctcaactggctcctggaccaaggccctaacccaccagtttctttctccagaacccctgctggctctcccatagccaagtgggtggagcagagccctcctgaggctcccagtgcagacagacctccacccaaccacagtgatccggaggacctgctggctgcatggctggtgtgatgctgggaggagagccggggagggaggaggatggtaggcaggaacatgcctcagcacagatgggcaggtgggttgaccttccctgccctcagggctgggcaccattggcacccaacagggccgtcttgcggaagacctgcagggttgggttgtgcagcagcgtgtaggccagaccccagcgagccctgccgcggctggccccgggcctagctcccttggccatggagtcctttgtctgtagcagctgcatccctgagagagacggactttctgtgagtcactcagcaaacacccagccaaccctccctggccctcagacctgatcagagagcctgaaaatcccaggcgtgtgcaggtcgtgaggcttaggatgtcccctgcaggcagcacatggaagtggggggtgaggtctgtggatggactggaagctgggtgggacaagggtctggagctggcttagtgtcccctccctacacacacttctgggcagaaggaaaggaggagtcatactccctgccccaagggagaagcgggggcagtgacggagccccttaggaaggcagctgtttcattctctctgtgtgcacacatatggtgtgtgtatgtgtgtgttcatatcatggaaaaaatcaccctgagatcagaccaggaggggtgaccaaaggcagccaaggaagagaggaagtgagaattttcctggcgctcactctgtgtgctggggaggggcacacatccttcctagaagaagctgggtaggctctattcccccattcccagtgggagggcgcaccttcgtcttcctcccctggtctgaggctgtcctggggggctgccatggtcctgggtaggaggctctgcgcttgcaggagcagggagcagaaggctgtcatggctggatgcgactggctgacttcaatcttcaagaagtttcggtacgtgtagtagcctggggtggggtggcggatggcaatgctgggggagcaggggccacactggaggcatccagacatcccctaacacacacacagggagtgcacgtgcactccctgcatccaagcatgtcgacacaccaagcacgtggcacattggctgcatgggcacgtgtggacctgctagaacaccccacatccactgcacgtgctgcagggccacaggaggcacagcgcaggggcacacaggtggcacatgcagctacaggcatcggtgtgaactgatcagctggcacggccctggggcagggcagatgccttcctcactgcttgggtagcctgagcaatcctccagccccgcccagtgaccttaccggggtcgagagtggcggctctcggtggcagcaggctgaggtccatctggccaaggtggatggcgttgtagagggcagagaggagcactcgccaggtggccaccatggcacccaccagcacattgagggggaagagaagaaaggtggctgcatagagcactcgcctaggatgggagaagaaagctgaggcaggccgttccccagagctccctccccagggtcagtgtcagacctggatgcccagaactgctgtgtatttactgagtgcctaccatttattgctatgtcttctgtgcaccccaccctgggcaaggccttctctctttcaacccaccatgctgggagatgggaaactgaggcccagagagattgggagacttagccaaggctgtcagctattcagtggcagagctgggctttaactctaggtccatctgagtctttctatgaccctgatgcctcccacctcccttttctgggtcccctgtctgctaattccaagttcccctgggagccaaggttctcccacagacttgtcatctgacagggaactcccttgctacaaagtggggaggggcatggttttaaggaaacagaggatccaggggagagcagtaccgattcccaaagcaagaaaggttcacgggggtacttccagccccatgccgggtatgtagagaggtactttggagtgggctgagccattgtcccttttctctatgggtaaggcaagctctttctactatcatctgggttccttgatagagagaagggatagatggcagtggagggaggacacaaaaagagagagacaccgaagaagaggcgagggcctgagggagccacaagcccagatgccacctcaccggttggtcagctgtgggtgtccatcatgagtctccaggaagacccaatgggctgccatgttctgcaggatcacagccagggccaaagtcagccagaagggcctgccagtggggtggggaggtggtcgctgttagcggacctctaaggagtccctgagccctccatgtcttgtttcactcaccacgaggactccagggaacggaagagcaggaggttcctgccatggagcacaggcatgagcaccaggaaggccagggccgtggttcccaggaagaagatgatctgctgcaccaggagccctgccaggggcgggagtggcagggggacagaaaacaggttccatgaaaactggccatccccgctgcccccagaaccaagggctttgggattgggcaggcctggttttagatctctgctctgccactgcctagctatgctgccttgaacaaatcactttacttcattgagcctcagtttcttcctctgtaaaatggggataatagtccctacctcagaggctgttgtaaggatccaatgagataatgtctgtggaaactcttaaaatcacaaaatactttgcaaatgttatttccctccagtttctcctgagtttgagttactgggggataaggctacatattaaactgatgtttgcattccttcaagccagagcctggcatacggtaggtgcccaaggactgtctattgaaataatctggccaactgattagagaatgatgtctacaaaagggcctggaggcataagggctaccaagaagagacgctatgacttttgtcctagtaattcatctactcctttaccatccttctcctcccgcaaggaggtgagaatggaaggaactggagggagagatacaaggcccttggatgtgcaacccaggccacagcccctcaccattcagagtgcttttctcactgcagtacccaaggggagagtcagaaacttggggctggtaggggtcctggaaggttatctggtccaactctctcagggcaggaccccctttgcagactgcaacaatatccatggaactctgcttgcatacccccagtgacagggatctcattacctttgtaggtagccaaatgtgacacagccctttcttaagctggagcgcagtggtgcaatctcggctcactgcaacctccacctcctgggttcaagcgattctcctgcctcatcctcccgaatagctggaactgcaggtgcacaccaccatacccggctaatttttgtatttttagtagagacggggtctcaccatgttggccaggctggtcttcatctcctgacttcgtgatccacctgcctcagcctcccaaagtgctgggattacaggtgtgagccactgagcccagccaggaatgtaccattttgaatttgacacctccagacctgggtccacccccatgtgaatacttggtggcacccagggttcatctccatgtggagggtacacactcaatttcccgagggctcctgtacccccatcctgaataagcttcttaagggcagggaaggcaggggggtccctccttcttgctgctgccccagagcattcccagacaaactctgagggcagtacttgctgagcactcttctccccaactgaggccagtgtctgaggggaggcccaggccaaggctgggtgtggcgggcaagggaggctcaccaaggcagataaaggctgtctggtaggcactgaagctcatccaacagaatatggcttggcgggagggatggggactccgatgcaagggactcaagtccagggcagctcctcggtgcagagctcgaaggttggtcctggggtgggagccagggaggcagagacctcagggagcaacacactcttcctaaatcctcctctgggccagcaactggccaaactcccaatagaatttcaactcacagccatcagcagggaagcccagaactgtgggagccaggaggaggccactaacccaagatatctggaagaggtgatatctgggtagtcttaaacagtgaacgaggaatacaaaacgaggcagaaggctcaacctgagccaagtcagaaaagtgagaaacaacagtgagaatggaagtgacacacagcacagccaacaggtaaagaggcaaggcaagcacaggctgaggagccttgaatgccagaagaaggaggggtgacctgtggaaaaagatccctgggaagagctctgagacctggcaagtgcgcaggagacatgggccagttctctgacatgggtaagtgctcgggctgccccttccacctgccctgggccttcagtgctcctcaccactcaccgctgcagggcaagcaaggtggcatggcgagacccgtaccacctctccagtgtgctatgccaccaggctacccctcacctacactctcacatggcagggccaccccagcctctgttctcgtccacacagtcctcacctcctatctccttccattcccgggcaggtgcagcttccccaggccaccttccctctcatccagcccacccggtggcccctactcagggggcaagctccactagctgccctgagttggtggtgccctatgtccctcacactcacagacgtttccccaaccagacaggaaggcccaagggcaggacccagccccaccttctcccactgcagcgcagccacgcacaggtgggctccatgacagcccgggccggcagagcccttccctccctccaggcccagggcctccccgcaggcccacaggactcccactccttccccacctcggcgctgggtgagccagagtctgtcactcacctgtgtgtcaccagtgagcgcatcaggaccaggaaggtgagtaagcaggacaagaccaaggctgagatgtagcacactggtgggcagagaatgagcaaagtgagaggtcagggtctggagagtctcctggaggcctcagaacccctgccagggtggtgccttgtggggagttccccctgccccaaactgaactctgtgtggaagcctcttggccccacccccaggtctcagatgcagtgtaagccaatgacttcggccaccccattcttcccagtgacatacagtggtcaagagatgaaaccagctctgagtctgcagacctagtcctcaccctgctgttgctgcttctattgctgtgggacctccatccaacctggcatctgcctccagcttcactgcttcttggccatgtggccttcaggagggcactccttctccccaggcccccatttgctcgtgaacataccgcacgccgttatgctgcccagctctcaggataatgtgagccataaggccccatccacgtctgcactaatggtcttcgttcagggcatagagggtgtgagtccacatcggtgtggactgagtccatcagaatagggaggcagccgctgtcacccagctccctcaccctctccctggccatgcacacaatgagtgtgtgcatgatggtgtgtcatgaacaagcctgggtgtttaagaatttcaggggtgcaggctgcaactctcccaccttacgtccacatccagtcttgctctggactgtaacagcaaccccgcaaggttagacagaagaactgttcccactgggctgaagaggaagctgaggctcagagagagggcttcgcccagacagccatgctgctaggaatgatagagtgaggtgtgtaaccatttctaagcagatccagaatgagcctgagatgcctgcaccctgatctcatcagtcagtccagggaagtgttcctggtgcccgtgtcaccaccagaatctcaaggacggggagagcaaacacagaaaaggtgagtgctagttccacatagccacagggattagagtggtggatctcagcaccgatagcgcctttaggatcacctggagctgctaaaactcgcccatagcccagcctgcacccaaaccagttaaatcagaatttctgtgggtgggacccagccttagcctgtgaaagcaacactggtgattcagtgtgcagtcaggactgacagccactgctctgggggctttccaaaggcagagccttcatgatttatttccatcagaaatgaattgaaatcaaccaaccaaccaatatttattgggtgcctactacagtggtgatcaaactttgcttgcatgagaatcactgggactgtgatcccaacactttggaaggctgaggcggtggatcacctggggtcagaagttcgagaccagcctgaccaatatggtgaaactccgtctctactaaaaatacaaaaattagccaggcctggtggcgggcccctgtaatcccagctactcgggaggctgagatgggagaatcacttgaacctgagagacggaggttgcagtgagccgagattgtgccacggcactccaccctgggagacagaatgagactccgtctcaaaacaaaacaaaattagccgggcctggtggtatgtgcctgtaatcccagctactcgggaggctgaaatgggagaattgcttgaacccaggaggtggaggttgcagtgagccgagattgcaccactgcactccagcctgggcgacagagcacaactccatctcaaaagaaaaaaaaaatcactgggagggctgttcactcaaagaggctgggccccactctgagagtttctgattcagtaggtctggcacagggcttgagcaacgggaatgttaaagccaccaggtgcttcccagattcagccagggctaaaaatgatgctacagaaacctaggcccttctgctggtccctagctccctcctccagggccctcgcagggacacttttctcagaagcaaggttgggagaaagcactgtgcatgcatagctccagcctctgtggtcccccttctggagccagctgggctgcagcgagggcacattctggaccatttgctgccaggaggtgaacagcccgcctgctgagcctggcctggtgagtgtacaggctaacacagggttgaagggttagcagcccccttggccacaggcctggcctttgatctccatccatctacctcctacctctctctccctccactggttcccaacttgggcacccccaaaccccagcactcacacaatcttcctgctctttgccacctctgggatcctgtgcctgccttcttctgggccctgctttgggggatagatctgtcttccctcatgtgattgagggcctcaagggcaagtgttcctttttcactccagcactcattttgcagttggggaaattgaggtcaggagaggtaatgcactttgcccaaggtcactcagcttgtaagtgatggaacagagattctaatctagtttgcctgactcagtctgagctctctgtgagtgatgccaggcttatggtccaagtgctgggtggcagtcctaacagaagctctgagctcagaagacattagctccttaggcgaaggacagaccaagggacactggagcccaggttgcgggatggctttggccgtatctgtaatcctcctgggcctcagtattcctcatctgcaaatttaaagagtaactgttgctctgtttggcccaagaagattcaaagtgggagcctttgagcttggaaactgcaacatgcaattaaaaatataagacatgatgagtggaagcagagtcctttgccctggatgtgtctcattttgtctttgagcctcaatgtcctgccctgtgagctgggatcaatgatgctgacctacagggtcactgtgagcaagggtctgaggttggttgtgggctgacctggaccatgtctgcacctgcctatgaaccagattgcaaccagctcagaaaatctcctgggagaggacattttcagctcacccggaacttgtcacctgtccagtttgttgccctcagcagcagttccagggcagcctctagtacgggaactgaggtgctcacggagatggtggaggtggtcagggaaggaagtggtcactccgtgcacctctgcccaccccccactccctgccccgccatgaccagcatgcccaggtctgtaggataaggatgatgttaatggtcaggtacagctgcggagcagctacacctccacctgcaacgctggcagcccacgctctgaccacatgttactcctcagaagccgggggcccatccgtcccagcctggggtccccaagtaagcagaaggcgcatgcctcctgagtcctcagcaccgggctttgtcccaaggtgatggagaaggcccccgcctaggcttcaggagccctgcgttctcttggctgcactctgccctgctggatggcctcaggcaaatccttccccatgtgtcaagtggggacacttctcagtcccctccacagcgctgttgggagcgcccaggaggcagagtaagtaggtggctgcaggaggcatcagaccacagaaggggaagccaagatggttccctggttcaggagctcattgtcagaggagggaaggagaaaggagacggccccaaaagacagggagtggggaagagaaagcctgtgccctgcccaacgccagacccctgccacgaggattcgctcagaaatcctcaccatctcccttcgccgtctcttccctccttccccaccctcagctcccccatcccatggccttcctcatctccatgcctggatagttggtcagagacactgggggtggtgggggaagatgccacagaagcaggcaagggacaggagctgctgagatgtcccttcaggtttcatggaagctcagaactggaagcgccaactgccacaatttggagatgaggcaatcgagacccagagagaggaaggaatgtgtccaagggcccccagtgtgtccatggctgactagggcatagaccttgggtctccccgctttcattccccactgcagccctcaggggctccctggaggcctcaccttccagagcccacagatggtgcttcaccagctccaccacctcctgcttgtcctcggagagcacgattccaaagccggccagcaggtaggagacatccgtggtgacccctgccctcaccttctggatagtgggtaccacgcccaccagcagcagcagggccacctggaagagccccacagtgagggccccatcccaggaaagggttttctgtgctaacaggggagacgctggggaagaaactggcagcacacaggccccagccacatgcccattgcccatcagtgttcttatctgccccttagagcagggatctcacgcctctaaatgaggacattacagacaggtgcaatcacagcctaataggccaaaggcatgccttcgagcaccgtaacttcatatagtcagccctgcgtatctgtgggttccacatccacaaccaaccaattcaatcaagcgcagatcaaaaatatttggggaaaaaccctcaataaaaaataacaattcaatacaaataatacaaataaaaaataatacagtaggacaacttcttcttttttttttttttttgagatggagtcttgctctgtggccaggctggagtgcagtggcgcgatctcggctcactgcaacctccacctcccaggttcaagcaattctcctgcctcagcctcctgagtagctgggactacaggcccgcgccaccaccgccagctaatttttatatttttagtagagacagggtttcactacattggctgggatggtctcaatctcttgacattgtgatccgcccgcctcagcctcccaaagtgctgggattacaggtgtgagccaccacacccagacataggacaactgtttacatagcacttatgttcgatattataagtactttagagataacgaggtatactggagaatgtgtgtaggctatatgcaaatactacaccatcgtatatcagaaatttgagcctttggattttggtatggaggggtgttcctggaaccaacccacctcagatactgagggatgactgtgtctgcacctctatctatttacccatcatctatctatctaaactttggaatgtaaaatttctggtttttctatgttgtgaaagtaaatgagcacaggaattaaagctggacagacttggattcaaacttaggctacgctgagatattagctgtgcagaaacttggccaagtcaaattcacctctccaagcttccattctccccatctgtaaagtggagaataatcatacccatctcccaggattttaattgttgttgttggttttttcggggttttttttttttcggaggtggtgaggcagagtttatcaaacatgttgtcttgctaaatcttcccaattactcaaagaggaaaattattctattttctcctttttacagatgagctaacaggttcagagaggttatataacttgcccaaggccacacaggaggtaaatagtggagctaggatttaaattcgtgtttatgtggcctccaaaattaatgctccgagtcacttcatgagtccaagagtgaacaccccggcccttctgggtaggccagaactcccaagatggcctgcagcacctggtcagggttctggatggagcacctggagagctgggttgggccggaactgctccaggcttgggggttgagggcagggctccagaggcagatggcagtacagggtgagggacatacctggtaaatggccgtccctgtcagtgtagctgaaagcaccagcttcagcgggagatggaatcctgtagtcctcaaaggaaggagtatggtgaacagcaccactcaggcccgggagccctcctccctcccaaggggcccaggaaaagggccagcaggaccctaaatgaccaaggccaggccagggtcttcccgctgtcccaagctggtagttgtccctcttgatgacaaggattctggggagcaggagccagtcctccactgcagccattctgtgcaagggagggtaacgtcccctgtcacgctcggcctcagctcccaaccccatacctggctgtggagtgtagatgcagtgtctcaagcagacgcgggcccaggacaggaagccatgcttggaggtgtggtagctgcagaaagacccaggcaggtgcggggtcctcaggggaagcccattccctgagggccagccccagaggctggtcattcttcccctctgcccctgccatgctgcccagtgccagcttcccaagcacggctgctaaccagcccaatccattggcccacaaagggtgtgtcagagaccccacctgcttcccagcttcttcctgcaaaggaggttcctcagatattcctcagagtagctgctctgcagcccctgtggagacagacaattgaacaagcagatgagatctgcctcgacccattcgtgggtccctggctcagggaactagagtgttcaccaagcaggtgctccataaaaacctgttggccatggcggtggtggtgagtgtggatggggctgacctgtggggatgaggtccgtgccctccaaagcttcccttttctctctcacaaatacaaggccagtctcctatcaaagaaccatcaatgccaggaagttcttcctaagatctgtctccaactctcgcctgctttactcagtcacatctcttcaccgtttcttcccacccctagccctctggcctctgctagctgaaactggggcaaagggaagcttgtgtcccacgggcacatcctagaccaggacacagaagagggtcattccaggtcagacaccctcaggcttctcctgctgccactgcgcaagggagatcacaagggtgaccagatttgtctaagccacattccaggccttaagctgcctgtgaagtagcagaggcccatgggaagatggggtgagcccctgcctggaatcactgggagaacacaggctgttgtcacttgttgccatgacaaccctgggatcccgggcaggagtgggtcagctcaaagcttgatgggggtcctttgagacttaaacctctttgaccaaagtccaaagaggattgtacacctctcaagcctgggaggaaaggctggcaatggagagagagatggggtggtggaaaccctggaagagaaggtaaaggggcatgcctcaggcactgtgtcgtcccggggggccgctcccttttcagagccagctgtaaacaggaggggacacaggcttcctcgaggggtgttggcctcaataggcaggagctacaagcgctcagaactccctgcctgccacgtgggagccgagtctggagtccgtgggccttctcggaccagagtagcccaaaagggacccggggttctccatcctgcctagggatctcactcactctctggattcagtctgaccttgccgagttaacacccggtcccagcccctctgctgagctccagactttgagcagtacaccctcaggaccaagcatcatcccaggagcacctgctcctccctccaccttccctgggccagcagctggcaccaccacctacctgctggctggccaggtgcctcccatcaagcctttccttcccctgccctgtctgaagagaagccacgccctttggcctctatgtcttaagactttctcctgagtctgttcttctttcccctttgagggtctctgcagagctttcttcctcctcctctctcaccagaaagaagtagtggaccccgccccctgcaccacagtcccaacacccggtgcaggtttcacattgcactgcaggtgttttgtgccgcatctgtctcccccaccacactgggagctcctggagatcagacacaagtccatcagctccaagtccacagcactgagcccggggcctgacatatggtaggtgcttagaaggctttttagtgagattgaagtatcttctaagaattctcttttaccatgatgcattcatccatccatccttccttccatacatctttccttcgatccatccatccattcatccatctattcaaaaattcaaaaatatttgctgagtatctattaagggccaagacccacccagtgctgcaaatataatgaacaaaacagacacaaaactatctcttcccctttactcatgctctttcccgtgcctacaatgcctgctccttattctctcatcactctagatctccctgtccttcaggcccttgtagagtctacctcctctaggaagccctctcagccctcccctttatctgaaattattcaaccacatccaacctagagttgactcataatggagttctgccctgggtgcttcctgaatcatctcattatgtgcagaactcggattaggcacaaggctccaggctgtctctccagccagatctcagtgtttcacagacagagatatgactctcctggcttctgactcagttctgctttgttaagtccctactattcacacagcccagtgccgcgggtatcctgggtgccagtcaagggcccagtccagcttttgcctagggagggaggactaagcagtcactcagcaaacattttctgagcatctattctgtgctgggccctacatcaagcacggccatgtatctgggaccacagatacgggggagtagggctgtcttgggtgctgaggaagagctcatcccaggcctgcccctttaccttggagcctgctcctgtcctacggctgaagcttctcaccagctgcacagggtaccaaaggctcaggaatccgaggcccagcaggagaggcagggaggccagcagggagtagtacttgtagatctggacagacaaacacccagacagactactttccaccttcttcccccagccaagaaccagaatccgttgcccttcccacctcacactgggccctgagggtggtctggggggccatgggaaggcttcagctctatggttcccaacctgccacccagcgcaaacctgcccacttccccttctcgagccctgcagagatgctcacccctcccccaggctcctggatccccacgggcctgagaggagccaagaggaggagatcacttgattccctcctgccccccactggaaaggacacctctttctgtttctgtgttcccggagcattaggaacagttctgaaaatcacacgaaagcctgcctttgcctacatatagttttcaacctgagcatcaggaaagtctatgccctactcctcagggctgaggccttcctgggggtgggctttttgtatactcattcatttatttgttggttcaatatacttttattgagagcttagtatgtgccaggttctaggtggtgaaaaaaagccaccaagttccccctctcaaagcaacctcttagtcttcacctccaccctgagggactggtgttatcagctccatggacggatggagaaacggtctcagaaaggtggcactgtttccccaaggcacttggtaccacctggcatcattttgtttgcgtgtcatgtctgcccttctgaagtgacggctcttgggaggctagggactgtttgtcttgttcatagctgtagtccagtgcctggaaatgtccctggtacaaagtatgtgcttcaaatatgttgttgaatgaatgggtgagtgaatgaatgaagtggtgaagctggattcacactcaggttgtctggctctaaagcctgtaccatcactctttgagttctagactggacagcttcacagccccagccagcagccagtgagcaaggtcctgaggttccggaattctcctctcagccctcttagaccatccctgacttcgcacttgccggcctccatcaagcttcactcccattccctctccagcctgaccaaagggaagctgggggatcactaacacaggcattgggggtgggggccatttcaggctttctcttccccctactctgcccacttccccttctccgccacctcctagacttaaagttcctgagggctgggcccagccaccttgttccctgcctctcctgcagagcagccaagcttggaaggggcacatgtttgaaggcatggaatcccatgcacaatggaaggctgcagggcggcccatcatagaatcagagctcaaaggaggcactgtggtttgagtaggttgctctgtgcgcccctctgccctaggccattgtgatcagcggttaccttgggcacctggggacactctgccctctgccagacctggaccccaaggtgggcccaggacagcgtgctgccgagcaggtgtgcagctgtgtggccagccgtggcacaggcagccagagggtagtagagggcagcataatagaacagtcccagtatcttccaggcccctggaaggtgaaacaagcagagagacccatgctggaggggcagacatggggcctgcagtgagcccacccaggcctctcttcggtctccagcttccaagcccttcagcacgttcagtgggcaagaacactaggttcaaatccaggctctgactagtctcaactctgtgatcttgggcaagttacctcttggagcctcagttttcccatctgtaaaatgaaaataatcacagtatattagcaagggcaaaatgagaaggtggatatataatgcttagcatggtgcctgagcaaatactcaatttaagatactacttccctggctctcagttcctccattgcaaaatggggctaatatgcatactttgtagcatcgttgtaaagactggatggtctaaaaaggtcacgtctcaggatagcagcccatctcattgacagctgttcctgttactctcatctccttgagccaagcttaaaactccgagaccccaccctaccccatcccatcacaccaaccccagggcctgggggtcagtgggtaccttggctgggtgctgaggcgagagtcaggaagggcaatgcgtcctcgtcggggagcagcaaacacagggagctcaggaggaccatgaaaacagcagcaggcactgcccggggcctgtccccagccaagaaatccacagggctagcacagaggcaaggacagggcaggagggagttgctcagcccctgcacccccattacctcccagctgtattccataaatcaaggaggtggagtcagtcccactttctagatgggggaataaggccccttcattcattcattccatagatatttgtggagtgcctcttatctaccaagctctgggccccgtgccaaagggacttgggacacacatacagtgggaagaagccctaagactgctcctccgcccaccctggaagctccaggaagcagccacctccacactaattggtctgtctgagctggcaaaccttcagagaactcagcgagtcacaacatccttgtacaacagccgccgccctgggctgggtgtggacccggggcagagggcagacagcgggcatagctgtcccaggcatcacccttctgggctcagggcaagccactcagacccacagcttctgcactgcagcttgcattcatgctctgagaggttcattctccctcaaacactgccccagccagggcaagctctttctggggccaaccagagaccccaggctggttccccacaaaaccagcacagcaagacctgcctcggtgcacagtctgggtctgggatgtgaagctgtctacaccaaggagccacccatcacctgccccaaccctttggtctctcgcacactagcttgcccagccccatctcctcaggatcatgcctgtccaggctctggagtcacagggctgaaggagataggagaagaaagctccagctataggggctagatgtcagtccccataaatctgccttcaagcattagggtccaggtgataccctcagggaagatgacggtcaagatggcattgggatggtcacgtcaatccacacatggagggctgcctgagaaggtacactctgacgctgggtcctgtcaggcttgtttccctagggtctgggttggagtcctttctcccaggcgggcttgagcgagtccctcccccttcctctgggggtcctgactaaacctggagacctaggtgggggtgaggaaagctccaggctgagggcgatagggatgtcattaaagccagagctgccttttaggtacctaacaaatcacccaccctcccagagggaccctgtcagctgggtcccctgagtgggggtgcccaggccatggtacaaacctgggcaggccgggcctgccacgcacacagtcaggccagagctggcggcgcctcaccagcatggccaggagcagcagcacaaggatctgaaaggagagtgcagaggagggcttggggtgcccaggcctcccctgagggtctgagtttgagggcttggactcaggccccaggatatcccctacctgcccagtgcacactcatgtgacatcttggggactggtcaaggggtgacagacatctggaaggttggacttgcatcctggtttgggcctccaagctgggagaactcccagatagctccccccacccaggatcttccagggccccccttcaccagccccagtggggaacacaggtcccactgcccaggctggcagcagcttgcaagccaggttcaacttgggttggactcactgacagcgaggccaggcaggcgtggtacaggccgggtggtatgctggtgtggcaggagggcacttccctgcagagcaaatgaaggctggctcaggcctgcgtcaggcccccctgggtgtgcagatgggtctggggttcaagactgttcacactgaggctttacccactacctccctcaaccctctgatccctcctacacaagccttcccagtcccaccttctcagggtcattctggggccctcgtgtccctgtgatgtgccagccccatgccaagctctggggttataagactaaaggacatgggaagctcccaggggaagcagagtagaccggctcggcctgatcacttattctcttttttttttttctggagggacagggtcttgctctgtcacccaggctggagtgcagtggctcgatctcggcttactgcagcctcagcctcctgggctcaaaagatcctcccacctcagcctcatgagtagctgggaccacaggtgtgcaccaccatgcctggcatttttttttctgtatttttagtagagacagggcctcaccatgtcgcccaggctggtcttggatttctgagctcaagcaatcctcatgcctcagcctcccaaagtgctgggattacaggtgtgagccactgtgcccggctgagcacttattcttgctcacccagatgcttcctgtccttcaaggcctcccctctccagggagcccctctgactgctcctggtctcacagacgtcttctcagaactgcagttgagcacactacctgggtcaagcagtcaagggtttggccctgtgattcgccctctactcactgccatctgaggttggtctgtgactaaaatgatctcccctggtccctctcttttcctgcttccctctcattgagagcctccatggacagccatgcaggttgcccactgcacaaagatgctcagccaagggaacgagcaggccaccctgctcaccaaacccagcacctgctgagctgaatgcacctaactggggatccctttctctaattccacagaggctccctatggcctggcaatggtcctgcactcaccctggctgagcgcagaggtaaacccacagtggagataggggtcactgaggacaatgaaaccctccgcttccccagcagaatcatgtggtggagaaagggagtgaggcaggagtcctgagctcagggctggccctggccctgggagagtaggcaggactgggtccctggtgagcagtagagctccgggttttcccagcttgggcctgggagagccagagggagggtggcagcatgggtgaggccagtggggtctggtgggcgagggcctgagatggagcctgggctgccgccagtccctgcctgcacagagggcttagccgcccaccaaaacgccctccactgtatgaagagaggcatcaaggctgcattatccaggggagtgcagagccctgggatgctctgctgggtcagctcggtctgtcctgctcgctttctctcaggaaatcccagcgggtgagcggtgggaaagaaaccagtcacttggtggagaggcagagtaagtcagctctgggcagcttcttggccaggagaccagcctcttcccaaagtagaactgggatcgtgagtagcagccacactgactccagtgtcagctccccacctccagctccaaggcctctcactctggtgcgtagggcagccctccctctcagccggcatctccccgcatgactaggtcccgctccacctttacacctgggcccggcagggacttggaaaactgtccctggagtagtttgaccattttcctatggaccttaccccaaaccacccctacccccagaaatgccctccagggccctgcctgggggagcctctggccctttctgtatcacctgaggtccccatctgacctctcagctcagtgtgaggggtcagatggggatctcaggtggcatagaaatgagcaaatatttggctagtggcttgtggccccactttttgtgccatgggacaggcaggatggcacagacataaagaccttggagagggtggtgagcttgatcctgggacaggcacagcaggtgctgaaggatgcagaggagggagaactttgggcaaaaggaggtggtatctgattggagtttaaaaaatggttagtggctgggagcagtggctcacgcctataatcccagcactttgggagactgaggcaggcagatcaaccaaggtcaagagtttgagaccagcctggccaacatgatgaaaccctgtctccactaaaaatacaaaaaaaattagctgggcgtggtggcacgcacctgtaatcccagctactcgggaggctgaggcaggagaatcacttgaactggggaagcggaggttgcagtgagccaagatcgcaccactgcactccaacccgggcaacaagagcgagactccatctcaaaaaataaataaataaaagttggttagcatctctttaggcaaagaaggggagaggcagctccaggtggagggaagtgcatgaggaagcagagaggcaggcgacaggcagcgtggctggggctgggcaggccttccagtttgattgcagcccagaggtcaggtgagatgaggttacagcaagcatgggaggccccaggaagccactgagggtgtttgagccattgaatgttctggattttaggacatttctgtggctgactccactgccatcagtgttcatccaccccaactccagcctgagagtgctggggcactgggcactccggagttcttcaaagctctgatgcaacatgtccccagggtgtctgactcacacagacagaggtgaacccaagttcatttccttgggattcccctgagctcccaattttctgctcccactttgagggcagggggatggcaggcagctcaattggtttggctaagtaagtagattcaaacaaatctctttattcttatggatgtcatgccctgcagtgggagaaagaagctgaatcttctagatgtcacccacatgagggactggactccccatcacccagtgcctgacatacacacaactttattctgagacaacagctatagaccacagctacatttacaggcacctggcccccagccagtgcccaggccctgaggctcccaaggacacagcttcagattagagccttcacctaggtcagaaaccatcctcatgggttcctgggcctgtcctcattctggtctctcgcaggccacacatacacagcaggatatgtggagcccacaggctctcggtcagtcaggcaagatgagtggggagcacgcccttgctgactgcaggctattttccaggtggtcagaaccctgagtcctccaaacaacagctccttccccgaggcctgggtggagcctctgtccctgctggatgacccaagcccagccaggccgcagccccagcccctggggaggcacgcaaggatttttccttctcaagtttcaggttttgatggagaacagatgtgcacacatctggctcggcaacccccagcctcacctttctacttctccaaaccgtcagacagagcagggagataagggatggggccaggcctgggaacaacaggggagaactggctctgggtcctacacaggcaagacatcctggcaggaggtgggggacacagaaggggcccagctcctccaccagggtgcccagactaaaccccggtagaatggacccaggcaaagcagctgtggctgggttctcaggccaccctggggcgggctgccttcctgctcccaccctcacctgggctggcctgagcacttctgctaaagggaataggctctcctcatcctctgagaccatccaaagacaacaagggtgcttgtttcctcagtgacttctcaccaggctttctccctttggttctctgccttccccgaatcccccagcctgcccagagaacttgacacttggaaacaccacacccaaatgctcaccacagagaccaataaccccttgaagggaggtctgcttgcctcaactgctctcagcagcttctccatcctggctatgggccagaatcacccagggagccatccctgcagatctgaatcatctgtatttttaacacgtcacacatcatacctaaggtgaccagccttaggtgtcttaacagcagggtgagggatgttgttctcatgtaacagaggcagagactgaatgaaccccagagaggctgtgacttgcccaaggtcacacagcaaatgagtggcagagccagacctagcagcccctgcccaggagctgctccctggccagttgcaacctctgccatcaccccattctgatggctgacagagtgaggtggggtggttccacacttacccctctggctggagctcctcgcccccctggggctcatcgatgtaccagctgccataggagtagtcctctgtggccccgggggaggtctggttccctgctggctgggacgacattctctggcccttctcctttgaccccaggcgagagaaaaaaaaagccactacagatgtgaaaagaggcttaaaagagaaaaaaaaagaaagaaagacggaaaacccaaacaaagaaacatttctctttaatcctgaaggttactttcttacttttagctctctgggaaaagcccgtctgggactgagggcctgagcaagctggcacgggaagaggacagggcctctcgtgtcccctcctcccttcccgcccatcgcactggtcctgcagagatagctgtccccttggggccccggggctcccgctggcgcatctgtctgaccaaccaccagcaggcgtgtgttcaaaggaccattttcaaagaaggcttgtccagtctgagctgcctaaagagacgccccttccttcccctttcccaagcccacctagacagacccacagacacaccagaagggaggcccagggaggaaggagttgcagagatgaaagggtaggcagcccacggccagctccgcactgcctgcctgggccctcccagctgggctcccttgagcccctcccccagcctcagcctgcccctttctggcccctttgggcctcggtgatggaaatacaccataatccttgacaaagcccccctcctgggggaggaggccccagcaccattggcggcctgagccctgcaagggtgtggccaggagccacccccacccccgcacctgacttcacacacatacctgccttcagcgcctgccccagagctcccaagcccctgcccgccacatctgcagtgccgcacacagacaggagaccagcattacagcaacaaccgagtgagacggaccgctggggctgggctggggcggaggcagggaaggggaatctgtccgtttcttctcctagggtttccatgaaggaggcaacatgtgtctcattggtaaaccctttttgttcctacaagttgatttcacaaggagataactcacccccacaaggcggaaattagctctttaaacacaaaccagacccacgggtaggcaagaggagccccgcctgcctcctgctcctcctggagtgaggttgagggtgagcaagggaaggtctgggccagggaggagggctcctccgcattctccctccccaggagcaggaccctgccccagcctggaggaaggggcgagaggcagaagaaggtagaaagcagttctcaggccactgtccctggtggaggtttaggcccctaaaactgtgagggtctctgtccttccaataccctacaaggggcttcggcttggaccctgtcagctaaggcagtcattcaacagcttttttaagaagacattattcatttagtcttttaacttaaatttattgaacacacactatgtgccagcactgttctgagccctgaggcaggagagatgacagttcagcggggacacagccagataactaaatcccctccaaagtctgagggttacaaagggaatcacaggttgagctggtctgtaccatgggaaaccaaatttagtccaagagcatttggggatggggggagattcctgaagaaaagaacctttccgtggtgatctgaagggcaggggaaagtccgctgagcagagggtggcaggctcaggatggggatgggggtgggggaaagtgtgttccccacagaggaaacagcacgggtgaagtctcagagtagacagggcttgaaatcctggaggctctctttcaaattcccaagcctgcagggcaggattaggggctgagcaccctgctagcctgagttcctcccccttcttcccaaatggcccttcttgcaggaagagggctctgttgctctccaccatcccacagagatatcagcatctgctgactcagagctgaacccgagctttatttgatgtaatgaggagcccacactggcccttctgatcccagggatgcgggaaacttgccttccaggcgcgagtgtgagctcccggagggcgggactctatccctcccacccctcctcctgccttcccctgatgctcagcgcctggcccttgggtaagagggacttcagaaattgagcttggcaaagccattgcttgttctggcggccagtattcatttgtgggcctgtcctatacaggcggctgctgtgccctgaggttcaccagctgggcttcccagagtccccgtgcccacaccagaggccagcaagcccttccctgctcaggggtctcagactgttaccttagggagcagccaactcccatctgattttaaatccacctccaaccattggagtccagttccagacagggagcccactccctctacaaggcagcagtgtcaggggttagacatccttgcctatcagaaaccatgccctttggccaggtgtggtggcttacacttgtaatcctagcactttgggaggccgaggcaggtggatcacctgaggtcaggagttagagacccagcctggccaacaaggcaaaatcccatctctactaaaaatacaaaaaattagccggacgtggtggcgcacacctgtaatcccagctactagggaggctgaggcaggagaatcgcttgaacccagggggcagaggttgcagtgagccaagatcgtgccactgcactccagcctggacaaaagaggcaaactccatctcaaaaaaaaagaaagaaagaaagaaaagaaaccatcctcttccttggaggaagcctaactctgccttccccaggctggtttggcagcgagcaagatgagtcaaggcctgcaccaaatggaacctgatgtatggtagggcttaggggagacaacaccagaggggaagtgaagtgggggaagagaagagagacgggagttggctgtttgagacaaggtggtcagggaaggcctcactgagaaggtggtgtgttgctgataccagaggggagagagggaggtaccagttgggcactgtgttcatctgtttcgcattgctgtgaaggaaaacctgactctgggtaacttagaaggaaagggggtttatgtggctcacagttctgcaggctgtgcaggaagcagcacggcaccagcatcagcttctggggagggcctcaggaaacccacaatcgtgatggaaggtgaaggggggtcaggcaggacacttggcaagagagggagcaggagagatgccaggcacttacaaatagccagctctcacatgaactgatagagcgagaactcactcattaccacagggagggcaccaagccattcaggagggataccccgcaatgacccaaacaccacacaccaggcctcacttccaacactggggtcacatttcaacatgagatttggagggcacacacatccaaaccatatcgggcactgaagaaaggcaatcaggttgcctgaaggagcctccatctgcccaggggctgcagccaggctggcagaaagggaccccagctgagcccaggcacagtcccttccccaccccccacggagagcccagtgccaacaataccacctccctcctcatgggaagacacagaggccaccaagggaggccctaagcagaggggaggaaatggtgagcttcgtccttttcccctggtgggggcctagcaagcagagcgcagccttgtgcctggtactttggccagggcatagctggaaggtccagaggtaagggccaggtttctgcatggcagtggagaacgcctggttggggaggccacctagccggatttgaaccctgggactggctatgtggccttgagtgagtcttttcctctctgtgggtctcactgtcctctctcaaatccggcctggagattctccagttgtgaactctccccacaaggcccccgtccctgcacaccagtaaccagttgtaacaagaaggtcacagagagtggttgtgacttcctaggtgcccccattgcctcccacctgccccctcctggcccccagctgccctgcccagtctggtgcgggcagggtgggcaggctgggttgaagatccatggatagcgggtggccgcgtggctcaagctgcaaggtgagcccacttcttgagcccaaggtacctcctcagcttggggctagaatcgcttggagctcccatctgcaaaatgggaggctcggctctgagctgttaagaaagatgctacctgggaagacggcaggaggcaagaagtgttaggaagagaaggatggtaatgatgtgcccctgaagaatttctccaaaggcctgggcagcagagtcaagggcctgccctctggagctggctttaaaggggcactgatacccaggaaggcccagccctgccctcaggagagcaaaagtgctcaaaagacagaactgccaaagcctgaggagcggggagggaaaggaggagatggcttgggcagtcttgcaggctccctggaggagggggcctggagcagggccctgaagccatggaagatctggaatggtaacaagaatgaattgacacgtgtctcaggagtgccaagaagggaagtctgagagacaaggagagagtagcataagggtcagggcagggctccctcgctgtgaccagcatgaacccacgtgggcactcagatgaggctgatgccagtatccaaggagcagctcaaaccagcaggtctcccaactgggcacagattggcgggtggctaagccctgctcactatgggaggaggtcctaaaaagcttctggactctgagccagtgaaggccatctgccatttgggcttggcacagagctgctatgcccctcgggttggagctggcccatgaaggccttgggacagggcttccttcctctcatgtttttgttcaagttgattaaacctgaggaatttttgcatccaggagcagaggcccacgtgcatttctgcgggagcctgtgattatcaaatcctcaaagggcaaagtgccaagcttagaagaagctaacagcaggccagaaggaatggggaaggccagcagcatccccagaacctcagaaacatcccctcaaggactcccagatctcccagagaacctccagaatctcagcaacatttctgagtttcagtaatgccataagaagccctgcaacctcagtattgcccccaagaagccccagaccttcagtaacacatcagaaccactgcaacacctcaggacactcaaactctggcaaactcaaactctggcaaatcaaccacagattggaacaagatgttcaaaagcctgtgaccatttgcagaaaggccagagacccccgttgctctccaccctcccatctcagcccttgactctgagtccagcagcaaacccaatagtttacaatactcaaacctcaggtacacccccaacttcgatagcacggaagagaacacgcaagagaggcgttccaggagtggggggatggccactgtgcccacctgtgcagcccagtccccttgagagtccatgaataagcagccgagagagtcaacctcatgcgggcccgtgagcttggggtgtgccctcagtggcacagcacactcacacacacatccaactgcccttcgcacacatacgtgcttaattctggcaccagaccaagtctgactccacacagtgggctggaaggcagtgtcgtcggctgccgtgctcacggcaggaagagtatgggtgactctccacctcctgtctctctacctcctacctcccctgccatgtgggagggtcagaagcaccatctgatgtgcccttcctgcaattctcatgcccccctcaccaacagcatcatcataacataaaggatttagaccaggctgttctggtatgagggtggacactggtgaggaggaggagggtagccggctgtgccaggggagcagcatgttctttccctcccagagggctaggctagtactgacctggaggagggaggcagatttcagctcagaacaaaggtagccttctagagtagtgaggcccccatcaagggaggcaatcaagaagaggctgttaacatcaagatgcaacagagggcttcctgccttcggaggactagacacaaggccatgaagattccccagctataagagccccacgttctccgttcccagcacgttcctccctgggctggccaccgtggtgtggccttgagatgtaggctttgtgctgccctccttcctcactgaggacattgactgctgggcagatcccctgacttctctctccttgttcccttgctgaccacaggacagggctctccaccaaccttttgcccacagccagtcagatccaactcagacaggactctgcgaatgtctcctgccttttggagctcctgctagccccccagtgtcccctgagggcagcccaccccaggtctccaaacttactcatcagaattgctccagcccatcactctgctcacttcctgcccctaggctctgactcctgctcacttcccaccgcacaccccatgtgccttctcgctgttccccgacctgttccaatcccacctggcctcccagacttggctccagcctacctccaatcaagcgctctcctgacctctcccttccttgtctctttcctttcctttattgatctctcccggaaacttgtccctccaggcaagcagggtgctcccaacacggggccttctcctctgagcccagcaccagctgggctgggatcctagaggggtggctggttgtgtggtctcggcagttggccctgagaagtgtccccagcacctgctttaaaaggtgtttgatct

SEQ ID NO: 1025 - DNA, 30240 bp, Homo sapiens
tttctcaggaacaagtttattgcagggaacacactaacctctttcataatagccaaaggcataaaaactacaaaaatatctggctctcgagtgtgggcagctcagtgtgggacctggtctgagtcatgacttgggctgccctgcaggccagaggcccgggagctttccggccactccccagagaggtccgtggcgctgagggggtgaggaagtgccttggctgcttccacagcgtgaaggccaaggctgaggtggagctgggctggagtggttccagagaaggcttcatcgaggcccttcaaggctgatggcagagccagggtagggagacgcctggatgtggctgccctggctcaactggctcctggaccaaggccctaacccaccagtttctttctccagaacccctgctggctctcccatagccaagtgggtggagcagagccctcctgaggctcccagtgcagacagacctccacccaaccacagtgatccggaggacctgctggctgcatggctggtgtgatgctgggaggagagccggggagggaggaggatggtaggcaggaacatgcctcagcacagatgggcaggtgggttgaccttccctgccctcagggctgggcaccattggcacccaacagggccgtcttgcggaagacctgcagggttgggttgtgcagcagcgtgtaggccagaccccagcgagccctgccgcggctggccccgggcctagctcccttggccatggagtcctttgtctgtagcagctgcatccctgagagagacggactttctgtgagtcactcagcaaacacccagccaaccctccctggccctcagacctgatcagagagcctgaaaatcccaggcgtgtgcaggtcgtgaggcttaggatgtcccctgcaggcagcacatggaagtggggggtgaggtctgtggatggactggaagctgggtgggacaagggtctggagctggcttagtgtcccctccctacacacacttctgggcagaaggaaaggaggagtcatactccctgccccaagggagaagcgggggcagtgacggagccccttaggaaggcagctgtttcattctctctgtgtgcacacatatggtgtgtgtatgtgtgtgttcatatcatggaaaaaatcaccctgagatcagaccaggaggggtgaccaaaggcagccaaggaagagaggaagtgagaattttcctggcgctcactctgtgtgctggggaggggcacacatccttcctagaagaagctgggtaggctctattcccccattcccagtgggagggcgcaccttcgtcttcctcccctggtctgaggctgtcctggggggctgccatggtcctgggtaggaggctctgcgcttgcaggagcagggagcagaaggctgtcatggctggatgcgactggctgacttcaatcttcaagaagtttcggtacgtgtagtagcctggggtggggtggcggatggcaatgctgggggagcaggggccacactggaggcatccagacatcccctaacacacacacagggagtgcacgtgcactccctgcatccaagcatgtcgacacaccaagcacgtggcacattggctgcatgggcacgtgtggacctgctagaacaccccacatccactgcacgtgctgcagggccacaggaggcacagcgcaggggcacacaggtggcacatgcagctacaggcatcggtgtgaactgatcagctggcacggccctggggcagggcagatgccttcctcactgcttgggtagcctgagcaatcctccagccccgcccagtgaccttaccggggtcgagagtggcggctctcggtggcagcaggctgaggtccatctggccaaggtggatggcgttgtagagggcagagaggagcactcgccaggtggccaccatggcacccaccagcacattgagggggaagagaagaaaggtggctgcatagagcactcgcctaggatgggagaagaaagctgaggcaggccgttccccagagctccctccccagggtcagtgtcagacctggatgcccagaactgctgtgtatttactgagtgcctaccatttattgctatgtcttctgtgcaccccaccctgggcaaggccttctctctttcaacccaccatgctgggagatgggaaactgaggcccagagagattgggagacttagccaaggctgtcagctattcagtggcagagctgggctttaactctaggtccatctgagtctttctatgaccctgatgcctcccacctcccttttctgggtcccctgtctgctaattccaagttcccctgggagccaaggttctcccacagacttgtcatctgacagggaactcccttgctacaaagtggggaggggcatggttttaaggaaacagaggatccaggggagagcagtaccgattcccaaagcaagaaaggttcacgggggtacttccagccccatgccgggtatgtagagaggtactttggagtgggctgagccattgtcccttttctctatgggtaaggcaagctctttctactatcatctgggttccttgatagagagaagggatagatggcagtggagggaggacacaaaaagagagagacaccgaagaagaggcgagggcctgagggagccacaagcccagatgccacctcaccggttggtcagctgtgggtgtccatcatgagtctccaggaagacccaatgggctgccatgttctgcaggatcacagccagggccaaagtcagccagaagggcctgccagtggggtggggaggtggtcgctgttagcggacctctaaggagtccctgagccctccatgtcttgtttcactcaccacgaggactccagggaacggaagagcaggaggttcctgccatggagcacaggcatgagcaccaggaaggccagggccgtggttcccaggaagaagatgatctgctgcaccaggagccctgccaggggcgggagtggcagggggacagaaaacaggttccatgaaaactggccatccccgctgcccccagaaccaagggctttgggattgggcaggcctggttttagatctctgctctgccactgcctagctatgctgccttgaacaaatcactttacttcattgagcctcagtttcttcctctgtaaaatggggataatagtccctacctcagaggctgttgtaaggatccaatgagataatgtctgtggaaactcttaaaatcacaaaatactttgcaaatgttatttccctccagtttctcctgagtttgagttactgggggataaggctacatattaaactgatgtttgcattccttcaagccagagcctggcatacggtaggtgcccaaggactgtctattgaaataatctggccaactgattagagaatgatgtctacaaaagggcctggaggcataagggctaccaagaagagacgctatgacttttgtcctagtaattcatctactcctttaccatccttctcctcccgcaaggaggtgagaatggaaggaactggagggagagatacaaggcccttggatgtgcaacccaggccacagcccctcaccattcagagtgcttttctcactgcagtacccaaggggagagtcagaaacttggggctggtaggggtcctggaaggttatctggtccaactctctcagggcaggaccccctttgcagactgcaacaatatccatggaactctgcttgcatacccccagtgacagggatctcattacctttgtaggtagccaaatgtgacacagccctttcttaagctggagcgcagtggtgcaatctcggctcactgcaacctccacctcctgggttcaagcgattctcctgcctcatcctcccgaatagctggaactgcaggtgcacaccaccatacccggctaatttttgtatttttagtagagacggggtctcaccatgttggccaggctggtcttcatctcctgacttcgtgatccacctgcctcagcctcccaaagtgctgggattacaggtgtgagccactgagcccagccaggaatgtaccattttgaatttgacacctccagacctgggtccacccccatgtgaatacttggtggcacccagggttcatctccatgtggagggtacacactcaatttcccgagggctcctgtacccccatcctgaataagcttcttaagggcagggaaggcaggggggtccctccttcttgctgctgccccagagcattcccagacaaactctgagggcagtacttgctgagcactcttctccccaactgaggccagtgtctgaggggaggcccaggccaaggctgggtgtggcgggcaagggaggctcaccaaggcagataaaggctgtctggtaggcactgaagctcatccaacagaatatggcttggcgggagggatggggactccgatgcaagggactcaagtccagggcagctcctcggtgcagagctcgaaggttggtcctggggtgggagccagggaggcagagacctcagggagcaacacactcttcctaaatcctcctctgggccagcaactggccaaactcccaatagaatttcaactcacagccatcagcagggaagcccagaactgtgggagccaggaggaggccactaacccaagatatctggaagaggtgatatctgggtagtcttaaacagtgaacgaggaatacaaaacgaggcagaaggctcaacctgagccaagtcagaaaagtgagaaacaacagtgagaatggaagtgacacacagcacagccaacaggtaaagaggcaaggcaagcacaggctgaggagccttgaatgccagaagaaggaggggtgacctgtggaaaaagatccctgggaagagctctgagacctggcaagtgcgcaggagacatgggccagttctctgacatgggtaagtgctcgggctgccccttccacctgccctgggccttcagtgctcctcaccactcaccgctgcagggcaagcaaggtggcatggcgagacccgtaccacctctccagtgtgctatgccaccaggctacccctcacctacactctcacatggcagggccaccccagcctctgttctcgtccacacagtcctcacctcctatctccttccattcccgggcaggtgcagcttccccaggccaccttccctctcatccagcccacccggtggcccctactcagggggcaagctccactagctgccctgagttggtggtgccctatgtccctcacactcacagacgtttccccaaccagacaggaaggcccaagggcaggacccagccccaccttctcccactgcagcgcagccacgcacaggtgggctccatgacagcccgggccggcagagcccttccctccctccaggcccagggcctccccgcaggcccacaggactcccactccttccccacctcggcgctgggtgagccagagtctgtcactcacctgtgtgtcaccagtgagcgcatcaggaccaggaaggtgagtaagcaggacaagaccaaggctgagatgtagcacactggtgggcagagaatgagcaaagtgagaggtcagggtctggagagtctcctggaggcctcagaacccctgccagggtggtgccttgtggggagttccccctgccccaaactgaactctgtgtggaagcctcttggccccacccccaggtctcagatgcagtgtaagccaatgacttcggccaccccattcttcccagtgacatacagtggtcaagagatgaaaccagctctgagtctgcagacctagtcctcaccctgctgttgctgcttctattgctgtgggacctccatccaacctggcatctgcctccagcttcactgcttcttggccatgtggccttcaggagggcactccttctccccaggcccccatttgctcgtgaacataccgcacgccgttatgctgcccagctctcaggataatgtgagccataaggccccatccacgtctgcactaatggtcttcgttcagggcatagagggtgtgagtccacatcggtgtggactgagtccatcagaatagggaggcagccgctgtcacccagctccctcaccctctccctggccatgcacacaatgagtgtgtgcatgatggtgtgtcatgaacaagcctgggtgtttaagaatttcaggggtgcaggctgcaactctcccaccttacgtccacatccagtcttgctctggactgtaacagcaaccccgcaaggttagacagaagaactgttcccactgggctgaagaggaagctgaggctcagagagagggcttcgcccagacagccatgctgctaggaatgatagagtgaggtgtgtaaccatttctaagcagatccagaatgagcctgagatgcctgcaccctgatctcatcagtcagtccagggaagtgttcctggtgcccgtgtcaccaccagaatctcaaggacggggagagcaaacacagaaaaggtgagtgctagttccacatagccacagggattagagtggtggatctcagcaccgatagcgcctttaggatcacctggagctgctaaaactcgcccatagcccagcctgcacccaaaccagttaaatcagaatttctgtgggtgggacccagccttagcctgtgaaagcaacactggtgattcagtgtgcagtcaggactgacagccactgctctgggggctttccaaaggcagagccttcatgatttatttccatcagaaatgaattgaaatcaaccaaccaaccaatatttattgggtgcctactacagtggtgatcaaactttgcttgcatgagaatcactgggactgtgatcccaacactttggaaggctgaggcggtggatcacctggggtcagaagttcgagaccagcctgaccaatatggtgaaactccgtctctactaaaaatacaaaaattagccaggcctggtggcgggcccctgtaatcccagctactcgggaggctgagatgggagaatcacttgaacctgagagacggaggttgcagtgagccgagattgtgccacggcactccaccctgggagacagaatgagactccgtctcaaaacaaaacaaaattagccgggcctggtggtatgtgcctgtaatcccagctactcgggaggctgaaatgggagaattgcttgaacccaggaggtggaggttgcagtgagccgagattgcaccactgcactccagcctgggcgacagagcacaactccatctcaaaagaaaaaaaaaatcactgggagggctgttcactcaaagaggctgggccccactctgagagtttctgattcagtaggtctggcacagggcttgagcaacgggaatgttaaagccaccaggtgcttcccagattcagccagggctaaaaatgatgctacagaaacctaggcccttctgctggtccctagctccctcctccagggccctcgcagggacacttttctcagaagcaaggttgggagaaagcactgtgcatgcatagctccagcctctgtggtcccccttctggagccagctgggctgcagcgagggcacattctggaccatttgctgccaggaggtgaacagcccgcctgctgagcctggcctggtgagtgtacaggctaacacagggttgaagggttagcagcccccttggccacaggcctggcctttgatctccatccatctacctcctacctctctctccctccactggttcccaacttgggcacccccaaaccccagcactcacacaatcttcctgctctttgccacctctgggatcctgtgcctgccttcttctgggccctgctttgggggatagatctgtcttccctcatgtgattgagggcctcaagggcaagtgttcctttttcactccagcactcattttgcagttggggaaattgaggtcaggagaggtaatgcactttgcccaaggtcactcagcttgtaagtgatggaacagagattctaatctagtttgcctgactcagtctgagctctctgtgagtgatgccaggcttatggtccaagtgctgggtggcagtcctaacagaagctctgagctcagaagacattagctccttaggcgaaggacagaccaagggacactggagcccaggttgcgggatggctttggccgtatctgtaatcctcctgggcctcagtattcctcatctgcaaatttaaagagtaactgttgctctgtttggcccaagaagattcaaagtgggagcctttgagcttggaaactgcaacatgcaattaaaaatataagacatgatgagtggaagcagagtcctttgccctggatgtgtctcattttgtctttgagcctcaatgtcctgccctgtgagctgggatcaatgatgctgacctacagggtcactgtgagcaagggtctgaggttggttgtgggctgacctggaccatgtctgcacctgcctatgaaccagattgcaaccagctcagaaaatctcctgggagaggacattttcagctcacccggaacttgtcacctgtccagtttgttgccctcagcagcagttccagggcagcctctagtacgggaactgaggtgctcacggagatggtggaggtggtcagggaaggaagtggtcactccgtgcacctctgcccaccccccactccctgccccgccatgaccagcatgcccaggtctgtaggataaggatgatgttaatggtcaggtacagctgcggagcagctacacctccacctgcaacgctggcagcccacgctctgaccacatgttactcctcagaagccgggggcccatccgtcccagcctggggtccccaagtaagcagaaggcgcatgcctcctgagtcctcagcaccgggctttgtcccaaggtgatggagaaggcccccgcctaggcttcaggagccctgcgttctcttggctgcactctgccctgctggatggcctcaggcaaatccttccccatgtgtcaagtggggacacttctcagtcccctccacagcgctgttgggagcgcccaggaggcagagtaagtaggtggctgcaggaggcatcagaccacagaaggggaagccaagatggttccctggttcaggagctcattgtcagaggagggaaggagaaaggagacggccccaaaagacagggagtggggaagagaaagcctgtgccctgcccaacgccagacccctgccacgaggattcgctcagaaatcctcaccatctcccttcgccgtctcttccctccttccccaccctcagctcccccatcccatggccttcctcatctccatgcctggatagttggtcagagacactgggggtggtgggggaagatgccacagaagcaggcaagggacaggagctgctgagatgtcccttcaggtttcatggaagctcagaactggaagcgccaactgccacaatttggagatgaggcaatcgagacccagagagaggaaggaatgtgtccaagggcccccagtgtgtccatggctgactagggcatagaccttgggtctccccgctttcattccccactgcagccctcaggggctccctggaggcctcaccttccagagcccacagatggtgcttcaccagctccaccacctcctgcttgtcctcggagagcacgattccaaagccggccagcaggtaggagacatccgtggtgacccctgccctcaccttctggatagtgggtaccacgcccaccagcagcagcagggccacctggaagagccccacagtgagggccccatcccaggaaagggttttctgtgctaacaggggagacgctggggaagaaactggcagcacacaggccccagccacatgcccattgcccatcagtgttcttatctgccccttagagcagggatctcacgcctctaaatgaggacattacagacaggtgcaatcacagcctaataggccaaaggcatgccttcgagcaccgtaacttcatatagtcagccctgcgtatctgtgggttccacatccacaaccaaccaattcaatcaagcgcagatcaaaaatatttggggaaaaaccctcaataaaaaataacaattcaatacaaataatacaaataaaaaataatacagtaggacaacttcttcttttttttttttttttgagatggagtcttgctctgtggccaggctggagtgcagtggcgcgatctcggctcactgcaacctccacctcccaggttcaagcaattctcctgcctcagcctcctgagtagctgggactacaggcccgcgccaccaccgccagctaatttttatatttttagtagagacagggtttcactacattggctgggatggtctcaatctcttgacattgtgatccgcccgcctcagcctcccaaagtgctgggattacaggtgtgagccaccacacccagacataggacaactgtttacatagcacttatgttcgatattataagtactttagagataacgaggtatactggagaatgtgtgtaggctatatgcaaatactacaccatcgtatatcagaaatttgagcctttggattttggtatggaggggtgttcctggaaccaacccacctcagatactgagggatgactgtgtctgcacctctatctatttacccatcatctatctatctaaactttggaatgtaaaatttctggtttttctatgttgtgaaagtaaatgagcacaggaattaaagctggacagacttggattcaaacttaggctacgctgagatattagctgtgcagaaacttggccaagtcaaattcacctctccaagcttccattctccccatctgtaaagtggagaataatcatacccatctcccaggattttaattgttgttgttggttttttcggggttttttttttttcggaggtggtgaggcagagtttatcaaacatgttgtcttgctaaatcttcccaattactcaaagaggaaaattattctattttctcctttttacagatgagctaacaggttcagagaggttatataacttgcccaaggccacacaggaggtaaatagtggagctaggatttaaattcgtgtttatgtggcctccaaaattaatgctccgagtcacttcatgagtccaagagtgaacaccccggcccttctgggtaggccagaactcccaagatggcctgcagcacctggtcagggttctggatggagcacctggagagctgggttgggccggaactgctccaggcttgggggttgagggcagggctccagaggcagatggcagtacagggtgagggacatacctggtaaatggccgtccctgtcagtgtagctgaaagcaccagcttcagcgggagatggaatcctgtagtcctcaaaggaaggagtatggtgaacagcaccactcaggcccgggagccctcctccctcccaaggggcccaggaaaagggccagcaggaccctaaatgaccaaggccaggccagggtcttcccgctgtcccaagctggtagttgtccctcttgatgacaaggattctggggagcaggagccagtcctccactgcagccattctgtgcaagggagggtaacgtcccctgtcacgctcggcctcagctcccaaccccatacctggctgtggagtgtagatgcagtgtctcaagcagacgcgggcccaggacaggaagccatgcttggaggtgtggtagctgcagaaagacccaggcaggtgcggggtcctcaggggaagcccattccctgagggccagccccagaggctggtcattcttcccctctgcccctgccatgctgcccagtgccagcttcccaagcacggctgctaaccagcccaatccattggcccacaaagggtgtgtcagagaccccacctgcttcccagcttcttcctgcaaaggaggttcctcagatattcctcagagtagctgctctgcagcccctgtggagacagacaattgaacaagcagatgagatctgcctcgacccattcgtgggtccctggctcagggaactagagtgttcaccaagcaggtgctccataaaaacctgttggccatggcggtggtggtgagtgtggatggggctgacctgtggggatgaggtccgtgccctccaaagcttcccttttctctctcacaaatacaaggccagtctcctatcaaagaaccatcaatgccaggaagttcttcctaagatctgtctccaactctcgcctgctttactcagtcacatctcttcaccgtttcttcccacccctagccctctggcctctgctagctgaaactggggcaaagggaagcttgtgtcccacgggcacatcctagaccaggacacagaagagggtcattccaggtcagacaccctcaggcttctcctgctgccactgcgcaagggagatcacaagggtgaccagatttgtctaagccacattccaggccttaagctgcctgtgaagtagcagaggcccatgggaagatggggtgagcccctgcctggaatcactgggagaacacaggctgttgtcacttgttgccatgacaaccctgggatcccgggcaggagtgggtcagctcaaagcttgatgggggtcctttgagacttaaacctctttgaccaaagtccaaagaggattgtacacctctcaagcctgggaggaaaggctggcaatggagagagagatggggtggtggaaaccctggaagagaaggtaaaggggcatgcctcaggcactgtgtcgtcccggggggccgctcccttttcagagccagctgtaaacaggaggggacacaggcttcctcgaggggtgttggcctcaataggcaggagctacaagcgctcagaactccctgcctgccacgtgggagccgagtctggagtccgtgggccttctcggaccagagtagcccaaaagggacccggggttctccatcctgcctagggatctcactcactctctggattcagtctgaccttgccgagttaacacccggtcccagcccctctgctgagctccagactttgagcagtacaccctcaggaccaagcatcatcccaggagcacctgctcctccctccaccttccctgggccagcagctggcaccaccacctacctgctggctggccaggtgcctcccatcaagcctttccttcccctgccctgtctgaagagaagccacgccctttggcctctatgtcttaagactttctcctgagtctgttcttctttcccctttgagggtctctgcagagctttcttcctcctcctctctcaccagaaagaagtagtggaccccgccccctgcaccacagtcccaacacccggtgcaggtttcacattgcactgcaggtgttttgtgccgcatctgtctcccccaccacactgggagctcctggagatcagacacaagtccatcagctccaagtccacagcactgagcccggggcctgacatatggtaggtgcttagaaggctttttagtgagattgaagtatcttctaagaattctcttttaccatgatgcattcatccatccatccttccttccatacatctttccttcgatccatccatccattcatccatctattcaaaaattcaaaaatatttgctgagtatctattaagggccaagacccacccagtgctgcaaatataatgaacaaaacagacacaaaactatctcttcccctttactcatgctctttcccgtgcctacaatgcctgctccttattctctcatcactctagatctccctgtccttcaggcccttgtagagtctacctcctctaggaagccctctcagccctcccctttatctgaaattattcaaccacatccaacctagagttgactcataatggagttctgccctgggtgcttcctgaatcatctcattatgtgcagaactcggattaggcacaaggctccaggctgtctctccagccagatctcagtgtttcacagacagagatatgactctcctggcttctgactcagttctgctttgttaagtccctactattcacacagcccagtgccgcgggtatcctgggtgccagtcaagggcccagtccagcttttgcctagggagggaggactaagcagtcactcagcaaacattttctgagcatctattctgtgctgggccctacatcaagcacggccatgtatctgggaccacagatacgggggagtagggctgtcttgggtgctgaggaagagctcatcccaggcctgcccctttaccttggagcctgctcctgtcctacggctgaagcttctcaccagctgcacagggtaccaaaggctcaggaatccgaggcccagcaggagaggcagggaggccagcagggagtagtacttgtagatctggacagacaaacacccagacagactactttccaccttcttcccccagccaagaaccagaatccgttgcccttcccacctcacactgggccctgagggtggtctggggggccatgggaaggcttcagctctatggttcccaacctgccacccagcgcaaacctgcccacttccccttctcgagccctgcagagatgctcacccctcccccaggctcctggatccccacgggcctgagaggagccaagaggaggagatcacttgattccctcctgccccccactggaaaggacacctctttctgtttctgtgttcccggagcattaggaacagttctgaaaatcacacgaaagcctgcctttgcctacatatagttttcaacctgagcatcaggaaagtctatgccctactcctcagggctgaggccttcctgggggtgggctttttgtatactcattcatttatttgttggttcaatatacttttattgagagcttagtatgtgccaggttctaggtggtgaaaaaaagccaccaagttccccctctcaaagcaacctcttagtcttcacctccaccctgagggactggtgttatcagctccatggacggatggagaaacggtctcagaaaggtggcactgtttccccaaggcacttggtaccacctggcatcattttgtttgcgtgtcatgtctgcccttctgaagtgacggctcttgggaggctagggactgtttgtcttgttcatagctgtagtccagtgcctggaaatgtccctggtacaaagtatgtgcttcaaatatgttgttgaatgaatgggtgagtgaatgaatgaagtggtgaagctggattcacactcaggttgtctggctctaaagcctgtaccatcactctttgagttctagactggacagcttcacagccccagccagcagccagtgagcaaggtcctgaggttccggaattctcctctcagccctcttagaccatccctgacttcgcacttgccggcctccatcaagcttcactcccattccctctccagcctgaccaaagggaagctgggggatcactaacacaggcattgggggtgggggccatttcaggctttctcttccccctactctgcccacttccccttctccgccacctcctagacttaaagttcctgagggctgggcccagccaccttgttccctgcctctcctgcagagcagccaagcttggaaggggcacatgtttgaaggcatggaatcccatgcacaatggaaggctgcagggcggcccatcatagaatcagagctcaaaggaggcactgtggtttgagtaggttgctctgtgcgcccctctgccctaggccattgtgatcagcggttaccttgggcacctggggacactctgccctctgccagacctggaccccaaggtgggcccaggacagcgtgctgccgagcaggtgtgcagctgtgtggccagccgtggcacaggcagccagagggtagtagagggcagcataatagaacagtcccagtatcttccaggcccctggaaggtgaaacaagcagagagacccatgctggaggggcagacatggggcctgcagtgagcccacccaggcctctcttcggtctccagcttccaagcccttcagcacgttcagtgggcaagaacactaggttcaaatccaggctctgactagtctcaactctgtgatcttgggcaagttacctcttggagcctcagttttcccatctgtaaaatgaaaataatcacagtatattagcaagggcaaaatgagaaggtggatatataatgcttagcatggtgcctgagcaaatactcaatttaagatactacttccctggctctcagttcctccattgcaaaatggggctaatatgcatactttgtagcatcgttgtaaagactggatggtctaaaaaggtcacgtctcaggatagcagcccatctcattgacagctgttcctgttactctcatctccttgagccaagcttaaaactccgagaccccaccctaccccatcccatcacaccaaccccagggcctgggggtcagtgggtaccttggctgggtgctgaggcgagagtcaggaagggcaatgcgtcctcgtcggggagcagcaaacacagggagctcaggaggaccatgaaaacagcagcaggcactgcccggggcctgtccccagccaagaaatccacagggctagcacagaggcaaggacagggcaggagggagttgctcagcccctgcacccccattacctcccagctgtattccataaatcaaggaggtggagtcagtcccactttctagatgggggaataaggccccttcattcattcattccatagatatttgtggagtgcctcttatctaccaagctctgggccccgtgccaaagggacttgggacacacatacagtgggaagaagccctaagactgctcctccgcccaccctggaagctccaggaagcagccacctccacactaattggtctgtctgagctggcaaaccttcagagaactcagcgagtcacaacatccttgtacaacagccgccgccctgggctgggtgtggacccggggcagagggcagacagcgggcatagctgtcccaggcatcacccttctgggctcagggcaagccactcagacccacagcttctgcactgcagcttgcattcatgctctgagaggttcattctccctcaaacactgccccagccagggcaagctctttctggggccaaccagagaccccaggctggttccccacaaaaccagcacagcaagacctgcctcggtgcacagtctgggtctgggatgtgaagctgtctacaccaaggagccacccatcacctgccccaaccctttggtctctcgcacactagcttgcccagccccatctcctcaggatcatgcctgtccaggctctggagtcacagggctgaaggagataggagaagaaagctccagctataggggctagatgtcagtccccataaatctgccttcaagcattagggtccaggtgataccctcagggaagatgacggtcaagatggcattgggatggtcacgtcaatccacacatggagggctgcctgagaaggtacactctgacgctgggtcctgtcaggcttgtttccctagggtctgggttggagtcctttctcccaggcgggcttgagcgagtccctcccccttcctctgggggtcctgactaaacctggagacctaggtgggggtgaggaaagctccaggctgagggcgatagggatgtcattaaagccagagctgccttttaggtacctaacaaatcacccaccctcccagagggaccctgtcagctgggtcccctgagtgggggtgcccaggccatggtacaaacctgggcaggccgggcctgccacgcacacagtcaggccagagctggcggcgcctcaccagcatggccaggagcagcagcacaaggatctgaaaggagagtgcagaggagggcttggggtgcccaggcctcccctgagggtctgagtttgagggcttggactcaggccccaggatatcccctacctgcccagtgcacactcatgtgacatcttggggactggtcaaggggtgacagacatctggaaggttggacttgcatcctggtttgggcctccaagctgggagaactcccagatagctccccccacccaggatcttccagggccccccttcaccagccccagtggggaacacaggtcccactgcccaggctggcagcagcttgcaagccaggttcaacttgggttggactcactgacagcgaggccaggcaggcgtggtacaggccgggtggtatgctggtgtggcaggagggcacttccctgcagagcaaatgaaggctggctcaggcctgcgtcaggcccccctgggtgtgcagatgggtctggggttcaagactgttcacactgaggctttacccactacctccctcaaccctctgatccctcctacacaagccttcccagtcccaccttctcagggtcattctggggccctcgtgtccctgtgatgtgccagccccatgccaagctctggggttataagactaaaggacatgggaagctcccaggggaagcagagtagaccggctcggcctgatcacttattctcttttttttttttctggagggacagggtcttgctctgtcacccaggctggagtgcagtggctcgatctcggcttactgcagcctcagcctcctgggctcaaaagatcctcccacctcagcctcatgagtagctgggaccacaggtgtgcaccaccatgcctggcatttttttttctgtatttttagtagagacagggcctcaccatgtcgcccaggctggtcttggatttctgagctcaagcaatcctcatgcctcagcctcccaaagtgctgggattacaggtgtgagccactgtgcccggctgagcacttattcttgctcacccagatgcttcctgtccttcaaggcctcccctctccagggagcccctctgactgctcctggtctcacagacgtcttctcagaactgcagttgagcacactacctgggtcaagcagtcaagggtttggccctgtgattcgccctctactcactgccatctgaggttggtctgtgactaaaatgatctcccctggtccctctcttttcctgcttccctctcattgagagcctccatggacagccatgcaggttgcccactgcacaaagatgctcagccaagggaacgagcaggccaccctgctcaccaaacccagcacctgctgagctgaatgcacctaactggggatccctttctctaattccacagaggctccctatggcctggcaatggtcctgcactcaccctggctgagcgcagaggtaaacccacagtggagataggggtcactgaggacaatgaaaccctccgcttccccagcagaatcatgtggtggagaaagggagtgaggcaggagtcctgagctcagggctggccctggccctgggagagtaggcaggactgggtccctggtgagcagtagagctccgggttttcccagcttgggcctgggagagccagagggagggtggcagcatgggtgaggccagtggggtctggtgggcgagggcctgagatggagcctgggctgccgccagtccctgcctgcacagagggcttagccgcccaccaaaacgccctccactgtatgaagagaggcatcaaggctgcattatccaggggagtgcagagccctgggatgctctgctgggtcagctcggtctgtcctgctcgctttctctcaggaaatcccagcgggtgagcggtgggaaagaaaccagtcacttggtggagaggcagagtaagtcagctctgggcagcttcttggccaggagaccagcctcttcccaaagtagaactgggatcgtgagtagcagccacactgactccagtgtcagctccccacctccagctccaaggcctctcactctggtgcgtagggcagccctccctctcagccggcatctccccgcatgactaggtcccgctccacctttacacctgggcccggcagggacttggaaaactgtccctggagtagtttgaccattttcctatggaccttaccccaaaccacccctacccccagaaatgccctccagggccctgcctgggggagcctctggccctttctgtatcacctgaggtccccatctgacctctcagctcagtgtgaggggtcagatggggatctcaggtggcatagaaatgagcaaatatttggctagtggcttgtggccccactttttgtgccatgggacaggcaggatggcacagacataaagaccttggagagggtggtgagcttgatcctgggacaggcacagcaggtgctgaaggatgcagaggagggagaactttgggcaaaaggaggtggtatctgattggagtttaaaaaatggttagtggctgggagcagtggctcacgcctataatcccagcactttgggagactgaggcaggcagatcaaccaaggtcaagagtttgagaccagcctggccaacatgatgaaaccctgtctccactaaaaatacaaaaaaaattagctgggcgtggtggcacgcacctgtaatcccagctactcgggaggctgaggcaggagaatcacttgaactggggaagcggaggttgcagtgagccaagatcgcaccactgcactccaacccgggcaacaagagcgagactccatctcaaaaaataaataaataaaagttggttagcatctctttaggcaaagaaggggagaggcagctccaggtggagggaagtgcatgaggaagcagagaggcaggcgacaggcagcgtggctggggctgggcaggccttccagtttgattgcagcccagaggtcaggtgagatgaggttacagcaagcatgggaggccccaggaagccactgagggtgtttgagccattgaatgttctggattttaggacatttctgtggctgactccactgccatcagtgttcatccaccccaactccagcctgagagtgctggggcactgggcactccggagttcttcaaagctctgatgcaacatgtccccagggtgtctgactcacacagacagaggtgaacccaagttcatttccttgggattcccctgagctcccaattttctgctcccactttgagggcagggggatggcaggcagctcaattggtttggctaagtaagtagattcaaacaaatctctttattcttatggatgtcatgccctgcagtgggagaaagaagctgaatcttctagatgtcacccacatgagggactggactccccatcacccagtgcctgacatacacacaactttattctgagacaacagctatagaccacagctacatttacaggcacctggcccccagccagtgcccaggccctgaggctcccaaggacacagcttcagattagagccttcacctaggtcagaaaccatcctcatgggttcctgggcctgtcctcattctggtctctcgcaggccacacatacacagcaggatatgtggagcccacaggctctcggtcagtcaggcaagatgagtggggagcacgcccttgctgactgcaggctattttccaggtggtcagaaccctgagtcctccaaacaacagctccttccccgaggcctgggtggagcctctgtccctgctggatgacccaagcccagccaggccgcagccccagcccctggggaggcacgcaaggatttttccttctcaagtttcaggttttgatggagaacagatgtgcacacatctggctcggcaacccccagcctcacctttctacttctccaaaccgtcagacagagcagggagataagggatggggccaggcctgggaacaacaggggagaactggctctgggtcctacacaggcaagacatcctggcaggaggtgggggacacagaaggggcccagctcctccaccagggtgcccagactaaaccccggtagaatggacccaggcaaagcagctgtggctgggttctcaggccaccctggggcgggctgccttcctgctcccaccctcacctgggctggcctgagcacttctgctaaagggaataggctctcctcatcctctgagaccatccaaagacaacaagggtgcttgtttcctcagtgacttctcaccaggctttctccctttggttctctgccttccccgaatcccccagcctgcccagagaacttgacacttggaaacaccacacccaaatgctcaccacagagaccaataaccccttgaagggaggtctgcttgcctcaactgctctcagcagcttctccatcctggctatgggccagaatcacccagggagccatccctgcagatctgaatcatctgtatttttaacacgtcacacatcatacctaaggtgaccagccttaggtgtcttaacagcagggtgagggatgttgttctcatgtaacagaggcagagactgaatgaaccccagagaggctgtgacttgcccaaggtcacacagcaaatgagtggcagagccagacctagcagcccctgcccaggagctgctccctggccagttgcaacctctgccatcaccccattctgatggctgacagagtgaggtggggtggttccacacttacccctctggctggagctcctcgcccccctggggctcatcgatgtaccagctgccataggagtagtcctctgtggccccgggggaggtctggttccctgctggctgggacgacattctctggcccttctcctttgaccccaggcgagagaaaaaaaaagccactacagatgtgaaaagaggcttaaaagagaaaaaaaaagaaagaaagacggaaaacccaaacaaagaaacatttctctttaatcctgaaggttactttcttacttttagctctctgggaaaagcccgtctgggactgagggcctgagcaagctggcacgggaagaggacagggcctctcgtgtcccctcctcccttcccgcccatcgcactggtcctgcagagatagctgtccccttggggccccggggctcccgctggcgcatctgtctgaccaaccaccagcaggcgtgtgttcaaaggaccattttcaaagaaggcttgtccagtctgagctgcctaaagagacgccccttccttcccctttcccaagcccacctagacagacccacagacacaccagaagggaggcccagggaggaaggagttgcagagatgaaagggtaggcagcccacggccagctccgcactgcctgcctgggccctcccagctgggctcccttgagcccctcccccagcctcagcctgcccctttctggcccctttgggcctcggtgatggaaatacaccataatccttgacaaagcccccctcctgggggaggaggccccagcaccattggcggcctgagccctgcaagggtgtggccaggagccacccccacccccgcacctgacttcacacacatacctgccttcagcgcctgccccagagctcccaagcccctgcccgccacatctgcagtgccgcacacagacaggagaccagcattacagcaacaaccgagtgagacggaccgctggggctgggctggggcggaggcagggaaggggaatctgtccgtttcttctcctagggtttccatgaaggaggcaacatgtgtctcattggtaaaccctttttgttcctacaagttgatttcacaaggagataactcacccccacaaggcggaaattagctctttaaacacaaaccagacccacgggtaggcaagaggagccccgcctgcctcctgctcctcctggagtgaggttgagggtgagcaagggaaggtctgggccagggaggagggctcctccgcattctccctccccaggagcaggaccctgccccagcctggaggaaggggcgagaggcagaagaaggtagaaagcagttctcaggccactgtccctggtggaggtttaggcccctaaaactgtgagggtctctgtccttccaataccctacaaggggcttcggcttggaccctgtcagctaaggcagtcattcaacagcttttttaagaagacattattcatttagtcttttaacttaaatttattgaacacacactatgtgccagcactgttctgagccctgaggcaggagagatgacagttcagcggggacacagccagataactaaatcccctccaaagtctgagggttacaaagggaatcacaggttgagctggtctgtaccatgggaaaccaaatttagtccaagagcatttggggatggggggagattcctgaagaaaagaacctttccgtggtgatctgaagggcaggggaaagtccgctgagcagagggtggcaggctcaggatggggatgggggtgggggaaagtgtgttccccacagaggaaacagcacgggtgaagtctcagagtagacagggcttgaaatcctggaggctctctttcaaattcccaagcctgcagggcaggattaggggctgagcaccctgctagcctgagttcctcccccttcttcccaaatggcccttcttgcaggaagagggctctgttgctctccaccatcccacagagatatcagcatctgctgactcagagctgaacccgagctttatttgatgtaatgaggagcccacactggcccttctgatcccagggatgcgggaaacttgccttccaggcgcgagtgtgagctcccggagggcgggactctatccctcccacccctcctcctgccttcccctgatgctcagcgcctggcccttgggtaagagggacttcagaaattgagcttggcaaagccattgcttgttctggcggccagtattcatttgtgggcctgtcctatacaggcggctgctgtgccctgaggttcaccagctgggcttcccagagtccccgtgcccacaccagaggccagcaagcccttccctgctcaggggtctcagactgttaccttagggagcagccaactcccatctgattttaaatccacctccaaccattggagtccagttccagacagggagcccactccctctacaaggcagcagtgtcaggggttagacatccttgcctatcagaaaccatgccctttggccaggtgtggtggcttacacttgtaatcctagcactttgggaggccgaggcaggtggatcacctgaggtcaggagttagagacccagcctggccaacaaggcaaaatcccatctctactaaaaatacaaaaaattagccggacgtggtggcgcacacctgtaatcccagctactagggaggctgaggcaggagaatcgcttgaacccagggggcagaggttgcagtgagccaagatcgtgccactgcactccagcctggacaaaagaggcaaactccatctcaaaaaaaaagaaagaaagaaagaaaagaaaccatcctcttccttggaggaagcctaactctgccttccccaggctggtttggcagcgagcaagatgagtcaaggcctgcaccaaatggaacctgatgtatggtagggcttaggggagacaacaccagaggggaagtgaagtgggggaagagaagagagacgggagttggctgtttgagacaaggtggtcagggaaggcctcactgagaaggtggtgtgttgctgataccagaggggagagagggaggtaccagttgggcactgtgttcatctgtttcgcattgctgtgaaggaaaacctgactctgggtaacttagaaggaaagggggtttatgtggctcacagttctgcaggctgtgcaggaagcagcacggcaccagcatcagcttctggggagggcctcaggaaacccacaatcgtgatggaaggtgaaggggggtcaggcaggacacttggcaagagagggagcaggagagatgccaggcacttacaaatagccagctctcacatgaactgatagagcgagaactcactcattaccacagggagggcaccaagccattcaggagggataccccgcaatgacccaaacaccacacaccaggcctcacttccaacactggggtcacatttcaacatgagatttggagggcacacacatccaaaccatatcgggcactgaagaaaggcaatcaggttgcctgaaggagcctccatctgcccaggggctgcagccaggctggcagaaagggaccccagctgagcccaggcacagtcccttccccaccccccacggagagcccagtgccaacaataccacctccctcctcatgggaagacacagaggccaccaagggaggccctaagcagaggggaggaaatggtgagcttcgtccttttcccctggtgggggcctagcaagcagagcgcagccttgtgcctggtactttggccagggcatagctggaaggtccagaggtaagggccaggtttctgcatggcagtggagaacgcctggttggggaggccacctagccggatttgaaccctgggactggctatgtggccttgagtgagtcttttcctctctgtgggtctcactgtcctctctcaaatccggcctggagattctccagttgtgaactctccccacaaggcccccgtccctgcacaccagtaaccagttgtaacaagaaggtcacagagagtggttgtgacttcctaggtgcccccattgcctcccacctgccccctcctggcccccagctgccctgcccagtctggtgcgggcagggtgggcaggctgggttgaagatccatggatagcgggtggccgcgtggctcaagctgcaaggtgagcccacttcttgagcccaaggtacctcctcagcttggggctagaatcgcttggagctcccatctgcaaaatgggaggctcggctctgagctgttaagaaagatgctacctgggaagacggcaggaggcaagaagtgttaggaagagaaggatggtaatgatgtgcccctgaagaatttctccaaaggcctgggcagcagagtcaagggcctgccctctggagctggctttaaaggggcactgatacccaggaaggcccagccctgccctcaggagagcaaaagtgctcaaaagacagaactgccaaagcctgaggagcggggagggaaaggaggagatggcttgggcagtcttgcaggctccctggaggagggggcctggagcagggccctgaagccatggaagatctggaatggtaacaagaatgaattgacacgtgtctcaggagtgccaagaagggaagtctgagagacaaggagagagtagcataagggtcagggcagggctccctcgctgtgaccagcatgaacccacgtgggcactcagatgaggctgatgccagtatccaaggagcagctcaaaccagcaggtctcccaactgggcacagattggcgggtggctaagccctgctcactatgggaggaggtcctaaaaagcttctggactctgagccagtgaaggccatctgccatttgggcttggcacagagctgctatgcccctcgggttggagctggcccatgaaggccttgggacagggcttccttcctctcatgtttttgttcaagttgattaaacctgaggaatttttgcatccaggagcagaggcccacgtgcatttctgcgggagcctgtgattatcaaatcctcaaagggcaaagtgccaagcttagaagaagctaacagcaggccagaaggaatggggaaggccagcagcatccccagaacctcagaaacatcccctcaaggactcccagatctcccagagaacctccagaatctcagcaacatttctgagtttcagtaatgccataagaagccctgcaacctcagtattgcccccaagaagccccagaccttcagtaacacatcagaaccactgcaacacctcaggacactcaaactctggcaaactcaaactctggcaaatcaaccacagattggaacaagatgttcaaaagcctgtgaccatttgcagaaaggccagagacccccgttgctctccaccctcccatctcagcccttgactctgagtccagcagcaaacccaatagtttacaatactcaaacctcaggtacacccccaacttcgatagcacggaagagaacacgcaagagaggcgttccaggagtggggggatggccactgtgcccacctgtgcagcccagtccccttgagagtccatgaataagcagccgagagagtcaacctcatgcgggcccgtgagcttggggtgtgccctcagtggcacagcacactcacacacacatccaactgcccttcgcacacatacgtgcttaattctggcaccagaccaagtctgactccacacagtgggctggaaggcagtgtcgtcggctgccgtgctcacggcaggaagagtatgggtgactctccacctcctgtctctctacctcctacctcccctgccatgtgggagggtcagaagcaccatctgatgtgcccttcctgcaattctcatgcccccctcaccaacagcatcatcataacataaaggatttagaccaggctgttctggtatgagggtggacactggtgaggaggaggagggtagccggctgtgccaggggagcagcatgttctttccctcccagagggctaggctagtactgacctggaggagggaggcagatttcagctcagaacaaaggtagccttctagagtagtgaggcccccatcaagggaggcaatcaagaagaggctgttaacatcaagatgcaacagagggcttcctgccttcggaggactagacacaaggccatgaagattccccagctataagagccccacgttctccgttcccagcacgttcctccctgggctggccaccgtggtgtggccttgagatgtaggctttgtgctgccctccttcctcactgaggacattgactgctgggcagatcccctgacttctctctccttgttcccttgctgaccacaggacagggctctccaccaaccttttgcccacagccagtcagatccaactcagacaggactctgcgaatgtctcctgccttttggagctcctgctagccccccagtgtcccctgagggcagcccaccccaggtctccaaacttactcatcagaattgctccagcccatcactctgctcacttcctgcccctaggctctgactcctgctcacttcccaccgcacaccccatgtgccttctcgctgttccccgacctgttccaatcccacctggcctcccagacttggctccagcctacctccaatcaagcgctctcctgacctctcccttccttgtctctttcctttcctttattgatctctcccggaaacttgtccctccaggcaagcagggtgctcccaacacggggccttctcctctgagcccagcaccagctgggctgggatcctagaggggtggctggttgtgtggtctcggcagttggccctgagaagtgtccccagcacctgctttaaaaggtgtttgatctgctcctcccggaaggcagctccccccttctccagtctggctctgcccctcctcctgccctcacagacctcccgcccttgattccgggatcagaggaacccaccccacccccatctccagctcaggcacagagcaggggctggggccccacacaacacacagggcggcttgtctccagcggtatagcctctccacacccccaaaccgtttgctcgaaacttgatctccttggccctcagagtcacctcagtggagaagcctgcacagggctttgatggctgagtttccccagatgtggccttagagaagctgaggaaccccctacttacctccatttgtccccatccatcactcccagggggccactgcctgatgaattgccagaggggaaccaccagctcggctcttaataaccggatctgcatcctgctgctgcccagctgggctgagggccctgaccacagctaaggggagtcatcacagggcttcagggctggaattccaggtatgatctattcccaggggaagtgaaaaaggccccctcggagctttctcttctatttctcacttctcacagacaggctggggttctggagtcctgctcttcaccccaagtacatgcctgcaacctccaacgctgctggacagtcggctgcatcccccctcacctgagcac

SEQ ID NO: 1026 - DNA, 23750 bp, Homo sapiens
tttctcaggaacaagtttattgcagggaacacactaacctctttcataatagccaaaggcataaaaactacaaaaatatctggctctcgagtgtgggcagctcagtgtgggacctggtctgagtcatgacttgggctgccctgcaggccagaggcccgggagctttccggccactccccagagaggtccgtggcgctgagggggtgaggaagtgccttggctgcttccacagcgtgaaggccaaggctgaggtggagctgggctggagtggttccagagaaggcttcatcgaggcccttcaaggctgatggcagagccagggtagggagacgcctggatgtggctgccctggctcaactggctcctggaccaaggccctaacccaccagtttctttctccagaacccctgctggctctcccatagccaagtgggtggagcagagccctcctgaggctcccagtgcagacagacctccacccaaccacagtgatccggaggacctgctggctgcatggctggtgtgatgctgggaggagagccggggagggaggaggatggtaggcaggaacatgcctcagcacagatgggcaggtgggttgaccttccctgccctcagggctgggcaccattggcacccaacagggccgtcttgcggaagacctgcagggttgggttgtgcagcagcgtgtaggccagaccccagcgagccctgccgcggctggccccgggcctagctcccttggccatggagtcctttgtctgtagcagctgcatccctgagagagacggactttctgtgagtcactcagcaaacacccagccaaccctccctggccctcagacctgatcagagagcctgaaaatcccaggcgtgtgcaggtcgtgaggcttaggatgtcccctgcaggcagcacatggaagtggggggtgaggtctgtggatggactggaagctgggtgggacaagggtctggagctggcttagtgtcccctccctacacacacttctgggcagaaggaaaggaggagtcatactccctgccccaagggagaagcgggggcagtgacggagccccttaggaaggcagctgtttcattctctctgtgtgcacacatatggtgtgtgtatgtgtgtgttcatatcatggaaaaaatcaccctgagatcagaccaggaggggtgaccaaaggcagccaaggaagagaggaagtgagaattttcctggcgctcactctgtgtgctggggaggggcacacatccttcctagaagaagctgggtaggctctattcccccattcccagtgggagggcgcaccttcgtcttcctcccctggtctgaggctgtcctggggggctgccatggtcctgggtaggaggctctgcgcttgcaggagcagggagcagaaggctgtcatggctggatgcgactggctgacttcaatcttcaagaagtttcggtacgtgtagtagcctggggtggggtggcggatggcaatgctgggggagcaggggccacactggaggcatccagacatcccctaacacacacacagggagtgcacgtgcactccctgcatccaagcatgtcgacacaccaagcacgtggcacattggctgcatgggcacgtgtggacctgctagaacaccccacatccactgcacgtgctgcagggccacaggaggcacagcgcaggggcacacaggtggcacatgcagctacaggcatcggtgtgaactgatcagctggcacggccctggggcagggcagatgccttcctcactgcttgggtagcctgagcaatcctccagccccgcccagtgaccttaccggggtcgagagtggcggctctcggtggcagcaggctgaggtccatctggccaaggtggatggcgttgtagagggcagagaggagcactcgccaggtggccaccatggcacccaccagcacattgagggggaagagaagaaaggtggctgcatagagcactcgcctaggatgggagaagaaagctgaggcaggccgttccccagagctccctccccagggtcagtgtcagacctggatgcccagaactgctgtgtatttactgagtgcctaccatttattgctatgtcttctgtgcaccccaccctgggcaaggccttctctctttcaacccaccatgctgggagatgggaaactgaggcccagagagattgggagacttagccaaggctgtcagctattcagtggcagagctgggctttaactctaggtccatctgagtctttctatgaccctgatgcctcccacctcccttttctgggtcccctgtctgctaattccaagttcccctgggagccaaggttctcccacagacttgtcatctgacagggaactcccttgctacaaagtggggaggggcatggttttaaggaaacagaggatccaggggagagcagtaccgattcccaaagcaagaaaggttcacgggggtacttccagccccatgccgggtatgtagagaggtactttggagtgggctgagccattgtcccttttctctatgggtaaggcaagctctttctactatcatctgggttccttgatagagagaagggatagatggcagtggagggaggacacaaaaagagagagacaccgaagaagaggcgagggcctgagggagccacaagcccagatgccacctcaccggttggtcagctgtgggtgtccatcatgagtctccaggaagacccaatgggctgccatgttctgcaggatcacagccagggccaaagtcagccagaagggcctgccagtggggtggggaggtggtcgctgttagcggacctctaaggagtccctgagccctccatgtcttgtttcactcaccacgaggactccagggaacggaagagcaggaggttcctgccatggagcacaggcatgagcaccaggaaggccagggccgtggttcccaggaagaagatgatctgctgcaccaggagccctgccaggggcgggagtggcagggggacagaaaacaggttccatgaaaactggccatccccgctgcccccagaaccaagggctttgggattgggcaggcctggttttagatctctgctctgccactgcctagctatgctgccttgaacaaatcactttacttcattgagcctcagtttcttcctctgtaaaatggggataatagtccctacctcagaggctgttgtaaggatccaatgagataatgtctgtggaaactcttaaaatcacaaaatactttgcaaatgttatttccctccagtttctcctgagtttgagttactgggggataaggctacatattaaactgatgtttgcattccttcaagccagagcctggcatacggtaggtgcccaaggactgtctattgaaataatctggccaactgattagagaatgatgtctacaaaagggcctggaggcataagggctaccaagaagagacgctatgacttttgtcctagtaattcatctactcctttaccatccttctcctcccgcaaggaggtgagaatggaaggaactggagggagagatacaaggcccttggatgtgcaacccaggccacagcccctcaccattcagagtgcttttctcactgcagtacccaaggggagagtcagaaacttggggctggtaggggtcctggaaggttatctggtccaactctctcagggcaggaccccctttgcagactgcaacaatatccatggaactctgcttgcatacccccagtgacagggatctcattacctttgtaggtagccaaatgtgacacagccctttcttaagctggagcgcagtggtgcaatctcggctcactgcaacctccacctcctgggttcaagcgattctcctgcctcatcctcccgaatagctggaactgcaggtgcacaccaccatacccggctaatttttgtatttttagtagagacggggtctcaccatgttggccaggctggtcttcatctcctgacttcgtgatccacctgcctcagcctcccaaagtgctgggattacaggtgtgagccactgagcccagccaggaatgtaccattttgaatttgacacctccagacctgggtccacccccatgtgaatacttggtggcacccagggttcatctccatgtggagggtacacactcaatttcccgagggctcctgtacccccatcctgaataagcttcttaagggcagggaaggcaggggggtccctccttcttgctgctgccccagagcattcccagacaaactctgagggcagtacttgctgagcactcttctccccaactgaggccagtgtctgaggggaggcccaggccaaggctgggtgtggcgggcaagggaggctcaccaaggcagataaaggctgtctggtaggcactgaagctcatccaacagaatatggcttggcgggagggatggggactccgatgcaagggactcaagtccagggcagctcctcggtgcagagctcgaaggttggtcctggggtgggagccagggaggcagagacctcagggagcaacacactcttcctaaatcctcctctgggccagcaactggccaaactcccaatagaatttcaactcacagccatcagcagggaagcccagaactgtgggagccaggaggaggccactaacccaagatatctggaagaggtgatatctgggtagtcttaaacagtgaacgaggaatacaaaacgaggcagaaggctcaacctgagccaagtcagaaaagtgagaaacaacagtgagaatggaagtgacacacagcacagccaacaggtaaagaggcaaggcaagcacaggctgaggagccttgaatgccagaagaaggaggggtgacctgtggaaaaagatccctgggaagagctctgagacctggcaagtgcgcaggagacatgggccagttctctgacatgggtaagtgctcgggctgccccttccacctgccctgggccttcagtgctcctcaccactcaccgctgcagggcaagcaaggtggcatggcgagacccgtaccacctctccagtgtgctatgccaccaggctacccctcacctacactctcacatggcagggccaccccagcctctgttctcgtccacacagtcctcacctcctatctccttccattcccgggcaggtgcagcttccccaggccaccttccctctcatccagcccacccggtggcccctactcagggggcaagctccactagctgccctgagttggtggtgccctatgtccctcacactcacagacgtttccccaaccagacaggaaggcccaagggcaggacccagccccaccttctcccactgcagcgcagccacgcacaggtgggctccatgacagcccgggccggcagagcccttccctccctccaggcccagggcctccccgcaggcccacaggactcccactccttccccacctcggcgctgggtgagccagagtctgtcactcacctgtgtgtcaccagtgagcgcatcaggaccaggaaggtgagtaagcaggacaagaccaaggctgagatgtagcacactggtgggcagagaatgagcaaagtgagaggtcagggtctggagagtctcctggaggcctcagaacccctgccagggtggtgccttgtggggagttccccctgccccaaactgaactctgtgtggaagcctcttggccccacccccaggtctcagatgcagtgtaagccaatgacttcggccaccccattcttcccagtgacatacagtggtcaagagatgaaaccagctctgagtctgcagacctagtcctcaccctgctgttgctgcttctattgctgtgggacctccatccaacctggcatctgcctccagcttcactgcttcttggccatgtggccttcaggagggcactccttctccccaggcccccatttgctcgtgaacataccgcacgccgttatgctgcccagctctcaggataatgtgagccataaggccccatccacgtctgcactaatggtcttcgttcagggcatagagggtgtgagtccacatcggtgtggactgagtccatcagaatagggaggcagccgctgtcacccagctccctcaccctctccctggccatgcacacaatgagtgtgtgcatgatggtgtgtcatgaacaagcctgggtgtttaagaatttcaggggtgcaggctgcaactctcccaccttacgtccacatccagtcttgctctggactgtaacagcaaccccgcaaggttagacagaagaactgttcccactgggctgaagaggaagctgaggctcagagagagggcttcgcccagacagccatgctgctaggaatgatagagtgaggtgtgtaaccatttctaagcagatccagaatgagcctgagatgcctgcaccctgatctcatcagtcagtccagggaagtgttcctggtgcccgtgtcaccaccagaatctcaaggacggggagagcaaacacagaaaaggtgagtgctagttccacatagccacagggattagagtggtggatctcagcaccgatagcgcctttaggatcacctggagctgctaaaactcgcccatagcccagcctgcacccaaaccagttaaatcagaatttctgtgggtgggacccagccttagcctgtgaaagcaacactggtgattcagtgtgcagtcaggactgacagccactgctctgggggctttccaaaggcagagccttcatgatttatttccatcagaaatgaattgaaatcaaccaaccaaccaatatttattgggtgcctactacagtggtgatcaaactttgcttgcatgagaatcactgggactgtgatcccaacactttggaaggctgaggcggtggatcacctggggtcagaagttcgagaccagcctgaccaatatggtgaaactccgtctctactaaaaatacaaaaattagccaggcctggtggcgggcccctgtaatcccagctactcgggaggctgagatgggagaatcacttgaacctgagagacggaggttgcagtgagccgagattgtgccacggcactccaccctgggagacagaatgagactccgtctcaaaacaaaacaaaattagccgggcctggtggtatgtgcctgtaatcccagctactcgggaggctgaaatgggagaattgcttgaacccaggaggtggaggttgcagtgagccgagattgcaccactgcactccagcctgggcgacagagcacaactccatctcaaaagaaaaaaaaaatcactgggagggctgttcactcaaagaggctgggccccactctgagagtttctgattcagtaggtctggcacagggcttgagcaacgggaatgttaaagccaccaggtgcttcccagattcagccagggctaaaaatgatgctacagaaacctaggcccttctgctggtccctagctccctcctccagggccctcgcagggacacttttctcagaagcaaggttgggagaaagcactgtgcatgcatagctccagcctctgtggtcccccttctggagccagctgggctgcagcgagggcacattctggaccatttgctgccaggaggtgaacagcccgcctgctgagcctggcctggtgagtgtacaggctaacacagggttgaagggttagcagcccccttggccacaggcctggcctttgatctccatccatctacctcctacctctctctccctccactggttcccaacttgggcacccccaaaccccagcactcacacaatcttcctgctctttgccacctctgggatcctgtgcctgccttcttctgggccctgctttgggggatagatctgtcttccctcatgtgattgagggcctcaagggcaagtgttcctttttcactccagcactcattttgcagttggggaaattgaggtcaggagaggtaatgcactttgcccaaggtcactcagcttgtaagtgatggaacagagattctaatctagtttgcctgactcagtctgagctctctgtgagtgatgccaggcttatggtccaagtgctgggtggcagtcctaacagaagctctgagctcagaagacattagctccttaggcgaaggacagaccaagggacactggagcccaggttgcgggatggctttggccgtatctgtaatcctcctgggcctcagtattcctcatctgcaaatttaaagagtaactgttgctctgtttggcccaagaagattcaaagtgggagcctttgagcttggaaactgcaacatgcaattaaaaatataagacatgatgagtggaagcagagtcctttgccctggatgtgtctcattttgtctttgagcctcaatgtcctgccctgtgagctgggatcaatgatgctgacctacagggtcactgtgagcaagggtctgaggttggttgtgggctgacctggaccatgtctgcacctgcctatgaaccagattgcaaccagctcagaaaatctcctgggagaggacattttcagctcacccggaacttgtcacctgtccagtttgttgccctcagcagcagttccagggcagcctctagtacgggaactgaggtgctcacggagatggtggaggtggtcagggaaggaagtggtcactccgtgcacctctgcccaccccccactccctgccccgccatgaccagcatgcccaggtctgtaggataaggatgatgttaatggtcaggtacagctgcggagcagctacacctccacctgcaacgctggcagcccacgctctgaccacatgttactcctcagaagccgggggcccatccgtcccagcctggggtccccaagtaagcagaaggcgcatgcctcctgagtcctcagcaccgggctttgtcccaaggtgatggagaaggcccccgcctaggcttcaggagccctgcgttctcttggctgcactctgccctgctggatggcctcaggcaaatccttccccatgtgtcaagtggggacacttctcagtcccctccacagcgctgttgggagcgcccaggaggcagagtaagtaggtggctgcaggaggcatcagaccacagaaggggaagccaagatggttccctggttcaggagctcattgtcagaggagggaaggagaaaggagacggccccaaaagacagggagtggggaagagaaagcctgtgccctgcccaacgccagacccctgccacgaggattcgctcagaaatcctcaccatctcccttcgccgtctcttccctccttccccaccctcagctcccccatcccatggccttcctcatctccatgcctggatagttggtcagagacactgggggtggtgggggaagatgccacagaagcaggcaagggacaggagctgctgagatgtcccttcaggtttcatggaagctcagaactggaagcgccaactgccacaatttggagatgaggcaatcgagacccagagagaggaaggaatgtgtccaagggcccccagtgtgtccatggctgactagggcatagaccttgggtctccccgctttcattccccactgcagccctcaggggctccctggaggcctcaccttccagagcccacagatggtgcttcaccagctccaccacctcctgcttgtcctcggagagcacgattccaaagccggccagcaggtaggagacatccgtggtgacccctgccctcaccttctggatagtgggtaccacgcccaccagcagcagcagggccacctggaagagccccacagtgagggccccatcccaggaaagggttttctgtgctaacaggggagacgctggggaagaaactggcagcacacaggccccagccacatgcccattgcccatcagtgttcttatctgccccttagagcagggatctcacgcctctaaatgaggacattacagacaggtgcaatcacagcctaataggccaaaggcatgccttcgagcaccgtaacttcatatagtcagccctgcgtatctgtgggttccacatccacaaccaaccaattcaatcaagcgcagatcaaaaatatttggggaaaaaccctcaataaaaaataacaattcaatacaaataatacaaataaaaaataatacagtaggacaacttcttcttttttttttttttttgagatggagtcttgctctgtggccaggctggagtgcagtggcgcgatctcggctcactgcaacctccacctcccaggttcaagcaattctcctgcctcagcctcctgagtagctgggactacaggcccgcgccaccaccgccagctaatttttatatttttagtagagacagggtttcactacattggctgggatggtctcaatctcttgacattgtgatccgcccgcctcagcctcccaaagtgctgggattacaggtgtgagccaccacacccagacataggacaactgtttacatagcacttatgttcgatattataagtactttagagataacgaggtatactggagaatgtgtgtaggctatatgcaaatactacaccatcgtatatcagaaatttgagcctttggattttggtatggaggggtgttcctggaaccaacccacctcagatactgagggatgactgtgtctgcacctctatctatttacccatcatctatctatctaaactttggaatgtaaaatttctggtttttctatgttgtgaaagtaaatgagcacaggaattaaagctggacagacttggattcaaacttaggctacgctgagatattagctgtgcagaaacttggccaagtcaaattcacctctccaagcttccattctccccatctgtaaagtggagaataatcatacccatctcccaggattttaattgttgttgttggttttttcggggttttttttttttcggaggtggtgaggcagagtttatcaaacatgttgtcttgctaaatcttcccaattactcaaagaggaaaattattctattttctcctttttacagatgagctaacaggttcagagaggttatataacttgcccaaggccacacaggaggtaaatagtggagctaggatttaaattcgtgtttatgtggcctccaaaattaatgctccgagtcacttcatgagtccaagagtgaacaccccggcccttctgggtaggccagaactcccaagatggcctgcagcacctggtcagggttctggatggagcacctggagagctgggttgggccggaactgctccaggcttgggggttgagggcagggctccagaggcagatggcagtacagggtgagggacatacctggtaaatggccgtccctgtcagtgtagctgaaagcaccagcttcagcgggagatggaatcctgtagtcctcaaaggaaggagtatggtgaacagcaccactcaggcccgggagccctcctccctcccaaggggcccaggaaaagggccagcaggaccctaaatgaccaaggccaggccagggtcttcccgctgtcccaagctggtagttgtccctcttgatgacaaggattctggggagcaggagccagtcctccactgcagccattctgtgcaagggagggtaacgtcccctgtcacgctcggcctcagctcccaaccccatacctggctgtggagtgtagatgcagtgtctcaagcagacgcgggcccaggacaggaagccatgcttggaggtgtggtagctgcagaaagacccaggcaggtgcggggtcctcaggggaagcccattccctgagggccagccccagaggctggtcattcttcccctctgcccctgccatgctgcccagtgccagcttcccaagcacggctgctaaccagcccaatccattggcccacaaagggtgtgtcagagaccccacctgcttcccagcttcttcctgcaaaggaggttcctcagatattcctcagagtagctgctctgcagcccctgtggagacagacaattgaacaagcagatgagatctgcctcgacccattcgtgggtccctggctcagggaactagagtgttcaccaagcaggtgctccataaaaacctgttggccatggcggtggtggtgagtgtggatggggctgacctgtggggatgaggtccgtgccctccaaagcttcccttttctctctcacaaatacaaggccagtctcctatcaaagaaccatcaatgccaggaagttcttcctaagatctgtctccaactctcgcctgctttactcagtcacatctcttcaccgtttcttcccacccctagccctctggcctctgctagctgaaactggggcaaagggaagcttgtgtcccacgggcacatcctagaccaggacacagaagagggtcattccaggtcagacaccctcaggcttctcctgctgccactgcgcaagggagatcacaagggtgaccagatttgtctaagccacattccaggccttaagctgcctgtgaagtagcagaggcccatgggaagatggggtgagcccctgcctggaatcactgggagaacacaggctgttgtcacttgttgccatgacaaccctgggatcccgggcaggagtgggtcagctcaaagcttgatgggggtcctttgagacttaaacctctttgaccaaagtccaaagaggattgtacacctctcaagcctgggaggaaaggctggcaatggagagagagatggggtggtggaaaccctggaagagaaggtaaaggggcatgcctcaggcactgtgtcgtcccggggggccgctcccttttcagagccagctgtaaacaggaggggacacaggcttcctcgaggggtgttggcctcaataggcaggagctacaagcgctcagaactccctgcctgccacgtgggagccgagtctggagtccgtgggccttctcggaccagagtagcccaaaagggacccggggttctccatcctgcctagggatctcactcactctctggattcagtctgaccttgccgagttaacacccggtcccagcccctctgctgagctccagactttgagcagtacaccctcaggaccaagcatcatcccaggagcacctgctcctccctccaccttccctgggccagcagctggcaccaccacctacctgctggctggccaggtgcctcccatcaagcctttccttcccctgccctgtctgaagagaagccacgccctttggcctctatgtcttaagactttctcctgagtctgttcttctttcccctttgagggtctctgcagagctttcttcctcctcctctctcaccagaaagaagtagtggaccccgccccctgcaccacagtcccaacacccggtgcaggtttcacattgcactgcaggtgttttgtgccgcatctgtctcccccaccacactgggagctcctggagatcagacacaagtccatcagctccaagtccacagcactgagcccggggcctgacatatggtaggtgcttagaaggctttttagtgagattgaagtatcttctaagaattctcttttaccatgatgcattcatccatccatccttccttccatacatctttccttcgatccatccatccattcatccatctattcaaaaattcaaaaatatttgctgagtatctattaagggccaagacccacccagtgctgcaaatataatgaacaaaacagacacaaaactatctcttcccctttactcatgctctttcccgtgcctacaatgcctgctccttattctctcatcactctagatctccctgtccttcaggcccttgtagagtctacctcctctaggaagccctctcagccctcccctttatctgaaattattcaaccacatccaacctagagttgactcataatggagttctgccctgggtgcttcctgaatcatctcattatgtgcagaactcggattaggcacaaggctccaggctgtctctccagccagatctcagtgtttcacagacagagatatgactctcctggcttctgactcagttctgctttgttaagtccctactattcacacagcccagtgccgcgggtatcctgggtgccagtcaagggcccagtccagcttttgcctagggagggaggactaagcagtcactcagcaaacattttctgagcatctattctgtgctgggccctacatcaagcacggccatgtatctgggaccacagatacgggggagtagggctgtcttgggtgctgaggaagagctcatcccaggcctgcccctttaccttggagcctgctcctgtcctacggctgaagcttctcaccagctgcacagggtaccaaaggctcaggaatccgaggcccagcaggagaggcagggaggccagcagggagtagtacttgtagatctggacagacaaacacccagacagactactttccaccttcttcccccagccaagaaccagaatccgttgcccttcccacctcacactgggccctgagggtggtctggggggccatgggaaggcttcagctctatggttcccaacctgccacccagcgcaaacctgcccacttccccttctcgagccctgcagagatgctcacccctcccccaggctcctggatccccacgggcctgagaggagccaagaggaggagatcacttgattccctcctgccccccactggaaaggacacctctttctgtttctgtgttcccggagcattaggaacagttctgaaaatcacacgaaagcctgcctttgcctacatatagttttcaacctgagcatcaggaaagtctatgccctactcctcagggctgaggccttcctgggggtgggctttttgtatactcattcatttatttgttggttcaatatacttttattgagagcttagtatgtgccaggttctaggtggtgaaaaaaagccaccaagttccccctctcaaagcaacctcttagtcttcacctccaccctgagggactggtgttatcagctccatggacggatggagaaacggtctcagaaaggtggcactgtttccccaaggcacttggtaccacctggcatcattttgtttgcgtgtcatgtctgcccttctgaagtgacggctcttgggaggctagggactgtttgtcttgttcatagctgtagtccagtgcctggaaatgtccctggtacaaagtatgtgcttcaaatatgttgttgaatgaatgggtgagtgaatgaatgaagtggtgaagctggattcacactcaggttgtctggctctaaagcctgtaccatcactctttgagttctagactggacagcttcacagccccagccagcagccagtgagcaaggtcctgaggttccggaattctcctctcagccctcttagaccatccctgacttcgcacttgccggcctccatcaagcttcactcccattccctctccagcctgaccaaagggaagctgggggatcactaacacaggcattgggggtgggggccatttcaggctttctcttccccctactctgcccacttccccttctccgccacctcctagacttaaagttcctgagggctgggcccagccaccttgttccctgcctctcctgcagagcagccaagcttggaaggggcacatgtttgaaggcatggaatcccatgcacaatggaaggctgcagggcggcccatcatagaatcagagctcaaaggaggcactgtggtttgagtaggttgctctgtgcgcccctctgccctaggccattgtgatcagcggttaccttgggcacctggggacactctgccctctgccagacctggaccccaaggtgggcccaggacagcgtgctgccgagcaggtgtgcagctgtgtggccagccgtggcacaggcagccagagggtagtagagggcagcataatagaacagtcccagtatcttccaggcccctggaaggtgaaacaagcagagagacccatgctggaggggcagacatggggcctgcagtgagcccacccaggcctctcttcggtctccagcttccaagcccttcagcacgttcagtgggcaagaacactaggttcaaatccaggctctgactagtctcaactctgtgatcttgggcaagttacctcttggagcctcagttttcccatctgtaaaatgaaaataatcacagtatattagcaagggcaaaatgagaaggtggatatataatgcttagcatggtgcctgagcaaatactcaatttaagatactacttccctggctctcagttcctccattgcaaaatggggctaatatgcatactttgtagcatcgttgtaaagactggatggtctaaaaaggtcacgtctcaggatagcagcccatctcattgacagctgttcctgttactctcatctccttgagccaagcttaaaactccgagaccccaccctaccccatcccatcacaccaaccccagggcctgggggtcagtgggtaccttggctgggtgctgaggcgagagtcaggaagggcaatgcgtcctcgtcggggagcagcaaacacagggagctcaggaggaccatgaaaacagcagcaggcactgcccggggcctgtccccagccaagaaatccacagggctagcacagaggcaaggacagggcaggagggagttgctcagcccctgcacccccattacctcccagctgtattccataaatcaaggaggtggagtcagtcccactttctagatgggggaataaggccccttcattcattcattccatagatatttgtggagtgcctcttatctaccaagctctgggccccgtgccaaagggacttgggacacacatacagtgggaagaagccctaagactgctcctccgcccaccctggaagctccaggaagcagccacctccacactaattggtctgtctgagctggcaaaccttcagagaactcagcgagtcacaacatccttgtacaacagccgccgccctgggctgggtgtggacccggggcagagggcagacagcgggcatagctgtcccaggcatcacccttctgggctcagggcaagccactcagacccacagcttctgcactgcagcttgcattcatgctctgagaggttcattctccctcaaacactgccccagccagggcaagctctttctggggccaaccagagaccccaggctggttccccacaaaaccagcacagcaagacctgcctcggtgcacagtctgggtctgggatgtgaagctgtctacaccaaggagccacccatcacctgccccaaccctttggtctctcgcacactagcttgcccagccccatctcctcaggatcatgcctgtccaggctctggagtcacagggctgaaggagataggagaagaaagctccagctataggggctagatgtcagtccccataaatctgccttcaagcattagggtccaggtgataccctcagggaagatgacggtcaagatggcattgggatggtcacgtcaatccacacatggagggctgcctgagaaggtacactctgacgctgggtcctgtcaggcttgtttccctagggtctgggttggagtcctttctcccaggcgggcttgagcgagtccctcccccttcctctgggggtcctgactaaacctggagacctaggtgggggtgaggaaagctccaggctgagggcgatagggatgtcattaaagccagagctgccttttaggtacctaacaaatcacccaccctcccagagggaccctgtcagctgggtcccctgagtgggggtgcccaggccatggtacaaacctgggcaggccgggcctgccacgcacacagtcaggccagagctggcggcgcctcaccagcatggccaggagcagcagcacaaggatctgaaaggagagtgcagaggagggcttggggtgcccaggcctcccctgagggtctgagtttgagggcttggactcaggccccaggatatcccctacctgcccagtgcacactcatgtgacatcttggggactggtcaaggggtgacagacatctggaaggttggacttgcatcctggtttgggcctccaagctgggagaactcccagatagctccccccacccaggatcttccagggccccccttcaccagccccagtggggaacacaggtcccactgcccaggctggcagcagcttgcaagccaggttcaacttgggttggactcactgacagcgaggccaggcaggcgtggtacaggccgggtggtatgctggtgtggcaggagggcacttccctgcagagcaaatgaaggctggctcaggcctgcgtcaggcccccctgggtgtgcagatgggtctggggttcaagactgttcacactgaggctttacccactacctccctcaaccctctgatccctcctacacaagccttcccagtcccaccttctcagggtcattctggggccctcgtgtccctgtgatgtgccagccccatgccaagctctggggttataagactaaaggacatgggaagctcccaggggaagcagagtagaccggctcggcctgatcacttattctcttttttttttttctggagggacagggtcttgctctgtcacccaggctggagtgcagtggctcgatctcggcttactgcagcctcagcctcctgggctcaaaagatcctcccacctcagcctcatgagtagctgggaccacaggtgtgcaccaccatgcctggcatttttttttctgtatttttagtagagacagggcctcaccatgtcgcccaggctggtcttggatttctgagctcaagcaatcctcatgcctcagcctcccaaagtgctgggattacaggtgtgagccactgtgcccggctgagcacttattcttgctcacccagatgcttcctgtccttcaaggcctcccctctccagggagcccctctgactgctcctggtctcacagacgtcttctcagaactgcagttgagcacactacctgggtcaagcagtcaagggtttggccctgtgattcgccctctactcactgccatctgaggttggtctgtgactaaaatgatctcccctggtccctctcttttcctgcttccctctcattgagagcctccatggacagccatgcaggttgcccactgcacaaagatgctcagccaagggaacgagcaggccaccctgctcaccaaacccagcacctgctgagctgaatgcacctaactggggatccctttctctaattccacagaggctccctatggcctggcaatggtcctgcactcaccctggctgagcgcagaggtaaacccacagtggagataggggtcactgaggacaatgaaaccctccgcttccccagcagaatcatgtggtggagaaagggagtgaggcaggagtcctgagctcagggctggccctggccctgggagagtaggcaggactgggtccctggtgagcagtagagctccgggttttcccagcttgggcctgggagagccagagggagggtggcagcatgggtgaggccagtggggtctggtgggcgagggcctgagatggagcctgggctgccgccagtccctgcctgcacagagggcttagccgcccaccaaaacgccctccactgtatgaagagaggcatcaaggctgcattatccaggggagtgcagagccctgggatgctctgctgggtcagctcggtctgtcctgctcgctttctctcaggaaatcccagcgggtgagcggtgggaaagaaaccagtcacttggtggagaggcagagtaagtcagctctgggcagcttcttggccaggagaccagcctcttcccaaagtagaactgggatcgtgagtagcagccacactgactccagtgtcagctccccacctccagctccaaggcctctcactctggtgcgtagggcagccctccctctcagccggcatctccccgcatgactaggtcccgctccacctttacacctgggcccggcagggacttggaaaactgtccctggagtagtttgaccattttcctatggaccttaccccaaaccacccctacccccagaaatgccctccagggccctgcctgggggagcctctggccctttctgtatcacctgaggtccccatctgacctctcagctcagtgtgaggggtcagatggggatctcaggtggcatagaaatgagcaaatatttggctagtggcttgtggccccactttttgtgccatgggacaggcaggatggcacagacataaagaccttggagagggtggtgagcttgatcctgggacaggcacagcaggtgctgaaggatgcagaggagggagaactttgggcaaaaggaggtggtatctgattggagtttaaaaaatggttagtggctgggagcagtggctcacgcctataatcccagcactttgggagactgaggcaggcagatcaaccaaggtcaagagtttgagaccagcctggccaacatgatgaaaccctgtctccactaaaaatacaaaaaaaattagctgggcgtggtggcacgcacctgtaatcccagctactcgggaggctgaggcaggagaatcacttgaactggggaagcggaggttgcagtgagccaagatcgcaccactgcactccaacccgggcaacaagagcgagactccatctcaaaaaataaataaataaaagttggttagcatctctttaggcaaagaaggggagaggcagctccaggtggagggaagtgcatgaggaagcagagaggcaggcgacaggcagcgtggctggggctgggcaggccttccagtttgattgcagcccagaggtcaggtgagatgaggttacagcaagcatgggaggccccaggaagccactgagggtgtttgagccattgaatgttctggattttaggacatttctgtggctgactccactgccatcagtgttcatccaccccaactccagcctgagagtgctggggcactgggcactccggagttcttcaaagctctgatgcaacatgtccccagggtgtctgactcacacagacagaggtgaacccaagttcatttccttgggattcccctgagctcccaattttctgctcccactttgagggcagggggatggcaggcagctcaattggtttggctaagtaagtagattcaaacaaatctctttattcttatggatgtcatgccctgcagtgggagaaagaagctgaatcttctagatgtcacccacatgagggactggactccccatcacccagtgcctgacatacacacaactttattctgagacaacagctatagaccacagctacatttacaggcacctggcccccagccagtgcccaggccctgaggctcccaaggacacagcttcagattagagccttcacctaggtcagaaaccatcctcatgggttcctgggcctgtcctcattctggtctctcgcaggccacacatacacagcaggatatgtggagcccacaggctctcggtcagtcaggcaagatgagtggggagcacgcccttgctgactgcaggctattttccaggtggtcagaaccctgagtcctccaaacaacagctccttccccgaggcctgggtggagcctctgtccctgctggatgacccaagcccagccaggccgcagccccagcccctggggaggcacgcaaggatttttccttctcaagtttcaggttttgatggagaacagatgtgcacacatctggctcggcaacccccagcctcacctttctacttctccaaaccgtcagacagagcagggagataagggatggggccaggcctgggaacaacaggggagaactggctctgggtcctacacaggcaagacatcctggcaggaggtgggggacacagaaggggcccagctcctccaccagggtgcccagactaaaccccggtagaatggacccaggcaaagcagctgtggctgggttctcaggccaccctggggcgggctgccttcctgctcccaccctcacctgggctggcctgagcacttctgctaaagggaataggctctcctcatcctctgagaccatccaaagacaacaagggtgcttgtttcctcagtgacttctcaccaggctttctccctttggttctctgccttccccgaatcccccagcctgcccagagaacttgacacttggaaacaccacacccaaatgctcaccacagagaccaataaccccttgaagggaggtctgcttgcctcaactgctctcagcagcttctccatcctggctatgggccagaatcacccagggagccatccctgcagatctgaatcatctgtatttttaacacgtcacacatcatacctaaggtgaccagccttaggtgtcttaacagcagggtgagggatgttgttctcatgtaacagaggcagagactgaatgaaccccagagaggctgtgacttgcccaaggtcacacagcaaatgagtggcagagccagacctagcagcccctgcccaggagctgctccctggccagttgcaacctctgccatcaccccattctgatggctgacagagtgaggtggggtggttccacacttacccctctggctggagctcctcgcccccctggggctcatcgatgtaccagctgccataggagtagtcctctgtggccccgggggaggtctggttccctgctggctgggacgacattctctggcccttctcctttgaccccaggcgagagaaaaaaaaagccactacagatgtgaaaagaggcttaaaagagaaaaaaaaagaaagaaagacggaaaacccaaacaaagaaacatttctctttaatcctgaaggttactttcttacttttagctctctgggaaaagcccgtctgggactgagggcctgagcaagctggcacgggaagaggacagggcctctcgtgtcccctcctcccttcccgcccatcgcactggtcctgcagagatagctgtccccttggggccccggggctcccgctggcgcatctgtctgaccaaccaccagcaggcgtgtgttcaaaggaccattttcaaagaaggcttgtccagtctgagctgcctaaagagacgccccttccttcccctttcccaagcccacctagacagacccacagacacaccagaagggaggcccagggaggaaggagttgcagagatgaaagggtaggcagcccacggccagctccgcactgcctgcctgggccctcccagctgggctcccttgagcccctcccccagcctcagcctgcccctttctggcccctttgggcctcggtgatggaaatacaccataatccttgacaaagcccccctcctgggggaggaggccccagcaccattggcggcctgagccctgcaagggtgtggccaggagccacccccacccccgcacctgacttcacacacatacctgccttcagcgcctgccccagagctcccaagcccctgcccgccacatctgcagtgccgcacacagacaggagaccagcattacagcaacaaccgagtgagacggaccgctggggctgggctggggcggaggcagggaaggggaatctgtccgtttcttctcctagggtttccatgaaggaggcaacatgtgtctcattggtaaacccttttt

SEQ ID NO: 1027 - DNA, 29565 bp, Homo sapiens; identical to SEQ ID NO: 1024

SEQ ID NO: 1028 - DNA, 23414 bp, Homo sapiens
tttctcaggaacaagtttattgcagggaacacactaacctctttcataatagccaaaggcataaaaactacaaaaatatctggctctcgagtgtgggcagctcagtgtgggacctggtctgagtcatgacttgggctgccctgcaggccagaggcccgggagctttccggccactccccagagaggtccgtggcgctgagggggtgaggaagtgccttggctgcttccacagcgtgaaggccaaggctgaggtggagctgggctggagtggttccagagaaggcttcatcgaggcccttcaaggctgatggcagagccagggtagggagacgcctggatgtggctgccctggctcaactggctcctggaccaaggccctaacccaccagtttctttctccagaacccctgctggctctcccatagccaagtgggtggagcagagccctcctgaggctcccagtgcagacagacctccacccaaccacagtgatccggaggacctgctggctgcatggctggtgtgatgctgggaggagagccggggagggaggaggatggtaggcaggaacatgcctcagcacagatgggcaggtgggttgaccttccctgccctcagggctgggcaccattggcacccaacagggccgtcttgcggaagacctgcagggttgggttgtgcagcagcgtgtaggccagaccccagcgagccctgccgcggctggccccgggcctagctcccttggccatggagtcctttgtctgtagcagctgcatccctgagagagacggactttctgtgagtcactcagcaaacacccagccaaccctccctggccctcagacctgatcagagagcctgaaaatcccaggcgtgtgcaggtcgtgaggcttaggatgtcccctgcaggcagcacatggaagtggggggtgaggtctgtggatggactggaagctgggtgggacaagggtctggagctggcttagtgtcccctccctacacacacttctgggcagaaggaaaggaggagtcatactccctgccccaagggagaagcgggggcagtgacggagccccttaggaaggcagctgtttcattctctctgtgtgcacacatatggtgtgtgtatgtgtgtgttcatatcatggaaaaaatcaccctgagatcagaccaggaggggtgaccaaaggcagccaaggaagagaggaagtgagaattttcctggcgctcactctgtgtgctggggaggggcacacatccttcctagaagaagctgggtaggctctattcccccattcccagtgggagggcgcaccttcgtcttcctcccctggtctgaggctgtcctggggggctgccatggtcctgggtaggaggctctgcgcttgcaggagcagggagcagaaggctgtcatggctggatgcgactggctgacttcaatcttcaagaagtttcggtacgtgtagtagcctggggtggggtggcggatggcaatgctgggggagcaggggccacactggaggcatccagacatcccctaacacacacacagggagtgcacgtgcactccctgcatccaagcatgtcgacacaccaagcacgtggcacattggctgcatgggcacgtgtggacctgctagaacaccccacatccactgcacgtgctgcagggccacaggaggcacagcgcaggggcacacaggtggcacatgcagctacaggcatcggtgtgaactgatcagctggcacggccctggggcagggcagatgccttcctcactgcttgggtagcctgagcaatcctccagccccgcccagtgaccttaccggggtcgagagtggcggctctcggtggcagcaggctgaggtccatctggccaaggtggatggcgttgtagagggcagagaggagcactcgccaggtggccaccatggcacccaccagcacattgagggggaagagaagaaaggtggctgcatagagcactcgcctaggatgggagaagaaagctgaggcaggccgttccccagagctccctccccagggtcagtgtcagacctggatgcccagaactgctgtgtatttactgagtgcctaccatttattgctatgtcttctgtgcaccccaccctgggcaaggccttctctctttcaacccaccatgctgggagatgggaaactgaggcccagagagattgggagacttagccaaggctgtcagctattcagtggcagagctgggctttaactctaggtccatctgagtctttctatgaccctgatgcctcccacctcccttttctgggtcccctgtctgctaattccaagttcccctgggagccaaggttctcccacagacttgtcatctgacagggaactcccttgctacaaagtggggaggggcatggttttaaggaaacagaggatccaggggagagcagtaccgattcccaaagcaagaaaggttcacgggggtacttccagccccatgccgggtatgtagagaggtactttggagtgggctgagccattgtcccttttctctatgggtaaggcaagctctttctactatcatctgggttccttgatagagagaagggatagatggcagtggagggaggacacaaaaagagagagacaccgaagaagaggcgagggcctgagggagccacaagcccagatgccacctcaccggttggtcagctgtgggtgtccatcatgagtctccaggaagacccaatgggctgccatgttctgcaggatcacagccagggccaaagtcagccagaagggcctgccagtggggtggggaggtggtcgctgttagcggacctctaaggagtccctgagccctccatgtcttgtttcactcaccacgaggactccagggaacggaagagcaggaggttcctgccatggagcacaggcatgagcaccaggaaggccagggccgtggttcccaggaagaagatgatctgctgcaccaggagccctgccaggggcgggagtggcagggggacagaaaacaggttccatgaaaactggccatccccgctgcccccagaaccaagggctttgggattgggcaggcctggttttagatctctgctctgccactgcctagctatgctgccttgaacaaatcactttacttcattgagcctcagtttcttcctctgtaaaatggggataatagtccctacctcagaggctgttgtaaggatccaatgagataatgtctgtggaaactcttaaaatcacaaaatactttgcaaatgttatttccctccagtttctcctgagtttgagttactgggggataaggctacatattaaactgatgtttgcattccttcaagccagagcctggcatacggtaggtgcccaaggactgtctattgaaataatctggccaactgattagagaatgatgtctacaaaagggcctggaggcataagggctaccaagaagagacgctatgacttttgtcctagtaattcatctactcctttaccatccttctcctcccgcaaggaggtgagaatggaaggaactggagggagagatacaaggcccttggatgtgcaacccaggccacagcccctcaccattcagagtgcttttctcactgcagtacccaaggggagagtcagaaacttggggctggtaggggtcctggaaggttatctggtccaactctctcagggcaggaccccctttgcagactgcaacaatatccatggaactctgcttgcatacccccagtgacagggatctcattacctttgtaggtagccaaatgtgacacagccctttcttaagctggagcgcagtggtgcaatctcggctcactgcaacctccacctcctgggttcaagcgattctcctgcctcatcctcccgaatagctggaactgcaggtgcacaccaccatacccggctaatttttgtatttttagtagagacggggtctcaccatgttggccaggctggtcttcatctcctgacttcgtgatccacctgcctcagcctcccaaagtgctgggattacaggtgtgagccactgagcccagccaggaatgtaccattttgaatttgacacctccagacctgggtccacccccatgtgaatacttggtggcacccagggttcatctccatgtggagggtacacactcaatttcccgagggctcctgtacccccatcctgaataagcttcttaagggcagggaaggcaggggggtccctccttcttgctgctgccccagagcattcccagacaaactctgagggcagtacttgctgagcactcttctccccaactgaggccagtgtctgaggggaggcccaggccaaggctgggtgtggcgggcaagggaggctcaccaaggcagataaaggctgtctggtaggcactgaagctcatccaacagaatatggcttggcgggagggatggggactccgatgcaagggactcaagtccagggcagctcctcggtgcagagctcgaaggttggtcctggggtgggagccagggaggcagagacctcagggagcaacacactcttcctaaatcctcctctgggccagcaactggccaaactcccaatagaatttcaactcacagccatcagcagggaagcccagaactgtgggagccaggaggaggccactaacccaagatatctggaagaggtgatatctgggtagtcttaaacagtgaacgaggaatacaaaacgaggcagaaggctcaacctgagccaagtcagaaaagtgagaaacaacagtgagaatggaagtgacacacagcacagccaacaggtaaagaggcaaggcaagcacaggctgaggagccttgaatgccagaagaaggaggggtgacctgtggaaaaagatccctgggaagagctctgagacctggcaagtgcgcaggagacatgggccagttctctgacatgggtaagtgctcgggctgccccttccacctgccctgggccttcagtgctcctcaccactcaccgctgcagggcaagcaaggtggcatggcgagacccgtaccacctctccagtgtgctatgccaccaggctacccctcacctacactctcacatggcagggccaccccagcctctgttctcgtccacacagtcctcacctcctatctccttccattcccgggcaggtgcagcttccccaggccaccttccctctcatccagcccacccggtggcccctactcagggggcaagctccactagctgccctgagttggtggtgccctatgtccctcacactcacagacgtttccccaaccagacaggaaggcccaagggcaggacccagccccaccttctcccactgcagcgcagccacgcacaggtgggctccatgacagcccgggccggcagagcccttccctccctccaggcccagggcctccccgcaggcccacaggactcccactccttccccacctcggcgctgggtgagccagagtctgtcactcacctgtgtgtcaccagtgagcgcatcaggaccaggaaggtgagtaagcaggacaagaccaaggctgagatgtagcacactggtgggcagagaatgagcaaagtgagaggtcagggtctggagagtctcctggaggcctcagaacccctgccagggtggtgccttgtggggagttccccctgccccaaactgaactctgtgtggaagcctcttggccccacccccaggtctcagatgcagtgtaagccaatgacttcggccaccccattcttcccagtgacatacagtggtcaagagatgaaaccagctctgagtctgcagacctagtcctcaccctgctgttgctgcttctattgctgtgggacctccatccaacctggcatctgcctccagcttcactgcttcttggccatgtggccttcaggagggcactccttctccccaggcccccatttgctcgtgaacataccgcacgccgttatgctgcccagctctcaggataatgtgagccataaggccccatccacgtctgcactaatggtcttcgttcagggcatagagggtgtgagtccacatcggtgtggactgagtccatcagaatagggaggcagccgctgtcacccagctccctcaccctctccctggccatgcacacaatgagtgtgtgcatgatggtgtgtcatgaacaagcctgggtgtttaagaatttcaggggtgcaggctgcaactctcccaccttacgtccacatccagtcttgctctggactgtaacagcaaccccgcaaggttagacagaagaactgttcccactgggctgaagaggaagctgaggctcagagagagggcttcgcccagacagccatgctgctaggaatgatagagtgaggtgtgtaaccatttctaagcagatccagaatgagcctgagatgcctgcaccctgatctcatcagtcagtccagggaagtgttcctggtgcccgtgtcaccaccagaatctcaaggacggggagagcaaacacagaaaaggtgagtgctagttccacatagccacagggattagagtggtggatctcagcaccgatagcgcctttaggatcacctggagctgctaaaactcgcccatagcccagcctgcacccaaaccagttaaatcagaatttctgtgggtgggacccagccttagcctgtgaaagcaacactggtgattcagtgtgcagtcaggactgacagccactgctctgggggctttccaaaggcagagccttcatgatttatttccatcagaaatgaattgaaatcaaccaaccaaccaatatttattgggtgcctactacagtggtgatcaaactttgcttgcatgagaatcactgggactgtgatcccaacactttggaaggctgaggcggtggatcacctggggtcagaagttcgagaccagcctgaccaatatggtgaaactccgtctctactaaaaatacaaaaattagccaggcctggtggcgggcccctgtaatcccagctactcgggaggctgagatgggagaatcacttgaacctgagagacggaggttgcagtgagccgagattgtgccacggcactccaccctgggagacagaatgagactccgtctcaaaacaaaacaaaattagccgggcctggtggtatgtgcctgtaatcccagctactcgggaggctgaaatgggagaattgcttgaacccaggaggtggaggttgcagtgagccgagattgcaccactgcactccagcctgggcgacagagcacaactccatctcaaaagaaaaaaaaaatcactgggagggctgttcactcaaagaggctgggccccactctgagagtttctgattcagtaggtctggcacagggcttgagcaacgggaatgttaaagccaccaggtgcttcccagattcagccagggctaaaaatgatgctacagaaacctaggcccttctgctggtccctagctccctcctccagggccctcgcagggacacttttctcagaagcaaggttgggagaaagcactgtgcatgcatagctccagcctctgtggtcccccttctggagccagctgggctgcagcgagggcacattctggaccatttgctgccaggaggtgaacagcccgcctgctgagcctggcctggtgagtgtacaggctaacacagggttgaagggttagcagcccccttggccacaggcctggcctttgatctccatccatctacctcctacctctctctccctccactggttcccaacttgggcacccccaaaccccagcactcacacaatcttcctgctctttgccacctctgggatcctgtgcctgccttcttctgggccctgctttgggggatagatctgtcttccctcatgtgattgagggcctcaagggcaagtgttcctttttcactccagcactcattttgcagttggggaaattgaggtcaggagaggtaatgcactttgcccaaggtcactcagcttgtaagtgatggaacagagattctaatctagtttgcctgactcagtctgagctctctgtgagtgatgccaggcttatggtccaagtgctgggtggcagtcctaacagaagctctgagctcagaagacattagctccttaggcgaaggacagaccaagggacactggagcccaggttgcgggatggctttggccgtatctgtaatcctcctgggcctcagtattcctcatctgcaaatttaaagagtaactgttgctctgtttggcccaagaagattcaaagtgggagcctttgagcttggaaactgcaacatgcaattaaaaatataagacatgatgagtggaagcagagtcctttgccctggatgtgtctcattttgtctttgagcctcaatgtcctgccctgtgagctgggatcaatgatgctgacctacagggtcactgtgagcaagggtctgaggttggttgtgggctgacctggaccatgtctgcacctgcctatgaaccagattgcaaccagctcagaaaatctcctgggagaggacattttcagctcacccggaacttgtcacctgtccagtttgttgccctcagcagcagttccagggcagcctctagtacgggaactgaggtgctcacggagatggtggaggtggtcagggaaggaagtggtcactccgtgcacctctgcccaccccccactccctgccccgccatgaccagcatgcccaggtctgtaggataaggatgatgttaatggtcaggtacagctgcggagcagctacacctccacctgcaacgctggcagcccacgctctgaccacatgttactcctcagaagccgggggcccatccgtcccagcctggggtccccaagtaagcagaaggcgcatgcctcctgagtcctcagcaccgggctttgtcccaaggtgatggagaaggcccccgcctaggcttcaggagccctgcgttctcttggctgcactctgccctgctggatggcctcaggcaaatccttccccatgtgtcaagtggggacacttctcagtcccctccacagcgctgttgggagcgcccaggaggcagagtaagtaggtggctgcaggaggcatcagaccacagaaggggaagccaagatggttccctggttcaggagctcattgtcagaggagggaaggagaaaggagacggccccaaaagacagggagtggggaagagaaagcctgtgccctgcccaacgccagacccctgccacgaggattcgctcagaaatcctcaccatctcccttcgccgtctcttccctccttccccaccctcagctcccccatcccatggccttcctcatctccatgcctggatagttggtcagagacactgggggtggtgggggaagatgccacagaagcaggcaagggacaggagctgctgagatgtcccttcaggtttcatggaagctcagaactggaagcgccaactgccacaatttggagatgaggcaatcgagacccagagagaggaaggaatgtgtccaagggcccccagtgtgtccatggctgactagggcatagaccttgggtctccccgctttcattccccactgcagccctcaggggctccctggaggcctcaccttccagagcccacagatggtgcttcaccagctccaccacctcctgcttgtcctcggagagcacgattccaaagccggccagcaggtaggagacatccgtggtgacccctgccctcaccttctggatagtgggtaccacgcccaccagcagcagcagggccacctggaagagccccacagtgagggccccatcccaggaaagggttttctgtgctaacaggggagacgctggggaagaaactggcagcacacaggccccagccacatgcccattgcccatcagtgttcttatctgccccttagagcagggatctcacgcctctaaatgaggacattacagacaggtgcaatcacagcctaataggccaaaggcatgccttcgagcaccgtaacttcatatagtcagccctgcgtatctgtgggttccacatccacaaccaaccaattcaatcaagcgcagatcaaaaatatttggggaaaaaccctcaataaaaaataacaattcaatacaaataatacaaataaaaaataatacagtaggacaacttcttcttttttttttttttttgagatggagtcttgctctgtggccaggctggagtgcagtggcgcgatctcggctcactgcaacctccacctcccaggttcaagcaattctcctgcctcagcctcctgagtagctgggactacaggcccgcgccaccaccgccagctaatttttatatttttagtagagacagggtttcactacattggctgggatggtctcaatctcttgacattgtgatccgcccgcctcagcctcccaaagtgctgggattacaggtgtgagccaccacacccagacataggacaactgtttacatagcacttatgttcgatattataagtactttagagataacgaggtatactggagaatgtgtgtaggctatatgcaaatactacaccatcgtatatcagaaatttgagcctttggattttggtatggaggggtgttcctggaaccaacccacctcagatactgagggatgactgtgtctgcacctctatctatttacccatcatctatctatctaaactttggaatgtaaaatttctggtttttctatgttgtgaaagtaaatgagcacaggaattaaagctggacagacttggattcaaacttaggctacgctgagatattagctgtgcagaaacttggccaagtcaaattcacctctccaagcttccattctccccatctgtaaagtggagaataatcatacccatctcccaggattttaattgttgttgttggttttttcggggttttttttttttcggaggtggtgaggcagagtttatcaaacatgttgtcttgctaaatcttcccaattactcaaagaggaaaattattctattttctcctttttacagatgagctaacaggttcagagaggttatataacttgcccaaggccacacaggaggtaaatagtggagctaggatttaaattcgtgtttatgtggcctccaaaattaatgctccgagtcacttcatgagtccaagagtgaacaccccggcccttctgggtaggccagaactcccaagatggcctgcagcacctggtcagggttctggatggagcacctggagagctgggttgggccggaactgctccaggcttgggggttgagggcagggctccagaggcagatggcagtacagggtgagggacatacctggtaaatggccgtccctgtcagtgtagctgaaagcaccagcttcagcgggagatggaatcctgtagtcctcaaaggaaggagtatggtgaacagcaccactcaggcccgggagccctcctccctcccaaggggcccaggaaaagggccagcaggaccctaaatgaccaaggccaggccagggtcttcccgctgtcccaagctggtagttgtccctcttgatgacaaggattctggggagcaggagccagtcctccactgcagccattctgtgcaagggagggtaacgtcccctgtcacgctcggcctcagctcccaaccccatacctggctgtggagtgtagatgcagtgtctcaagcagacgcgggcccaggacaggaagccatgcttggaggtgtggtagctgcagaaagacccaggcaggtgcggggtcctcaggggaagcccattccctgagggccagccccagaggctggtcattcttcccctctgcccctgccatgctgcccagtgccagcttcccaagcacggctgctaaccagcccaatccattggcccacaaagggtgtgtcagagaccccacctgcttcccagcttcttcctgcaaaggaggttcctcagatattcctcagagtagctgctctgcagcccctgtggagacagacaattgaacaagcagatgagatctgcctcgacccattcgtgggtccctggctcagggaactagagtgttcaccaagcaggtgctccataaaaacctgttggccatggcggtggtggtgagtgtggatggggctgacctgtggggatgaggtccgtgccctccaaagcttcccttttctctctcacaaatacaaggccagtctcctatcaaagaaccatcaatgccaggaagttcttcctaagatctgtctccaactctcgcctgctttactcagtcacatctcttcaccgtttcttcccacccctagccctctggcctctgctagctgaaactggggcaaagggaagcttgtgtcccacgggcacatcctagaccaggacacagaagagggtcattccaggtcagacaccctcaggcttctcctgctgccactgcgcaagggagatcacaagggtgaccagatttgtctaagccacattccaggccttaagctgcctgtgaagtagcagaggcccatgggaagatggggtgagcccctgcctggaatcactgggagaacacaggctgttgtcacttgttgccatgacaaccctgggatcccgggcaggagtgggtcagctcaaagcttgatgggggtcctttgagacttaaacctctttgaccaaagtccaaagaggattgtacacctctcaagcctgggaggaaaggctggcaatggagagagagatggggtggtggaaaccctggaagagaaggtaaaggggcatgcctcaggcactgtgtcgtcccggggggccgctcccttttcagagccagctgtaaacaggaggggacacaggcttcctcgaggggtgttggcctcaataggcaggagctacaagcgctcagaactccctgcctgccacgtgggagccgagtctggagtccgtgggccttctcggaccagagtagcccaaaagggacccggggttctccatcctgcctagggatctcactcactctctggattcagtctgaccttgccgagttaacacccggtcccagcccctctgctgagctccagactttgagcagtacaccctcaggaccaagcatcatcccaggagcacctgctcctccctccaccttccctgggccagcagctggcaccaccacctacctgctggctggccaggtgcctcccatcaagcctttccttcccctgccctgtctgaagagaagccacgccctttggcctctatgtcttaagactttctcctgagtctgttcttctttcccctttgagggtctctgcagagctttcttcctcctcctctctcaccagaaagaagtagtggaccccgccccctgcaccacagtcccaacacccggtgcaggtttcacattgcactgcaggtgttttgtgccgcatctgtctcccccaccacactgggagctcctggagatcagacacaagtccatcagctccaagtccacagcactgagcccggggcctgacatatggtaggtgcttagaaggctttttagtgagattgaagtatcttctaagaattctcttttaccatgatgcattcatccatccatccttccttccatacatctttccttcgatccatccatccattcatccatctattcaaaaattcaaaaatatttgctgagtatctattaagggccaagacccacccagtgctgcaaatataatgaacaaaacagacacaaaactatctcttcccctttactcatgctctttcccgtgcctacaatgcctgctccttattctctcatcactctagatctccctgtccttcaggcccttgtagagtctacctcctctaggaagccctctcagccctcccctttatctgaaattattcaaccacatccaacctagagttgactcataatggagttctgccctgggtgcttcctgaatcatctcattatgtgcagaactcggattaggcacaaggctccaggctgtctctccagccagatctcagtgtttcacagacagagatatgactctcctggcttctgactcagttctgctttgttaagtccctactattcacacagcccagtgccgcgggtatcctgggtgccagtcaagggcccagtccagcttttgcctagggagggaggactaagcagtcactcagcaaacattttctgagcatctattctgtgctgggccctacatcaagcacggccatgtatctgggaccacagatacgggggagtagggctgtcttgggtgctgaggaagagctcatcccaggcctgcccctttaccttggagcctgctcctgtcctacggctgaagcttctcaccagctgcacagggtaccaaaggctcaggaatccgaggcccagcaggagaggcagggaggccagcagggagtagtacttgtagatctggacagacaaacacccagacagactactttccaccttcttcccccagccaagaaccagaatccgttgcccttcccacctcacactgggccctgagggtggtctggggggccatgggaaggcttcagctctatggttcccaacctgccacccagcgcaaacctgcccacttccccttctcgagccctgcagagatgctcacccctcccccaggctcctggatccccacgggcctgagaggagccaagaggaggagatcacttgattccctcctgccccccactggaaaggacacctctttctgtttctgtgttcccggagcattaggaacagttctgaaaatcacacgaaagcctgcctttgcctacatatagttttcaacctgagcatcaggaaagtctatgccctactcctcagggctgaggccttcctgggggtgggctttttgtatactcattcatttatttgttggttcaatatacttttattgagagcttagtatgtgccaggttctaggtggtgaaaaaaagccaccaagttccccctctcaaagcaacctcttagtcttcacctccaccctgagggactggtgttatcagctccatggacggatggagaaacggtctcagaaaggtggcactgtttccccaaggcacttggtaccacctggcatcattttgtttgcgtgtcatgtctgcccttctgaagtgacggctcttgggaggctagggactgtttgtcttgttcatagctgtagtccagtgcctggaaatgtccctggtacaaagtatgtgcttcaaatatgttgttgaatgaatgggtgagtgaatgaatgaagtggtgaagctggattcacactcaggttgtctggctctaaagcctgtaccatcactctttgagttctagactggacagcttcacagccccagccagcagccagtgagcaaggtcctgaggttccggaattctcctctcagccctcttagaccatccctgacttcgcacttgccggcctccatcaagcttcactcccattccctctccagcctgaccaaagggaagctgggggatcactaacacaggcattgggggtgggggccatttcaggctttctcttccccctactctgcccacttccccttctccgccacctcctagacttaaagttcctgagggctgggcccagccaccttgttccctgcctctcctgcagagcagccaagcttggaaggggcacatgtttgaaggcatggaatcccatgcacaatggaaggctgcagggcggcccatcatagaatcagagctcaaaggaggcactgtggtttgagtaggttgctctgtgcgcccctctgccctaggccattgtgatcagcggttaccttgggcacctggggacactctgccctctgccagacctggaccccaaggtgggcccaggacagcgtgctgccgagcaggtgtgcagctgtgtggccagccgtggcacaggcagccagagggtagtagagggcagcataatagaacagtcccagtatcttccaggcccctggaaggtgaaacaagcagagagacccatgctggaggggcagacatggggcctgcagtgagcccacccaggcctctcttcggtctccagcttccaagcccttcagcacgttcagtgggcaagaacactaggttcaaatccaggctctgactagtctcaactctgtgatcttgggcaagttacctcttggagcctcagttttcccatctgtaaaatgaaaataatcacagtatattagcaagggcaaaatgagaaggtggatatataatgcttagcatggtgcctgagcaaatactcaatttaagatactacttccctggctctcagttcctccattgcaaaatggggctaatatgcatactttgtagcatcgttgtaaagactggatggtctaaaaaggtcacgtctcaggatagcagcccatctcattgacagctgttcctgttactctcatctccttgagccaagcttaaaactccgagaccccaccctaccccatcccatcacaccaaccccagggcctgggggtcagtgggtaccttggctgggtgctgaggcgagagtcaggaagggcaatgcgtcctcgtcggggagcagcaaacacagggagctcaggaggaccatgaaaacagcagcaggcactgcccggggcctgtccccagccaagaaatccacagggctagcacagaggcaaggacagggcaggagggagttgctcagcccctgcacccccattacctcccagctgtattccataaatcaaggaggtggagtcagtcccactttctagatgggggaataaggccccttcattcattcattccatagatatttgtggagtgcctcttatctaccaagctctgggccccgtgccaaagggacttgggacacacatacagtgggaagaagccctaagactgctcctccgcccaccctggaagctccaggaagcagccacctccacactaattggtctgtctgagctggcaaaccttcagagaactcagcgagtcacaacatccttgtacaacagccgccgccctgggctgggtgtggacccggggcagagggcagacagcgggcatagctgtcccaggcatcacccttctgggctcagggcaagccactcagacccacagcttctgcactgcagcttgcattcatgctctgagaggttcattctccctcaaacactgccccagccagggcaagctctttctggggccaaccagagaccccaggctggttccccacaaaaccagcacagcaagacctgcctcggtgcacagtctgggtctgggatgtgaagctgtctacaccaaggagccacccatcacctgccccaaccctttggtctctcgcacactagcttgcccagccccatctcctcaggatcatgcctgtccaggctctggagtcacagggctgaaggagataggagaagaaagctccagctataggggctagatgtcagtccccataaatctgccttcaagcattagggtccaggtgataccctcagggaagatgacggtcaagatggcattgggatggtcacgtcaatccacacatggagggctgcctgagaaggtacactctgacgctgggtcctgtcaggcttgtttccctagggtctgggttggagtcctttctcccaggcgggcttgagcgagtccctcccccttcctctgggggtcctgactaaacctggagacctaggtgggggtgaggaaagctccaggctgagggcgatagggatgtcattaaagccagagctgccttttaggtacctaacaaatcacccaccctcccagagggaccctgtcagctgggtcccctgagtgggggtgcccaggccatggtacaaacctgggcaggccgggcctgccacgcacacagtcaggccagagctggcggcgcctcaccagcatggccaggagcagcagcacaaggatctgaaaggagagtgcagaggagggcttggggtgcccaggcctcccctgagggtctgagtttgagggcttggactcaggccccaggatatcccctacctgcccagtgcacactcatgtgacatcttggggactggtcaaggggtgacagacatctggaaggttggacttgcatcctggtttgggcctccaagctgggagaactcccagatagctccccccacccaggatcttccagggccccccttcaccagccccagtggggaacacaggtcccactgcccaggctggcagcagcttgcaagccaggttcaacttgggttggactcactgacagcgaggccaggcaggcgtggtacaggccgggtggtatgctggtgtggcaggagggcacttccctgcagagcaaatgaaggctggctcaggcctgcgtcaggcccccctgggtgtgcagatgggtctggggttcaagactgttcacactgaggctttacccactacctccctcaaccctctgatccctcctacacaagccttcccagtcccaccttctcagggtcattctggggccctcgtgtccctgtgatgtgccagccccatgccaagctctggggttataagactaaaggacatgggaagctcccaggggaagcagagtagaccggctcggcctgatcacttattctcttttttttttttctggagggacagggtcttgctctgtcacccaggctggagtgcagtggctcgatctcggcttactgcagcctcagcctcctgggctcaaaagatcctcccacctcagcctcatgagtagctgggaccacaggtgtgcaccaccatgcctggcatttttttttctgtatttttagtagagacagggcctcaccatgtcgcccaggctggtcttggatttctgagctcaagcaatcctcatgcctcagcctcccaaagtgctgggattacaggtgtgagccactgtgcccggctgagcacttattcttgctcacccagatgcttcctgtccttcaaggcctcccctctccagggagcccctctgactgctcctggtctcacagacgtcttctcagaactgcagttgagcacactacctgggtcaagcagtcaagggtttggccctgtgattcgccctctactcactgccatctgaggttggtctgtgactaaaatgatctcccctggtccctctcttttcctgcttccctctcattgagagcctccatggacagccatgcaggttgcccactgcacaaagatgctcagccaagggaacgagcaggccaccctgctcaccaaacccagcacctgctgagctgaatgcacctaactggggatccctttctctaattccacagaggctccctatggcctggcaatggtcctgcactcaccctggctgagcgcagaggtaaacccacagtggagataggggtcactgaggacaatgaaaccctccgcttccccagcagaatcatgtggtggagaaagggagtgaggcaggagtcctgagctcagggctggccctggccctgggagagtaggcaggactgggtccctggtgagcagtagagctccgggttttcccagcttgggcctgggagagccagagggagggtggcagcatgggtgaggccagtggggtctggtgggcgagggcctgagatggagcctgggctgccgccagtccctgcctgcacagagggcttagccgcccaccaaaacgccctccactgtatgaagagaggcatcaaggctgcattatccaggggagtgcagagccctgggatgctctgctgggtcagctcggtctgtcctgctcgctttctctcaggaaatcccagcgggtgagcggtgggaaagaaaccagtcacttggtggagaggcagagtaagtcagctctgggcagcttcttggccaggagaccagcctcttcccaaagtagaactgggatcgtgagtagcagccacactgactccagtgtcagctccccacctccagctccaaggcctctcactctggtgcgtagggcagccctccctctcagccggcatctccccgcatgactaggtcccgctccacctttacacctgggcccggcagggacttggaaaactgtccctggagtagtttgaccattttcctatggaccttaccccaaaccacccctacccccagaaatgccctccagggccctgcctgggggagcctctggccctttctgtatcacctgaggtccccatctgacctctcagctcagtgtgaggggtcagatggggatctcaggtggcatagaaatgagcaaatatttggctagtggcttgtggccccactttttgtgccatgggacaggcaggatggcacagacataaagaccttggagagggtggtgagcttgatcctgggacaggcacagcaggtgctgaaggatgcagaggagggagaactttgggcaaaaggaggtggtatctgattggagtttaaaaaatggttagtggctgggagcagtggctcacgcctataatcccagcactttgggagactgaggcaggcagatcaaccaaggtcaagagtttgagaccagcctggccaacatgatgaaaccctgtctccactaaaaatacaaaaaaaattagctgggcgtggtggcacgcacctgtaatcccagctactcgggaggctgaggcaggagaatcacttgaactggggaagcggaggttgcagtgagccaagatcgcaccactgcactccaacccgggcaacaagagcgagactccatctcaaaaaataaataaataaaagttggttagcatctctttaggcaaagaaggggagaggcagctccaggtggagggaagtgcatgaggaagcagagaggcaggcgacaggcagcgtggctggggctgggcaggccttccagtttgattgcagcccagaggtcaggtgagatgaggttacagcaagcatgggaggccccaggaagccactgagggtgtttgagccattgaatgttctggattttaggacatttctgtggctgactccactgccatcagtgttcatccaccccaactccagcctgagagtgctggggcactgggcactccggagttcttcaaagctctgatgcaacatgtccccagggtgtctgactcacacagacagaggtgaacccaagttcatttccttgggattcccctgagctcccaattttctgctcccactttgagggcagggggatggcaggcagctcaattggtttggctaagtaagtagattcaaacaaatctctttattcttatggatgtcatgccctgcagtgggagaaagaagctgaatcttctagatgtcacccacatgagggactggactccccatcacccagtgcctgacatacacacaactttattctgagacaacagctatagaccacagctacatttacaggcacctggcccccagccagtgcccaggccctgaggctcccaaggacacagcttcagattagagccttcacctaggtcagaaaccatcctcatgggttcctgggcctgtcctcattctggtctctcgcaggccacacatacacagcaggatatgtggagcccacaggctctcggtcagtcaggcaagatgagtggggagcacgcccttgctgactgcaggctattttccaggtggtcagaaccctgagtcctccaaacaacagctccttccccgaggcctgggtggagcctctgtccctgctggatgacccaagcccagccaggccgcagccccagcccctggggaggcacgcaaggatttttccttctcaagtttcaggttttgatggagaacagatgtgcacacatctggctcggcaacccccagcctcacctttctacttctccaaaccgtcagacagagcagggagataagggatggggccaggcctgggaacaacaggggagaactggctctgggtcctacacaggcaagacatcctggcaggaggtgggggacacagaaggggcccagctcctccaccagggtgcccagactaaaccccggtagaatggacccaggcaaagcagctgtggctgggttctcaggccaccctggggcgggctgccttcctgctcccaccctcacctgggctggcctgagcacttctgctaaagggaataggctctcctcatcctctgagaccatccaaagacaacaagggtgcttgtttcctcagtgacttctcaccaggctttctccctttggttctctgccttccccgaatcccccagcctgcccagagaacttgacacttggaaacaccacacccaaatgctcaccacagagaccaataaccccttgaagggaggtctgcttgcctcaactgctctcagcagcttctccatcctggctatgggccagaatcacccagggagccatccctgcagatctgaatcatctgtatttttaacacgtcacacatcatacctaaggtgaccagccttaggtgtcttaacagcagggtgagggatgttgttctcatgtaacagaggcagagactgaatgaaccccagagaggctgtgacttgcccaaggtcacacagcaaatgagtggcagagccagacctagcagcccctgcccaggagctgctccctggccagttgcaacctctgccatcaccccattctgatggctgacagagtgaggtggggtggttccacacttacccctctggctggagctcctcgcccccctggggctcatcgatgtaccagctgccataggagtagtcctctgtggccccgggggaggtctggttccctgctggctgggacgacattctctggcccttctcctttgaccccaggcgagagaaaaaaaaagccactacagatgtgaaaagaggcttaaaagagaaaaaaaaagaaagaaagacggaaaacccaaacaaagaaacatttctctttaatcctgaaggttactttcttacttttagctctctgggaaaagcccgtctgggactgagggcctgagcaagctggcacgggaagaggacagggcctctcgtgtcccctcctcccttcccgcccatcgcactggtcctgcagagatagctgtccccttggggccccggggctcccgctggcgcatctgtctgaccaaccaccagcaggcgtgtgttcaaaggaccattttcaaagaaggcttgtccagtctgagctgcctaaagagacgccccttccttcccctttcccaagcccacctagacagacccacagacacaccagaagggaggcccagggaggaaggagttgcagagatgaaagggtaggcagcccacggccagctccgcactgcctgcctgggccctcccagctgggctcccttgagcccctcccccagcctcagcctgcccctttctggcccctttgggcctcggtgatggaaatac

SEQ ID NO: 1029 - DNA, 2309 bp, Homo sapiens
acaggccgaggcagggagaactctccactcggaggaggagctggggtcctcttccatcccgtcttcatcctgcctggctgcgtgacctcgggcaagtctccgcccttctcttggcctcagtttctccttccgtaggatgggggcggtgggctaggtggtgttgggatttagctgggttatgtgggacagggcctcctgatgggaaagagctctggctgggcttgtgggaggaatgagtccctttggcaggttctcgggatcccctgggtgacatgcctttctctgcaggaggcaccatgcaggagctgcatctgctctggtgggcgcttctcctgggcctggctcaggcctgccctgagccctgcgactgtggggaaaagtatggcttccagatcgccgactgtgcctaccgcgacctagaatccgtgccgcctggcttcccggccaatgtgactacactgagcctgtcagccaaccggctgccaggcttgccggagggtgccttcagggaggtgcccctgctgcagtcgctgtggctggcacacaatgagatccgcacggtggccgccggagccctggcctctctgagccatctcaagagcctggacctcagccacaatctcatctctgactttgcctggagcgacctgcacaacctcagtgccctccaattgctcaagatggacagcaacgagctgaccttcatcccccgcgacgccttccgcagcctccgtgctctgcgctcgctgcaactcaaccacaaccgcttgcacacattggccgagggcaccttcaccccgctcaccgcgctgtcccacctgcagatcaacgagaaccccttcgactgcacctgcggcatcgtgtggctcaagacatgggccctgaccacggccgtgtccatcccggagcaggacaacatcgcctgcacctcaccccatgtgctcaagggtacgccgctgagccgcctgccgccactgccatgctcggcgccctcagtgcagctcagctaccaacccagccaggatggtgccgagctgcggcctggttttgtgctggcactgcactgtgatgtggacgggcagccggcccctcagcttcactggcacatccagatacccagtggcattgtggagatcaccagccccaacgtgggcactgatgggcgtgccctgcctggcacccctgtggccagctcccagccgcgcttccaggcctttgccaatggcagcctgcttatccccgactttggcaagctggaggaaggcacctacagctgcctggccaccaatgagctgggcagtgctgagagctcagtggacgtggcactggccacgcccggtgagggtggtgaggacacactggggcgcaggttccatggcaaagcggttgagggaaagggctgctatacggttgacaacgaggtgcagccatcagggccggaggacaatgtggtcatcatctacctcagccgtgctgggaaccctgaggctgcagtcgcagaaggggtccctgggcagctgcccccaggcctgctcctgctgggccaaagcctcctcctcttcttcttcctcacctccttctagccccacccagggcttccctaactcctccccttgcccctaccaatgcccctttaagtgctgcaggggtctggggttggcaactcctgaggcctgcatgggtgacttcacattttcctacctctccttctaatctcttctagagcacctgctatccccaacttctagacctgctccaaactagtgactaggatagaatttgatcccctaactcactgtctgcggtgctcattgctgctaacagcattgcctgtgctctcctctcaggggcagcatgctaacggggcgacgtcctaatccaactgggagaagcctcagtggtggaattccaggcactgtgactgtcaagctggcaagggccaggattgggggaatggagctggggcttagctgggaggtggtctgaagcagacagggaatgggagaggaggatgggaagtagacagtggctggtatggctctgaggctccctggggcctgctcaagctcctcctgctccttgctgttttctgatgatttgggggcttgggagtccctttgtcctcatctgagactgaaatgtggggatccaggatggccttccttcctcttacccttcctccctcagcctgcaacctctatcctggaacctgtcctccctttctccccaactatgcatctgttgtctgctcctctgcaaaggccagccagcttgggagcagcagagaaataaacagcatttctgatgcc

SEQ ID NO: 1030 - DNA, 3127 bp, Homo sapiens
gaagcagttgttttgctggaaggagggagtgcgcgggctgccccgggctcctccctgccgcctcctctcagtggatggttccaggcaccctgtctggggcagggagggcacaggcctgcacatcgaaggtggggtgggaccaggctgcccctcgccccagcatccaagtcctcccttgggcgcccgtggccctgcagactctcagggctaaggtcctctgttgctttttggttccaccttagaagaggctccgcttgactaagagtagcttgaaggtaagccagtggggaggagggctccagggccagcggcgggagcgggaggcctgttggacataggggctggttccctcttggtccatccctgctggtctgaggtgcgtgggacaatccctagcttggagccgtccagggggcatctgcttcttccacaacccacaactgaggccccagaaatcccagctgcgtttgggctgagcctctggcctcacccaagtcagctgagaggtcctggcgggggtttatttaggcagctgcctggctaagtttgaacagaacaggccacgggtgtgattccacagaaaaggcctggtgtctgctgcggtcatggccggaggagcgggagagggcgggtggagtggatgggggtggtgtgcactgcacaaggggcctcgtctgggccaaggcaaagcatacctatggggggctccggtgggagggactgcggccaggatgtgggagggcagggggaggttctgcaaagtgctgggggaggggggtggctggaaaacagatttcaagtcataaagtcagctaggaacaggccgaggcagggagaactctccactcggaggaggagctggggtcctcttccatcccgtcttcatcctgcctggctgcgtgacctcgggcaagtctccgcccttctcttggcctcagtttctccttccgtaggatgggggcggtgggctaggtggtgttgggatttagctgggttatgtgggacagggcctcctgatgggaaagagctctggctgggcttgtgggaggaatgagtccctttggcaggttctcgggatcccctgggtgacatgcctttctctgcaggaggcaccatgcaggagctgcatctgctctggtgggcgcttctcctgggcctggctcaggcctgccctgagccctgcgactgtggggaaaagtatggcttccagatcgccgactgtgcctaccgcgacctagaatccgtgccgcctggcttcccggccaatgtgactacactgagcctgtcagccaaccggctgccaggcttgccggagggtgccttcagggaggtgcccctgctgcagtcgctgtggctggcacacaatgagatccgcacggtggccgccggagccctggcctctctgagccatctcaagagcctggacctcagccacaatctcatctctgactttgcctggagcgacctgcacaacctcagtgccctccaattgctcaagatggacagcaacgagctgaccttcatcccccgcgacgccttccgcagcctccgtgctctgcgctcgctgcaactcaaccacaaccgcttgcacacattggccgagggcaccttcaccccgctcaccgcgctgtcccacctgcagatcaacgagaaccccttcgactgcacctgcggcatcgtgtggctcaagacatgggccctgaccacggccgtgtccatcccggagcaggacaacatcgcctgcacctcaccccatgtgctcaagggtacgccgctgagccgcctgccgccactgccatgctcggcgccctcagtgcagctcagctaccaacccagccaggatggtgccgagctgcggcctggttttgtgctggcactgcactgtgatgtggacgggcagccggcccctcagcttcactggcacatccagatacccagtggcattgtggagatcaccagccccaacgtgggcactgatgggcgtgccctgcctggcacccctgtggccagctcccagccgcgcttccaggcctttgccaatggcagcctgcttatccccgactttggcaagctggaggaaggcacctacagctgcctggccaccaatgagctgggcagtgctgagagctcagtggacgtggcactggccacgcccggtgagggtggtgaggacacactggggcgcaggttccatggcaaagcggttgagggaaagggctgctatacggttgacaacgaggtgcagccatcagggccggaggacaatgtggtcatcatctacctcagccgtgctgggaaccctgaggctgcagtcgcagaaggggtccctgggcagctgcccccaggcctgctcctgctgggccaaagcctcctcctcttcttcttcctcacctccttctagccccacccagggcttccctaactcctccccttgcccctaccaatgcccctttaagtgctgcaggggtctggggttggcaactcctgaggcctgcatgggtgacttcacattttcctacctctccttctaatctcttctagagcacctgctatccccaacttctagacctgctccaaactagtgactaggatagaatttgatcccctaactcactgtctgcggtgctcattgctgctaacagcattgcctgtgctctcctctcaggggcagcatgctaacggggcgacgtcctaatccaactgggagaagcctcagtggtggaattccaggcactgtgactgtcaagctggcaagggccaggattgggggaatggagctggggcttagctgggaggtggtctgaagcagacagggaatgggagaggaggatgggaagtagacagtggctggtatggctctgaggctccctggggcctgctcaagctcctcctgctccttgctgttttctgatgatttgggggcttgggagtccctttgtcctcatctgagactgaaatgtggggatccaggatggccttccttcctcttacccttcctccctcagcctgcaacctctatcctggaacctgtcctccctttctccccaactatgcatctgttgtctgctcctctgcaaaggccagccagcttgggagcagcagagaaataaacagcatttctgatgcc

SEQ ID NO: 1031 - DNA, 14644 bp, Homo sapiens
tttgttggttcaatatacttttattgagagcttagtatgtgccaggttctaggtggtgaaaaaaagccaccaagttccccctctcaaagcaacctcttagtcttcacctccaccctgagggactggtgttatcagctccatggacggatggagaaacggtctcagaaaggtggcactgtttccccaaggcacttggtaccacctggcatcattttgtttgcgtgtcatgtctgcccttctgaagtgacggctcttgggaggctagggactgtttgtcttgttcatagctgtagtccagtgcctggaaatgtccctggtacaaagtatgtgcttcaaatatgttgttgaatgaatgggtgagtgaatgaatgaagtggtgaagctggattcacactcaggttgtctggctctaaagcctgtaccatcactctttgagttctagactggacagcttcacagccccagccagcagccagtgagcaaggtcctgaggttccggaattctcctctcagccctcttagaccatccctgacttcgcacttgccggcctccatcaagcttcactcccattccctctccagcctgaccaaagggaagctgggggatcactaacacaggcattgggggtgggggccatttcaggctttctcttccccctactctgcccacttccccttctccgccacctcctagacttaaagttcctgagggctgggcccagccaccttgttccctgcctctcctgcagagcagccaagcttggaaggggcacatgtttgaaggcatggaatcccatgcacaatggaaggctgcagggcggcccatcatagaatcagagctcaaaggaggcactgtggtttgagtaggttgctctgtgcgcccctctgccctaggccattgtgatcagcggttaccttgggcacctggggacactctgccctctgccagacctggaccccaaggtgggcccaggacagcgtgctgccgagcaggtgtgcagctgtgtggccagccgtggcacaggcagccagagggtagtagagggcagcataatagaacagtcccagtatcttccaggcccctggaaggtgaaacaagcagagagacccatgctggaggggcagacatggggcctgcagtgagcccacccaggcctctcttcggtctccagcttccaagcccttcagcacgttcagtgggcaagaacactaggttcaaatccaggctctgactagtctcaactctgtgatcttgggcaagttacctcttggagcctcagttttcccatctgtaaaatgaaaataatcacagtatattagcaagggcaaaatgagaaggtggatatataatgcttagcatggtgcctgagcaaatactcaatttaagatactacttccctggctctcagttcctccattgcaaaatggggctaatatgcatactttgtagcatcgttgtaaagactggatggtctaaaaaggtcacgtctcaggatagcagcccatctcattgacagctgttcctgttactctcatctccttgagccaagcttaaaactccgagaccccaccctaccccatcccatcacaccaaccccagggcctgggggtcagtgggtaccttggctgggtgctgaggcgagagtcaggaagggcaatgcgtcctcgtcggggagcagcaaacacagggagctcaggaggaccatgaaaacagcagcaggcactgcccggggcctgtccccagccaagaaatccacagggctagcacagaggcaaggacagggcaggagggagttgctcagcccctgcacccccattacctcccagctgtattccataaatcaaggaggtggagtcagtcccactttctagatgggggaataaggccccttcattcattcattccatagatatttgtggagtgcctcttatctaccaagctctgggccccgtgccaaagggacttgggacacacatacagtgggaagaagccctaagactgctcctccgcccaccctggaagctccaggaagcagccacctccacactaattggtctgtctgagctggcaaaccttcagagaactcagcgagtcacaacatccttgtacaacagccgccgccctgggctgggtgtggacccggggcagagggcagacagcgggcatagctgtcccaggcatcacccttctgggctcagggcaagccactcagacccacagcttctgcactgcagcttgcattcatgctctgagaggttcattctccctcaaacactgccccagccagggcaagctctttctggggccaaccagagaccccaggctggttccccacaaaaccagcacagcaagacctgcctcggtgcacagtctgggtctgggatgtgaagctgtctacaccaaggagccacccatcacctgccccaaccctttggtctctcgcacactagcttgcccagccccatctcctcaggatcatgcctgtccaggctctggagtcacagggctgaaggagataggagaagaaagctccagctataggggctagatgtcagtccccataaatctgccttcaagcattagggtccaggtgataccctcagggaagatgacggtcaagatggcattgggatggtcacgtcaatccacacatggagggctgcctgagaaggtacactctgacgctgggtcctgtcaggcttgtttccctagggtctgggttggagtcctttctcccaggcgggcttgagcgagtccctcccccttcctctgggggtcctgactaaacctggagacctaggtgggggtgaggaaagctccaggctgagggcgatagggatgtcattaaagccagagctgccttttaggtacctaacaaatcacccaccctcccagagggaccctgtcagctgggtcccctgagtgggggtgcccaggccatggtacaaacctgggcaggccgggcctgccacgcacacagtcaggccagagctggcggcgcctcaccagcatggccaggagcagcagcacaaggatctgaaaggagagtgcagaggagggcttggggtgcccaggcctcccctgagggtctgagtttgagggcttggactcaggccccaggatatcccctacctgcccagtgcacactcatgtgacatcttggggactggtcaaggggtgacagacatctggaaggttggacttgcatcctggtttgggcctccaagctgggagaactcccagatagctccccccacccaggatcttccagggccccccttcaccagccccagtggggaacacaggtcccactgcccaggctggcagcagcttgcaagccaggttcaacttgggttggactcactgacagcgaggccaggcaggcgtggtacaggccgggtggtatgctggtgtggcaggagggcacttccctgcagagcaaatgaaggctggctcaggcctgcgtcaggcccccctgggtgtgcagatgggtctggggttcaagactgttcacactgaggctttacccactacctccctcaaccctctgatccctcctacacaagccttcccagtcccaccttctcagggtcattctggggccctcgtgtccctgtgatgtgccagccccatgccaagctctggggttataagactaaaggacatgggaagctcccaggggaagcagagtagaccggctcggcctgatcacttattctcttttttttttttctggagggacagggtcttgctctgtcacccaggctggagtgcagtggctcgatctcggcttactgcagcctcagcctcctgggctcaaaagatcctcccacctcagcctcatgagtagctgggaccacaggtgtgcaccaccatgcctggcatttttttttctgtatttttagtagagacagggcctcaccatgtcgcccaggctggtcttggatttctgagctcaagcaatcctcatgcctcagcctcccaaagtgctgggattacaggtgtgagccactgtgcccggctgagcacttattcttgctcacccagatgcttcctgtccttcaaggcctcccctctccagggagcccctctgactgctcctggtctcacagacgtcttctcagaactgcagttgagcacactacctgggtcaagcagtcaagggtttggccctgtgattcgccctctactcactgccatctgaggttggtctgtgactaaaatgatctcccctggtccctctcttttcctgcttccctctcattgagagcctccatggacagccatgcaggttgcccactgcacaaagatgctcagccaagggaacgagcaggccaccctgctcaccaaacccagcacctgctgagctgaatgcacctaactggggatccctttctctaattccacagaggctccctatggcctggcaatggtcctgcactcaccctggctgagcgcagaggtaaacccacagtggagataggggtcactgaggacaatgaaaccctccgcttccccagcagaatcatgtggtggagaaagggagtgaggcaggagtcctgagctcagggctggccctggccctgggagagtaggcaggactgggtccctggtgagcagtagagctccgggttttcccagcttgggcctgggagagccagagggagggtggcagcatgggtgaggccagtggggtctggtgggcgagggcctgagatggagcctgggctgccgccagtccctgcctgcacagagggcttagccgcccaccaaaacgccctccactgtatgaagagaggcatcaaggctgcattatccaggggagtgcagagccctgggatgctctgctgggtcagctcggtctgtcctgctcgctttctctcaggaaatcccagcgggtgagcggtgggaaagaaaccagtcacttggtggagaggcagagtaagtcagctctgggcagcttcttggccaggagaccagcctcttcccaaagtagaactgggatcgtgagtagcagccacactgactccagtgtcagctccccacctccagctccaaggcctctcactctggtgcgtagggcagccctccctctcagccggcatctccccgcatgactaggtcccgctccacctttacacctgggcccggcagggacttggaaaactgtccctggagtagtttgaccattttcctatggaccttaccccaaaccacccctacccccagaaatgccctccagggccctgcctgggggagcctctggccctttctgtatcacctgaggtccccatctgacctctcagctcagtgtgaggggtcagatggggatctcaggtggcatagaaatgagcaaatatttggctagtggcttgtggccccactttttgtgccatgggacaggcaggatggcacagacataaagaccttggagagggtggtgagcttgatcctgggacaggcacagcaggtgctgaaggatgcagaggagggagaactttgggcaaaaggaggtggtatctgattggagtttaaaaaatggttagtggctgggagcagtggctcacgcctataatcccagcactttgggagactgaggcaggcagatcaaccaaggtcaagagtttgagaccagcctggccaacatgatgaaaccctgtctccactaaaaatacaaaaaaaattagctgggcgtggtggcacgcacctgtaatcccagctactcgggaggctgaggcaggagaatcacttgaactggggaagcggaggttgcagtgagccaagatcgcaccactgcactccaacccgggcaacaagagcgagactccatctcaaaaaataaataaataaaagttggttagcatctctttaggcaaagaaggggagaggcagctccaggtggagggaagtgcatgaggaagcagagaggcaggcgacaggcagcgtggctggggctgggcaggccttccagtttgattgcagcccagaggtcaggtgagatgaggttacagcaagcatgggaggccccaggaagccactgagggtgtttgagccattgaatgttctggattttaggacatttctgtggctgactccactgccatcagtgttcatccaccccaactccagcctgagagtgctggggcactgggcactccggagttcttcaaagctctgatgcaacatgtccccagggtgtctgactcacacagacagaggtgaacccaagttcatttccttgggattcccctgagctcccaattttctgctcccactttgagggcagggggatggcaggcagctcaattggtttggctaagtaagtagattcaaacaaatctctttattcttatggatgtcatgccctgcagtgggagaaagaagctgaatcttctagatgtcacccacatgagggactggactccccatcacccagtgcctgacatacacacaactttattctgagacaacagctatagaccacagctacatttacaggcacctggcccccagccagtgcccaggccctgaggctcccaaggacacagcttcagattagagccttcacctaggtcagaaaccatcctcatgggttcctgggcctgtcctcattctggtctctcgcaggccacacatacacagcaggatatgtggagcccacaggctctcggtcagtcaggcaagatgagtggggagcacgcccttgctgactgcaggctattttccaggtggtcagaaccctgagtcctccaaacaacagctccttccccgaggcctgggtggagcctctgtccctgctggatgacccaagcccagccaggccgcagccccagcccctggggaggcacgcaaggatttttccttctcaagtttcaggttttgatggagaacagatgtgcacacatctggctcggcaacccccagcctcacctttctacttctccaaaccgtcagacagagcagggagataagggatggggccaggcctgggaacaacaggggagaactggctctgggtcctacacaggcaagacatcctggcaggaggtgggggacacagaaggggcccagctcctccaccagggtgcccagactaaaccccggtagaatggacccaggcaaagcagctgtggctgggttctcaggccaccctggggcgggctgccttcctgctcccaccctcacctgggctggcctgagcacttctgctaaagggaataggctctcctcatcctctgagaccatccaaagacaacaagggtgcttgtttcctcagtgacttctcaccaggctttctccctttggttctctgccttccccgaatcccccagcctgcccagagaacttgacacttggaaacaccacacccaaatgctcaccacagagaccaataaccccttgaagggaggtctgcttgcctcaactgctctcagcagcttctccatcctggctatgggccagaatcacccagggagccatccctgcagatctgaatcatctgtatttttaacacgtcacacatcatacctaaggtgaccagccttaggtgtcttaacagcagggtgagggatgttgttctcatgtaacagaggcagagactgaatgaaccccagagaggctgtgacttgcccaaggtcacacagcaaatgagtggcagagccagacctagcagcccctgcccaggagctgctccctggccagttgcaacctctgccatcaccccattctgatggctgacagagtgaggtggggtggttccacacttacccctctggctggagctcctcgcccccctggggctcatcgatgtaccagctgccataggagtagtcctctgtggccccgggggaggtctggttccctgctggctgggacgacattctctggcccttctcctttgaccccaggcgagagaaaaaaaaagccactacagatgtgaaaagaggcttaaaagagaaaaaaaaagaaagaaagacggaaaacccaaacaaagaaacatttctctttaatcctgaaggttactttcttacttttagctctctgggaaaagcccgtctgggactgagggcctgagcaagctggcacgggaagaggacagggcctctcgtgtcccctcctcccttcccgcccatcgcactggtcctgcagagatagctgtccccttggggccccggggctcccgctggcgcatctgtctgaccaaccaccagcaggcgtgtgttcaaaggaccattttcaaagaaggcttgtccagtctgagctgcctaaagagacgccccttccttcccctttcccaagcccacctagacagacccacagacacaccagaagggaggcccagggaggaaggagttgcagagatgaaagggtaggcagcccacggccagctccgcactgcctgcctgggccctcccagctgggctcccttgagcccctcccccagcctcagcctgcccctttctggcccctttgggcctcggtgatggaaatacaccataatccttgacaaagcccccctcctgggggaggaggccccagcaccattggcggcctgagccctgcaagggtgtggccaggagccacccccacccccgcacctgacttcacacacatacctgccttcagcgcctgccccagagctcccaagcccctgcccgccacatctgcagtgccgcacacagacaggagaccagcattacagcaacaaccgagtgagacggaccgctggggctgggctggggcggaggcagggaaggggaatctgtccgtttcttctcctagggtttccatgaaggaggcaacatgtgtctcattggtaaaccctttttgttcctacaagttgatttcacaaggagataactcacccccacaaggcggaaattagctctttaaacacaaaccagacccacgggtaggcaagaggagccccgcctgcctcctgctcctcctggagtgaggttgagggtgagcaagggaaggtctgggccagggaggagggctcctccgcattctccctccccaggagcaggaccctgccccagcctggaggaaggggcgagaggcagaagaaggtagaaagcagttctcaggccactgtccctggtggaggtttaggcccctaaaactgtgagggtctctgtccttccaataccctacaaggggcttcggcttggaccctgtcagctaaggcagtcattcaacagcttttttaagaagacattattcatttagtcttttaacttaaatttattgaacacacactatgtgccagcactgttctgagccctgaggcaggagagatgacagttcagcggggacacagccagataactaaatcccctccaaagtctgagggttacaaagggaatcacaggttgagctggtctgtaccatgggaaaccaaatttagtccaagagcatttggggatggggggagattcctgaagaaaagaacctttccgtggtgatctgaagggcaggggaaagtccgctgagcagagggtggcaggctcaggatggggatgggggtgggggaaagtgtgttccccacagaggaaacagcacgggtgaagtctcagagtagacagggcttgaaatcctggaggctctctttcaaattcccaagcctgcagggcaggattaggggctgagcaccctgctagcctgagttcctcccccttcttcccaaatggcccttcttgcaggaagagggctctgttgctctccaccatcccacagagatatcagcatctgctgactcagagctgaacccgagctttatttgatgtaatgaggagcccacactggcccttctgatcccagggatgcgggaaacttgccttccaggcgcgagtgtgagctcccggagggcgggactctatccctcccacccctcctcctgccttcccctgatgctcagcgcctggcccttgggtaagagggacttcagaaattgagcttggcaaagccattgcttgttctggcggccagtattcatttgtgggcctgtcctatacaggcggctgctgtgccctgaggttcaccagctgggcttcccagagtccccgtgcccacaccagaggccagcaagcccttccctgctcaggggtctcagactgttaccttagggagcagccaactcccatctgattttaaatccacctccaaccattggagtccagttccagacagggagcccactccctctacaaggcagcagtgtcaggggttagacatccttgcctatcagaaaccatgccctttggccaggtgtggtggcttacacttgtaatcctagcactttgggaggccgaggcaggtggatcacctgaggtcaggagttagagacccagcctggccaacaaggcaaaatcccatctctactaaaaatacaaaaaattagccggacgtggtggcgcacacctgtaatcccagctactagggaggctgaggcaggagaatcgcttgaacccagggggcagaggttgcagtgagccaagatcgtgccactgcactccagcctggacaaaagaggcaaactccatctcaaaaaaaaagaaagaaagaaagaaaagaaaccatcctcttccttggaggaagcctaactctgccttccccaggctggtttggcagcgagcaagatgagtcaaggcctgcaccaaatggaacctgatgtatggtagggcttaggggagacaacaccagaggggaagtgaagtgggggaagagaagagagacgggagttggctgtttgagacaaggtggtcagggaaggcctcactgagaaggtggtgtgttgctgataccagaggggagagagggaggtaccagttgggcactgtgttcatctgtttcgcattgctgtgaaggaaaacctgactctgggtaacttagaaggaaagggggtttatgtggctcacagttctgcaggctgtgcaggaagcagcacggcaccagcatcagcttctggggagggcctcaggaaacccacaatcgtgatggaaggtgaaggggggtcaggcaggacacttggcaagagagggagcaggagagatgccaggcacttacaaatagccagctctcacatgaactgatagagcgagaactcactcattaccacagggagggcaccaagccattcaggagggataccccgcaatgacccaaacaccacacaccaggcctcacttccaacactggggtcacatttcaacatgagatttggagggcacacacatccaaaccatatcgggcactgaagaaaggcaatcaggttgcctgaaggagcctccatctgcccaggggctgcagccaggctggcagaaagggaccccagctgagcccaggcacagtcccttccccaccccccacggagagcccagtgccaacaataccacctccctcctcatgggaagacacagaggccaccaagggaggccctaagcagaggggaggaaatggtgagcttcgtccttttcccctggtgggggcctagcaagcagagcgcagccttgtgcctggtactttggccagggcatagctggaaggtccagaggtaagggccaggtttctgcatggcagtggagaacgcctggttggggaggccacctagccggatttgaaccctgggactggctatgtggccttgagtgagtcttttcctctctgtgggtctcactgtcctctctcaaatccggcctggagattctccagttgtgaactctccccacaaggcccccgtccctgcacaccagtaaccagttgtaacaagaaggtcacagagagtggttgtgacttcctaggtgcccccattgcctcccacctgccccctcctggcccccagctgccctgcccagtctggtgcgggcagggtgggcaggctgggttgaagatccatggatagcgggtggccgcgtggctcaagctgcaaggtgagcccacttcttgagcccaaggtacctcctcagcttggggctagaatcgcttggagctcccatctgcaaaatgggaggctcggctctgagctgttaagaaagatgctacctgggaagacggcaggaggcaagaagtgttaggaagagaaggatggtaatgatgtgcccctgaagaatttctccaaaggcctgggcagcagagtcaagggcctgccctctggagctggctttaaaggggcactgatacccaggaaggcccagccctgccctcaggagagcaaaagtgctcaaaagacagaactgccaaagcctgaggagcggggagggaaaggaggagatggcttgggcagtcttgcaggctccctggaggagggggcctggagcagggccctgaagccatggaagatctggaatggtaacaagaatgaattgacacgtgtctcaggagtgccaagaagggaagtctgagagacaaggagagagtagcataagggtcagggcagggctccctcgctgtgaccagcatgaacccacgtgggcactcagatgaggctgatgccagtatccaaggagcagctcaaaccagcaggtctcccaactgggcacagattggcgggtggctaagccctgctcactatgggaggaggtcctaaaaagcttctggactctgagccagtgaaggccatctgccatttgggcttggcacagagctgctatgcccctcgggttggagctggcccatgaaggccttgggacagggcttccttcctctcatgtttttgttcaagttgattaaacctgaggaatttttgcatccaggagcagaggcccacgtgcatttctgcgggagcctgtgattatcaaatcctcaaagggcaaagtgccaagcttagaagaagctaacagcaggccagaaggaatggggaaggccagcagcatccccagaacctcagaaacatcccctcaaggactcccagatctcccagagaacctccagaatctcagcaacatttctgagtttcagtaatgccataagaagccctgcaacctcagtattgcccccaagaagccccagaccttcagtaacacatcagaaccactgcaacacctcaggacactcaaactctggcaaactcaaactctggcaaatcaaccacagattggaacaagatgttcaaaagcctgtgaccatttgcagaaaggccagagacccccgttgctctccaccctcccatctcagcccttgactctgagtccagcagcaaacccaatagtttacaatactcaaacctcaggtacacccccaacttcgatagcacggaagagaacacgcaagagaggcgttccaggagtggggggatggccactgtgcccacctgtgcagcccagtccccttgagagtccatgaataagcagccgagagagtcaacctcatgcgggcccgtgagcttggggtgtgccctcagtggcacagcacactcacacacacatccaactgcccttcgcacacatacgtgcttaattctggcaccagaccaagtctgactccacacagtgggctggaaggcagtgtcgtcggctgccgtgctcacggcaggaagagtatgggtgactctccacctcctgtctctctacctcctacctcccctgccatgtgggagggtcagaagcaccatctgatgtgcccttcctgcaattctcatgcccccctcaccaacagcatcatcataacataaaggatttagaccaggctgttctggtatgagggtggacactggtgaggaggaggagggtagccggctgtgccaggggagcagcatgttctttccctcccagagggctaggctagtactgacctggaggagggaggcagatttcagctcagaacaaaggtagccttctagagtagtgaggcccccatcaagggaggcaatcaagaagaggctgttaacatcaagatgcaacagagggcttcctgccttcggaggactagacacaaggccatgaagattccccagctataagagccccacgttctccgttcccagcacgttcctccctgggctggccaccgtggtgtggccttgagatgtaggctttgtgctgccctccttcctcactgaggacattgactgctgggcagatcccctgacttctctctccttgttcccttgctgaccacaggacagggctctccaccaaccttttgcccacagccagtcagatccaactcagacaggactctgcgaatgtctcctgccttttggagctcctgctagccccccagtgtcccctgagggcagcccaccccaggtctccaaacttactcatcagaattgctccagcccatcactctgctcacttcctgcccctaggctctgactcctgctcacttcccaccgcacaccccatgtgccttctcgctgttccccgacctgttccaatcccacctggcctcccagacttggctccagcctacctccaatcaagcgctctcctgacctctcccttccttgtctctttcctttcctttattgatctctcccggaaacttgtccctccaggcaagcagggtgctcccaacacggggccttctcctctgagcccagcaccagctgggctgggatcctagaggggtggctggttgtgtggtctcggcagttggccctgagaagtgtccccagcacctgctttaaaaggtgtttgatct

SEQ ID NO: 1032 - DNA, 23414 bp, Homo sapiens; identical to SEQ ID NO: 1028

SEQ ID NO: 1033 - DNA, 29980 bp, Homo sapiens
acatggttcagctgtttattgtctccatggggtgggtgaagaggagtggcccagctgagctgaggaaggtgaccactgagaacccattcaacctgctgagcaggctgggcagaaaggagcaggacttgggacagacgactgaagatgcagagaccccatgggccccacccctgggccttcctcccatgtggctgcaggccatcctctctgatcactgctgggttgcttcctggttaaagggccagaaggtgaaggagatgggcttttcaggcatcagaatgaggttgaatgtggtgcccacatcgctgaggtgttggatttcaactctgaagttctccagcatctgagaaaggcagatggtaggtttaggggagggcaggggaggatctgtctccctagccaggccaattcacccataggcagtgcctgtggagtgtgatttgaggagttccaaggagttcaccaccagctcctggtgtaaccctgcacagtgcctgataatgcacccttagtgctgcatttccttgatttaggcctagaccttaacttgtctacaaacctcagtcctatcccatcccatcaccaccatggggaatggatggccaggggcatcagtgggtgatgagtggttgagcccgaaagagggggcagcagagaactgtgggagagagcgagagcaagtaactggaggtagatgcgccccagcactgacatccttgggctctggacagagataggaggaggaagattggtgccttcattagggccagggccagcccagggtgcctagatgtccccagcttgactcacattgatgaggaagatggtcatctctagctcagcgatccgccgtcccagacactgccgcacaccccagccaaagcccaagttccggaagtaggtgatgttcttgtctttgctcagccatcgggttgggtcaaaattttccgggtcgaagaagaaggtgggctctcggcccagagcatagatggccacttgcaccagtgtctggggcaaggtgatcagaggcctgagtaagccccacttccccacagccctgagcacaaaacccccttccctagtcccctgccctctcaccaccactcccactccccagcatggctgcccagctctccagggcaggacattctgcccactgtgcagccttgaacaaggccccgcccctctgtaatccttacccaccaaatggggatggctgaagacccaaggccaggatgattgtcccaccctttcctcagacccaggcaaatcatgaagtctccctcctaaccctgggttccaataacatcctagaggtcaccgcccaccatgcccaccacctctgcccttcattcagacttagactgctgccatcaagggccccaccagggccccagtgccaccctctgtctgcaattccagcctgccccagccctctctgactggcagagcctgcagcctgctggctgcacctaccttggcaggaatcatgtaatctcgaagaaccaagtcatttacaagatatctctgcagggtcacggagatggggtgaagtctgcgggaggagggcactcagaagctgatggccccaaaggctggacacagccgccggagccccacaccctgtgtggcatctcagccctagctgcagcagcctggggggacctgggggtagggccctggctctatttctttctcctccagacttttcacttcctgcttccaacctcctccaccagcccatcctcgtaaccctttccccgggcacttccctggccctgcccagggattggagttgggggcggcatgggtggttgtgggcttgccttagtgtctccttgatgctggctttgaggagggggaccagctgtagcatcgtggccatgtctccctgggcctggtgccgcgcagccaagacctctgcccgcagcatatcctgcaccttcaggttgcgtgccatctcatacaagtgccactgcagggtcatggacgtctggtggggagtagggtatacagaagaccaggagggcctgtcactccggggccccttgaggtccttgaccccatggtaaattttcatttccaagaacctctttctccccgaaccccatcccagtctccaagaccatcctctgcaagagcaaaacacattccattgtctaaaaggcaaatgtccaagaagcctttcttgccggccaggcaggaacattcagggcagcacttgtccctgccctcgtccctcatgtcaccaaaaacccacccatgtccacagtgagtagagtgtcagctacacagccaatgccttcttccaaagaattccagaggcccttagaggccaaatccttctgtaatgattgcactccagaatgactgccattccttttgaaatgccttgttaaacaaccacccctctttccagtagaacttcctaaaaccttaggcttcacctatagcaacatggcttcaagtaaggctcaaagaagctgaaaccagaccagccggatgtttcctatcagtgttgcaattagggtgtggtgtgtgttgaaattaatcagctaatctcaacgtaagccagaggctgtgaccactagcccttcgccagagatctgagtgaccctcatcaaaccccacagtcccagattcctcaatgatgacaaaccaggcccgtttgggactccagcctggagcagccctccctcctggggactaggacatgggttgttgacacattatcttaccaaggatcatatttttgtccaacagacttagacacccacctccctcctcctggcaggggcaacaatgacaagctgtgaggtaccatttattaagcatatattatatggcaggcagggtcctaagctgtttacatatgttacctcgtttaatactcacaaacaaacctctaaggtatgttaccatcatccccctttttcagatgcggaaactgaaacaacacacagctccttctcagcttaaaatccttgcctggctccccagagcctccagatgaaatacagaggctcaggcctgagccacagggcccctcaacacctgcctgctgctccccaataccccactccccacctctctccaacacacacctaatgttccagctacatggagtggcacacagcccctgaagcccagaagtcttccccacgctaggtcctcttcctggaattcccttccccgcctaagaaggaaggatgtgctccctctgcaagactctaatcaaatgtgtgtattcatctcagtactgccaaggcctgccatagagatgtacttgggatttaataaggtggttaactatgttactagctgtgtgacctcgaccaagttatttaacctctctgtgctctactttcctcatctgaaaaagggggatgatggtaacataccttagagggttgtttgtgagtattaaatgaggtaacatatgtaaacagcttaggaccctgcctgccatatagtatgtgcttaataaatgtgacctcacagtaatcgtttctttggtgccggtgagtgatttttgaagatctcttctacgtaatagacaatgaactatgtttaaggtatgctcaaaggctccatttgcagtctgtctcagggatggaaactccttcatcagagtgtaacacagatataatacctgggaatgaaagtgattcacccagggggcttgacatgtgcttctccctagtcctgaaatgctattccttctctctcctcctggcaacagcctgcaagacacgcacgttgaattttagctcctctgtggagccttctccgtgtccttcatggccacattagccactccccacctctcagctttgtcagtggcaggtgcttgcctctgtcactgcagtgtgctattcctccgttcacactgctgcctccctgttataggctgagctgtataccccctcccaaaattcatctgctgaagtcctaaccctcagaacctcaaatgtgactatatttggagatagaacctttaaagattttaaagtaaaatgaagtccttgaggaggatcctaatccagttctgattagtgtcctcatgaggagagacaattctgacacagacacagagggaagcccatgtgagacagagggagaagacggccatctacaagccaaggaaagaggcctttagaatgcaccaaccctgccaacaccttgaccttgaacttccagcctccggaactgtgagaaaatcaatgtttgttgtttaaatcgcccagtcaatgccattttgttacagcggccctagcaaaccagtacacccctcccctctgagccacgtgaggacatttgaggtctactgtattccttttgagatggagtctcacactaccacctgagctggagtgcagtggtgcgatctcggctcaccacaatctctgcctcacgggttcaagcgattctcctgcctcagcctcctgagtagctgggattgtaggtgcccaccaccaggcccagctaattttttgtatttttagtagagatggggtttcactatgttggccaggctggtctcgaacttctgacctcatgatccgcccacctctgcctcccaaagtgctgggattacaggcatgagccactgcgcccggccaggactgattattcttaatatccaaagaaagaagtttctagggtgccatgctgctatggaaagagcactggggatgcctctgggcgttgggggcaccgtagggtactgaggtctggaaaggggaggaggaaggacaacaaaaagaccatggacggcagagcccacagcaaatgcctcggcctcccaatgtttccgggctcctgcctgcttccctggatttgagtgagtgtgttctccaccaggagctgggggcattgtcctccatcagcagggctctgatagagcaagcctccagaggggacctcctcctgtggagactctacgtggaacctggacctcaccaccatgcccggccactcctctctcacaggcaaagaaaaatagctgatcatcctcaaatcatgccctgggtgacttgactttgaccccaccatcttaggagattagcgctttggaaatggaggcaaggaggaagacatatcctacatgagtaggaacgccttgaacaacagggtttcagacaacgaggggcctggtggggaaggggcacgtgggcacagggggcaacaaggtgccgcccctacagccacctcaccgtgtccacccctcctgccagcatctctgtgacgttggccttgatgtcctcgaaggacatcttgctgtctcccaggagtctgtagaggatgccacggtaatcgtggtgaacacttcctttctgtctcaattcccagtagaagttctgggtgtatatgtcagctgtggggaaggaggaaagaaaaaagagtgaggttccctgcaggcgggtgggaaggagggcagtctgtggtgaaaggtggcaccaagggcctggggattccggagccctgtgcttcttaggctgccgttttactgagcacgtactctgtactaagcccttcatatctgttttttcatcgaattcttggggtatgtgacatcatccccattttacagataacagaggtgcagagacatagtcacttgcccaaggtcacatggctgtaaggggcagaggtgggatttgactctgccataccctgacgagccttctccacccaaccttccccatctctcccacccaagtccctgtcatccagcacagccgtggctcagacactggtcctttgccctctggggagcatgagctcctttgaagaagatcacagatgtctttgctcctctttttccagaaaaatctaataatccccaacagccagccttccatccgccatttccaggggtcccagggccttcctgacacccacgcctgcccgccacagtgtgggtttcctacaggtcaagtcagcgcccattgacatagcgtgggacaaaggagccggctgaggcctggggctccgaggaggagagcacagccagagaagccctcacctttactgaaaatcacgtcccatgcagccacatggtccttccaggtcttggtcctgaacagacggaacaggtctgggggaaggttgagcatggggacgctggtgtggaacatctggtagatggcatcaatgaatcgctgggcctcggggttcactacttcctccagcatcccctggcgctccccaaaaatgacgttagtgatggctgcagggagaggaagaggctgaggagccatttctgacggggccatctgagagccacaactcccagggactcctccaccctcacctccctcagcacaaaggatctcttgcccctaccctcagcctccttcagtaaataaattgaggcctgagtcccaaagggctaagatgcaaggctgagaaagctgacctctggcaaccacacaggtcctgcagaggggcatgtggaggacctgaaaggtgggaagcagggtctccagcagagctgagagagggcctagcccaggatgcaactgctctgcccaggcttccaccaagagagattcctcatctgtaattggctgaattggctaaatacttcctgaaacaggtcagaaaggagactgagggtcataaatccctggataattaaccatccaggacctagtcttgctggacctaagaagttacaacagcctcaagttttccccacctaccaggtgagtaatttgaatactgatttcatacaaagctctgggcaccccaaatctcttgctgtgaccacacaatcttcatcaagccacagggcctttgtatgtgtggttccctctacctatactgcctgacttccttaccccatctagataactcctacagattcctcaatgcctacctcagattaaccactgaactctcctctaccctaccagactccaaaggtctatggcccaggaggtggagacttgcagaatgaaggtccaagccaagctctggctttggcggatggtggcaatagggacctgtactttggggacccttgctcctacagcacaaatgccagatgagagagaatgccagatgagagaaccccagagcaaggggtctcactctgttgcccagggtggtcttaaattgcctctgagtagcaggcagtggaggacatgatcagcggctcatcccagaagtcagtctcaatgcctctgcagggtctgtactgaacctcaaggtaagagagtgaacactgagtcctcccacccccatgcccactgccagccaggtgcaagcccccttacactcaaaggcaaagcggaacaggtcatcactgatgtcccccgagtaatttccggagcccgccttcttgatgcgcctgtgcaggacactgacgaagtcccgagacactgcatccaacaggggcaaaaagttcttggtggcctctggagccatcacctcctggttcagggccacccggtctttcttccaggctgccgacttcctgagaaaacatgggcccacaagccctcatggtcacagaccccaggcctggtgaacacagagggggctgactcagttttcccaggaagctgagtcacagctcacagcatccagcactcccaccagggcctctgccctcacctctccgagcaccctctgcctctcacctcctccctgctctgcctggctgggagaagagaaaggaaaaaagagagtgaaggggaacaaaactccaactcccctccactccctctgctgagggccaggaactgatattcttagaaccctttgtgtaactttcagtctctccagtctttgcctcagctgcaggcatgccttccatgccactcccacttcctcctggccgatgctcacctttgacactccagggcccctctatataacattttctgactcttgcacaaacaaaattgaccagcctctcctcctctgcacccccaacacgtcccattactcacttctgtcgggggacctcaggtgccccgaactgggttggtcataataaaccttaattcatgcacactcttgaaattcatcaatccatgcaaagtcctcttcgtgacttgggggtgtttttgttgataagaatattatcacaaacttaccacccaccatagaaactaggaacttgacagtaacttacacttgccctcctggtccttccacatcctttgttcccttctaaggagaccacccactagaatcccttgctctcatttgtgtctaattttatctgatctccatttattcccaaaaggtactattacaaaatatatactagtgtttaacttcttttaaaaagctgtcggtcagacacagtggctcacgcctgtaatcccagcattttgggagaccgaggcaggtggatcacctgaggtcaggagttcgagaccagcctggccaacatggtgaaaccccgtctctactgaaaatacaaaaattagctgggcatggtggcgggcatctataatcccagctacgccggagcttgaggcaatagaatcacttgaacccgggaggcggaggttggagtgagccaagatcgtgccattgcactccagcctgggtgacagagcaagactctgcctcaaaaaaaaaaaaaaaaaaaaagaaagaaagaaagaaaagctgtcatgctttgccagacttgcttttttcacttagttgcaccgttccaagtatcatctgtattgctgtgggagactgagtcccttcattttgactggtgtgtaccacaattcactcacttataatcctattgggcatttcagtagctttctggtttttaatatcatgaacggtaccactgcaaaccttctactacacatcccccaaagcagggatactctttggagtatatacctgaaatcaaactgctatgtcacaggtatgcaaatattccattttaggagaaaatgtccaaccattttccaaagtagtggctccagtttacactcccaccagtaacagatgagagccccagttgctctgtagccttacccacacttgatatggttacgttttaccttttcttttcttttttttttttttttttgagacaggatccagctctgtcacccagcctggagtgcagtggtgccatctctcgtcacagcaacctctgcttcctaggctcaagtagttctctggcctcagcctgccaagtagctgagaacacaggcatgtgccaccacatcggctaattttttattttttattttttgtagagatggggtctcactgtgttgcccagggtggtcttgaactcctgagctcaagcaatctgtccgccttggcctcccaaagtgctgggattacaggcatgagccaatgcgccctgaccctcattttacatttttgatggggtgggtatggtggctcatgcctataatcctagcactttggaaggctgaagcgggaagattgcttgagcccaggggtttgagaccagcctgggcaacatggcaaaatctcatctatactaaaaatgtaaaaattggctgggtgtggtgacacgcacctgtaatcccagctacttgggaggctgaggtgggaggatcacctgtgccggggggcagaggctgctgtgagccatgatcaaaccactgcactccagcctggatgacacaatgagatcccatctcaaaataaaaaaaaatttatgaacaatttcgtagaaaacagtatccactacacttaaatacactgatctgtccccatgtaggacaaatgtctcactgcccctttagcctgtatgggactcacggtggcaggtccctgctctatttgtcactgtatctccagttcctggcacaagtcctgattcatcaaggatgctcagtaaggtgggactcagtgagcaaaccagtcagtgagaactttgccagatctttaattattcattaggatcttcagcatggccatttccctgaaggctggcagagcaattcatcatcatcatcatcatcatcaccatcatttgttttagggaggcaggaaaatgacggggattcacctagaggccctgctaggaggcacagggcaagcctggcctcagcccctcacccccagcctctgccctctccacagctccccaccacctccctccagtccctgggagatggcccaggactcacttcaacaggactcctatgggtctctggtaatactggtgataggcgacccagggcgggatgaggaatcgttctgggttggggccctcggacttaaagagaagggccacatcttcagggtcgatgacataaaccgactccacgttgccgagcttctccctggaggggtgggggagaggggctgatggaaggatccgaggagagctatggatacaggctcagcacagctgcctcacagttccacaacttgctgactgtgggacctgagtcgaggcccttaacccctctgagtctcagtttcctcttctgtaaaatggagacaaatacagtacctgtctcgcagcgctgctgaaggacaagacaataggaagtatatggatgtgacctttgttaaacattctacaagtgagagctttatgatcactgttgctgctgtcccacagcacatccccagggccagcccaaagccacccccgagccttccatggaccagcaagtcctccactccttgcgcattcttcctgtgtccacacctacagcagccccagcttctcacctgtccacagagctcagaaccatggcacactttcatgtcactgctagagtgactcactatagcttgcaaggtaggccatattccaggccaaatccctgtcagactctacaactgaaattctgagagtggccaccctgaccctaagagtcagaggccacccaacaacacgctttgtctctattaaaataaaacttcagtaaaacatcaagccccaacatacaggcaggggagacaggcttgcaaatcactttgcagacaatctgtattaaatacaactgggtttttgttgttattgttgttttgagacagggtctctgttacccaggctggagtgcagtggtgtgatcacggctcactgcagccctgacctcccaggctcaagcgaccctctcacctcagcccggccaagtacctgggactacaggcaccaccatgcttaatttttgtgttttttgtagagatgaggttttgccatgttgcccaggctggtctcaaacttctgggctcaagagatcctcccacctcagcctcccaaagtgctgggatggcaggtttgagccaatgtgcctacccacatacaactgttacatatgactggtgttcttacatgaagagatgaggacacggatacacaaagaggaaggaccatgtcaacacacggggaaaagatagcatctaactccaaggagagaggcctcagaagaaagcaagcaactcagccaaaaccttgatctctgacttctagtttccagaactgccagaaaattaattctgttgtttaagcaaaaaataagaaataaaaatacaactactaaaaaacaacagaaaattccacttcttgctagcctctgccttttatcgaagaaaattaagatacacttttaggcaaaatagcataaaaacatggagatacaagccaagtgtgctcatgtgtgtgcatgttctctctctctctcctctcatagtgctgctttaaccactgagccagaaagcctgggcctaccttgatgagtttcaggccttcacttgttctgtggcctcccagaaaatcccctcagtgtttttccagctaccatgtgtctttgcactaactagctccatacccctaaccaagttcagccaagcccttgaactgctattatcatgatcaattccacttctgggaatctagcccaaggcaatgatctgacatcagcaacaatgcttgatggataaggatgtccattgcagcctcatgtctaacagcaaaaaagtcaagagtaggttgtatgttcactttaaagaacccgcgaaaaaaaaaatccatactgtgaactactatgctgccttttaaaattatattagaggccaggcacagtggctcacacctgtaatcccagtactttgggaggctgaggagggagagggaggatcacttgcgcccaggaattcaaggctacagtgagcctatgatggcaccactgcactccaccctgggagacagagcaagaccctgtttcaaaaaaagtaaatattaataagatagatcaagaaaaaggaagaagatataaataaacgaaacgagatctttccccagaaaagtctgaggaccactgaacatcactttctcttaaaatataaaataattttatattagagagagaaaaaaggaaagaattccttgatatattgttgtgagacaacataagcagcatatgtagtatattcacatacctcatgatacttaaatgttaaatcaattggaattgattgtatctgacttcaatttttcatttgtgtttctctgtattttctaaattgctctgtataaaacaagaacagcctttgtgttaggaaaaaaacccacaaaagttgtattttaaattcctcacatttattcagaagtttattgtttattagctataagttcaagtataatgacacacagagctggaagtcagacaattccagttcctgccctggctttgctctcatgagttgtgtgacattgacaagacccttcttctcactgggcctcagtttccccatctgtaaagtggggaaataataacaccaactacagggatatgttgcaagattcagatggaagtgactcagaaaacagaaagataattagggtctggaggcagggaacataaggccaattcacacttgagctgtgacaggaaatatcctctccatagggcgtatgctgtaaatgactttgtaactttacttcatcctctccatttacataaggcatatggaattaaccaatggaatgctctaaggggtatttaaactcccaaaaattctgttaacggggcccctgagctcctacactcaggcccctcccacaccgtggtgtgcattttcatgttcaatacatcccttcatcccttccgtgctttgtttgtgcgttttgtcaaattctttgttcaagacaccaagaacctggacaccctccaccggtaacatgtattttggccagccagccaggaggaagaggtaagcccaaagtttgggattcgtttttctccctttcctttctgctccatacaggagctctctctttctcttttctgttccaacttgggacccttgctgggccccacctaaacacggagacaactgcaggtttctggccgtggccagtgaaactaaggggtttccacgtggagaagcagcctgactgccaccgcccggttcgcttaagggacctgggtcttttttatgttttttttctctttttttgtctctttctatttcagtctttcagcggctgtttcctagtagctccttggaaattgaggctggggtcaccagtactgcctgaaggtctacgaatgaaagggaataattgcgctgccccaaagcgggagggactttttttaaaaatcttttttgcctatggttcctgatccctacatgcggtgctgctcggagcaaactcataaatgtttctgggggcttaaaccttactttcttatgctaaattcttcccttatagtgctcaactagctaaggacaaaaaaagcccacgcagcatccagttcacattacagttcatggctactcttataaagttcatagtatgctccagaggggaaagcctgcatgtgatgcccacctaaagccagagacgtctgggaccctaagattggaccccacaggaggatgctctgtgggtcctgcggaccccagccactccaaagaggatgctcttggcagaggttctgaggtctagccctccttagaattttctctccgcagttgcaatgctgtttggccccaacattgtttggaatctgaagtttactgttgaattggaaagtggaatagagttgcatgtatccaggcttttgtgctgcagctctaagcagggggcctggttaacatgtgacaccctgctttgaagtcgtgggaggtttggcctttaaaaatcaaactgccatggagactgctttagccaaaattttggttcacagccttcattggattatctgttggggcaaaaactggcaagcttgtattgctatctcatggctaaggttccaagctattgaatcttcgtttatgtgtgtgtatacatgtctagatgtgtttatttgtatgtacacattgttatatgttgtgtctaccaaattgccttataagtaaaagagcactcataaattaagtaaataagtctaagcaattttcaagttcacgtgacttaaagtataactttactaaacaagctagctttaaaattattggtggaataaaaatagaaatgccttcagtattatcagtatacattttgtttgaattttatgtttgtctttgctatctttttttttttttttttttttttgagacagagtctcactctgtcacccaggctagagtgcagtggtgtgatctcggctcactgcaacctccgccttctgggttcaaacaattctcctgcctcagcctcctaagaagctgggaccacaggcacacgccaccacgcccagctaatttttaaattttttaatagagacaaggtttcaccatattggccaggctggtcttgaactcttgaccttgtgatctgcctgcctcagcctcccaaagcactgggattacaggcatgagccaccactagatattcttaaatgtcagtgaattcaacctgggagctgcttggggcgagcctgcctccccttctattcaaagtctcactgagataaatgcatatctgattggttcctttggaaaggctaatcagaaactcaaaagaatgtaaacatctgtctcccacctgtgatctgaaagcctccaagcccactccttgccttgagttgtcccacctttcaggaccaaaccaatgttcattttacatatgttaattagtgtctcatgtctcccttgttaaaagtaaaaattgagtacagcaaatgggataaatgctttaggtaaactttttgtgtaaattaaaaccttaaagttatttttggcactcatttaatatctgggtcatttccaagtaagaaagggttgtgatatggggaaatatgtttctaaaattgtggaattgttcttatctataaatgcccatatctgatatttcaggatttcttgctttttagggtttcactaaaattttacattacaaaggataaggtttctagttaacacgtaattctgtatacaaaaagtgcctgaaagggttattactaaaaaaaggaaagaataattttgtctaattcagaagttatctaaaagttagttcaagttacagttttgaaaaggttatttatgaaacaatgtagtaaggaaccattaagtaggggagaaagatgaggtacagtttaaataataaaatattctttaaaacctgataaagaattggaaacatttggctaattaacatttttatagttaaagctcttagtcttgattaaagtaagaagtattgtaaaaatgcattggcagtttggcaactcttttttttaatatagttaagcatgaagctggatttagtgtggaaccaaattccacatacatgcttacattgcttcatactatgtttactgttttgcatggatagtgctggagtacttattggtcatacgcctaaagtgaatttgttaattgcacaggatgtatgataatattagtgaacttaaggatactgaattgtgtatcaggaataaaatattcattatgtgggtttttgggggccctatgtaacactgtagcctccagggtaaattgaataagaaaatttagggttggtttcctgcttatttgtttttgcttctagttttcatttgtttgccatttgttctcctctgactttgcttgtgtatgcatgtatataaaaaccatgatttttcttagttcctagtggaaggttttcatttagttctgtgttcctgtgcatttctagcaagtcatcattcattccatttttctggaattcccaagctacctttgttgggcctgcaggaattaatggagcatactagcttttttatccttaaactaactttttggattttaggcttcctgatactttaagtgtgttgagtatactctcacaaatagaattttagtcatatttctctcactctgcctagtttctccaaaatttgtaaactatttatgaatattcttaattcattgcaatgtgtttgtttgcatacagtcaagcagggtccctggggccactcagggagagaatgtcaggcctctgagcccaagctaagccgtcatatcccctgtgacctgcacgtatacatccagatggcctgaaataactgaagaatcacaaagaagtgaaaatggcctgttcctgccttaactgataacattaccttgtgaaattccttctcctggctcttctggctcaaaagctcccccactgagcaccttgtgacccccacccctgccagccaaaaaacaaccccctttgactgtaattttccattacctacccaaatcctataaaacagccccacccctatctccttttgctgactcttttcggattcagcctgcctgcacccaggtgattaaaaagctttattgctcacacaaagcctgtttggtggtctcttcacagggacacgcatgaaatttggtgccatgactcggatcaggggacctcccttgggagatcaatcccctgtcctcctgctctttgctcagtgagaaagatccacctatgacctcaggtcctcagaccaaccagcccaaggaacatcccaccaattttaaacccggtaagcagcctctttttactctcttctccaacctctctcactatctctcaacctctttctcctttcaatcttggcgccatctttcaatctctcccttcccttaatttcagttcctttccttttctggcagagacagaggagacgtgttttatccgtgaacccaaaactccagcgctggtcacagactcgggaagacagtcttcccttggtgtttaatcactgcggggatgcctgcttgattattcacccacatttcagaggtgtttgatcaccacggggacacctgccttgatccttcacccttagtggcaagcaccactaatttggggggcaagcacctcccttctctccgtgtctctaccctcccttttctctccactttcctggggggcaggcatcccccacaccttctctccatgtctctatcctctcttttctctgggcttacctccttcactatgggcaaacttccacccctccattcctccctcttctcccttagcctgtgttctcaagaatttaaaacctcttcaactcacacgtgacctaaaacctaaacatcttattttcttctgcaatgccacttaaccccaatacaaactcaacaatggttccaaatagccagaaaacggcactttcgatttctccatcctacaagatctagataattcttgtcataaaatgggcaaatggtctgaggtacctgacacccaggcattctttgttccctccctagtctatttccaatgcaattggtcccaaatcttcttttccctcccacctgtcccttcagtcccaaccccaagtgttgttgagtctttccaatcttccttttctaccgacccatctgacctctcccctcatccccagactgctcctcaggtcactccccagccaggctgaatcaggctccaattcttcctcagtttctgctcctccaccctataatccttctatcaccccctctccccaaacccagtccagcttacagtttcgttctgcaactagccctcccccatctgcccagtaatttcctcttaaaaaggtggctggagctaaaggcatagtcaaggttaatgctcctttttctttatccgaactctcccaaatcagttagtgtttaggctctttttcctcaaatataaaaacccagcccagttcatggctcatttggcagcaaccctgagacgctttacagccctagaccctgaagggtcagaaggctgtcttattctcaatatgcattttatcacccagtcagcccctgacattagaaaaaagcttcaaaaattagaatccggccctcaaacctcgcaatgggaattaatcaaccttgccttcaaggtgtacaataatagaaaggaggcagccagacagcaacacatttctgagttacaattacttgcctctgctgtgagacaaaacccagccgcatctccagcatacaagaacttcaaaacgcctgaactgcagcggccaggcattcctccaggaccacctgccccaggatcttgcttcaagtgctggaaatctggccactgggccaagtattgcctgcagcctgggattcctcctaagccatgtcccatctgtgcaggaccccactggaaactggactgtccaactcacccagcagccactcccagagcccctggaactctggcccaaggctatctgactgactccttcccagatcttctccgcttagcggctgaagactgatgctgcccaatcgcctcagaagcttcctggatcatcacagatgctttaggtaactcttacagtggagggtaagtccgtccccttcttaatcaatatggaggctaccaactccacattaccttcttttcaagggcctatttcctttgcctccacaactattgtgggtattgacagccaggcttctaaacctcttaaaacttcccaactctggtgccaacttggacaatattcttttatgcactcctttttagttatccccacctgcccagttcccttattaggtcaagacattttaactaaattatctgcttccctgactattcctgggctacagccacaccttattgccacccttttccccagtttaaagcctccttcacatcctccccttgtatctccccaccttaatccacacatatgggacatgtctactccctccttggtgactgatcatgcaccccttaccatcccattaaaacctaatcacccttaccctgttcaatgctaatatcctatcccacagcatgctttaaaaagattaaagcctgttatcacttgcctgttacagcatggccttttaaagcctataatctctccttataattcccccattttacctgttcaaaaaccagacaggtcttacaggttagtgcaggatctgtgccttatcaaccaaattgttttgcctatccaccccatggtgccaaactcatatatgctcctatcctccatacctccctccacaacccattattctgttctggatctcaaacatgctttctctactattcctttgcacccttcatcccagcctctcttcactttcacttggactgaccctgacacccatcaggctcagcaaattacctgggctgtactgctgcaagtcttcacggacaggccccattacttcagtgaaccccaatttcttcctcatccattacctatctcaacataattcttcatgaaaacacacatgctctccctgctgatcacgtccagctaatctcacaaaccctaaccccttctacaaagcaacaatgcctttccttcctaggcatggttagatactccacctttggatacctagttttaccatcctgactaaaccattatataaacttaaaaatgcaaacttagctgatcccatagatcctaaattctttcgccactcctctttctgttccttaaaaacagccctagaagctgctcccacactagctctctctaactcatccaaccctttttcattacacacagctgaagtgcagggctgtgcggtcagaattcttacacaagagccaggaccgcgcccggcagcctttctatccaaacaacttgaccttactgttttagcctagccctcatgtctgtgtacggcagctgtcgctgctttaatacttttagaggccctcaaaatcacaaactgtgctcaactcactctctccagttctcataacttccaaaatctattttcttcctcacacctgatgcatatactttctgccccgctccactacctctcagcaagctgaactcattgccttaactggagccctaacccttgcaaatgaattacacgtcaatatttatactgactctaaagatgccttccatatcctgcaccaccatgctgttgtatgggctgaaagaggtctcctcactacacaagggtcctccatcttaatgcctctttaataaaaactcttctcaaggccgctttacttccaaaggaagctggagtcattcactgcaagggccatcaaaaggcatcagatcccattgctctgggcaatgcttatgctgataaggtagctaaaaagcagctagcattccaacttctatccctcacagccagtttttctccttctcatcggtcactcccacctactcccctactaaaacttccacctatcaatctcttcccacacaaggcaaatggttcttagaccaaggaaaatatctccttccagcctcacaggcccattctattctgtcgtcatttcataacctcttccatgtaggttacaagccactagcccacctcttagaacctctcatttcctttccatcatggaaatctatccacaaggaaatcacttctcagggttccatctgctagtctactactcctcaggaccctcccttccctacacatcaagctcagggatttgcctctgcccaggactggcaaattgactttactcacatgccccaagtcaggaaactaaaatacctcttggtctaggtagacacgttcaccggttgggtagagacctttcccgtagggtctgaaaaggccaccacgatcatttcttcccttctgtcagacataattcctcggtttggccttcctacctctatacagtctgataacagaccagcctttattagtcaaatcactcaagcagtttctcaggctcttggtattcagtgaaaccttcataccccttaccgtcttcaatcttcaggaaaggtaaaacggactaatggtcttttaaaaacacacctcaccaaactcagcctccaacttaaaaaaaggactctgtcaagaatagagcccaaaaactcaccaaccaaacaagtaattacactgaatccccttgggcactctctaatcggatgtcctgggtcctcccaattcttagtcctttaatacctgtttttctccttctcttattcagaccttgtgtcttccatttagtttttcagttcatacaaaattgcatccaggccatcaccaatcattctacatgacaaatgctccttttaacaaccccacaatatcaccccttaccacaaaatcttcctttggcttaatctctcccactctaggttcccacactgcccttaatcctgcttgaagcagccctgagaaacattgcccattatctctccataccacccccaaaatttttgctgccccaacacttcaacactattttatgttatttttcttactaatataagaagacaggaatatcaggcctctgagcccaagctaagccatcatgtcccctgtgacctgcacgtatgcacccagatggcctgaagtaactgaaggatcacaaaagaagtgaaaacggcctgttcctgccttaactgatgacattaccttgtgaaattccttctcctggctcatcctggctcaaaagctcccccactgagcaccttgtgtcccctgcccgtgcctgccaaagaacaacccctttgactgtaattttccatgacctacccaaatcctataaaacggccccacccctatctcccttcgctgactctctttacggacttagcccacctgcacccaggtgattaaaaagctttattgctcacacaaagcctgttcagtggtctcttcacagggacacgcgtgaaagagagaaccctgaaatctggcatgccggtgaaaggataagaatttcttatgagtcagtctctgggctctttccctctatgcaaactggttaaatataaagtagaagtcacgtatatctcctctgtaagattttaaattaattggtttaataataataaaagcttaagtcaaatattttgtcagaaaagtagaaagtgtaatgccttttagttcatgtgactttagcaatagttgggaaataaagacagttttcaagattattggaaaaatacagttgtcttcaaaatgtaaacatgtggtgtacattatgttcaaatactaggtttgctaaatcctttaacatcataagctactcctttggcttttgaaaattgtttaacttgcctgctttccagctaggtaaggcctggggacacgtggagttagccatgcccctagctgtgctggaagtagtcaaaccttatcagaaactttatcagaacttaccagttttttttgtttttgtttttgttttgacagagtctcactctgtcccccaggctggagtgcagtggcgcaatctcggctcacccacaatctccatctcccagattcaagcaattctctgccctagcctcctgagtagctggaattacagacgcccgccaccacacctggctaattttttattattatttttagtagagatggggttttaccatcttggctaggctggtcttgaactcctgacctcatgatccacccgcctcggcctcccaaagtgctgggattacaggagtgagccaccgcgcctggcctaacttaccaggttttatgttaaaattcgccattataggccagtcacagtgcctcgcacctgtaatcccagcatttggggaggccgaggcaggtggatcacctaaggtcaggagttcaagaccagcctgaccaacatggtgaaacccccatctctagtaaaaatacaaaattagctgggcaaggtggtgcctgcctgtaatcccagctactggggaggctgaggcaggagaatcatttgaactcaggaggcagaggttgaagtgagccgagatcatgccattgcactccagcctgggcaacaagagtgaaactctgtctcaaaaaaaacaaatttgccattataacatgcaattaagactactagaaacagttttacatgcaaggtgtataagaacagtagaaagtgttgggggtttttttgtgtgtgtggaaggttacaaaaggtttttgcttctttaaaatttctgagtcatcattttggcaaaataaatagtttacggtaatctggaattccaaaatcaaacttcagtttcaaaattgtctttcctaatgcctggctttctagatgaatcagagggcccctgaaaacatccagaaaagaggtaaacaggattatttgacatgtttaggtacatgggattgacaaaatgatgttaaatcttctttaggttatatttttgtgaataatatattccaaaattgtatgggatttctcaaattctaatgtctaagtatatgttaccaatcacaattataattatgttaagttattgtaaaccacaaaaatgaccaaattttcttgtataaagctactaacccacgtaaaacaacaacaacaaaaaattaattacatatcaagaaaagactttcatgttaaaccagctaatactgaaattgtttaaaatagtttataacctgtcgctttgcagatgccgtcactgccaccaggagccctgtactatcagccatggtcaaccccaccgtgttctttgacatcgcagtcacggcgagcccttgggtcacgtctcctttgagctgtttgcagacaagattccaaaaacagcagaaaactttcatgctctgagcactggagaggaaggatttggttataagggttcctgctttcacataattattccaggatttatgtgtcagggtggtgacttcatatgccataatggcactggtggcaagtccatctatggggagaaatttgatgatgagaacttcatcctaaggcatacacgtcctggcatcttgtccatggcaaatgctggatccaatacaaacggttcccagtttttcatctgcactgacaagactgagtggtggatggcaagcatgtggtctttggcaaggtgaaagaaggcatgaatattgtggaggccacggagcgctttgggtccaggaatggcaagaccaggaagaagatcaccattgctgactgtggacaactctaataagtttgacttgtgttttatcttaaccaccagaccattccttctgtagctcaggacagcaccctccaccccatttgctcgcagtatcctagaatctttgtgctctcgctgcagttcccttccatgcctagctggactgcagagttgagttaaagtttatgattatgaaataaaaactaaataacaacaaaaaattgtttataaccaatgcttgatcccatattcctaggaaaacaattaaagcttcaggtatatttggtcttctggtcagccatttaaacattttataaagggatttcattccattgttattttccatgcatgttttctggttgtagaaaagctttcccatgcaagagggctgatgttataacagtagattattatgctacagtgtattttcaccagattaaaaaaaaaagctttttatggtttgaatctgctggaaacatcagagaaagactgtccttgccatctacactataacaaaacttcaggaccttgaactttgggttcataatctcacaactgagaagggcccctccatgctcttggagctgtgcacccactggaatgcttaaggtaaaactaactagggaaatttctcccaagaagaagatgacatcattgatgtgaacagcttttcccaagttcacagattaagacttctactatcatgaaactcttatttttgaatattttttcttgcttatgccttctacgaacaatagaagtggaaaaggggtctgttatgtgcacttatggggaacatttttatttgtgaaggagtttgcagccagccttatacatggataaaggcccaatgtatgtaagaaactttaatggtagatgtgttagctcataatcaatcaaaaacaaaaaattgattcactccacataacccacatcgtgggttaaagagaacattgccagaagtccttcactcttctgaaagggcatcatttgttaggtcctttttccatggtttaaagtaaaagaagcaatgattagaaatgtatccctcatgataggttccatagcaaattctactctaaaggctacagactctaaattctcttgtgaaagttataatagaattggctaaacagcgaagtatctgtgcagctgctggcacttgtggcctatacagaaatacatcaaatgaagactatagaaattcagtggtaggagactgacaaagaaattgattagtcaagtctctctctgttgcccaggctgaagtgcagtggcgtgatcttggctcactgcaacctccgactcccaggttcaagcaatcctcctgccttggcctcccaagtagctgggattacaggtgcacgtgaccacacccagccaatttttgtattttagtagagatggggtttcaccacgttggccaggctcatcttgaactcctgacctcaagtgagccacctcacccagccgtgagtaaactgtatctagctcattcttagatccatttgattttaggaggtttggtttatggggaccttgggtaaggagtatactcccaaattcttggtattatcctcctaatagccataataatggtctccctgacgagctgtatgctctcaaaggttttaaatgcttgcatgagccatctctagaatgtcatatggtctctcttcaactggaataacaggagctcaaagaaatatgcaaccatgaggacaccataacctataaatgacatgctgagaccagaaacccaaaatgatggtaactgagagtggcactgaggccctaggttttggtcacactctcacctaagtgaaaacctgatcaaaaagggaatttttttcaacaaaattctgggaggccgttgttttggactgatctcatgcactaggccccaacaaaccaaacaaaaccaaaatggggccactcatgccaagactttaaggaaacacatagattctagaaaagactaggttttgttttttcttctgcaaatcactacaacaaacatttctgacagtataggtatccaccccctaaagtttccattaaatcttttaaccaaattcatttcctctcacctagagaccatcaagcttcagatgatcatgtaacaaaggttccagccagttccaagtgaagacaccacccctggacatcaagaagctacccttcctccactagatagagcagggtgagagttccatgatccccaataggtagggactatgccccaagccagcatgaagcagttacagaaaaaagaccatcggtccctctgcctcccataaagatttatggggatcacatctcttgaaggggcagatgaggcaggaaaatagggtctgaagtgtgaagatcgattcacacttcagctataacaggaaatatcctctccatagggtgtatgactatgtaacttgaatacttcatcctctccatttacataaggtgtatctgaagtaaccaatggaatcctctgggggtaaatgccccacaattctgtaacgggacctttgagcccctacgctccgcctgctcccacactgtggtgtgtatgttcattttcaataaatcccttcattccttccttactttgtctgtgcattttgtccaattctttgttcaagacgccaagaacctggacaccctccaccggtaacaaaggggcttaataaaataaggagttgctactgagggtctaggaagtggtgaaaagggaagagaggaggaagcaaggataactagagatctatgtgaagtgagcacgggacagaagcactaataggcctaggagagagggggaggaaggagagacccagcggggcgcaacctcccaagcccagcactcaaccttgaatagggtggggtgcggggtggggggagctccctgccaccaaccagctatcaaaaggggcagtttggactttaaaggagttgtgagagagggagggagcagctgaagccccaacacaaactagcctgccttctcacccacccccagcccagtcatcaagccggccaacacatcttacccttccctcttcgtgactgacccattggaatgctctgagttgtaaagacctttcacttaaaggaaaacgtactgtccctcctggtctcccctcccagcccccaaccacccctgcgccacctccgttccctctcaaccggactcttagcaaagaacccaggtgtggctgaaaggctgcccaccgtgggaacagctttagcagttttcccaggaaaaagccacaagccctggaggcacagaggcccaaagacaaaaaaaaaaaaaaaaggcctttcctcctagcaggaagcaagcccgattcttgggaaagggaagggacagactcagagcctcagggccaaggggtgagatccagcaccccagcaggacaggaatctagctgggtgacctctctgagcctcagtctcctcctctgaccatggggacaacaaacttcgcttgcaaggtgtgcggagggtaacggatgtagggaggcatttagtagggcttgttctctaaccacctctctccgagagtttcaaagggagtgggatctggggaaggttgaggcctcaggcctgggaactaggaatactttcccttttacccaccaccatcccaggcctggaagaagatcagaagttggacaggagaggtccggccgcgcggacgtcaccttagcgcgccactgtcggctccggtgggctcgggtgagctcgggtgaacgcagcgagcgagggcagaggccagcagaggcgaggagtggatgctgcagggccgcaggccgggcagagaaacgcataccgggtcgctccctgcttcgccgccgcctcctggcagggccagcgaagccagtgctccagcgcccccgtaacacctcaaagcgcacggagtccgtgttggggaacttggcggcagagtgactgggacctaggacctgcggtggggccgccgccgcctccgcggggccgagcgcctggacctcgccctgaggtaaacgcgggtcgacccggggggcggatgggctcgggctgtgtcgaggggaggcggaggtgagcgacccgcgaagagcgcaggagcaggccgggggccacgctagggcggacccaatttcggaatagcgcggcccgggcggcggcgtgcgctgggaggaatgctgggtctgtcgctagcgccaaacttgaccacgctgcgaccttttcactctgtgctctgaccttcaaatctccctcccccgattttttttttttttttttttttgagacagagtttcgcttttgttgcccagggcgggagtgcagtgacatgatctcggctcactgcaacctccacctcctgggttcgggcgagtgtcctgcctcagcctcccgagtagctgggattatagacccccgccaccatgcccggctaattttttttattttatttatttatttatttatttatttatttatttttgtagtagagacagggtttcaccatgttggccgggttgatctcgaactcctgtcctcaagtgatccgcctgcctcagcctcccaaagtgctgggattacaagcgtgagccaccgcacccggccttctcccaatttttaaaactcgctggctgggctgacagctacagggccaggaattcaaaacttagcctcaccagtctcccctcctcagaccgaggaggttgttttgttttgtttgagacagaatctcactctgtcgcccaggctggattgcaatggtgcgatctcggctcactgcaacctctgcctctccggttcaagccattctcctgcttcagcctcccgagtagctgggattacaggcgcctgccaccacacccagctaatttttgtatttttagtagagacggggtttcatcatgttggccaggatggtctcgaactcttgatctcaagtgatccgcccacctcggcctcccaaagtgctgggattatgggtgtgagccaccatgcctggccagacctggggtttggacccattaaagagcttccttacagatggctggcggtcttgccaccaattgtttcaaaagtagatgtctggtttagagtacttaagacattcacagattcaaatgttgaattttgaaatatccctgatatatttctgtattgtattaccaaaaaaaaaaaaaaaaaagaagttagacaggagtttggaaccagagaacagcctgttgggggagtggggactacagcagggctacccaggcccctcctcctccctgtcccttcggctcccaccctctgccaggcttacctgtaaatcgggccatacttctggaaattctggacatggtgaaggtggactttgtgtgtgcccgtctccctccagaaatggtacaggtttagccagccattgtcaccaggagaggggatctcattgaaggggcgaggactgcgggtggagatgccagctccctcgccagtgggcaccctgagacgccccagcccctccctgggggcactcagaaaggtctggcagcctttgaccaggactgagcgtgggggaagacccttggccagcatgctgtccccacagctgtgactgtacctgctccacttcagcggggactgctaggatgactgtagccctgggccaccagggccaagattataactaccagctcaaggccataccagaagctgataaaatgttcacgtccttcctcctgctgcaggct

SEQ ID NO: 1034 - DNA, 28452 bp, Homo sapiens
acatggttcagctgtttattgtctccatggggtgggtgaagaggagtggcccagctgagctgaggaaggtgaccactgagaacccattcaacctgctgagcaggctgggcagaaaggagcaggacttgggacagacgactgaagatgcagagaccccatgggccccacccctgggccttcctcccatgtggctgcaggccatcctctctgatcactgctgggttgcttcctggttaaagggccagaaggtgaaggagatgggcttttcaggcatcagaatgaggttgaatgtggtgcccacatcgctgaggtgttggatttcaactctgaagttctccagcatctgagaaaggcagatggtaggtttaggggagggcaggggaggatctgtctccctagccaggccaattcacccataggcagtgcctgtggagtgtgatttgaggagttccaaggagttcaccaccagctcctggtgtaaccctgcacagtgcctgataatgcacccttagtgctgcatttccttgatttaggcctagaccttaacttgtctacaaacctcagtcctatcccatcccatcaccaccatggggaatggatggccaggggcatcagtgggtgatgagtggttgagcccgaaagagggggcagcagagaactgtgggagagagcgagagcaagtaactggaggtagatgcgccccagcactgacatccttgggctctggacagagataggaggaggaagattggtgccttcattagggccagggccagcccagggtgcctagatgtccccagcttgactcacattgatgaggaagatggtcatctctagctcagcgatccgccgtcccagacactgccgcacaccccagccaaagcccaagttccggaagtaggtgatgttcttgtctttgctcagccatcgggttgggtcaaaattttccgggtcgaagaagaaggtgggctctcggcccagagcatagatggccacttgcaccagtgtctggggcaaggtgatcagaggcctgagtaagccccacttccccacagccctgagcacaaaacccccttccctagtcccctgccctctcaccaccactcccactccccagcatggctgcccagctctccagggcaggacattctgcccactgtgcagccttgaacaaggccccgcccctctgtaatccttacccaccaaatggggatggctgaagacccaaggccaggatgattgtcccaccctttcctcagacccaggcaaatcatgaagtctccctcctaaccctgggttccaataacatcctagaggtcaccgcccaccatgcccaccacctctgcccttcattcagacttagactgctgccatcaagggccccaccagggccccagtgccaccctctgtctgcaattccagcctgccccagccctctctgactggcagagcctgcagcctgctggctgcacctaccttggcaggaatcatgtaatctcgaagaaccaagtcatttacaagatatctctgcagggtcacggagatggggtgaagtctgcgggaggagggcactcagaagctgatggccccaaaggctggacacagccgccggagccccacaccctgtgtggcatctcagccctagctgcagcagcctggggggacctgggggtagggccctggctctatttctttctcctccagacttttcacttcctgcttccaacctcctccaccagcccatcctcgtaaccctttccccgggcacttccctggccctgcccagggattggagttgggggcggcatgggtggttgtgggcttgccttagtgtctccttgatgctggctttgaggagggggaccagctgtagcatcgtggccatgtctccctgggcctggtgccgcgcagccaagacctctgcccgcagcatatcctgcaccttcaggttgcgtgccatctcatacaagtgccactgcagggtcatggacgtctggtggggagtagggtatacagaagaccaggagggcctgtcactccggggccccttgaggtccttgaccccatggtaaattttcatttccaagaacctctttctccccgaaccccatcccagtctccaagaccatcctctgcaagagcaaaacacattccattgtctaaaaggcaaatgtccaagaagcctttcttgccggccaggcaggaacattcagggcagcacttgtccctgccctcgtccctcatgtcaccaaaaacccacccatgtccacagtgagtagagtgtcagctacacagccaatgccttcttccaaagaattccagaggcccttagaggccaaatccttctgtaatgattgcactccagaatgactgccattccttttgaaatgccttgttaaacaaccacccctctttccagtagaacttcctaaaaccttaggcttcacctatagcaacatggcttcaagtaaggctcaaagaagctgaaaccagaccagccggatgtttcctatcagtgttgcaattagggtgtggtgtgtgttgaaattaatcagctaatctcaacgtaagccagaggctgtgaccactagcccttcgccagagatctgagtgaccctcatcaaaccccacagtcccagattcctcaatgatgacaaaccaggcccgtttgggactccagcctggagcagccctccctcctggggactaggacatgggttgttgacacattatcttaccaaggatcatatttttgtccaacagacttagacacccacctccctcctcctggcaggggcaacaatgacaagctgtgaggtaccatttattaagcatatattatatggcaggcagggtcctaagctgtttacatatgttacctcgtttaatactcacaaacaaacctctaaggtatgttaccatcatccccctttttcagatgcggaaactgaaacaacacacagctccttctcagcttaaaatccttgcctggctccccagagcctccagatgaaatacagaggctcaggcctgagccacagggcccctcaacacctgcctgctgctccccaataccccactccccacctctctccaacacacacctaatgttccagctacatggagtggcacacagcccctgaagcccagaagtcttccccacgctaggtcctcttcctggaattcccttccccgcctaagaaggaaggatgtgctccctctgcaagactctaatcaaatgtgtgtattcatctcagtactgccaaggcctgccatagagatgtacttgggatttaataaggtggttaactatgttactagctgtgtgacctcgaccaagttatttaacctctctgtgctctactttcctcatctgaaaaagggggatgatggtaacataccttagagggttgtttgtgagtattaaatgaggtaacatatgtaaacagcttaggaccctgcctgccatatagtatgtgcttaataaatgtgacctcacagtaatcgtttctttggtgccggtgagtgatttttgaagatctcttctacgtaatagacaatgaactatgtttaaggtatgctcaaaggctccatttgcagtctgtctcagggatggaaactccttcatcagagtgtaacacagatataatacctgggaatgaaagtgattcacccagggggcttgacatgtgcttctccctagtcctgaaatgctattccttctctctcctcctggcaacagcctgcaagacacgcacgttgaattttagctcctctgtggagccttctccgtgtccttcatggccacattagccactccccacctctcagctttgtcagtggcaggtgcttgcctctgtcactgcagtgtgctattcctccgttcacactgctgcctccctgttataggctgagctgtataccccctcccaaaattcatctgctgaagtcctaaccctcagaacctcaaatgtgactatatttggagatagaacctttaaagattttaaagtaaaatgaagtccttgaggaggatcctaatccagttctgattagtgtcctcatgaggagagacaattctgacacagacacagagggaagcccatgtgagacagagggagaagacggccatctacaagccaaggaaagaggcctttagaatgcaccaaccctgccaacaccttgaccttgaacttccagcctccggaactgtgagaaaatcaatgtttgttgtttaaatcgcccagtcaatgccattttgttacagcggccctagcaaaccagtacacccctcccctctgagccacgtgaggacatttgaggtctactgtattccttttgagatggagtctcacactaccacctgagctggagtgcagtggtgcgatctcggctcaccacaatctctgcctcacgggttcaagcgattctcctgcctcagcctcctgagtagctgggattgtaggtgcccaccaccaggcccagctaattttttgtatttttagtagagatggggtttcactatgttggccaggctggtctcgaacttctgacctcatgatccgcccacctctgcctcccaaagtgctgggattacaggcatgagccactgcgcccggccaggactgattattcttaatatccaaagaaagaagtttctagggtgccatgctgctatggaaagagcactggggatgcctctgggcgttgggggcaccgtagggtactgaggtctggaaaggggaggaggaaggacaacaaaaagaccatggacggcagagcccacagcaaatgcctcggcctcccaatgtttccgggctcctgcctgcttccctggatttgagtgagtgtgttctccaccaggagctgggggcattgtcctccatcagcagggctctgatagagcaagcctccagaggggacctcctcctgtggagactctacgtggaacctggacctcaccaccatgcccggccactcctctctcacaggcaaagaaaaatagctgatcatcctcaaatcatgccctgggtgacttgactttgaccccaccatcttaggagattagcgctttggaaatggaggcaaggaggaagacatatcctacatgagtaggaacgccttgaacaacagggtttcagacaacgaggggcctggtggggaaggggcacgtgggcacagggggcaacaaggtgccgcccctacagccacctcaccgtgtccacccctcctgccagcatctctgtgacgttggccttgatgtcctcgaaggacatcttgctgtctcccaggagtctgtagaggatgccacggtaatcgtggtgaacacttcctttctgtctcaattcccagtagaagttctgggtgtatatgtcagctgtggggaaggaggaaagaaaaaagagtgaggttccctgcaggcgggtgggaaggagggcagtctgtggtgaaaggtggcaccaagggcctggggattccggagccctgtgcttcttaggctgccgttttactgagcacgtactctgtactaagcccttcatatctgttttttcatcgaattcttggggtatgtgacatcatccccattttacagataacagaggtgcagagacatagtcacttgcccaaggtcacatggctgtaaggggcagaggtgggatttgactctgccataccctgacgagccttctccacccaaccttccccatctctcccacccaagtccctgtcatccagcacagccgtggctcagacactggtcctttgccctctggggagcatgagctcctttgaagaagatcacagatgtctttgctcctctttttccagaaaaatctaataatccccaacagccagccttccatccgccatttccaggggtcccagggccttcctgacacccacgcctgcccgccacagtgtgggtttcctacaggtcaagtcagcgcccattgacatagcgtgggacaaaggagccggctgaggcctggggctccgaggaggagagcacagccagagaagccctcacctttactgaaaatcacgtcccatgcagccacatggtccttccaggtcttggtcctgaacagacggaacaggtctgggggaaggttgagcatggggacgctggtgtggaacatctggtagatggcatcaatgaatcgctgggcctcggggttcactacttcctccagcatcccctggcgctccccaaaaatgacgttagtgatggctgcagggagaggaagaggctgaggagccatttctgacggggccatctgagagccacaactcccagggactcctccaccctcacctccctcagcacaaaggatctcttgcccctaccctcagcctccttcagtaaataaattgaggcctgagtcccaaagggctaagatgcaaggctgagaaagctgacctctggcaaccacacaggtcctgcagaggggcatgtggaggacctgaaaggtgggaagcagggtctccagcagagctgagagagggcctagcccaggatgcaactgctctgcccaggcttccaccaagagagattcctcatctgtaattggctgaattggctaaatacttcctgaaacaggtcagaaaggagactgagggtcataaatccctggataattaaccatccaggacctagtcttgctggacctaagaagttacaacagcctcaagttttccccacctaccaggtgagtaatttgaatactgatttcatacaaagctctgggcaccccaaatctcttgctgtgaccacacaatcttcatcaagccacagggcctttgtatgtgtggttccctctacctatactgcctgacttccttaccccatctagataactcctacagattcctcaatgcctacctcagattaaccactgaactctcctctaccctaccagactccaaaggtctatggcccaggaggtggagacttgcagaatgaaggtccaagccaagctctggctttggcggatggtggcaatagggacctgtactttggggacccttgctcctacagcacaaatgccagatgagagagaatgccagatgagagaaccccagagcaaggggtctcactctgttgcccagggtggtcttaaattgcctctgagtagcaggcagtggaggacatgatcagcggctcatcccagaagtcagtctcaatgcctctgcagggtctgtactgaacctcaaggtaagagagtgaacactgagtcctcccacccccatgcccactgccagccaggtgcaagcccccttacactcaaaggcaaagcggaacaggtcatcactgatgtcccccgagtaatttccggagcccgccttcttgatgcgcctgtgcaggacactgacgaagtcccgagacactgcatccaacaggggcaaaaagttcttggtggcctctggagccatcacctcctggttcagggccacccggtctttcttccaggctgccgacttcctgagaaaacatgggcccacaagccctcatggtcacagaccccaggcctggtgaacacagagggggctgactcagttttcccaggaagctgagtcacagctcacagcatccagcactcccaccagggcctctgccctcacctctccgagcaccctctgcctctcacctcctccctgctctgcctggctgggagaagagaaaggaaaaaagagagtgaaggggaacaaaactccaactcccctccactccctctgctgagggccaggaactgatattcttagaaccctttgtgtaactttcagtctctccagtctttgcctcagctgcaggcatgccttccatgccactcccacttcctcctggccgatgctcacctttgacactccagggcccctctatataacattttctgactcttgcacaaacaaaattgaccagcctctcctcctctgcacccccaacacgtcccattactcacttctgtcgggggacctcaggtgccccgaactgggttggtcataataaaccttaattcatgcacactcttgaaattcatcaatccatgcaaagtcctcttcgtgacttgggggtgtttttgttgataagaatattatcacaaacttaccacccaccatagaaactaggaacttgacagtaacttacacttgccctcctggtccttccacatcctttgttcccttctaaggagaccacccactagaatcccttgctctcatttgtgtctaattttatctgatctccatttattcccaaaaggtactattacaaaatatatactagtgtttaacttcttttaaaaagctgtcggtcagacacagtggctcacgcctgtaatcccagcattttgggagaccgaggcaggtggatcacctgaggtcaggagttcgagaccagcctggccaacatggtgaaaccccgtctctactgaaaatacaaaaattagctgggcatggtggcgggcatctataatcccagctacgccggagcttgaggcaatagaatcacttgaacccgggaggcggaggttggagtgagccaagatcgtgccattgcactccagcctgggtgacagagcaagactctgcctcaaaaaaaaaaaaaaaaaaaaagaaagaaagaaagaaaagctgtcatgctttgccagacttgcttttttcacttagttgcaccgttccaagtatcatctgtattgctgtgggagactgagtcccttcattttgactggtgtgtaccacaattcactcacttataatcctattgggcatttcagtagctttctggtttttaatatcatgaacggtaccactgcaaaccttctactacacatcccccaaagcagggatactctttggagtatatacctgaaatcaaactgctatgtcacaggtatgcaaatattccattttaggagaaaatgtccaaccattttccaaagtagtggctccagtttacactcccaccagtaacagatgagagccccagttgctctgtagccttacccacacttgatatggttacgttttaccttttcttttcttttttttttttttttttgagacaggatccagctctgtcacccagcctggagtgcagtggtgccatctctcgtcacagcaacctctgcttcctaggctcaagtagttctctggcctcagcctgccaagtagctgagaacacaggcatgtgccaccacatcggctaattttttattttttattttttgtagagatggggtctcactgtgttgcccagggtggtcttgaactcctgagctcaagcaatctgtccgccttggcctcccaaagtgctgggattacaggcatgagccaatgcgccctgaccctcattttacatttttgatggggtgggtatggtggctcatgcctataatcctagcactttggaaggctgaagcgggaagattgcttgagcccaggggtttgagaccagcctgggcaacatggcaaaatctcatctatactaaaaatgtaaaaattggctgggtgtggtgacacgcacctgtaatcccagctacttgggaggctgaggtgggaggatcacctgtgccggggggcagaggctgctgtgagccatgatcaaaccactgcactccagcctggatgacacaatgagatcccatctcaaaataaaaaaaaatttatgaacaatttcgtagaaaacagtatccactacacttaaatacactgatctgtccccatgtaggacaaatgtctcactgcccctttagcctgtatgggactcacggtggcaggtccctgctctatttgtcactgtatctccagttcctggcacaagtcctgattcatcaaggatgctcagtaaggtgggactcagtgagcaaaccagtcagtgagaactttgccagatctttaattattcattaggatcttcagcatggccatttccctgaaggctggcagagcaattcatcatcatcatcatcatcatcaccatcatttgttttagggaggcaggaaaatgacggggattcacctagaggccctgctaggaggcacagggcaagcctggcctcagcccctcacccccagcctctgccctctccacagctccccaccacctccctccagtccctgggagatggcccaggactcacttcaacaggactcctatgggtctctggtaatactggtgataggcgacccagggcgggatgaggaatcgttctgggttggggccctcggacttaaagagaagggccacatcttcagggtcgatgacataaaccgactccacgttgccgagcttctccctggaggggtgggggagaggggctgatggaaggatccgaggagagctatggatacaggctcagcacagctgcctcacagttccacaacttgctgactgtgggacctgagtcgaggcccttaacccctctgagtctcagtttcctcttctgtaaaatggagacaaatacagtacctgtctcgcagcgctgctgaaggacaagacaataggaagtatatggatgtgacctttgttaaacattctacaagtgagagctttatgatcactgttgctgctgtcccacagcacatccccagggccagcccaaagccacccccgagccttccatggaccagcaagtcctccactccttgcgcattcttcctgtgtccacacctacagcagccccagcttctcacctgtccacagagctcagaaccatggcacactttcatgtcactgctagagtgactcactatagcttgcaaggtaggccatattccaggccaaatccctgtcagactctacaactgaaattctgagagtggccaccctgaccctaagagtcagaggccacccaacaacacgctttgtctctattaaaataaaacttcagtaaaacatcaagccccaacatacaggcaggggagacaggcttgcaaatcactttgcagacaatctgtattaaatacaactgggtttttgttgttattgttgttttgagacagggtctctgttacccaggctggagtgcagtggtgtgatcacggctcactgcagccctgacctcccaggctcaagcgaccctctcacctcagcccggccaagtacctgggactacaggcaccaccatgcttaatttttgtgttttttgtagagatgaggttttgccatgttgcccaggctggtctcaaacttctgggctcaagagatcctcccacctcagcctcccaaagtgctgggatggcaggtttgagccaatgtgcctacccacatacaactgttacatatgactggtgttcttacatgaagagatgaggacacggatacacaaagaggaaggaccatgtcaacacacggggaaaagatagcatctaactccaaggagagaggcctcagaagaaagcaagcaactcagccaaaaccttgatctctgacttctagtttccagaactgccagaaaattaattctgttgtttaagcaaaaaataagaaataaaaatacaactactaaaaaacaacagaaaattccacttcttgctagcctctgccttttatcgaagaaaattaagatacacttttaggcaaaatagcataaaaacatggagatacaagccaagtgtgctcatgtgtgtgcatgttctctctctctctcctctcatagtgctgctttaaccactgagccagaaagcctgggcctaccttgatgagtttcaggccttcacttgttctgtggcctcccagaaaatcccctcagtgtttttccagctaccatgtgtctttgcactaactagctccatacccctaaccaagttcagccaagcccttgaactgctattatcatgatcaattccacttctgggaatctagcccaaggcaatgatctgacatcagcaacaatgcttgatggataaggatgtccattgcagcctcatgtctaacagcaaaaaagtcaagagtaggttgtatgttcactttaaagaacccgcgaaaaaaaaaatccatactgtgaactactatgctgccttttaaaattatattagaggccaggcacagtggctcacacctgtaatcccagtactttgggaggctgaggagggagagggaggatcacttgcgcccaggaattcaaggctacagtgagcctatgatggcaccactgcactccaccctgggagacagagcaagaccctgtttcaaaaaaagtaaatattaataagatagatcaagaaaaaggaagaagatataaataaacgaaacgagatctttccccagaaaagtctgaggaccactgaacatcactttctcttaaaatataaaataattttatattagagagagaaaaaaggaaagaattccttgatatattgttgtgagacaacataagcagcatatgtagtatattcacatacctcatgatacttaaatgttaaatcaattggaattgattgtatctgacttcaatttttcatttgtgtttctctgtattttctaaattgctctgtataaaacaagaacagcctttgtgttaggaaaaaaacccacaaaagttgtattttaaattcctcacatttattcagaagtttattgtttattagctataagttcaagtataatgacacacagagctggaagtcagacaattccagttcctgccctggctttgctctcatgagttgtgtgacattgacaagacccttcttctcactgggcctcagtttccccatctgtaaagtggggaaataataacaccaactacagggatatgttgcaagattcagatggaagtgactcagaaaacagaaagataattagggtctggaggcagggaacataaggccaattcacacttgagctgtgacaggaaatatcctctccatagggcgtatgctgtaaatgactttgtaactttacttcatcctctccatttacataaggcatatggaattaaccaatggaatgctctaaggggtatttaaactcccaaaaattctgttaacggggcccctgagctcctacactcaggcccctcccacaccgtggtgtgcattttcatgttcaatacatcccttcatcccttccgtgctttgtttgtgcgttttgtcaaattctttgttcaagacaccaagaacctggacaccctccaccggtaacatgtattttggccagccagccaggaggaagaggtaagcccaaagtttgggattcgtttttctccctttcctttctgctccatacaggagctctctctttctcttttctgttccaacttgggacccttgctgggccccacctaaacacggagacaactgcaggtttctggccgtggccagtgaaactaaggggtttccacgtggagaagcagcctgactgccaccgcccggttcgcttaagggacctgggtcttttttatgttttttttctctttttttgtctctttctatttcagtctttcagcggctgtttcctagtagctccttggaaattgaggctggggtcaccagtactgcctgaaggtctacgaatgaaagggaataattgcgctgccccaaagcgggagggactttttttaaaaatcttttttgcctatggttcctgatccctacatgcggtgctgctcggagcaaactcataaatgtttctgggggcttaaaccttactttcttatgctaaattcttcccttatagtgctcaactagctaaggacaaaaaaagcccacgcagcatccagttcacattacagttcatggctactcttataaagttcatagtatgctccagaggggaaagcctgcatgtgatgcccacctaaagccagagacgtctgggaccctaagattggaccccacaggaggatgctctgtgggtcctgcggaccccagccactccaaagaggatgctcttggcagaggttctgaggtctagccctccttagaattttctctccgcagttgcaatgctgtttggccccaacattgtttggaatctgaagtttactgttgaattggaaagtggaatagagttgcatgtatccaggcttttgtgctgcagctctaagcagggggcctggttaacatgtgacaccctgctttgaagtcgtgggaggtttggcctttaaaaatcaaactgccatggagactgctttagccaaaattttggttcacagccttcattggattatctgttggggcaaaaactggcaagcttgtattgctatctcatggctaaggttccaagctattgaatcttcgtttatgtgtgtgtatacatgtctagatgtgtttatttgtatgtacacattgttatatgttgtgtctaccaaattgccttataagtaaaagagcactcataaattaagtaaataagtctaagcaattttcaagttcacgtgacttaaagtataactttactaaacaagctagctttaaaattattggtggaataaaaatagaaatgccttcagtattatcagtatacattttgtttgaattttatgtttgtctttgctatctttttttttttttttttttttttgagacagagtctcactctgtcacccaggctagagtgcagtggtgtgatctcggctcactgcaacctccgccttctgggttcaaacaattctcctgcctcagcctcctaagaagctgggaccacaggcacacgccaccacgcccagctaatttttaaattttttaatagagacaaggtttcaccatattggccaggctggtcttgaactcttgaccttgtgatctgcctgcctcagcctcccaaagcactgggattacaggcatgagccaccactagatattcttaaatgtcagtgaattcaacctgggagctgcttggggcgagcctgcctccccttctattcaaagtctcactgagataaatgcatatctgattggttcctttggaaaggctaatcagaaactcaaaagaatgtaaacatctgtctcccacctgtgatctgaaagcctccaagcccactccttgccttgagttgtcccacctttcaggaccaaaccaatgttcattttacatatgttaattagtgtctcatgtctcccttgttaaaagtaaaaattgagtacagcaaatgggataaatgctttaggtaaactttttgtgtaaattaaaaccttaaagttatttttggcactcatttaatatctgggtcatttccaagtaagaaagggttgtgatatggggaaatatgtttctaaaattgtggaattgttcttatctataaatgcccatatctgatatttcaggatttcttgctttttagggtttcactaaaattttacattacaaaggataaggtttctagttaacacgtaattctgtatacaaaaagtgcctgaaagggttattactaaaaaaaggaaagaataattttgtctaattcagaagttatctaaaagttagttcaagttacagttttgaaaaggttatttatgaaacaatgtagtaaggaaccattaagtaggggagaaagatgaggtacagtttaaataataaaatattctttaaaacctgataaagaattggaaacatttggctaattaacatttttatagttaaagctcttagtcttgattaaagtaagaagtattgtaaaaatgcattggcagtttggcaactcttttttttaatatagttaagcatgaagctggatttagtgtggaaccaaattccacatacatgcttacattgcttcatactatgtttactgttttgcatggatagtgctggagtacttattggtcatacgcctaaagtgaatttgttaattgcacaggatgtatgataatattagtgaacttaaggatactgaattgtgtatcaggaataaaatattcattatgtgggtttttgggggccctatgtaacactgtagcctccagggtaaattgaataagaaaatttagggttggtttcctgcttatttgtttttgcttctagttttcatttgtttgccatttgttctcctctgactttgcttgtgtatgcatgtatataaaaaccatgatttttcttagttcctagtggaaggttttcatttagttctgtgttcctgtgcatttctagcaagtcatcattcattccatttttctggaattcccaagctacctttgttgggcctgcaggaattaatggagcatactagcttttttatccttaaactaactttttggattttaggcttcctgatactttaagtgtgttgagtatactctcacaaatagaattttagtcatatttctctcactctgcctagtttctccaaaatttgtaaactatttatgaatattcttaattcattgcaatgtgtttgtttgcatacagtcaagcagggtccctggggccactcagggagagaatgtcaggcctctgagcccaagctaagccgtcatatcccctgtgacctgcacgtatacatccagatggcctgaaataactgaagaatcacaaagaagtgaaaatggcctgttcctgccttaactgataacattaccttgtgaaattccttctcctggctcttctggctcaaaagctcccccactgagcaccttgtgacccccacccctgccagccaaaaaacaaccccctttgactgtaattttccattacctacccaaatcctataaaacagccccacccctatctccttttgctgactcttttcggattcagcctgcctgcacccaggtgattaaaaagctttattgctcacacaaagcctgtttggtggtctcttcacagggacacgcatgaaatttggtgccatgactcggatcaggggacctcccttgggagatcaatcccctgtcctcctgctctttgctcagtgagaaagatccacctatgacctcaggtcctcagaccaaccagcccaaggaacatcccaccaattttaaacccggtaagcagcctctttttactctcttctccaacctctctcactatctctcaacctctttctcctttcaatcttggcgccatctttcaatctctcccttcccttaatttcagttcctttccttttctggcagagacagaggagacgtgttttatccgtgaacccaaaactccagcgctggtcacagactcgggaagacagtcttcccttggtgtttaatcactgcggggatgcctgcttgattattcacccacatttcagaggtgtttgatcaccacggggacacctgccttgatccttcacccttagtggcaagcaccactaatttggggggcaagcacctcccttctctccgtgtctctaccctcccttttctctccactttcctggggggcaggcatcccccacaccttctctccatgtctctatcctctcttttctctgggcttacctccttcactatgggcaaacttccacccctccattcctccctcttctcccttagcctgtgttctcaagaatttaaaacctcttcaactcacacgtgacctaaaacctaaacatcttattttcttctgcaatgccacttaaccccaatacaaactcaacaatggttccaaatagccagaaaacggcactttcgatttctccatcctacaagatctagataattcttgtcataaaatgggcaaatggtctgaggtacctgacacccaggcattctttgttccctccctagtctatttccaatgcaattggtcccaaatcttcttttccctcccacctgtcccttcagtcccaaccccaagtgttgttgagtctttccaatcttccttttctaccgacccatctgacctctcccctcatccccagactgctcctcaggtcactccccagccaggctgaatcaggctccaattcttcctcagtttctgctcctccaccctataatccttctatcaccccctctccccaaacccagtccagcttacagtttcgttctgcaactagccctcccccatctgcccagtaatttcctcttaaaaaggtggctggagctaaaggcatagtcaaggttaatgctcctttttctttatccgaactctcccaaatcagttagtgtttaggctctttttcctcaaatataaaaacccagcccagttcatggctcatttggcagcaaccctgagacgctttacagccctagaccctgaagggtcagaaggctgtcttattctcaatatgcattttatcacccagtcagcccctgacattagaaaaaagcttcaaaaattagaatccggccctcaaacctcgcaatgggaattaatcaaccttgccttcaaggtgtacaataatagaaaggaggcagccagacagcaacacatttctgagttacaattacttgcctctgctgtgagacaaaacccagccgcatctccagcatacaagaacttcaaaacgcctgaactgcagcggccaggcattcctccaggaccacctgccccaggatcttgcttcaagtgctggaaatctggccactgggccaagtattgcctgcagcctgggattcctcctaagccatgtcccatctgtgcaggaccccactggaaactggactgtccaactcacccagcagccactcccagagcccctggaactctggcccaaggctatctgactgactccttcccagatcttctccgcttagcggctgaagactgatgctgcccaatcgcctcagaagcttcctggatcatcacagatgctttaggtaactcttacagtggagggtaagtccgtccccttcttaatcaatatggaggctaccaactccacattaccttcttttcaagggcctatttcctttgcctccacaactattgtgggtattgacagccaggcttctaaacctcttaaaacttcccaactctggtgccaacttggacaatattcttttatgcactcctttttagttatccccacctgcccagttcccttattaggtcaagacattttaactaaattatctgcttccctgactattcctgggctacagccacaccttattgccacccttttccccagtttaaagcctccttcacatcctccccttgtatctccccaccttaatccacacatatgggacatgtctactccctccttggtgactgatcatgcaccccttaccatcccattaaaacctaatcacccttaccctgttcaatgctaatatcctatcccacagcatgctttaaaaagattaaagcctgttatcacttgcctgttacagcatggccttttaaagcctataatctctccttataattcccccattttacctgttcaaaaaccagacaggtcttacaggttagtgcaggatctgtgccttatcaaccaaattgttttgcctatccaccccatggtgccaaactcatatatgctcctatcctccatacctccctccacaacccattattctgttctggatctcaaacatgctttctctactattcctttgcacccttcatcccagcctctcttcactttcacttggactgaccctgacacccatcaggctcagcaaattacctgggctgtactgctgcaagtcttcacggacaggccccattacttcagtgaaccccaatttcttcctcatccattacctatctcaacataattcttcatgaaaacacacatgctctccctgctgatcacgtccagctaatctcacaaaccctaaccccttctacaaagcaacaatgcctttccttcctaggcatggttagatactccacctttggatacctagttttaccatcctgactaaaccattatataaacttaaaaatgcaaacttagctgatcccatagatcctaaattctttcgccactcctctttctgttccttaaaaacagccctagaagctgctcccacactagctctctctaactcatccaaccctttttcattacacacagctgaagtgcagggctgtgcggtcagaattcttacacaagagccaggaccgcgcccggcagcctttctatccaaacaacttgaccttactgttttagcctagccctcatgtctgtgtacggcagctgtcgctgctttaatacttttagaggccctcaaaatcacaaactgtgctcaactcactctctccagttctcataacttccaaaatctattttcttcctcacacctgatgcatatactttctgccccgctccactacctctcagcaagctgaactcattgccttaactggagccctaacccttgcaaatgaattacacgtcaatatttatactgactctaaagatgccttccatatcctgcaccaccatgctgttgtatgggctgaaagaggtctcctcactacacaagggtcctccatcttaatgcctctttaataaaaactcttctcaaggccgctttacttccaaaggaagctggagtcattcactgcaagggccatcaaaaggcatcagatcccattgctctgggcaatgcttatgctgataaggtagctaaaaagcagctagcattccaacttctatccctcacagccagtttttctccttctcatcggtcactcccacctactcccctactaaaacttccacctatcaatctcttcccacacaaggcaaatggttcttagaccaaggaaaatatctccttccagcctcacaggcccattctattctgtcgtcatttcataacctcttccatgtaggttacaagccactagcccacctcttagaacctctcatttcctttccatcatggaaatctatccacaaggaaatcacttctcagggttccatctgctagtctactactcctcaggaccctcccttccctacacatcaagctcagggatttgcctctgcccaggactggcaaattgactttactcacatgccccaagtcaggaaactaaaatacctcttggtctaggtagacacgttcaccggttgggtagagacctttcccgtagggtctgaaaaggccaccacgatcatttcttcccttctgtcagacataattcctcggtttggccttcctacctctatacagtctgataacagaccagcctttattagtcaaatcactcaagcagtttctcaggctcttggtattcagtgaaaccttcataccccttaccgtcttcaatcttcaggaaaggtaaaacggactaatggtcttttaaaaacacacctcaccaaactcagcctccaacttaaaaaaaggactctgtcaagaatagagcccaaaaactcaccaaccaaacaagtaattacactgaatccccttgggcactctctaatcggatgtcctgggtcctcccaattcttagtcctttaatacctgtttttctccttctcttattcagaccttgtgtcttccatttagtttttcagttcatacaaaattgcatccaggccatcaccaatcattctacatgacaaatgctccttttaacaaccccacaatatcaccccttaccacaaaatcttcctttggcttaatctctcccactctaggttcccacactgcccttaatcctgcttgaagcagccctgagaaacattgcccattatctctccataccacccccaaaatttttgctgccccaacacttcaacactattttatgttatttttcttactaatataagaagacaggaatatcaggcctctgagcccaagctaagccatcatgtcccctgtgacctgcacgtatgcacccagatggcctgaagtaactgaaggatcacaaaagaagtgaaaacggcctgttcctgccttaactgatgacattaccttgtgaaattccttctcctggctcatcctggctcaaaagctcccccactgagcaccttgtgtcccctgcccgtgcctgccaaagaacaacccctttgactgtaattttccatgacctacccaaatcctataaaacggccccacccctatctcccttcgctgactctctttacggacttagcccacctgcacccaggtgattaaaaagctttattgctcacacaaagcctgttcagtggtctcttcacagggacacgcgtgaaagagagaaccctgaaatctggcatgccggtgaaaggataagaatttcttatgagtcagtctctgggctctttccctctatgcaaactggttaaatataaagtagaagtcacgtatatctcctctgtaagattttaaattaattggtttaataataataaaagcttaagtcaaatattttgtcagaaaagtagaaagtgtaatgccttttagttcatgtgactttagcaatagttgggaaataaagacagttttcaagattattggaaaaatacagttgtcttcaaaatgtaaacatgtggtgtacattatgttcaaatactaggtttgctaaatcctttaacatcataagctactcctttggcttttgaaaattgtttaacttgcctgctttccagctaggtaaggcctggggacacgtggagttagccatgcccctagctgtgctggaagtagtcaaaccttatcagaaactttatcagaacttaccagttttttttgtttttgtttttgttttgacagagtctcactctgtcccccaggctggagtgcagtggcgcaatctcggctcacccacaatctccatctcccagattcaagcaattctctgccctagcctcctgagtagctggaattacagacgcccgccaccacacctggctaattttttattattatttttagtagagatggggttttaccatcttggctaggctggtcttgaactcctgacctcatgatccacccgcctcggcctcccaaagtgctgggattacaggagtgagccaccgcgcctggcctaacttaccaggttttatgttaaaattcgccattataggccagtcacagtgcctcgcacctgtaatcccagcatttggggaggccgaggcaggtggatcacctaaggtcaggagttcaagaccagcctgaccaacatggtgaaacccccatctctagtaaaaatacaaaattagctgggcaaggtggtgcctgcctgtaatcccagctactggggaggctgaggcaggagaatcatttgaactcaggaggcagaggttgaagtgagccgagatcatgccattgcactccagcctgggcaacaagagtgaaactctgtctcaaaaaaaacaaatttgccattataacatgcaattaagactactagaaacagttttacatgcaaggtgtataagaacagtagaaagtgttgggggtttttttgtgtgtgtggaaggttacaaaaggtttttgcttctttaaaatttctgagtcatcattttggcaaaataaatagtttacggtaatctggaattccaaaatcaaacttcagtttcaaaattgtctttcctaatgcctggctttctagatgaatcagagggcccctgaaaacatccagaaaagaggtaaacaggattatttgacatgtttaggtacatgggattgacaaaatgatgttaaatcttctttaggttatatttttgtgaataatatattccaaaattgtatgggatttctcaaattctaatgtctaagtatatgttaccaatcacaattataattatgttaagttattgtaaaccacaaaaatgaccaaattttcttgtataaagctactaacccacgtaaaacaacaacaacaaaaaattaattacatatcaagaaaagactttcatgttaaaccagctaatactgaaattgtttaaaatagtttataacctgtcgctttgcagatgccgtcactgccaccaggagccctgtactatcagccatggtcaaccccaccgtgttctttgacatcgcagtcacggcgagcccttgggtcacgtctcctttgagctgtttgcagacaagattccaaaaacagcagaaaactttcatgctctgagcactggagaggaaggatttggttataagggttcctgctttcacataattattccaggatttatgtgtcagggtggtgacttcatatgccataatggcactggtggcaagtccatctatggggagaaatttgatgatgagaacttcatcctaaggcatacacgtcctggcatcttgtccatggcaaatgctggatccaatacaaacggttcccagtttttcatctgcactgacaagactgagtggtggatggcaagcatgtggtctttggcaaggtgaaagaaggcatgaatattgtggaggccacggagcgctttgggtccaggaatggcaagaccaggaagaagatcaccattgctgactgtggacaactctaataagtttgacttgtgttttatcttaaccaccagaccattccttctgtagctcaggacagcaccctccaccccatttgctcgcagtatcctagaatctttgtgctctcgctgcagttcccttccatgcctagctggactgcagagttgagttaaagtttatgattatgaaataaaaactaaataacaacaaaaaattgtttataaccaatgcttgatcccatattcctaggaaaacaattaaagcttcaggtatatttggtcttctggtcagccatttaaacattttataaagggatttcattccattgttattttccatgcatgttttctggttgtagaaaagctttcccatgcaagagggctgatgttataacagtagattattatgctacagtgtattttcaccagattaaaaaaaaaagctttttatggtttgaatctgctggaaacatcagagaaagactgtccttgccatctacactataacaaaacttcaggaccttgaactttgggttcataatctcacaactgagaagggcccctccatgctcttggagctgtgcacccactggaatgcttaaggtaaaactaactagggaaatttctcccaagaagaagatgacatcattgatgtgaacagcttttcccaagttcacagattaagacttctactatcatgaaactcttatttttgaatattttttcttgcttatgccttctacgaacaatagaagtggaaaaggggtctgttatgtgcacttatggggaacatttttatttgtgaaggagtttgcagccagccttatacatggataaaggcccaatgtatgtaagaaactttaatggtagatgtgttagctcataatcaatcaaaaacaaaaaattgattcactccacataacccacatcgtgggttaaagagaacattgccagaagtccttcactcttctgaaagggcatcatttgttaggtcctttttccatggtttaaagtaaaagaagcaatgattagaaatgtatccctcatgataggttccatagcaaattctactctaaaggctacagactctaaattctcttgtgaaagttataatagaattggctaaacagcgaagtatctgtgcagctgctggcacttgtggcctatacagaaatacatcaaatgaagactatagaaattcagtggtaggagactgacaaagaaattgattagtcaagtctctctctgttgcccaggctgaagtgcagtggcgtgatcttggctcactgcaacctccgactcccaggttcaagcaatcctcctgccttggcctcccaagtagctgggattacaggtgcacgtgaccacacccagccaatttttgtattttagtagagatggggtttcaccacgttggccaggctcatcttgaactcctgacctcaagtgagccacctcacccagccgtgagtaaactgtatctagctcattcttagatccatttgattttaggaggtttggtttatggggaccttgggtaaggagtatactcccaaattcttggtattatcctcctaatagccataataatggtctccctgacgagctgtatgctctcaaaggttttaaatgcttgcatgagccatctctagaatgtcatatggtctctcttcaactggaataacaggagctcaaagaaatatgcaaccatgaggacaccataacctataaatgacatgctgagaccagaaacccaaaatgatggtaactgagagtggcactgaggccctaggttttggtcacactctcacctaagtgaaaacctgatcaaaaagggaatttttttcaacaaaattctgggaggccgttgttttggactgatctcatgcactaggccccaacaaaccaaacaaaaccaaaatggggccactcatgccaagactttaaggaaacacatagattctagaaaagactaggttttgttttttcttctgcaaatcactacaacaaacatttctgacagtataggtatccaccccctaaagtttccattaaatcttttaaccaaattcatttcctctcacctagagaccatcaagcttcagatgatcatgtaacaaaggttccagccagttccaagtgaagacaccacccctggacatcaagaagctacccttcctccactagatagagcagggtgagagttccatgatccccaataggtagggactatgccccaagccagcatgaagcagttacagaaaaaagaccatcggtccctctgcctcccataaagatttatggggatcacatctcttgaaggggcagatgaggcaggaaaatagggtctgaagtgtgaagatcgattcacacttcagctataacaggaaatatcctctccatagggtgtatgactatgtaacttgaatacttcatcctctccatttacataaggtgtatctgaagtaaccaatggaatcctctgggggtaaatgccccacaattctgtaacgggacctttgagcccctacgctccgcctgctcccacactgtggtgtgtatgttcattttcaataaatcccttcattccttccttactttgtctgtgcattttgtccaattctttgttcaagacgccaagaacctggacaccctccaccggtaacaaaggggcttaataaaataaggagttgctactgagggtctaggaagtggtgaaaagggaagagaggaggaagcaaggataactagagatctatgtgaagtgagcacgggacagaagcactaataggcctaggagagagggggaggaaggagagacccagcggggcgcaacctcccaagcccagcactcaaccttgaatagggtggggtgcggggtggggggagctccctgccaccaaccagctatcaaaaggggcagtttggactttaaaggagttgtgagagagggagggagcagctgaagccccaacacaaactagcctgccttctcacccacccccagcccagtcatcaagccggccaacacatcttacccttccctcttcgtgactgacccattggaatgctctgagttgtaaagacctttcacttaaaggaaaacgtactgtccctcctggtctcccctcccagcccccaaccacccctgcgccacctccgttccctctcaaccggactcttagcaaagaacccaggtgtggctgaaaggctgcccaccgtgggaacagctttagcagttttcccaggaaaaagccacaagccctggaggcacagaggcccaaagacaaaaaaaaaaaaaaaaggcctttcctcctagcaggaagcaagcccgattcttgggaaagggaagggacagactcagagcctcagggccaaggggtgagatccagcaccccagcaggacaggaatctagctgggtgacctctctgagcctcagtctcctcctctgaccatggggacaacaaacttcgcttgcaaggtgtgcggagggtaacggatgtagggaggcatttagtagggcttgttctctaaccacctctctccgagagtttcaaagggagtgggatctggggaaggttgaggcctcaggcctgggaactaggaatactttcccttttacccaccaccatcccaggcctggaagaagatcagaagttggacaggagaggtccggccgcgcggacgtcaccttagcgcgccactgtcggctccggtgggctcgggtgagctcgggtgaacgcagcgagcgagggcagaggccagcagaggcgaggagtggatgctgcagggccgcaggccgggcagagaaacgcataccgggtcgctccctgcttcgccgccgcctcctggcagggccagcgaagccagtgctccagcgcccccgtaacacctcaaagcgcacggagtccgtgttggggaacttggcggcagagtgactgggacctaggacctgcggtggggccgccgccgcctccgcggggccgagcgcctggacctcgccctgaggtaaacgcgggtcgacccggggggcggatgggctcgggctgtgtcgaggggaggcggaggtgagcgacccgcgaagagcgcaggagcaggccgggggccacgctagggcggacccaatttcggaatagcgcggcccgggcggcggcgtgcgctgggaggaatgctgggtctgtcgctagc

SEQ ID NO: 1035 - DNA, 17584 bp, Homo sapiens
catcctggggaacaggactgctagcagtaaagatgggggagccagggcccccatcccctccagcccccaaggctgccccaggcctcattgacagcttctctgtaagtcgccccctcgcccactggttctgggaagatgggttggctcgcctagcagcaggtgtgttggggtgtgttgcccagcaaccagtagaggtgttcccagagcctcttaagtgggaggcagggtggagaggaccagggctttggcccttagatgcccgtggtcacaggaatcttttgcaaggcccctggctccagcctaggccacctgagcccacacagtaatccagagagggaggacagaagggcttctgggaaaatcccttgaagtgatcattgcctcctgctagtctgggccctacctctggtgtcttggaggtccagccttggatcctagaaagtggctgagcctgggctagcctgggaaggcttgctggtagtgcatgtgtggtgccgagctgtgaggaggagtgggtgtggcagatggggcatccagtggaagcagcagctcagactgggggctggggccgccccagtaagtgctaacccttctggtttgggccccagttgccaaagcatttcttcttcccctttggcaagaatcccagaggacaaccccaacaagggtcattccccacagggtgcagatgagcaggcacggagtgggcaagggcctcgcttcgggtcgttcgacagctgtgggcagaggctggatcagaacccaaggttctgggttccagccagggctcttcccccacccaatgtggggcattcctgaggcagcaaagctctaaccagggaggattctggcaggaggtgaccagtggggaagggttctttgaggaagagtgaacagggcctgtgagaccaggactggggcctgcccctcaccacctgctgaatgcccagccctgtactcacctgggctgagagcaagggctggccccaatctgctgtcagcagaggctggactctggcccaatacccaaggagtcatgactgatggcctgtcttgggatagcccgggggtcttcctggaggaggagggcccagaatggagccttgagggtcaggcagcgttcagaaaagcctaggaggggaagtaggaatgggaagccagcatcttccaggaagccccgcccccaccccagcccagccggtctccattgtcccagccaggcccaattagcacctggctcctgcaggggccaattagacaggggctgaggtcagctgccggccaaggccctgccacccctccaagcttcaccaagccaagcacaaaagctttctaggcatcatctctgctgcagcaggaagggaaagaaagaacagaagaaagggaaaattcactccttttgtttctttgccataaccttgggctgaacaaagaagcaactgcctcccctccctgggagggcagcttctgtggagcaggaagtctgttttaaacagcaatttgcacagatttgttgtggttgggaggcccagatgacattcgaggggaaccaggagcagagacctggggtgagcagggccctggttctagaaactcctgtgactccccactgcgctctgttcagaagcagagcttccgggcctggctggtgcaaacaggtgggcctgctccagctctctagccagacagacctgtgtactttgctgcctccaaagagcccagcccacatgggcctccacaccttccctcagtgttccccacctctgaagtcccacccaatccagtcaaatctcacctgcacctcaaaggcccagctccacccctcccctgcaggatcccctccccaaccctacccctggccttgacttgcactcctagggtgtgagccatgtcccacacaaggcctgcctcccaccgggaactctctgagtgcagggtctccccacccccaacagagctgagcttaggggtacaaacagcagctgccaggccctgctggggagcaggtggaagggagatatatgccagagtccaaaatggggtttgggaagctggggccaccctggggtggtgacaggtggagaaggggacccaccagtgccattgcctcctccaggctcccacccccagggcaatgccacatcgcacagaccaccctgccctcacctccctaaccctgccctctgtgtctcaggagcgcagcctctcccactgggctatgcccttgccgcttcgatatcccacccagccaatgaggctctcagtcctccctcgcctgccctctggtggtgatgaggttccagagtgaatggagggaaagaaagaagcttgtcctcatggccagtgggttctattgtccttcagtggctgggaagggagcttggctgggtgggcagtggcaaagaactgagaggccagggtcccagtggcattggcccgtgtgtttctgggagtaaggggacttcttagccatggtgagccccaacccctgggaaaacactagtccctttcagcaaattttcaggcacaacctccatcctccccgacttgtccctgagacggcccctcagaactgggcttttgctccctggtctctggaactggaggaggccagcatcaatttgccagctgaattttccattgtattttaaagaaatgtggttaattcgctttattttattttatcttattttatttatttatttatttttgagatggagtcttgctctgttgcccaggctggagttcagaggcacgatctcagctcagtgcaacctccgccccacccccgcctgccccccagttcaagcgattctcccacctcatcctcccaagtagctgggattacaggcatccaccaccatgcctggctaatttttgtatttttagtagagatggggtttcaccatgttggccaggctggtctcaaactgctgacctcaggtgatccacctcccttagcctcccaaagtgctgagattacaggcatgagccactgtgcccggtgtactttttgtatttttagtagagagggggtttcactgtgttggctaggctggtcttgaactcctgaccgtgagtgatccgcccccctcggctcccaaagtgctgggattacaggcgtgaaccaccgcaccgggccaagaaatgtggttaattccctttaaaagtattgggaaatttagattagccaagagagacctctctgacattcaaaggacacctacaggagttctgtttggcaaatctggcaggagcagggtctgggtcaaaggatttgcctgagtaagtcagggaggcagggaggcccttccctgccatcaaggtctttaggagctgaagggggagcatgtgcgtggcccttggcagatgaggagtgccaggctggtgtaggcgagaaacagcttctgggcagaggtagggaaggctttgaagataggggcccagaaggctgggcccatgggtggagtggccagggctaaattctgaaagggggtctagctgtgctgaaagaggtggaaattcaaagttggaaatttaccatgagggccagtgggagtcattggaggggtctggaggccagagaggatgttccagttacctattgcaataacaaactaccccaaaatgttatcatttaaaacgataattttttcttttattatcacatctcatagctttgtgggtcaggaactcagccacggcacagcaggtctaagtcctcagctgggacgacctacgggcaggggcgggagcagccagggctgggtgggcctcgctctctcccatacacttagtttgggcttcctcacagtctcagggcagcaaggaattagcagctagcagggaagaattggggttactgcaagatgggtctcatcccaagcccctgtcctcaccactcagccccaacatcttccctggagctaacccaggatagaggccccaggttcaagattcactgagtgacttcaggcaaatctctgcacctctctggtcccaatatcagaacttgtgagatgggggttccagggctagaggtcttggaaggctggctggaccacctggaggaaggacatgtgctcctggaactggggagagagacagctccgcacacaccttccccacaatatgagctgtgggccactcaggttggcctcatcccaccacaggctgaagctgagtgtctgtgggaggcggctgccctctgctgactgcaaaggcaaaccacatgcagatggcctgggcctgccagcgatggatcctggggatccggggaaccctgagattgggtggccgcccaaggaaggggacagaggagagggtgtgtgcctggtccagcaaacccaccctctgcacccacttcaacactagccagactgccacccacactacctcagacccagcaacctgtctcaggcctccttctctgggagagtgaagcccctccccgctcctacccctgctccagcccatacctcccctatgcatccctccctcttaccttctaagtctccaggaaatcctctctctccaccactatgcctctccttgaccctgttttcctagctacctttgacccttctcaacctcactgtcccctcagaccttacccacagcacccagcattcagagcactggccaaggtcacttcctccaggccacaccaagaggctccctctgcagatccggaaactgctaagccttctctcctttttccaaaattcttttaaattgtgaaatgtaacccatttcacaatttaagaaaaattgcattgaacatatagaacataattattataaattattatatagcaaatgtccatgaaaccaccacccaggtcaggaaacagcatcaccagcatcctcacgcccctcatgcccctcccagccacacccctcctctcctggatgtaatcactctgccagctttctgtccttgctttgcttctttatttttttattttttaattattttttttatttttgggacacagtcttgctctatcacccaggctgaagtgcagtggcataatctcagctcactgcaacctccgcctcccgggttcaagtgattctcaggcctcggcctgccaagtagctgggattacaggcacccgccaccacgcccggctattttttgggcttttgtgtagaaatggggtttcaccatgttagtcaggctggtctcaagcttctgacctggagtgacctgcctgcctcagcctcccaaagtgctgggattaaagggttaagctgccggttggttcacgcctgtaatcccagcactttgggaggccaaggtgggcggatcatgaggtcaggagttcgagactagcctgaccaacatggtgaaaccccgtctctactaaaaatacaaaaaaaattagcccggcatagtggcaggcgcctgtaatcccagctactcaggaggctgaggcaggagaattgcctgaacccgggaggcggttacagtgagccaagatcacaccactgcactccagcctaggcaatagaaagagactccatctcaaaaaaaaaaaaaaaaaaaaaaagtgtgagccactgtgcctgacctgctttgcttctttatactgtcgctacctgagcatgcctctcgaatcactctggcctaaattttctatttttaccttcatggagagggcaccgtgacatacacattgctttgcacacggctcttttgctcaccttgatgtatgtgaggttcacccacatcatggtttcttattgctctgaagtatcccgctgtatgggtctccacctgcccctatctctgccccataattcctcactcacttgccagttctttaatgtttttatgaaggtgagttttgctttgtgtcccattcagaccatctctagcggcgggttcatctccatcatccaagccgcaagactcaagcggaaggtggttgtcctccttttgaagccctcttgccagcctgctctcgccgcttttcctcctacctctctggcaattgcgctagtcctgagagctcctctcctaccaccccttgtccttgaaccccctcctcactccacagttgccagacgctgaaaatctgctcccttcccaaggctccaatggaaccagggctgtcctgccacctgtcccccaccaggattcactccaggcttgatcaccatcagccactgctggcctcctgcacctgaggccctgcaggtacctcacccctaacacgctcctcccccaacccagctccccctccttcccactccagacctgcgcctcctccacccaaagaccccagctcctcctctcctcatcccccacctcctccttctcccctcttcctccttcccactccaggcatgcacctctaccaaaaggccccagacttctcccactcctccccctcctcccccacctcctcctcctccacactacaggcatgcacctcctccacccaaagaccctagccccctgccaacctcctgctctgccatccccaaccctcctcttcgttgttcacttcactctgtcatgctgagtcctccttggtctgcctccacccagcaagggtccctggctccctgctctgggcctccattcatttctctgtccatcttggtggcctgaggcatcttgccacaaaccccctccagcttaggcccttcactggcctgcaggatggaatccaagctcctgagattggccacacccctacttactccccaaccagcactctgccctccaggaagtcaccgactttgttcctgatcatacactctctctcctccctgcctttgccacagtgtctcctctgcccaagagccctctcccctaccccgggtaacacctgctcaccctcctagagtgagctcaggctatcaccacctccaggaaggcttcctagacctggggctaggaaaagagactcctgtaagctctcctctgtcacagatgtcactgccatctccttggtgtagatgggagaccatcacaagcagggacggtctgggctggtctgggctccatggccccagtgtggacatggccttcagcaactgctgatgactgtgctgcttccaatgtagcctttacactgagtctctgtgaccttgggaacactacttccaatctcagcttccccattttacaatgagtttataaggaccctaagtagccacaggtgtcattggatgcagtgcctcagattctgccagaagcacttcttatttttttgcggggggtgggtaagggttaagcattaccctctttaggcctcctgcacccaaggccctgcaggtaccttacccccaacacaccctccctaacccagctcctccttctccccactcccagcataaaaacaaagacaatcgccattcctcctccttcgtgggaactggtcctcagtttctatacaatgaaagtagtcacatcatcatatcttctgtgcccactgcccagggttataataagaaccattaaaagtgcgacggcaggcagaatggctcatgcctataatcccagcactttgggaggtcaaggtaggaggatctcttgaggctaggagttcaagaccagcctgggcaacatagcaaggccccatctttacaaaaaatttaaaaattagccaggcatggtggcacacacctgtagtcccagctacttgggaggctgagtcaggaggaccacttgagcccagaagttcgaggttgcagtgagctatgatcatgccactgcactctagcctgggtgacagagtaagtctccatcttggaaaacaagaaagcactcagaaggtggtggaggaaaaagagatgctgttgccaggcaccctgtgtgccagagcctgggctggcactgttcatgccccctctctctccacagcaaccccccttggggtggggtgattttcccattccacggatgaggacgctaaggctcagagaacagcctcccttccagagccaaagcgaaggtgtcggtgcagcaaaggccaccagcgctcagtggcagtggggcaattcaaacccaaggacacctgacatttctcacctgggcaggatctgatagctgggtcttggatggggaaagcgcagtgtcaatgggtgaggagaatgcagtgggcactagccttaggcacaatggctttggagtcagtccttctagaggaggctaagcctagggacaagacagggaagtggctggtgcctgaccctcccccagcagactggaaagtggggagggggctggaggggagggattggagcaggggagtcagcaggaccacaacaggaatctgggccatggtgtccttcctgttctcaaggctgggctgtgacgcagagcatggccctgggggttggggaggcccagctccaggctgtagggagtggtcagggctgctcatctgcaggcagtgtcctcccagaccagctgtgctgctcaaggtcactgctgtgcgggtgggggaagccgaggagggaaagcaggtccttcagtttcccacagatgtagagggaagagagcatacagactgaggggtaagccagggccgagatccctctccatgccctgggggagccctctctctcagagagcagccaggcttggtgggggagggggataggcacctgtggaggcctataggactagtctccgaggagtggagtccagcagggaccgtctgactgagacagggacgcggcctcaccagaagccatgctctccctccatctccttcctcgctctgggccccagctttctttgtctgtcaaagcgaggtgttaataacagagctctgggccaggtgcggtggctcattcctctaatctcagcactttgggaggctgaggcgggcagattacctgaggtcaggagttcgagactagcctgaccaacatggtgaaactccatctctactaaaaagacaaaaattagctgggcgtggtggtgcacgcctgtagtcccagctacttgggaggctgaggccagagaatggcttgaacctgggaggcagagtttgcagagagccaagattgtgccactgcactccagcctgggtgatggagtgagactccgtcacaaaacaaaaataaaaataacagagctctgctcatgccccaaaacagctgagttggagaacaggagggtcttagaaaaaatgaccctctgaatgagaagagggggtgatcagacccatggggtgggctgaggaactggcagccccctcccccaggactcactccatgagcatgctcacaacccggttatggacaggatcgtattaatttgccacatgcactttcctttcacaatagagcgtggccatctctgtgtgtcagtataataaaatctgggtcatcctttgtgaccacagcctgtggtgcagagactgagcatgccctcatataagaccacaagctgtgctgcagtgagcatccctgcatgcattttcctggatgtgtgtgtgcgtgtttcgctggaagccaagaaaacccatttggatgctgctgtaattgtccagggcagatatgctaagagcttgaaccaggctgggcaaagaaagaaggggccaaatttcctttgccaaaatatcgtgtgcttcctttggtcagtcccccatcagtaatgggctgccataaactgaagatttagagcacagcaaaggaagggcctgggagctctgggggcagcaaggaggaagaggaaggggtctgacctgttgattaaagcagtgattagaatagaaatgggtgtggaggagagcagcagcctccaaattatacctgcctgggcaggggcttcacgcaccaactcttgagcctcacagcaacaccaggcatctccgtgtgaggactctgaggctcagaaaggtgaaggggcctggctgaactcacactgcatgtgagtggccaagctggcctgctgatctgggcctgactgcaaagccctgtgtgtgtgtggtctctagacagagtctctccattaacaatgctgtccgaggacaccagatgggcagatctggaggagccaagacctggaactcaacaggggcaagtgctggagagatgaacctggcactggtgcaattagagggagcccaaccagaaggctagacagtggcaggtgacaagtggtgtctggtgggcccctgctgccaggagacccctgctctcgaagccatggcctgccatgcagcaggtgggaggcagtggctgagaaggcaggccatatccgcagtcagcatgaggcccaggtggttgctgggggccgagctctgcttcctggaggtgtgagtccccacccgtatgtacacagcctcccacagcttcaggaagcccacagccacaggggctcagcaaacgcaggagcaaactcacttccccatgcccatttcctcccccatcccagctcccacctgctgttcctccatccagacctctctggcttcacatcgaggttgcagtgagctatgatggtgccactgcacgatccttttctattttgtgctgttcagatttaagaaactccctttgtgaaactttataaataacagtagggaatttctgcttataaaacaaatgcatataaatatagcctattaattttcatatatatatatatatacatgcacatgggcaggcatgattttttctctcgattggggattgcactgatcattcctttttgtagcctgcttttatcacttctcagcgtattgtgaagtgtccacatatggaggcctcatggcagaattgcacggctcttcagaacagaggctcaagtccctgcaggcctggatttcagaccctggctctatcactaatcagtcttgtaactgagcaagttactcacctctctgggccttggtttccgcattggtataacggagataatagtacctatccacgcaggtctgatgagaggactgagggagggcacataaaaagcttagaagaagacctggaacacagtgaatgctcaatgagcatcagacattaggattgctgttgttcctgacctcatggctgactccagcccccagccccacctcataccccacatcctgtagctggatcccagcctccactaagctctaacctgggtctcccagggtgaccttgggtcctctgactactgagctgtttggagggctgatgcccagtcaccttccaagtggcatccagtgggatttctgagaggttcttccctgggttctcagtgacgtgaggaatgagaggagttagaagatggggaaggaggagggaaaaggtgaagaaatagctatgatcgagccagaccctgcaaacctggccctggatcttctcaagtctccattgcccataggcctcctcccctgtgtccacacctggggtttccccctgagttggtatcacaggacgtgatgtggccccggggagagaacattagtgtggctgccctcacatggccaggatgggtgaggatcaagtcataaccacccttccagggagctgctaagacttagggccatggcttggggctcctggtgctcactggccttgtgggggacccactgactttcaagtgtagatgtggatgtgggaccagggttgctatggggcagtgggctcagctctgggctctgggatccacaggagatgaacaactaccggcgggccatgcagaagatggcagaggacatcctgtctctgcggagacaggccagcatcctggaaggagagaaccgcatactgaggagccgcctggcccagcaggaggaggaagaggggcagggcaaagccagtgaggcccagaacacgggtgaggatgtgcaggccaccaagggcacccgggcttctgcctgggcccaggctccaggttgtgcaatagggtggctgggagcttctcccagatgtgcatgctgctggactctggcaaataggagcccctcgcccacagacactcacacagtccctgcccagctgggtcctctcagggatgggaaacagagaatccagtcccgtcccaagccctcgggccaagggatatctgccttcctgctactgaccatgctgatttgagctgggagaggcttcctccctgagccagctccccaacccacctaacagtgtccatgaagcagaaactgctgctgagtgagctggatatgaagaaactgagggacagggtgcagcatttgcagaatgagctgattcgagtgagctggggcttgtgggggcagaggggagggagctatggtgggggagcatcggggtgagaagagtctgggaggagaagggagaacaggcacagagggaatggaagcacggaagaaagggggaccagcctggtggaggattcagcagaggggccgaggtggaccctcagggccaaggtggactcccaggcacccattctctccccttctctcctcccccatctcacagaagaatgatcgagagaaggagctgctccttctgtatcaggcccagcagccacaggccgctctgctgaagcagtaccagggcaagctgcagaagatgaaggcgctggaggagactgtgcggcaccaagagaaggcaggtggcagaggggctgcccccgaggccaactgatgatggcagagtagggagcccctgggccagcccagcctctgctctgctctccaggtgatcgagaagatggagcgggtgctggaggacaggctgcaggacaggagcaagccccctcctctgaacaggcagcagggaaagccctacacgggtgggtccacaccctgatgtgatcagctccccagcttctgctccacccctggaggccctgccttcctggagcctctcagcttcaggagaacctgcgaagaggtcccctgcactcagttatgtctgtgggcctgggagacccaggattgccctgctcccctcctcattcaggcgccccatccagagatcccctgagctccctccttccctggaagcccctcagaacacaattgggatgcagtgtgagccaggctagaaagagggtggacctccagaggagggccctgcagactagcacagcagagagggccttcccctgaagaagggccacctggggcaacacttcccagctcctagccccaggatccgtcgaattatttccccataccgccaaagattctgcctctgcaaagcaaacaaacaaaaatactttgattaaatcaatgatctggggccaggcgcaatggttcatgcctgtaatcccagcactttgggaggccgaggagggcagatcacttgaggtcaggagttcaagaccagcctggccaacatggtgaaaccccatctctactaaaaatacaaaaattagctgggcatggtggcgggcacctataatcccagctacttgggaggctgaggcaggagaatcacttgagcccaggaggcagaggttgctgtgagccaagattgtgccactgtactccggcctgggtgacagagggagactccgcctcaaaataaataaataaataaatgatttggaggttttcttccccatcgatattaaccaaaagccacctaaaactgccaatcagcctctgataagcagaaaggaccaggtaacaccatatcaggccagcccaaagcaagggatttccctgagcctgcctgtgcaacctcacccagggcccctgtgtgcccagccctgtgcttagccttcaccgctgagggtctcaggggcaggagggtgtttctaggagcctttagaatgcaatgaaagctgggctggcctttcaggaagcctgaggtcatccaggagtctggatgagactgagaaggcaacctagggaggggaaacagccagatcaaaggcccagggagtgagaagaattccaggatcagagaagggaggaagagagagaggtgaggagctgaaatacactgaagacaaatgaggagttagagagaacgttgaggtcaggttctaaagagcctagaaggacagcctgtgtgcacctgatcccactggtggtagggagccattgaaggcttgggagtagaggggaggggtggcagattgaagcaaaatgctggagcagatcaggacagggacatgggaagcaggagagcccatctcaccaacatctgtggccgtgtctctaggcttccctatgctctcagcctctggccttcccttgggttctatgggagagaacctgccggttgaactttactcggtgctgctggcagaaaacgcgaagctgcggacggagctggataagaaccgccaccagcaggcccccatcattctgcagcaacaggccctgccggtaagaggcccttgacctgggcctgcctatgccggtcactgggtgcccagaaatcacccatggtacaacccaagttgaagatcaagaccaggagctaagcttcccagggtctccagtctgcctgggggctcctggaatcagctctcaggccttggtctttttctcctgcggaatgtgtgtccccgaacacttcacctttaacctcatctagcatcccaggagaaagcaagccccttgttgacccttggtccctgaaccctgacccctttttcacctggctggcctccacctggaccctacacaggcctctcaaaactcccttctggagcattccctggtcttggtgcagccttggagagcccttttccatcccaggtggaccccggggagttgggagcaggaggagacttgacagagaggctacaagagacgcatggcccaggccactcagagtgcacagagaccctgcccgcacaggtgggtggcccagggcccagaaatgcccaggccctgctccacctctgaagatgcttcaggggccccttgctttacataaaccccaaagcagaacatttggaatcacagaatattgggcagggcaggggcacaggagagttttctctccatcccaggactcgccggaggtgagttctgttgaaagcacacctgactcatggacatccaggtaaagtgtgagggatgaggtcaactgcctcacaggttcttcacttcactcaaagactcccagtgcgttaattatagggggctccctaatgcattttacattaaaaaaaatgttgtgtcaaaacttcgtattctcaaaatctgtgtgggaaacagctgtgaaaaaagcacatgccagaccctgttctgaacttccagaagagggttcggcccaggtctgacgctctgcctcgggagctcagtctgaactcaggcctgactggtttcttcctcaataccttatggtttcccaagctcacactgccacagcctccagctggggccaaatgtgagtttgtgctttgcccacaggatctcctctctggtacttcagacaagttcaacctcctggccaagctggaacacgctcagagccggatcctgtccctggaaagccaggtgggtgagatgcaggagttgatgaggctggatcaggctcaccacacagcctataaccagggctcagtgtgtgagcagagtctaggctcaatctatgaccaggatcaaggcttagtgtgtggccagggtcggggttcagtgtgcaaccagggtcagggctcagtgtacaaccagggttagggttcagtgtgtaaccagggtcagggttcagtgtacaaccagggttagagttcagtgtgttaccagggttagggttcaatgtgcaaccagggtcagggttcagtgtacaaccagggttagggttcagtgtgtgaccagggtcagggttcagtgtacaatcagggtcagggctcagtgtacaaccagggttagggttcagtgtgtgaccagggtcagggttcagtgtacatccagggtcagggttcagtgtgtgaccagggttagggttcagtgtgtgaccagggtcagggttcagtgtacaaccagggtcagggttcagtgtgcgaccagggttagggttcagtatacaaccagggtcagggttcagtgtgcagccagggttaggattcagtgtgtgaccagagtcagcgttcagtgtgcaaccagggtcagggttccgtgtacaacgaggttagggttctgtgtatgaccagggttagggttctgtgtatgaccagggttagggttcagtgtatatccagggtcagggttcattgtgtgaccagggtcaggctctgtctatgaccagaatcagggatcagtgtggactcaggatcagagctcagtatgttgttgaaatgtccatctgtgtcttggtcaggctgcctgactgtttggccccctcaccctcaccccgccacccctgaggtctcgggaaggtgtcaagcccacatggcccagagctttgctttctgcctggacagcaggctcaggccctggttgtcctggccatcagggattagccctgctgcccatggtcctccaattgtccctctctgtgtctgcagttagaggactcagctcgacgctggggacgagagaagcaggatctggccacacggctgcaggagcaagaaaaaggtttcaggcacccctcgaactccatcatcatagaacagcctgtgagtgacccccctggagtagctcccaggggttcaggtggtggagcaggaagccaccgcacccccaaagtcactgggccctgagaaaagccattgtggagccaactccagggctgggggtcaggagtcctaggctcccattcctgctccattaccaaccgaaggctcggtcttaattcccccacctgtctaaggggaacagaaaacccctgccaaaactaccctttcccccatggggtgctgtgaaactcaaggagatgactgtggatgaggggtccatgcaggcatctccaggatgccctgacactgtgctttaggactggctgcgctcatgggcagagtagcttgtggccctacccccctgaatccatagagcctaagattctcaaattagcacacccttctcagatggccacgatgtaggctccactttgccaacttcccgagaacaaacaggcctgctcacaactgcccctcaagttcaaccccgggaccgcccagccccgcaaagcaaagaccctgacttctcctgctcttgagccagctgtgctttgcccgtggccagaagctcagcagcggctcctgggaaaggcctggaaaggatgagggaacaggcaaggaacaaaggcaacctttgcacactcacctgagccctggggacccttggagaaattaggtgtcacctgctgtggcaaaatgggtttagaaatctttgccaggtcatggcccactggattctggatactctgaggcctggtttgtcaggcaatatgcccttgagcaggtcaccccctgggaatggggggtactcacgcaccccgctttgcacaccacagagtgccctcacccactccatggacctcaagcagccctcagagctggagcccctgctgcccagctcagactctaagctcaacaagcccttgagcccccagaaggagaccgctaactctcagcagacctgagccccagagcaggcctccttccctgtgtgctggggagtctcatcaccgccccctaaaaatgacgttattaaatgttgtagctctgtga

SEQ ID NO: 1036 - DNA, 491 bp, Homo sapiens
catggtcaaccccaccgtgttctttgacatcgcagtcacggcgagcccttgggtcacgtctcctttgagctgtttgcagacaagattccaaaaacagcagaaaactttcatgctctgagcactggagaggaaggatttggttataagggttcctgctttcacataattattccaggatttatgtgtcagggtggtgacttcatatgccataatggcactggtggcaagtccatctatggggagaaatttgatgatgagaacttcatcctaaggcatacacgtcctggcatcttgtccatggcaaatgctggatccaatacaaacggttcccagtttttcatctgcactgacaagactgagtggtggatggcaagcatgtggtctttggcaaggtgaaagaaggcatgaatattgtggaggccacggagcgctttgggtccaggaatggcaagaccaggaagaagatcaccattgctgactgtggacaactc

SEQ ID NO: 1037 - DNA, 24373 bp, Homo sapiens
gtaaataaatagcttgtttattagtaatatgttacattattaaagtgcattgagaagaggtgcaggggccaaagctggaaggccactggccccagccactgccctgggtggccagacacagccggagaagggcccagctcccccctgaaatggatggacagggctgggggcagggccgcctgcctggagagctcggcccaggccatccccaccggaattttcacagtttagcctaagttataacatgtcctgagcgaaggtgggaggctaggagcatggaagcacagcccctggggaagggggctgagaggaagggaggaggccccccgccccccaaccctcaacgccaagggcagagtcctggaacctccccctgaggacccggctcgtccttccaaatgaacacggtgaaactagggctcagttttctccttcattctcccgtttccctcaccccaccccctcccataaccacccccaacactaggggctccaacaacgtccccctcagaccgggctcccagggcagagccagctcatgccactctccaagaacccatgcccgtctccagactcttatctcatccccgggagcctcagactgggatcacccccgctccccaacccatcccttcccagcccctccctttcccacccacccccccgcatgtagttttggtattttcatacagatgcagtcggaagtagctatacatgaaataagcctaacataaaaatagagctttttccgtccttccgtccggaaagcaaacatccttcaataaacatgcaaggcggctgtcctgtgggacccaggaccagagagggagctgcagaggacagggctggacagagggtagccctgggtcttcaggaacaccagccacccagccatgagagagggaggggaaggaggcaatgtgggtaccaagagtccagaaggactcaggcctcagccccagggtcgagatggagtcccagctctcctatccaaacccactccccgacccatgggctcttgggctgggagcatcgctgcatttagtcaagtttgaggagtctgaaaaatattttccagaagataaagtcttgggtcatcgatgccccagcttcacagtcggtgccctcattctcagcccctcaccatccgtgcgccacctggggcccagcagccgcctgcggctggacgtctccaggcctggcatcctccactgggttattctgtcccctggaagaagtggcaggcaaggagctcccgggccagccggctctgagtgtgagacgttctagtgccctgggctgcagaagcctgaggcatgcccagcctcgggaggccctagtggaccagcaagccaagagtgagtgtgggcagcacccccagccagagggaggcggccagggcacaggcatgacccagcaggtgctcggccatgatgccgtcctcgggcagcagctgccagtgctgagcctcgcggaagtaggagccctcctgggcctcgcagaagtagtggccgtactgctgcgccgtgaggttctcgatgaacaggatgcagttggggctctggtgaccaggttcgcagctctgctccacgttctccttgtggcgccatgagtaggtggcgtggcgggattccatggggcagctcaggtagtagcgagagtttggggccagggaaaccttctgcagtggggccttgtctggggaggcagtggggaagcagccgtgaggagggacaaagagctcccaggggaggatgtgtcctccccacggactgggatcccaggacaaggcttctgaatgaacgtggggaacccagccctcagcgtcctccttttttctcccgtctcgctcatcccaccaagagggctccctctgcaggactgtatcctgccccatgtacctggggcccacaggacaaggccatgtctccctcagaccaggacaatcagggcagggcagtaccccactcattgggccacagccgccagcagggccagatcaggtacctggtttggggttgggacactccttgtgtggctcggctggattaatggattgcagcactgacctggagtgggaaggacgaaagaggatcagcagatacaaggctgcagacctgaccctcctatccttaccccagtgcagttccagcagagaggagggtcccacaagaaaggcccagtaccgccacctcctccagcccgacaacacctccccctctcccatgcccaccttctcccagggacgagggatcccggccaacgtaccgttcggagctgtagatggagatgcagcggccttggtcccagccgcagtaggggtctcgggacatgaggcaaccgtggcagcccccgccatagacctcacacaggtccaggggcacctggctcacctcccactgggagctcacatacagcttcctctggaaggacagcaggattgggtcaggcccgggccccaccccacactcagtcctaaatgtccaggccctaaggcctagaagctcttaaaagaacacacaaatcacatgcaaaggagccctgtcctcagctgcagtcactgcatagcccatgggacgcagtgggggaaggctcacccgctcagcatccagcgacatggtctggatggcagccgcgcggcggaagggctggatctccatgatgttgaaggcgaagctgtgctcctgctcccccggttccaccaccttgtggatagtgcccctgtctgtgtatggtggacagagggtcagtgggcgggagtcccactgaggggccaggcagctttcctctaggccggggaggggtgggaagtcacaactcaggcaagggtcacaggactggtgtgggcagggcgaggagagcgtgactggggaagaatgtgggagcctaagggcagcctggaaccttccaaggctgatccagagaggccatcccaggaggcccaggggtccctggatacggcctccaacattcccaaggctgcacgggaagaacagaagcaggagccccacaccagcaaggtcagtgcggctgctgtccatgcatcacctcgtttaaccctccacagccctgcgaggtggctgtcatcttccccactccacagataaggaaatcaggctcagaaaggctaagccacttgctcaaggtcacacagctggtgagcagcagagaccgagttggaacccaaatctgtcagagcccaaccactcagctgcttctacaactcccctgcctcctggactcttagggaatatatttactttaaatacattttttttttattttggagtaattttagattcccagaaaagttgcaaagatagtacagagagctccaatctacccttctccagttccccctaatgttaccatcttacataaccacggtatatttgtcacaactaggcaactgacattggtgcattactattaacaaaactacagactttatttggatttcactagtttttccacaaatgtccttcttctgttctaggatccaattcaggactccacgttgcatttgatcttaggggatatcttaattttataaaatcttagatctaaaaaggatcttggattctaaatcaagagttcccaaggtcttataaccgagctgcctgcctcctagaccaatgctctctccgttcacaattagggaccaatgggcaccctgacccctggtcctcccaatcctacctcacctgctctcccagtttctagaatagcctacctccctctctccctccctcccaatttcccagggcatcacctgccccaaaaaagcagtcagatgattgcctgcctaggatgtttcctctacacatccgtgatcctcatctgtggactctgagatgtggccagatgctccttgggcctgataaggccccaccccagccactgccttcacagacatactgccctatacctccttccaaaccagccccagtaacagcatacccttggcaaaattctcaggaaaagagccaatacttctcccagttgtgagagcctcccattctctgcagaggacttagaaagctctatttttcagtctagcccaaatacgaatgatgcaggctccaaaatggtgcctcctccactgcccttagaacgaagacaccttctctaatcactcaagtgtgctcacctcccaagtctgcaggaagggaatccatggcccaagtccagccttccttgtcctagctcctgctcccagttccgcactgtgtgacctctcctcttctgctccccagtgccctgccatccctggctgaccacaacagctgtgccagccactactggagccaagcaaggatgggggcccaagggtgtagccgggatgaatagggagtaaagaggcagggaatcaggacccaggccctgccctgtgggaaattcctctccccaaggcttccaggagccaaacaatggtgctggggttccagtttcctacaaggtcaccaaagccgagacagttccaaggtgaagcagcaacaggagatcacatggggaatgtgaacaactgaggttgggcgcctgggcctgaattgaatggccccaggggtgctagaggccctttccagtctcaaggaaggcagctggcatgggaagctgcgacaaacccaactcaggactggctcctccgtgtcctgtggctttccagaaagcaggagcatctcccacggcattccacccagcttcccccagcagggcctactccagggaagaagagaagctgcccctgtcctctgtgagatggcaaaggttctgccccctggaactccttcctcatacctaatttgtgccccatcaactcctcaaatgtttcctctcacctgcacaatcccaaagacaggcgcagggcctgactccctcattctgcctggcagaggccagtatccctgtggttcaggcccctcctcctcatttgccacgtctcttcctaccatcttcttccctgagtcagacatctggaccaaaggtgcacctggctttgctcagactctccagatttccgcctccaaatcccagtgcttgcttttctcccatccccctttccctcttgcccctacctcctccaggaagctctccctgcctgactcttccacacccacacacattaacccctgacaactccagtcactcaattattccttccacatgtaaagatccaaccagatgttaactacattattccttacacctttcatgcccgtttttacaaagcaaactgagggtcccggggtagcctctcacctgtagttaggtaaagcacatgaaaggtctccccgtggctggcttgcatgcggtggacggccactttctggtagtggtatttagagtggaacaatggcgtcttcagaggccccatgggctccaccctctgcgccacctctgggtgacggtcagccacctggaaggtctctgtgggtatcggctgctggtctgggaggcactgggcaaggagagcaggcccaggtcagtggggtggtgggaggtgaggcagaaggagggctgggcctgggccacggctggtgtcacgctcaccttgccaggccgcgggttgggaaggcttgagtggtagcccttgagtgaggaggtacggaagaccttgtcaatgtcaccgagggaatacacacagacggctgagtagttcctgcagtgacatggagaccagctcaatggggggcccagaacccacccatccacctccactcacccaggccagccttgtgcctggcactgagttgccaaccaccactgaaaatggggagggatggagaggaggaaggagaggagttcagcctaatttctttgtgctgcaatttaaaaccacaaacttgtatcctgttacagaatcactgagtctagaggccatctgctctacccaaccccaaggcaggaggaaccccatcataggctgagcagttctctagccctccctgggcacaggctgtggggtgctgatgccccaggaggccagacccccaaccccttcccagcctgggggaccccactcacccaggagccacagagcagggtcttggcttcctccactctatccctaactctccccacacacacccaacacttccgcctgccgtgtgttcaatcaatgagagtgattaagaagtgtgaattatcgggctcaggcagtgcctgagcaggtgtaatagcacccagctccccgagagatgcttcagcagcttcctcctgggcccagtgtccactctcggcacaagcaggtggtgggacacacaggcacaagtgcagtcatgagtgtgcatatagggcatgcacacacacccatgagtgcagactcactcacacaacagtacatacatcgcactggctgtccccccaccccacacccagcaacagcccagcctcttgagcctgcagcccctgctcctgccacaccagggaggccctcagcagggcccaaggcctcctgtccctactggacactgaaccaatgccagccccggccccaggacaagggccactcaccaggggttggagaaaacaccatagaccctggtgtccctccactggccgctggggtcagggagcaggaagacgtcttgcagcctgttgaagttcttgttggtggcagcatcactgcataccagcatggctttcagaaaagtgttccacttggagactgacagtgaactttccccaccctggtccccctggaagggtagaggggagaagaggcccctcagcacctgcccgggcttccccacacaccccaggaaaccactgccagcaatatcaacacctgggcccagaggaggaaggcaggctgtgaggggccaggacctgccgggggtgccccaggactcagggcaggtctccagatgagactccagcaagcaggcctggctgatccagagcccagggccagcagtgcccagggtcagggcaggtgagagtgccaggtccccacagagcagacggactcagacacacatttactgactcacacacccacacacgtggcacagcacattcacacaggcaaaacacacacacacacacacacacaccccatcatacacacgctcacacgccatcatacgtgcacaggagctcagccacctttacccacacacagacacatgatgctccatgcacacacagctgctcccacagtccctgacacagacccactcatacatccacacaacttctacatgcacacggacacacagaactcaccctcactcaggcctattcatgcacagacacgtagccagcagccctcacgcccctgctcaccctgcacaactgggccacacgggacacattgagaggagcctcaggattcttgtcaggattgtcctctcggaagaagtagtagatcttgtcatcgtaagcctggtcttggtgcacgatggtggctttgatgaactgtgggtctgccagggacagaggcgagtgggcgtaaggctgggaagcttgcccgggagaccatcccaaccctgcacactctcctccctccttcgggtctgcacaaaccatggcaaatcagatctggaataggactcagaacatcaggtccaactccccgaggggccctagaccctgcacctccaccccacacctgttttgccctcttcctacaaagatgtcatcggcccaggagcaatgacttcatgcctggggactgggggaaggtccctgggggcccctatgtcacttctgctcaattggcagagccctgatgaggagggagttgggggctgcctccacgtgaactcagcagaggataaactttggctcctggggaccctgcactgggtctggggctccctctgtttgtgttcctgaagagggctgggcccatcccactgctataccttgtctgttcctctgctcccagccaaccctaacttctcaggcctataccaaggtcctgctttcctgcatggccccagcggccctcagggagccctcccagaaacatcaggatcccatctgccaccttaagtgctcacacccccttgcccaccctcagcccagccggagcctgactcactctgcatgacagtatcactggtgtacagctcactctcgccccggatgcggcggaaccgagggatcttcccattgtattcctgcttccggatggtggaatacacctcgtcccctggggtcagtgggagggagaaatgagtaagggcaggcagctcctggaagtccctcctccggacactggacaaagagctgaccactcctctcccagcccagttcagaagcatccccctggggcgcctgctccagcactgccctaccttcaaacagaaccagggagttctcgtccgggctgaagggggcgtagcctctcatctcgccaagtggcaccacagtgccattcacctgtgggagatccagagggttggatggccacataatcccacagccactgcctcccatgacggccagtttctcggccaggagccccatcctcccagggcaaggccagcattggagtctcgccatctccttcccaccatgaggggcagaagcccacgcagtagaaggtgagctgatcaggcacatggggagcagccttctcaccaggttccagcagctggggtgccgggcgttggtgccacaggccagcagcccctcactccgcctctccaggagagtgatgtagttctcgcagtcctgcccggggaagagagaagggaggagagaaattggttgctggaaggccctggcaagcctagcactaggacccccaggatcagggaagaaggtgtcagaagggcttagcataggtgacagcctcccgggacagcccagagtgtgtgcagctgacgccatcccctaagcacagaggaccacgtctccccatcagtctgggactcgtggggcagggccatgcttccttccttagaccctcagggtctcctctccctttaccaagtggctcagacccctccataccccctcccccactcacccgcttatccagacaggacccctttgtggagccgatattcacctgggggaaggggagaagcattagttcaatctgccaggggtgaggtacccctgaaatgctttccacacagcctcaggataagccccaaaggaagcaaccattattctcatctgacagatgagcaactggggctctgagagggtgagtgatctacctgaggtcaaacagggtctcatatccagagctgaggcccagagggttcagaagaccaggcatgggctctggggcccagcttccagcctgggctttccgcagcagcgctgcccagctggccaggcccattagctcctgtttttctccacaccgccccagctccccactccaatctggactacctttagggagcctcccccaggagccatttataggatacggaggtgggggcagtttaggaagagaagccagctccctcggattccctgaggacccttggcagggccagaggggagataagagggtagggggggtgttgggggaagagagaggctcaccgtgcgcacagatgcgttcttgccctcggggaagtcaaagaggtagaccttgccacgtcctcccacccacacagaggagctgcctggctcgtggaaaagcaccgtgtgcggctcagtctggccaaagtccacccggtcctgccctacatggcctgaggaggagacaattagtagaaacattgaagccaggtcccgagagagaagactctgggtcccctccacatggcacactggaaccagtgcttggtgctcagggtcctggcagggcgtcagacaagctctgggctggggtggtacccagactcagagagtcaaggacaggagaagtaagagatcctccggtgggctccagcaaccagctgtcctcacccacagcacggcccctcccctagtgtggcagcctctccttccttcacagtatgtgtgatctcagagtggggaaggatttagggacctcttgggggaacagaccccctcctctggcacacacttttgagggctgggctaaggcaggaggaccagggctccttggccatgctctgggaggttctctgctgccctaagccaaagcaagcagcgccccccaaccccgggcctttcagcaggcagcagggccttcaagcaccccccttggagtccaggttcccaggaatcacaatgctcagaaccccttctcctccttcaggaatccctctccaacctctcctggcccatccccagccccttagtgagcactagactagaggaggaaaggaatctcaacatctactccgtcccatttcacagatgggaaaacagaggccaagggaggggcagcccaagggcacacggaagcaggtcagtagcagaccctgaaccagagcctgcactcctgcctaccaagctggactctattccatggcccactctggcctggtttcacccatgaggatgctagctctccggggggtgaagatcggctcttcctccccagcaactctgggacaggggaaccttcacagagcacagcctgggactttcagcagaagggctgaccgggaaaattttccccaaaaaagaaactgactgcagccactgcctctggggaggtgtctcatctccagtgacactgctgaggttgtcctggttgcaggagtaaattatagggatgggatggcctgtggttgtgcccccagcaatcagccacacccagcatcttcccacctctgaccagcctgggcctcacctaggaactgggtctgaccactgttttttcagctgcaggaaactctggggcagccagcttggcagtgacacccaagctccagctctgaccaaaaagaactaccatttcctcaactctgcccccgatccctcttattcccattggagccatccctattgattctgcatttaacaggggcaaggagcagctggaccacacactgtgccaccacaccttcattctttaagaaacatcccttcatggccaggtcacccccggaagtgagcattcttcacctcttctgtggcctggcgcactgtgcagagaagaatgctgaggtaccctgggagacatgccaaggtcacaccagcaggcaggacacattagcttgtcccaggctgcagtatcagttctcagcagcatggcaggctacagagagaagtgctgagctcactgtccttgggtggtgtggctctcctggtgcacatcacaaacagcccaactgaacagctccggggatatcagccctccctggcccccaagcctccctccctgtaggcccgagatgtgcagagcaagggctgagaggtactggcacttcggtgggagggagggagagctggcaggtcttgggtgctgccctgctccccctcccttcctgggataaaattagagtgctggggtcacagacacagtcttcctgactcagctcccgtaactccccttccacccgcagcccaaactgcagccaccatcctctgtggcccagccagagatccagacagtctgccgccccaactcccctcctgctcccctcccatccaccgatagccagactggcagccaggaaaaggtgcgtgtctgcatctagagatgctgggctaggacctgagatccatagtccctgggagtcaaagcagaaaagttctagccgtcagactgtgctagccaccttcatcagtcaccttagccccactcctgcaccaaggccacaggcccaggtctccgagggggccggcaaggccaatgtacaactactcaagggaaaagaggcaccagacaggactctgggtgggggcaccctggtctaggaattgcagggctgttgaagagaagaggaaaacagtcctgccctggggagtcgagcctgatggcagagacatgactgggtcctggagagcaaggtctgagggggaggtctggccctaccctgggaatacatctgaggggtcagacagccacaccacagaaaacttccacagctctccagcaaaactgtcttagcatggaccccagggctgcccacaaagtatctgctgaagacatgaagggagggtgagggctgctggcccctgggtaggagctgcagcactagggcccggacaatcccatgcggatctgcaagcctgagcccagttcccttcaaaccctagccacaatggctagggtggaggaagcagggactgttcgtcccattttgcaggaaaacgaacaggagcccaggaccacggcctcccatgacccccaggttcctggccctcccacctctgttcttggtgatgcgtatggactagagggaatgacaccagctcagccccaggacaaggccttggcccattctccaccccagccccagcctgggctcccgcaccgcctgaggccctcaaaaggcctgattgtgcccgggaagtgtcgagcagcagcagctcgatgaatacatgaaaggaagctttgttcaggttggcaggagcgggggctgggggctaaggggcaggagggctgcctggaagtgaaggcagcaccaagccatcagggccaggcctcgagtctctgcccaggcaggggctgagcaaggccaggggctacccctaaaaaggccaggccaagggagtatgtatcatatccctgaacattttctttgtgatgctttatgaacccaaacggagaggtgaggtagataaaagctggatgggccctgaacaggccgggagggaaagccaggcagaggacgcaacctgagcaaaggtggggaaggtggctgtatggaggacagaggccatgcgctgcagcctggcagagtcctaatgagaagaatcgggaaggtgagctgaggcccacgtgtgatgggggagggaagatgcagcctgtccaaggacacactgacccactgcccaccactctcccctgctgcctgaacctacgagcagggccaggagtggaaaatgcctccccatcctctggcgtcccccacctcctggctccccctgcttcccatcctgcttgtctaaaaggagcaccgtctggcaccgtgtccccccctcactccccagcctgacgcattagtggctaagtggtagctaaaagctcccagaataaccaggggctcaggtaggggagggggctagggacatatggggagggcatagcccagaggcaggccaggaacaagacaacccacctcccgccccatgtgattccgagccaatcctcactcgtgctggaccaagaaagcacattcaggctgccccgtacccagccggactccatagttcccctgagtaccatttctcatggtggcagggccagcaaggcccagctccggccagataggagggctgcaaggatggctgggttgtaggagataacctccaccagacacagccgcagggccgggtgctcacagggctctgatcccattggaaagaatggggcctgactccttagggaccctaccctcgatcaccaccccagcagctgaccgactgtggcaagtctgggcctctggcatgcatttcctaactcaggcctgcctggtggagcacgtttcctcttctcattcactctggtgctgtcaccgtctggcccgctgtccccatactcttgttgtttgtgaaagaggagtgcagctccaggggagggcagagtgggaggtgttgttgtccatgaaggggctgggtcccatgctctggtctggcaaagccagccttgcaacctgacccactgacccagtgggccttgaatgtaacctcaaggagccttttgaaagtgggcagagagtcaggctctgaaaatggcaggaatgtgggcacccccacagagaatgcctaagtcaggcagtcagagaggccccgggccaaagagcagaaagcaggccgacctcaggttggagagccagcacatctggcaggagcgtcctcccacagttgtgcccccacccctgcactgccaggcctacctcacaccctcgcccaactacgtgtctggaaaagagagtagagggaaggcccacgtgatgcctaggaattagcctgcagcctctccaccctttggaatcccacatccacatgtcaaggtggaagggagaggatctaaacagtcattgaactgaaggacacagaggccagagaggctgtaccaccggcccaaggacacagagcgagggaagctccaagtttccagtacccattacccagctgcttctctccaggatcacatcctgggcttcctggagagcctctgatttgcaaaaagctgtatattcagcctctccctacttccctgaatcatccctactctacccttccctctcttgctcactaggtgccgagtcactaacctgataactaaagggaatcacccgcccacccaccttccaggtgaggccctgatctcctaggggcctttagtgatcaaagccttaaatccaaaggagtgactaatggtggaagtgtaggtgccgtgcatgtcagagtggtagaggaaacccttccactaggggtgggaatacaggaacaaatgtttctgtctctcctgatatggccaggaagagggtgtgagaagcctggtttccagggtggcaccggctcggtgctaaggataggtcatggttgcaggtgggtcctggcaactctcaggcagggttaggttctagattagctagtcgcctggcaggggcagagcctgtgtgctggggcaggtggtggggcctcgagacagcactcagctcatggaggactgagaagtctaacttgtttatgagctatgagaagagcgagctgtgtgctgggccaaaggggagcatcctcccacccaccaaggtcagctgtgggtgggaggggagtatatctcatgtgtggctcagccctggctccaagaagcctcattatctctttggtggctggacagctggctggctgtgacggtgattggggctgggccttcctgggttcattttcctccctgtggattagctgggtgcgagtcagggtgggtgctggtacttgtttgggcctgggttttatgacccaccaggattcttgaaacaaatcacaaaacaatcagggtgaagtccatgggtctttttgggaaagtgtgactctctgagtgccagagaagtcagacagttttctggaagtggaggcagcagaagaaactgacattctcatctgcttccactgaccagcccaccaaacctccagccaccctgcaaagaaggcaggacaacctgtattgccgttttacaaacaggaaaactaatgcccttccaagccaccaaggtctggatgctctccccatggcaccactgtgctcaaaggaccagaagaaggtttggctattggggagactgtctggggcaaagtcctagggagaagggacagtgtggaaagcaagccccttggtgagaggctgtgctgagcaggattcagggactcagggaaggaaggctggcactgaggcccagctggagtgggtaagatgccctgagcccacgcccagggaaggccggaagcccaggacaaacatcatgtcccatctaccttccagctgttctccagcccagcaggttccaaaagccccagagtggggccgaagtcgctggtggctccttcaaagcagacaaagggtagcggtgcagggcctgcccttgggcccacagccagggcaggggtcggggagagggcggagaatggctacacaaccccaagtggagggagggaggcaggtggaagactgctgagaaacagaaggttccccagtcttagccttagcctgaaccagcaggggagactgagcaagggcagccagccagcaaagcccattagggagaactggcaggggctgggctgccagggctgcattccatcagaaaccagagatgccagaggaggaggaggaagatgatgacgacgatgatgatgcccctaccacccaacccttccatcgcatttactacgtgccaaacactattccaaatgatttttagatatattaactcatttaatcatcactgaactctcatgaagtaggttcttttattatccccattttgcagatgaggaccatgagacacagagaagctgagtaacttacccagcattacacagctagtaaggggtggagcagaggttcatactcaggcaagctgactccagaatctgtgcttataacatcgtattccagagatgagcccttggaggcttccaaggtcagcccttcccagacagatgaggagaccaaagcctaccgagggtgaggcccagttagaggctacttggctaatgaagtcctgacctctgcccgtaacaccctgaagacagtgtgtgcaagtgagcacaggtgtgcaggcccaggtgaatgtagtgaattcctatgctttgatgttgccctggcatccgttttgaatataagctgggttttctcacactagaagcagggctcagtcaaccttgacaccgtttccagctccccacctcctcccagttcctccatgtgctcaatccagatatctaccgtagacagtcgtctcctggtgactgcttccctgtgggatggctacatacagcccacttgattggtcctgctgaccttgtcccacagcccgcatggactgtgcagataggccagtgaccttgtctcaagtcacaacatgacctcctggaactcatgactgcttgctgtaaacccaccaattaaaactccccatggaggccaggcacagtgggtcatgcccataatcccggcgctttgggaggctgaggtgggcagatcatttgaggtcaggagttcgagactagcctggccaacatggtgaaaccccatctctaccaaaaatacaaaaaaattagccagacatggtggtgtgcgcctgtactcccagctacttgggaggctgagacagaagaatcgcttgaacccaggaggcagaggttatagtgagctgagaccacgccactgcactccagcctgggtgacagagcaagactccatctcaaaacaacaacaacaacaaaacaaactccctgtggaaaacttgttttaataacaccatggaccccataaagatgctggcccatagatccccccaccctgcacatgctccctgacctccacctgtgtgtggcttcaggtacaccaggtatccctcaagacctgttagtaacaaaatctttatttccacctgcctctctcttaatcatggaagaggtgctctccatcttaaagatcctaagttacaacagtggggcaggaatcttctcgaggtgcagcgtggggccccggtcctgagtgactgattagaaagacaagtctcccaagatctcgctcagaacataaagtactctgtggggccgggtgccatggctcatgcctgttatcccagcacttcgggagaccaaggcagaaggatcacatgtgttcaggagttagaggctgcagagagctatgaatgcaccactgtactccagcctgggagacagtgagatcctgtctctaagaaaaaaagtactgcatgctctgaagctgaccacagtgaagggcagagtgtgctcaccagccaggtccccactcagccagccctggcgaaaacactcacctccactcctcagctcaaggacccaccatggctcctaactgcccatccaagcagggcccaaaacctcagggcagggcagtcaaggcccacctcatctctgcacagctctgccatggctcatttccatctctgcactttgctcctgttctcccctccctggattgaccttcctccttttctctgtgcacatggatcttacctgtccttgaaaatgtagctaaatcccttggatccaggaagtattccagactgctccagccctcactgcccgtaccttcgaccttgtaccacaaaccatctggcaccaccatcttcgctcagatcatgctgtctgatgggatttcatctggcctatggggccctgaaggtgaggaccaggcttcctcttgctccaagtcttccattcccagggagcagctcagacagtggagagaagcaagactggggcaggccaaactcccatgccagagggacaggtatcttagaacagattcctgggccaccaatggagtgcagaagtcatcacagtgaccttccttcctcgacaggctgggccagagctcctgcctcagcctcccaagtagctgggattacaggcgtgtgccaccacacccagctaatttttttgtatttttagtaaagacggggtttcaccatgttggccaggctggtctcgaactcctgacctcaactgatctgcctaccttggcctcccaaagtgctgggattacaggcgtgagactctgtacaaacaacaatatgaatagctgtctatgctgcactctgcccccaccctatgctcctgcccctagctctagcctggctcctcctcctcccccaggaagccttccttgattgcaccatcccacactgacctttcctgctctcacctcctgtcacagtcctaggctacatctgcaggtcattcctgacctccccaggggtccgccctacttcacaggcagaagactcacctctccaggaatgtgggggctccccaagggcaaacccagggcttctcttcctgcctctcccccagaggagccgaacacagacctaggctggctgccctccatgatgaggggtcacccaggggtgctggcacagagcccaagcctctggctggaagcatggggtgcagaaggcatggcaggatcagcataatcccaggctgtcatgacagttaaaacctgattagcccgagccgggacacagatcaacctgtccttgggacctgaggcccaacccacctgaggaaagaccagaagaggtatatggagctggtccaaatccaaggtcctgaagagaggacactcacagctggtgtggctcctgggaacagacagcactggggcgggaagagtctgggcccaactgggctagcagaggaggaaaggcactgaaggggcccccagcctgggacagagtatgatggcagacagaaagctggaaacaggctgagagctggggcagaagcaggctcagacgactcagccccggtcccagctctgcctctttgggtgatctcgggccagtccctgtcatctctgagcctcagtttccccatctgtggaatgtttggctggcccagctaatctctgacatttcttttctgacatcctaagctcgcgctgtcaggctgtgtgggttggggtcatccaagaaggttcctcagaggaactgagaaagaaccagcagcctcctttctgggcagaaaggaggaggagggtgagtggggtgcagagaggaggcggagccagggagcagtgagggaagaactgtgggagtctaggaggcagtggggccaggccaccatgcagggcctggggaaggcggcagctgtgtgccatgtgttctggatggggtgcagcatagggacagaggtcctccgggaggctgggcacagatctggagagatggcaaggccagggccagggagaataaagggcttggagagccaccccataccattcggggcagagaggggacagtccctcaaggcctggctggctagggaagggggaactctgtcctctgaggaggcagggcccaacaaggtgccgtggccctccatccccctgctttctttctggcctgcctggttccctgaggacaggacagctggccatacacctggtggctggccctccctgcaagggtacggaaccctggctcttctgaaggcaggacaggttaagggccccttcctcccccaaccatggcgaaggaaggctcctggggcagccacgctgggccaaaaaaggaaatcaagagaagtggaaacttttcagtccagagctgccgaccaaagcaggggaagtgcagtcagtctcttgtgacagagccgtgtgaagctgggggtggacaggctatcagctagtggcccatctactccagctactgccccctgagggctgccagacctgccccctgggctgagcttcacatcccaccttgcttggccctcctcaaaaaacagagcccagctttccctgcttcccccagggcgccaccctcagcccagatagtgacctatccatgccacccccaccctgccacctccatgctccttccatctctgcagaggaagagcaggagaagacagagctgagggacagaccttctcacctggagactgtcctgcggtcaggagtcaatggggaaagccatggtctccctggacccagagccagcctcccaccagggaactgtgacggggctatggccttgccagcactcgagaggccttccctgcctgccacggcccttctccagtgggtgcgtccttcctcctcactgctgcgccagtcataggatgacaggtatcccctcacctatgcccatctggacaagtttcaaacttttcgggagcccccaggcccaggctgactcaacgcctcttcacatgggggcccctcacatggcttctctcctctctgtggtcctagctgtaagttcttgggtttaaaatcctactaagtggggtgcttcctcctgttccttccctcccccagctggctcctcctcctgccatttcagcttgctccctcttccaggaagccctccctgattgggaaaattgggttaggcatctcctcagtgcccataactgctctctgttacacattctgttgtacctgcaggtttatctgcccatctacatctacactgagaagtctacaagggcacggaatcatcttgttcctcatcaccagatccccaagctcatccccaagaccagcacaagggtggccccggcaaatgtttgctgaatgaatatgtccacccttgagggcacatgctgatgatccatttcctccaaatgatcctcagcctttggcccacgagagaaaaagataggaaagaacgcgaacttaagggtttcccctgacttcccaggtttcaatttctcctccagatttctcgaaatctaagatttaaacaggccaccacagactctgcccagcccctcccatcccagagagagagaaatcctaagacattaaatctcagaaaaggatgagccccctcccctaccctctttgggcatttggggaaactggggttcagtaaaaggcaaagacttgcccagtcacagagcaaattaggtcacagcctgaaccaggctcccgacctcccagctctctcccctataccatggtcatcattggacctgtgccagcgtccattccaccggacctgctctcagaatcttcactgtccaggacagaggggtcacagagcttggtaggaagctcctggtgacctcaccaagcatctctcttggcttaggaaactccccctctcctccggggaattgcccccccaccatgagactctgtggagggagttcaccttgaaggtgatgaacacatctaagtccccaagggggcaaggatttccactggaaatgctgatgcttgggaagccccagatgtgacctcatcccctggaggaggtaacaacaacctcctgccctggggagcagccccagaatggctccccagcagccaccaagtcaacaataacatcccgttgtttcactggacaaaagcgagggagggcagaaccagccgggcaggttgagactggggatatgggttctgtttccccatggacaggctggttcacctctgaccttggggttccaagccttctttagctcctccaaccactgataaaatggaagaggggtgcacagcttacaaacgcatgccaacctcctgctaagccccagccctcacctgcaatctactcccttacagttcctgcttacaggaagatcaggaccacacatgcacatccttgactggcccatgtgtcagtgacagcccttgggggacaatccctacagcctttcttgctctggcaggctctaagggtcaaagacaagtgtggagctcaaggacacccagcaggtacatgatggcccatctctctccctggcctgagctacgctgtgccagactttcatcaagctgcagaggcagcaatctccctgatcagtgcaggctgggcccctctcagagttccctgctttaatctttctctagaacttggggatccaagcagcagaaaataaagaactttccatacctattccagtccccacagctgtcctgactcaaaactaaaacccccatctatgcctcatagagaaatggctccagaaccaccaccatccctgattttgtcattcctggataccaccatactcccacccaccactggtagacagagctctaggcttccagaaagaccccctcttaccctgttcctgggtttgtcctacccaagcccattcctgtccgattgccatgtgtcaccccacaggagacaggaggcagctgtcagtcgggcacaccatcaccagctggtggccctgggggtggggggcaggtgaatggcagggcctgtctggccagtggggcacctggcactggtgaaggagaccacagactgtcgttggacaagactggtgaacggttggcagaccccagccagcggggctcaacagtgcattactaagcagagggcacagccagtgtggctacagcagtgaactgcgggcgggggggtaggccatggagctgtgctgggagcttcgaaaagtgggtaagaggactgaaagcaactttaaatagcctcagggtgggaactaagtgcccaggatgggatgtatgcattaagtgctaagaagtgggtgtgcattaagtggggtgggggtggggggtcatgggaagactttgggacaggcaaacagagtcaaaatgcaaggggtttgatggagggaaagattccagaacactcagatgtggccatttgtcccctccagagtgcccacacgctatgatgtccaagacagccaaggagactgagggaaggcaaagctgctgggagggcaaaggaagcttgggctggagctgggatggcagaggggtgtgcaggcctcctccatgtacaggcggccggagctctagcagcactgctcggcttcctccaggagcacctcaggctgggtagccgagctggtccccagagcacctcattcatggtccctgaaccacctaaatccttctcccctccctaacccagaacctggactggtcctgtgccagatcagagcccctgcctgcacctgggctcccacactgctcagtgaccttgggcaagtcacattccctcagctactgcggcagttcgggccactcgttttgtgtatggttttttttcccctctgctaataatacctgccccagataatgctcagactcccgcaatccctgcaaactgccaaaggcatcaaaaggctcccggtggggccagacccgaccagttcccccagcccccactgcgagtcccccaccatcacgacaggggggccgcagacacgccaaatttggggacagagccgaatcggactgggggcggggaggcatttgtgtgcaatgcaggggaggggagatcagttcctcgcggcagaaagcctcaaacccccgcctaaccggctttctgtcccatagtacagggtctaaactgaggtgccctgggggagactccagtcccccaggttcttattatctaccctggcctaaaggctgcacccccgccctagatccaccgcctgggggtcccaacggccgtgccccacccaacgggcactgccccccaacgctggagccgatttctggtgacaactgccacgtgcgggcaaggggggagcggccggtcccggcattgctgaggcagcgccctggtaccccaagccgccgcaccgcaccatgtcccgccgctcgctgcaggatgcccacccccttgcctggcccgagctccgggccggggcgggggcgggggcaggcggcggggtctttgttcccgctgccgaagcgcggcggcggcggcaaggggtccgcgccccccttgccggcccagcctgcgccccgcgcgccagcagagcccgcagctcaaaaggagggtacccgggttggggtcccaggcggggaaaggtcctccgccgaagcccccgagccagaggacccagagtggctcggggccgagagaggggcccgccccctcccctggcgcccgggcgttgcggctcctggctgccagggacttggtgcgacttagccggggctccggcccccgccgctcgctcgccgcagcgttacagccggctctggtgtgccagcgtgtacactcacacacactcacccaaacccacacgctccacgcggggacagcgcggggacagcccgggacccgcagagctgcgcgcacgcact

SEQ ID NO: 1038 - DNA, 24671 bp, Homo sapiens
gtaaataaatagcttgtttattagtaatatgttacattattaaagtgcattgagaagaggtgcaggggccaaagctggaaggccactggccccagccactgccctgggtggccagacacagccggagaagggcccagctcccccctgaaatggatggacagggctgggggcagggccgcctgcctggagagctcggcccaggccatccccaccggaattttcacagtttagcctaagttataacatgtcctgagcgaaggtgggaggctaggagcatggaagcacagcccctggggaagggggctgagaggaagggaggaggccccccgccccccaaccctcaacgccaagggcagagtcctggaacctccccctgaggacccggctcgtccttccaaatgaacacggtgaaactagggctcagttttctccttcattctcccgtttccctcaccccaccccctcccataaccacccccaacactaggggctccaacaacgtccccctcagaccgggctcccagggcagagccagctcatgccactctccaagaacccatgcccgtctccagactcttatctcatccccgggagcctcagactgggatcacccccgctccccaacccatcccttcccagcccctccctttcccacccacccccccgcatgtagttttggtattttcatacagatgcagtcggaagtagctatacatgaaataagcctaacataaaaatagagctttttccgtccttccgtccggaaagcaaacatccttcaataaacatgcaaggcggctgtcctgtgggacccaggaccagagagggagctgcagaggacagggctggacagagggtagccctgggtcttcaggaacaccagccacccagccatgagagagggaggggaaggaggcaatgtgggtaccaagagtccagaaggactcaggcctcagccccagggtcgagatggagtcccagctctcctatccaaacccactccccgacccatgggctcttgggctgggagcatcgctgcatttagtcaagtttgaggagtctgaaaaatattttccagaagataaagtcttgggtcatcgatgccccagcttcacagtcggtgccctcattctcagcccctcaccatccgtgcgccacctggggcccagcagccgcctgcggctggacgtctccaggcctggcatcctccactgggttattctgtcccctggaagaagtggcaggcaaggagctcccgggccagccggctctgagtgtgagacgttctagtgccctgggctgcagaagcctgaggcatgcccagcctcgggaggccctagtggaccagcaagccaagagtgagtgtgggcagcacccccagccagagggaggcggccagggcacaggcatgacccagcaggtgctcggccatgatgccgtcctcgggcagcagctgccagtgctgagcctcgcggaagtaggagccctcctgggcctcgcagaagtagtggccgtactgctgcgccgtgaggttctcgatgaacaggatgcagttggggctctggtgaccaggttcgcagctctgctccacgttctccttgtggcgccatgagtaggtggcgtggcgggattccatggggcagctcaggtagtagcgagagtttggggccagggaaaccttctgcagtggggccttgtctggggaggcagtggggaagcagccgtgaggagggacaaagagctcccaggggaggatgtgtcctccccacggactgggatcccaggacaaggcttctgaatgaacgtggggaacccagccctcagcgtcctccttttttctcccgtctcgctcatcccaccaagagggctccctctgcaggactgtatcctgccccatgtacctggggcccacaggacaaggccatgtctccctcagaccaggacaatcagggcagggcagtaccccactcattgggccacagccgccagcagggccagatcaggtacctggtttggggttgggacactccttgtgtggctcggctggattaatggattgcagcactgacctggagtgggaaggacgaaagaggatcagcagatacaaggctgcagacctgaccctcctatccttaccccagtgcagttccagcagagaggagggtcccacaagaaaggcccagtaccgccacctcctccagcccgacaacacctccccctctcccatgcccaccttctcccagggacgagggatcccggccaacgtaccgttcggagctgtagatggagatgcagcggccttggtcccagccgcagtaggggtctcgggacatgaggcaaccgtggcagcccccgccatagacctcacacaggtccaggggcacctggctcacctcccactgggagctcacatacagcttcctctggaaggacagcaggattgggtcaggcccgggccccaccccacactcagtcctaaatgtccaggccctaaggcctagaagctcttaaaagaacacacaaatcacatgcaaaggagccctgtcctcagctgcagtcactgcatagcccatgggacgcagtgggggaaggctcacccgctcagcatccagcgacatggtctggatggcagccgcgcggcggaagggctggatctccatgatgttgaaggcgaagctgtgctcctgctcccccggttccaccaccttgtggatagtgcccctgtctgtgtatggtggacagagggtcagtgggcgggagtcccactgaggggccaggcagctttcctctaggccggggaggggtgggaagtcacaactcaggcaagggtcacaggactggtgtgggcagggcgaggagagcgtgactggggaagaatgtgggagcctaagggcagcctggaaccttccaaggctgatccagagaggccatcccaggaggcccaggggtccctggatacggcctccaacattcccaaggctgcacgggaagaacagaagcaggagccccacaccagcaaggtcagtgcggctgctgtccatgcatcacctcgtttaaccctccacagccctgcgaggtggctgtcatcttccccactccacagataaggaaatcaggctcagaaaggctaagccacttgctcaaggtcacacagctggtgagcagcagagaccgagttggaacccaaatctgtcagagcccaaccactcagctgcttctacaactcccctgcctcctggactcttagggaatatatttactttaaatacattttttttttattttggagtaattttagattcccagaaaagttgcaaagatagtacagagagctccaatctacccttctccagttccccctaatgttaccatcttacataaccacggtatatttgtcacaactaggcaactgacattggtgcattactattaacaaaactacagactttatttggatttcactagtttttccacaaatgtccttcttctgttctaggatccaattcaggactccacgttgcatttgatcttaggggatatcttaattttataaaatcttagatctaaaaaggatcttggattctaaatcaagagttcccaaggtcttataaccgagctgcctgcctcctagaccaatgctctctccgttcacaattagggaccaatgggcaccctgacccctggtcctcccaatcctacctcacctgctctcccagtttctagaatagcctacctccctctctccctccctcccaatttcccagggcatcacctgccccaaaaaagcagtcagatgattgcctgcctaggatgtttcctctacacatccgtgatcctcatctgtggactctgagatgtggccagatgctccttgggcctgataaggccccaccccagccactgccttcacagacatactgccctatacctccttccaaaccagccccagtaacagcatacccttggcaaaattctcaggaaaagagccaatacttctcccagttgtgagagcctcccattctctgcagaggacttagaaagctctatttttcagtctagcccaaatacgaatgatgcaggctccaaaatggtgcctcctccactgcccttagaacgaagacaccttctctaatcactcaagtgtgctcacctcccaagtctgcaggaagggaatccatggcccaagtccagccttccttgtcctagctcctgctcccagttccgcactgtgtgacctctcctcttctgctccccagtgccctgccatccctggctgaccacaacagctgtgccagccactactggagccaagcaaggatgggggcccaagggtgtagccgggatgaatagggagtaaagaggcagggaatcaggacccaggccctgccctgtgggaaattcctctccccaaggcttccaggagccaaacaatggtgctggggttccagtttcctacaaggtcaccaaagccgagacagttccaaggtgaagcagcaacaggagatcacatggggaatgtgaacaactgaggttgggcgcctgggcctgaattgaatggccccaggggtgctagaggccctttccagtctcaaggaaggcagctggcatgggaagctgcgacaaacccaactcaggactggctcctccgtgtcctgtggctttccagaaagcaggagcatctcccacggcattccacccagcttcccccagcagggcctactccagggaagaagagaagctgcccctgtcctctgtgagatggcaaaggttctgccccctggaactccttcctcatacctaatttgtgccccatcaactcctcaaatgtttcctctcacctgcacaatcccaaagacaggcgcagggcctgactccctcattctgcctggcagaggccagtatccctgtggttcaggcccctcctcctcatttgccacgtctcttcctaccatcttcttccctgagtcagacatctggaccaaaggtgcacctggctttgctcagactctccagatttccgcctccaaatcccagtgcttgcttttctcccatccccctttccctcttgcccctacctcctccaggaagctctccctgcctgactcttccacacccacacacattaacccctgacaactccagtcactcaattattccttccacatgtaaagatccaaccagatgttaactacattattccttacacctttcatgcccgtttttacaaagcaaactgagggtcccggggtagcctctcacctgtagttaggtaaagcacatgaaaggtctccccgtggctggcttgcatgcggtggacggccactttctggtagtggtatttagagtggaacaatggcgtcttcagaggccccatgggctccaccctctgcgccacctctgggtgacggtcagccacctggaaggtctctgtgggtatcggctgctggtctgggaggcactgggcaaggagagcaggcccaggtcagtggggtggtgggaggtgaggcagaaggagggctgggcctgggccacggctggtgtcacgctcaccttgccaggccgcgggttgggaaggcttgagtggtagcccttgagtgaggaggtacggaagaccttgtcaatgtcaccgagggaatacacacagacggctgagtagttcctgcagtgacatggagaccagctcaatggggggcccagaacccacccatccacctccactcacccaggccagccttgtgcctggcactgagttgccaaccaccactgaaaatggggagggatggagaggaggaaggagaggagttcagcctaatttctttgtgctgcaatttaaaaccacaaacttgtatcctgttacagaatcactgagtctagaggccatctgctctacccaaccccaaggcaggaggaaccccatcataggctgagcagttctctagccctccctgggcacaggctgtggggtgctgatgccccaggaggccagacccccaaccccttcccagcctgggggaccccactcacccaggagccacagagcagggtcttggcttcctccactctatccctaactctccccacacacacccaacacttccgcctgccgtgtgttcaatcaatgagagtgattaagaagtgtgaattatcgggctcaggcagtgcctgagcaggtgtaatagcacccagctccccgagagatgcttcagcagcttcctcctgggcccagtgtccactctcggcacaagcaggtggtgggacacacaggcacaagtgcagtcatgagtgtgcatatagggcatgcacacacacccatgagtgcagactcactcacacaacagtacatacatcgcactggctgtccccccaccccacacccagcaacagcccagcctcttgagcctgcagcccctgctcctgccacaccagggaggccctcagcagggcccaaggcctcctgtccctactggacactgaaccaatgccagccccggccccaggacaagggccactcaccaggggttggagaaaacaccatagaccctggtgtccctccactggccgctggggtcagggagcaggaagacgtcttgcagcctgttgaagttcttgttggtggcagcatcactgcataccagcatggctttcagaaaagtgttccacttggagactgacagtgaactttccccaccctggtccccctggaagggtagaggggagaagaggcccctcagcacctgcccgggcttccccacacaccccaggaaaccactgccagcaatatcaacacctgggcccagaggaggaaggcaggctgtgaggggccaggacctgccgggggtgccccaggactcagggcaggtctccagatgagactccagcaagcaggcctggctgatccagagcccagggccagcagtgcccagggtcagggcaggtgagagtgccaggtccccacagagcagacggactcagacacacatttactgactcacacacccacacacgtggcacagcacattcacacaggcaaaacacacacacacacacacacacaccccatcatacacacgctcacacgccatcatacgtgcacaggagctcagccacctttacccacacacagacacatgatgctccatgcacacacagctgctcccacagtccctgacacagacccactcatacatccacacaacttctacatgcacacggacacacagaactcaccctcactcaggcctattcatgcacagacacgtagccagcagccctcacgcccctgctcaccctgcacaactgggccacacgggacacattgagaggagcctcaggattcttgtcaggattgtcctctcggaagaagtagtagatcttgtcatcgtaagcctggtcttggtgcacgatggtggctttgatgaactgtgggtctgccagggacagaggcgagtgggcgtaaggctgggaagcttgcccgggagaccatcccaaccctgcacactctcctccctccttcgggtctgcacaaaccatggcaaatcagatctggaataggactcagaacatcaggtccaactccccgaggggccctagaccctgcacctccaccccacacctgttttgccctcttcctacaaagatgtcatcggcccaggagcaatgacttcatgcctggggactgggggaaggtccctgggggcccctatgtcacttctgctcaattggcagagccctgatgaggagggagttgggggctgcctccacgtgaactcagcagaggataaactttggctcctggggaccctgcactgggtctggggctccctctgtttgtgttcctgaagagggctgggcccatcccactgctataccttgtctgttcctctgctcccagccaaccctaacttctcaggcctataccaaggtcctgctttcctgcatggccccagcggccctcagggagccctcccagaaacatcaggatcccatctgccaccttaagtgctcacacccccttgcccaccctcagcccagccggagcctgactcactctgcatgacagtatcactggtgtacagctcactctcgccccggatgcggcggaaccgagggatcttcccattgtattcctgcttccggatggtggaatacacctcgtcccctggggtcagtgggagggagaaatgagtaagggcaggcagctcctggaagtccctcctccggacactggacaaagagctgaccactcctctcccagcccagttcagaagcatccccctggggcgcctgctccagcactgccctaccttcaaacagaaccagggagttctcgtccgggctgaagggggcgtagcctctcatctcgccaagtggcaccacagtgccattcacctgtgggagatccagagggttggatggccacataatcccacagccactgcctcccatgacggccagtttctcggccaggagccccatcctcccagggcaaggccagcattggagtctcgccatctccttcccaccatgaggggcagaagcccacgcagtagaaggtgagctgatcaggcacatggggagcagccttctcaccaggttccagcagctggggtgccgggcgttggtgccacaggccagcagcccctcactccgcctctccaggagagtgatgtagttctcgcagtcctgcccggggaagagagaagggaggagagaaattggttgctggaaggccctggcaagcctagcactaggacccccaggatcagggaagaaggtgtcagaagggcttagcataggtgacagcctcccgggacagcccagagtgtgtgcagctgacgccatcccctaagcacagaggaccacgtctccccatcagtctgggactcgtggggcagggccatgcttccttccttagaccctcagggtctcctctccctttaccaagtggctcagacccctccataccccctcccccactcacccgcttatccagacaggacccctttgtggagccgatattcacctgggggaaggggagaagcattagttcaatctgccaggggtgaggtacccctgaaatgctttccacacagcctcaggataagccccaaaggaagcaaccattattctcatctgacagatgagcaactggggctctgagagggtgagtgatctacctgaggtcaaacagggtctcatatccagagctgaggcccagagggttcagaagaccaggcatgggctctggggcccagcttccagcctgggctttccgcagcagcgctgcccagctggccaggcccattagctcctgtttttctccacaccgccccagctccccactccaatctggactacctttagggagcctcccccaggagccatttataggatacggaggtgggggcagtttaggaagagaagccagctccctcggattccctgaggacccttggcagggccagaggggagataagagggtagggggggtgttgggggaagagagaggctcaccgtgcgcacagatgcgttcttgccctcggggaagtcaaagaggtagaccttgccacgtcctcccacccacacagaggagctgcctggctcgtggaaaagcaccgtgtgcggctcagtctggccaaagtccacccggtcctgccctacatggcctgaggaggagacaattagtagaaacattgaagccaggtcccgagagagaagactctgggtcccctccacatggcacactggaaccagtgcttggtgctcagggtcctggcagggcgtcagacaagctctgggctggggtggtacccagactcagagagtcaaggacaggagaagtaagagatcctccggtgggctccagcaaccagctgtcctcacccacagcacggcccctcccctagtgtggcagcctctccttccttcacagtatgtgtgatctcagagtggggaaggatttagggacctcttgggggaacagaccccctcctctggcacacacttttgagggctgggctaaggcaggaggaccagggctccttggccatgctctgggaggttctctgctgccctaagccaaagcaagcagcgccccccaaccccgggcctttcagcaggcagcagggccttcaagcaccccccttggagtccaggttcccaggaatcacaatgctcagaaccccttctcctccttcaggaatccctctccaacctctcctggcccatccccagccccttagtgagcactagactagaggaggaaaggaatctcaacatctactccgtcccatttcacagatgggaaaacagaggccaagggaggggcagcccaagggcacacggaagcaggtcagtagcagaccctgaaccagagcctgcactcctgcctaccaagctggactctattccatggcccactctggcctggtttcacccatgaggatgctagctctccggggggtgaagatcggctcttcctccccagcaactctgggacaggggaaccttcacagagcacagcctgggactttcagcagaagggctgaccgggaaaattttccccaaaaaagaaactgactgcagccactgcctctggggaggtgtctcatctccagtgacactgctgaggttgtcctggttgcaggagtaaattatagggatgggatggcctgtggttgtgcccccagcaatcagccacacccagcatcttcccacctctgaccagcctgggcctcacctaggaactgggtctgaccactgttttttcagctgcaggaaactctggggcagccagcttggcagtgacacccaagctccagctctgaccaaaaagaactaccatttcctcaactctgcccccgatccctcttattcccattggagccatccctattgattctgcatttaacaggggcaaggagcagctggaccacacactgtgccaccacaccttcattctttaagaaacatcccttcatggccaggtcacccccggaagtgagcattcttcacctcttctgtggcctggcgcactgtgcagagaagaatgctgaggtaccctgggagacatgccaaggtcacaccagcaggcaggacacattagcttgtcccaggctgcagtatcagttctcagcagcatggcaggctacagagagaagtgctgagctcactgtccttgggtggtgtggctctcctggtgcacatcacaaacagcccaactgaacagctccggggatatcagccctccctggcccccaagcctccctccctgtaggcccgagatgtgcagagcaagggctgagaggtactggcacttcggtgggagggagggagagctggcaggtcttgggtgctgccctgctccccctcccttcctgggataaaattagagtgctggggtcacagacacagtcttcctgactcagctcccgtaactccccttccacccgcagcccaaactgcagccaccatcctctgtggcccagccagagatccagacagtctgccgccccaactcccctcctgctcccctcccatccaccgatagccagactggcagccaggaaaaggtgcgtgtctgcatctagagatgctgggctaggacctgagatccatagtccctgggagtcaaagcagaaaagttctagccgtcagactgtgctagccaccttcatcagtcaccttagccccactcctgcaccaaggccacaggcccaggtctccgagggggccggcaaggccaatgtacaactactcaagggaaaagaggcaccagacaggactctgggtgggggcaccctggtctaggaattgcagggctgttgaagagaagaggaaaacagtcctgccctggggagtcgagcctgatggcagagacatgactgggtcctggagagcaaggtctgagggggaggtctggccctaccctgggaatacatctgaggggtcagacagccacaccacagaaaacttccacagctctccagcaaaactgtcttagcatggaccccagggctgcccacaaagtatctgctgaagacatgaagggagggtgagggctgctggcccctgggtaggagctgcagcactagggcccggacaatcccatgcggatctgcaagcctgagcccagttcccttcaaaccctagccacaatggctagggtggaggaagcagggactgttcgtcccattttgcaggaaaacgaacaggagcccaggaccacggcctcccatgacccccaggttcctggccctcccacctctgttcttggtgatgcgtatggactagagggaatgacaccagctcagccccaggacaaggccttggcccattctccaccccagccccagcctgggctcccgcaccgcctgaggccctcaaaaggcctgattgtgcccgggaagtgtcgagcagcagcagctcgatgaatacatgaaaggaagctttgttcaggttggcaggagcgggggctgggggctaaggggcaggagggctgcctggaagtgaaggcagcaccaagccatcagggccaggcctcgagtctctgcccaggcaggggctgagcaaggccaggggctacccctaaaaaggccaggccaagggagtatgtatcatatccctgaacattttctttgtgatgctttatgaacccaaacggagaggtgaggtagataaaagctggatgggccctgaacaggccgggagggaaagccaggcagaggacgcaacctgagcaaaggtggggaaggtggctgtatggaggacagaggccatgcgctgcagcctggcagagtcctaatgagaagaatcgggaaggtgagctgaggcccacgtgtgatgggggagggaagatgcagcctgtccaaggacacactgacccactgcccaccactctcccctgctgcctgaacctacgagcagggccaggagtggaaaatgcctccccatcctctggcgtcccccacctcctggctccccctgcttcccatcctgcttgtctaaaaggagcaccgtctggcaccgtgtccccccctcactccccagcctgacgcattagtggctaagtggtagctaaaagctcccagaataaccaggggctcaggtaggggagggggctagggacatatggggagggcatagcccagaggcaggccaggaacaagacaacccacctcccgccccatgtgattccgagccaatcctcactcgtgctggaccaagaaagcacattcaggctgccccgtacccagccggactccatagttcccctgagtaccatttctcatggtggcagggccagcaaggcccagctccggccagataggagggctgcaaggatggctgggttgtaggagataacctccaccagacacagccgcagggccgggtgctcacagggctctgatcccattggaaagaatggggcctgactccttagggaccctaccctcgatcaccaccccagcagctgaccgactgtggcaagtctgggcctctggcatgcatttcctaactcaggcctgcctggtggagcacgtttcctcttctcattcactctggtgctgtcaccgtctggcccgctgtccccatactcttgttgtttgtgaaagaggagtgcagctccaggggagggcagagtgggaggtgttgttgtccatgaaggggctgggtcccatgctctggtctggcaaagccagccttgcaacctgacccactgacccagtgggccttgaatgtaacctcaaggagccttttgaaagtgggcagagagtcaggctctgaaaatggcaggaatgtgggcacccccacagagaatgcctaagtcaggcagtcagagaggccccgggccaaagagcagaaagcaggccgacctcaggttggagagccagcacatctggcaggagcgtcctcccacagttgtgcccccacccctgcactgccaggcctacctcacaccctcgcccaactacgtgtctggaaaagagagtagagggaaggcccacgtgatgcctaggaattagcctgcagcctctccaccctttggaatcccacatccacatgtcaaggtggaagggagaggatctaaacagtcattgaactgaaggacacagaggccagagaggctgtaccaccggcccaaggacacagagcgagggaagctccaagtttccagtacccattacccagctgcttctctccaggatcacatcctgggcttcctggagagcctctgatttgcaaaaagctgtatattcagcctctccctacttccctgaatcatccctactctacccttccctctcttgctcactaggtgccgagtcactaacctgataactaaagggaatcacccgcccacccaccttccaggtgaggccctgatctcctaggggcctttagtgatcaaagccttaaatccaaaggagtgactaatggtggaagtgtaggtgccgtgcatgtcagagtggtagaggaaacccttccactaggggtgggaatacaggaacaaatgtttctgtctctcctgatatggccaggaagagggtgtgagaagcctggtttccagggtggcaccggctcggtgctaaggataggtcatggttgcaggtgggtcctggcaactctcaggcagggttaggttctagattagctagtcgcctggcaggggcagagcctgtgtgctggggcaggtggtggggcctcgagacagcactcagctcatggaggactgagaagtctaacttgtttatgagctatgagaagagcgagctgtgtgctgggccaaaggggagcatcctcccacccaccaaggtcagctgtgggtgggaggggagtatatctcatgtgtggctcagccctggctccaagaagcctcattatctctttggtggctggacagctggctggctgtgacggtgattggggctgggccttcctgggttcattttcctccctgtggattagctgggtgcgagtcagggtgggtgctggtacttgtttgggcctgggttttatgacccaccaggattcttgaaacaaatcacaaaacaatcagggtgaagtccatgggtctttttgggaaagtgtgactctctgagtgccagagaagtcagacagttttctggaagtggaggcagcagaagaaactgacattctcatctgcttccactgaccagcccaccaaacctccagccaccctgcaaagaaggcaggacaacctgtattgccgttttacaaacaggaaaactaatgcccttccaagccaccaaggtctggatgctctccccatggcaccactgtgctcaaaggaccagaagaaggtttggctattggggagactgtctggggcaaagtcctagggagaagggacagtgtggaaagcaagccccttggtgagaggctgtgctgagcaggattcagggactcagggaaggaaggctggcactgaggcccagctggagtgggtaagatgccctgagcccacgcccagggaaggccggaagcccaggacaaacatcatgtcccatctaccttccagctgttctccagcccagcaggttccaaaagccccagagtggggccgaagtcgctggtggctccttcaaagcagacaaagggtagcggtgcagggcctgcccttgggcccacagccagggcaggggtcggggagagggcggagaatggctacacaaccccaagtggagggagggaggcaggtggaagactgctgagaaacagaaggttccccagtcttagccttagcctgaaccagcaggggagactgagcaagggcagccagccagcaaagcccattagggagaactggcaggggctgggctgccagggctgcattccatcagaaaccagagatgccagaggaggaggaggaagatgatgacgacgatgatgatgcccctaccacccaacccttccatcgcatttactacgtgccaaacactattccaaatgatttttagatatattaactcatttaatcatcactgaactctcatgaagtaggttcttttattatccccattttgcagatgaggaccatgagacacagagaagctgagtaacttacccagcattacacagctagtaaggggtggagcagaggttcatactcaggcaagctgactccagaatctgtgcttataacatcgtattccagagatgagcccttggaggcttccaaggtcagcccttcccagacagatgaggagaccaaagcctaccgagggtgaggcccagttagaggctacttggctaatgaagtcctgacctctgcccgtaacaccctgaagacagtgtgtgcaagtgagcacaggtgtgcaggcccaggtgaatgtagtgaattcctatgctttgatgttgccctggcatccgttttgaatataagctgggttttctcacactagaagcagggctcagtcaaccttgacaccgtttccagctccccacctcctcccagttcctccatgtgctcaatccagatatctaccgtagacagtcgtctcctggtgactgcttccctgtgggatggctacatacagcccacttgattggtcctgctgaccttgtcccacagcccgcatggactgtgcagataggccagtgaccttgtctcaagtcacaacatgacctcctggaactcatgactgcttgctgtaaacccaccaattaaaactccccatggaggccaggcacagtgggtcatgcccataatcccggcgctttgggaggctgaggtgggcagatcatttgaggtcaggagttcgagactagcctggccaacatggtgaaaccccatctctaccaaaaatacaaaaaaattagccagacatggtggtgtgcgcctgtactcccagctacttgggaggctgagacagaagaatcgcttgaacccaggaggcagaggttatagtgagctgagaccacgccactgcactccagcctgggtgacagagcaagactccatctcaaaacaacaacaacaacaaaacaaactccctgtggaaaacttgttttaataacaccatggaccccataaagatgctggcccatagatccccccaccctgcacatgctccctgacctccacctgtgtgtggcttcaggtacaccaggtatccctcaagacctgttagtaacaaaatctttatttccacctgcctctctcttaatcatggaagaggtgctctccatcttaaagatcctaagttacaacagtggggcaggaatcttctcgaggtgcagcgtggggccccggtcctgagtgactgattagaaagacaagtctcccaagatctcgctcagaacataaagtactctgtggggccgggtgccatggctcatgcctgttatcccagcacttcgggagaccaaggcagaaggatcacatgtgttcaggagttagaggctgcagagagctatgaatgcaccactgtactccagcctgggagacagtgagatcctgtctctaagaaaaaaagtactgcatgctctgaagctgaccacagtgaagggcagagtgtgctcaccagccaggtccccactcagccagccctggcgaaaacactcacctccactcctcagctcaaggacccaccatggctcctaactgcccatccaagcagggcccaaaacctcagggcagggcagtcaaggcccacctcatctctgcacagctctgccatggctcatttccatctctgcactttgctcctgttctcccctccctggattgaccttcctccttttctctgtgcacatggatcttacctgtccttgaaaatgtagctaaatcccttggatccaggaagtattccagactgctccagccctcactgcccgtaccttcgaccttgtaccacaaaccatctggcaccaccatcttcgctcagatcatgctgtctgatgggatttcatctggcctatggggccctgaaggtgaggaccaggcttcctcttgctccaagtcttccattcccagggagcagctcagacagtggagagaagcaagactggggcaggccaaactcccatgccagagggacaggtatcttagaacagattcctgggccaccaatggagtgcagaagtcatcacagtgaccttccttcctcgacaggctgggccagagctcctgcctcagcctcccaagtagctgggattacaggcgtgtgccaccacacccagctaatttttttgtatttttagtaaagacggggtttcaccatgttggccaggctggtctcgaactcctgacctcaactgatctgcctaccttggcctcccaaagtgctgggattacaggcgtgagactctgtacaaacaacaatatgaatagctgtctatgctgcactctgcccccaccctatgctcctgcccctagctctagcctggctcctcctcctcccccaggaagccttccttgattgcaccatcccacactgacctttcctgctctcacctcctgtcacagtcctaggctacatctgcaggtcattcctgacctccccaggggtccgccctacttcacaggcagaagactcacctctccaggaatgtgggggctccccaagggcaaacccagggcttctcttcctgcctctcccccagaggagccgaacacagacctaggctggctgccctccatgatgaggggtcacccaggggtgctggcacagagcccaagcctctggctggaagcatggggtgcagaaggcatggcaggatcagcataatcccaggctgtcatgacagttaaaacctgattagcccgagccgggacacagatcaacctgtccttgggacctgaggcccaacccacctgaggaaagaccagaagaggtatatggagctggtccaaatccaaggtcctgaagagaggacactcacagctggtgtggctcctgggaacagacagcactggggcgggaagagtctgggcccaactgggctagcagaggaggaaaggcactgaaggggcccccagcctgggacagagtatgatggcagacagaaagctggaaacaggctgagagctggggcagaagcaggctcagacgactcagccccggtcccagctctgcctctttgggtgatctcgggccagtccctgtcatctctgagcctcagtttccccatctgtggaatgtttggctggcccagctaatctctgacatttcttttctgacatcctaagctcgcgctgtcaggctgtgtgggttggggtcatccaagaaggttcctcagaggaactgagaaagaaccagcagcctcctttctgggcagaaaggaggaggagggtgagtggggtgcagagaggaggcggagccagggagcagtgagggaagaactgtgggagtctaggaggcagtggggccaggccaccatgcagggcctggggaaggcggcagctgtgtgccatgtgttctggatggggtgcagcatagggacagaggtcctccgggaggctgggcacagatctggagagatggcaaggccagggccagggagaataaagggcttggagagccaccccataccattcggggcagagaggggacagtccctcaaggcctggctggctagggaagggggaactctgtcctctgaggaggcagggcccaacaaggtgccgtggccctccatccccctgctttctttctggcctgcctggttccctgaggacaggacagctggccatacacctggtggctggccctccctgcaagggtacggaaccctggctcttctgaaggcaggacaggttaagggccccttcctcccccaaccatggcgaaggaaggctcctggggcagccacgctgggccaaaaaaggaaatcaagagaagtggaaacttttcagtccagagctgccgaccaaagcaggggaagtgcagtcagtctcttgtgacagagccgtgtgaagctgggggtggacaggctatcagctagtggcccatctactccagctactgccccctgagggctgccagacctgccccctgggctgagcttcacatcccaccttgcttggccctcctcaaaaaacagagcccagctttccctgcttcccccagggcgccaccctcagcccagatagtgacctatccatgccacccccaccctgccacctccatgctccttccatctctgcagaggaagagcaggagaagacagagctgagggacagaccttctcacctggagactgtcctgcggtcaggagtcaatggggaaagccatggtctccctggacccagagccagcctcccaccagggaactgtgacggggctatggccttgccagcactcgagaggccttccctgcctgccacggcccttctccagtgggtgcgtccttcctcctcactgctgcgccagtcataggatgacaggtatcccctcacctatgcccatctggacaagtttcaaacttttcgggagcccccaggcccaggctgactcaacgcctcttcacatgggggcccctcacatggcttctctcctctctgtggtcctagctgtaagttcttgggtttaaaatcctactaagtggggtgcttcctcctgttccttccctcccccagctggctcctcctcctgccatttcagcttgctccctcttccaggaagccctccctgattgggaaaattgggttaggcatctcctcagtgcccataactgctctctgttacacattctgttgtacctgcaggtttatctgcccatctacatctacactgagaagtctacaagggcacggaatcatcttgttcctcatcaccagatccccaagctcatccccaagaccagcacaagggtggccccggcaaatgtttgctgaatgaatatgtccacccttgagggcacatgctgatgatccatttcctccaaatgatcctcagcctttggcccacgagagaaaaagataggaaagaacgcgaacttaagggtttcccctgacttcccaggtttcaatttctcctccagatttctcgaaatctaagatttaaacaggccaccacagactctgcccagcccctcccatcccagagagagagaaatcctaagacattaaatctcagaaaaggatgagccccctcccctaccctctttgggcatttggggaaactggggttcagtaaaaggcaaagacttgcccagtcacagagcaaattaggtcacagcctgaaccaggctcccgacctcccagctctctcccctataccatggtcatcattggacctgtgccagcgtccattccaccggacctgctctcagaatcttcactgtccaggacagaggggtcacagagcttggtaggaagctcctggtgacctcaccaagcatctctcttggcttaggaaactccccctctcctccggggaattgcccccccaccatgagactctgtggagggagttcaccttgaaggtgatgaacacatctaagtccccaagggggcaaggatttccactggaaatgctgatgcttgggaagccccagatgtgacctcatcccctggaggaggtaacaacaacctcctgccctggggagcagccccagaatggctccccagcagccaccaagtcaacaataacatcccgttgtttcactggacaaaagcgagggagggcagaaccagccgggcaggttgagactggggatatgggttctgtttccccatggacaggctggttcacctctgaccttggggttccaagccttctttagctcctccaaccactgataaaatggaagaggggtgcacagcttacaaacgcatgccaacctcctgctaagccccagccctcacctgcaatctactcccttacagttcctgcttacaggaagatcaggaccacacatgcacatccttgactggcccatgtgtcagtgacagcccttgggggacaatccctacagcctttcttgctctggcaggctctaagggtcaaagacaagtgtggagctcaaggacacccagcaggtacatgatggcccatctctctccctggcctgagctacgctgtgccagactttcatcaagctgcagaggcagcaatctccctgatcagtgcaggctgggcccctctcagagttccctgctttaatctttctctagaacttggggatccaagcagcagaaaataaagaactttccatacctattccagtccccacagctgtcctgactcaaaactaaaacccccatctatgcctcatagagaaatggctccagaaccaccaccatccctgattttgtcattcctggataccaccatactcccacccaccactggtagacagagctctaggcttccagaaagaccccctcttaccctgttcctgggtttgtcctacccaagcccattcctgtccgattgccatgtgtcaccccacaggagacaggaggcagctgtcagtcgggcacaccatcaccagctggtggccctgggggtggggggcaggtgaatggcagggcctgtctggccagtggggcacctggcactggtgaaggagaccacagactgtcgttggacaagactggtgaacggttggcagaccccagccagcggggctcaacagtgcattactaagcagagggcacagccagtgtggctacagcagtgaactgcgggcgggggggtaggccatggagctgtgctgggagcttcgaaaagtgggtaagaggactgaaagcaactttaaatagcctcagggtgggaactaagtgcccaggatgggatgtatgcattaagtgctaagaagtgggtgtgcattaagtggggtgggggtggggggtcatgggaagactttgggacaggcaaacagagtcaaaatgcaaggggtttgatggagggaaagattccagaacactcagatgtggccatttgtcccctccagagtgcccacacgctatgatgtccaagacagccaaggagactgagggaaggcaaagctgctgggagggcaaaggaagcttgggctggagctgggatggcagaggggtgtgcaggcctcctccatgtacaggcggccggagctctagcagcactgctcggcttcctccaggagcacctcaggctgggtagccgagctggtccccagagcacctcattcatggtccctgaaccacctaaatccttctcccctccctaacccagaacctggactggtcctgtgccagatcagagcccctgcctgcacctgggctcccacactgctcagtgaccttgggcaagtcacattccctcagctactgcggcagttcgggccactcgttttgtgtatggttttttttcccctctgctaataatacctgccccagataatgctcagactcccgcaatccctgcaaactgccaaaggcatcaaaaggctcccggtggggccagacccgaccagttcccccagcccccactgcgagtcccccaccatcacgacaggggggccgcagacacgccaaatttggggacagagccgaatcggactgggggcggggaggcatttgtgtgcaatgcaggggaggggagatcagttcctcgcggcagaaagcctcaaacccccgcctaaccggctttctgtcccatagtacagggtctaaactgaggtgccctgggggagactccagtcccccaggttcttattatctaccctggcctaaaggctgcacccccgccctagatccaccgcctgggggtcccaacggccgtgccccacccaacgggcactgccccccaacgctggagccgatttctggtgacaactgccacgtgcgggcaaggggggagcggccggtcccggcattgctgaggcagcgccctggtaccccaagccgccgcaccgcaccatgtcccgccgctcgctgcaggatgcccacccccttgcctggcccgagctccgggccggggcgggggcgggggcaggcggcggggtctttgttcccgctgccgaagcgcggcggcggcggcaaggggtccgcgccccccttgccggcccagcctgcgccccgcgcgccagcagagcccgcagctcaaaaggagggtacccgggttggggtcccaggcggggaaaggtcctccgccgaagcccccgagccagaggacccagagtggctcggggccgagagaggggcccgccccctcccctggcgcccgggcgttgcggctcctggctgccagggacttggtgcgacttagccggggctccggcccccgccgctcgctcgccgcagcgttacagccggctctggtgtgccagcgtgtacactcacacacactcacccaaacccacacgctccacgcggggacagcgcggggacagcccgggacccgcagagctgcgcgcacgcactccctccgggtgcagcacactccgcacccgccccgcgcagcgtctgatcccgcgcctgaccggccgcgcggcgccgcctacctttccagacggcgaagatgcggggtccgctccttaggtggccctgggcggaggcggcggccgcccagagcagcagcagcagccgcagccgcagcggaagccccaaccgagccggcgggccagggacgcgggcgcgcggtgcgctgggggcggcacgtccgggcggaggaggcgtcatcccgtggccccgggagcgacagcggcaatcagccgagact

SEQ ID NO: 1039 - DNA, 24671 bp, Homo sapiens; identical to SEQ ID NO: 1038

SEQ ID NO: 1040 - DNA, 20029 bp, Homo sapiens
tagttgcaaagcttccggttctgggggaaggcgtggcttccgcgctctttgaaatgtccggcgccggaatgtctgggtgctttggttggagagggtcccatttccagtcattcttcagcctggtgattcccgcgctcccctgaggagcatatgaagtacgtcggttctgccaggttggaacgcgctgctggacactcggccgtaaggcggatcccggatcccctcccactccgacccttccctccagaagggccggttcccaaacggcccctttagacacatccaagcggttgccgacggccctcacgatgaaaactgctgtccgttggtgaaggcagcctcttctgtgctcctcgccgctgacttcctgaggcggacctacctgtggaggcataccaggaaccagacgatgaccccctccaaaagttgggtctttgaggagagctactaacttgggttcctggtacaccctctacatgcagtggtgaagcttatctaacagtcattcatagaatcagtttgggaaggggaattttcactgaactctcatagagaaactgtgttttagataacagaaagttctgcacggttaaaatggaacagaaatttttttgcacagaaattaggattaccgaaaatactgaagaaagactacctctgattggactcttctcaaggaattaataattcaagaactaaggaaagaaaaaagtgattatatgaaaatactgaagttgatcgtagcagctgaaggctgatcctgtgtgggtaaatgtaaacgctgaattcccacattccaatgtgcgacctgggattaaggcagcaattgagcagggtaatgttactgaggagagcgaacagatcgcaggatctcagaaggcctaacattaaaggcagatcacccctctgttctcataagttatatggggagttttgaaatggctttcactgtcttcagggagtttatcttcaggataactcccatgtatgttgtgggcgcattaggaacccatggctgttcccaaagtctccctttcccatcctacccatttttagatataccccctctttcagtaatccttcctaactagacttctttagactccttcctctcctgcctactaagttacttgcacctgagctccataatttatcaaaattatatattgtgaatactttcccagttcatgattttttttttactcttaatggtattagataatttaatttcattttaaaacttttttttttttttgagacggagtcttgctctgtcgcccagattggagtgcagtagtggccgatctcggctcactgcaccctccgcctcccgggttcaagagattctcatgcctcagcctcttgaggagctggggctacaggtacctgccaccacgcccggctaatttttgtatttttagtagagacggggtttcaccacgttggccaggctgctcgaactcctgacctcaggtgatcccaaagtgctgggattacaagcggtagccaccacgcccggcctgaaattttgttgtgatggttagtgccttttgtgtcctatgtaagaaatctttgcctgccctcgttatgaagatactatcctaggttttcttctgtgttattttatctttcacatttaggtctatgattaatttcacattaatctttgtatatgataggagttagacatcaagattcatctcttccatatgggtgtacaattgatccagcactatttaaaaattttgttcccactgaatttcagtggcagctttgtcataaatccggtgactatgtatgtctgggtcaatttttgactcttattctgtgccatgggtgtatttttctgtcattgtgccaatgtcacacgtcttgatttctctaactttagagtaggtcttgatatctgctagccttttggctttaagaggggcatggctattctatcaccaatagatgacaattgttaactttgttttatgcttctaaaagtataattttactgaatcttaaatatgtatattcaacaaaatttagattacactgtacatttgtttagtaatctacatattttacctagcttgaatatttcccctgtgctcaaatattcttgagactttttactttgaaataatttcaagtttacagtacagttgcaaaaatattacaaaataatgccctcatacccttaacccaaagtccccagttgttaatagtttacatttacctcatcattctttctctctcactctctcactatgcatattgttcttttgtttttccacccgatccgtttaagagccaattacagacattacccaaagtatttctgtatttcctgaaaacaaggatatattctatgtcacagccacagtacaacccagcaaaatcaagaaattaataaatacaataataccatgtaacttacaatctcattcagctttcatcaaccattccagttgggtggaggctgatcatctctctgccattttcataagttatgtcatagattttcacatctgtcacatcattcatttctccaaagagccttagttccttttagtaaggaatggtatttagaagccaagtttggatgctaggtgtgtttattgctactgagatgtcattatttccagtctatttcagtgactagacctagcaaataaatgaatattgatatacacacccattcatctatatttctatgaaatatatttaaatatgtgtgcatatagatgtgtatatgtatatatagatctatgtatatgtgagcatatatatgtgcacatatatcaaaatatatatgtatatataaaatatgagttcacaccaatacctcaaattccaatccaataccacatattttcctctagtcttcctcttctctataattttacctcccttctgcaatagtaggaaacttgattctcattttccacaatatacttgtattttctcatgttgacattcatggtacctgatatggtttggctctgtgtccccacccaaatctcatgttgaattgtaatcctcaatgttggaggaggggcctggtgggaggtcatgatgtttggatcatggggcagacttcccccttgctgttctcatgacagtgagttctcaagagatctggttgttcaaaagtgtgtagcacttccccctttgccctctctctcctgctctgccatgtgaagatgtgcttgcttccccttcacgttctgccatgattgtatgtttcctgtggcttccccagccatgcttcctgtatagcctgcagaactgtgcgtcaattaaagcacttttctttataaatcacctggtctcaggtagttctttatagcagtgcaagaacagactaatacagtaccataacaatggagcctcctcttcaacttgattcttgagtccttttgacataaccctggaggtttttgatagctccctgctatctagcatgacaagagttcctagctaatcttgtacttcctgccctaggcataaaaattagccatttcttcaagaaattcatatggttttctgtgggaaatggtatattaagaccacaatctgggcactagggatgcttattgctactgaattgtttgttacttgtaagccacattagtggatggagctagggggagatctatatccatagagatataaatagagaatatttatactgctacttcaaattcaagactacagaggttgggtttggttttggcttttggttttatgggttgctttttgttttgttttttttgagacaggatctccctctgttgcccaggctggagtacagaggtgcaatcatgactcactgctgcctcaaactcccaggctcaagcgattctcccacctcagcctgccaagtagctgggactacagttgtgcaccaccatgcccagctaatttgtgtattttctgtggaggcagggtttcaccatgttgcccaggccggtcttgaattactggactcaagcaatctgcccacctcagcctcccaaagtaagactgcagaattttaatttaatattttctatattacatctttatttcctttcttccacactgagaatactagttctcaagaacataagggacaacagtatttaaatatctattttcatttcctttatcccatatcacatacccaactgtctcaaaataacaatactaatgatactatcaccaccaatataattattgagacgtttaaaaaaatgtttgcatatgcccttctcattctatcccctccattcattctctccattttaacagatgtgctgtatattatctgagcctatactcattactctaccttcctctttttaactctcttaatactacaaagaattccatgtttaggccaggtgcggcagcgcacacctgtaatcccagcactttgggaggctgagacaggcagatcacctgaggtcaggagtttgagaccagcctggccaacatagtgaaacccttctctactaaaaatacaaaaattagtgggggtgtgctggcgggcactgtaatctcagctacttgggagcttgaggcaggagaattgcttgaacccaggaagtggaggttgcagtgagccgagatcacaccattgcactccagcctgggcgacaagagtgaaactccatctcaaaaataaataaataaataaaatcagaattccatgtttaatgctttccactggtttttgttgctgttgttgttgttgttttgttttgttttctgacacagagtctcactgtatcacccaggctgaagtacattggtgcaatcttggctcactgcatctccaccccaggttcaagcgattctcctgcctcagcctcccaagcagctgggattacaggtatgtagcacaatgcccggctaatttttgtatttttaatagagacagagtttcaccgtgttggctaggctggtctcaaactcctggcctcaagtgattcacccgccttggcctcccaaaatgttgggattacaagcatgagccactgtgcctggcccagtggtttttattactgaacccgttctttagtggatttcctggaaggactacaatattctctgtgaatgatattccctaaacttttgcatattaatagcagtttatttctggcctttatgcttgaaaatcagtttgctaaatataaaattgttggctcacattttctttcttaagatatttcattttcatctgatgacagaaatctaattttctttcccttacaagttacttgctcttttcaccaggttgcccaagtagtttttaaaattttttgtttaatttccagtcattttacctgactacatcttggtgctgtttgttttaggtcagtagtctcagttatgtggtattctcttccaaaatgtaatttatattttttttatttcagtaaagattgatttttgaattacaggttttagaatagttccgttctcttgccttggtttggttcttaagaggactcatgttagccatatgttgtatctttgttgtttctcttcaatatctgccacttttctcaaatcttttctctttcttcatttttaaaaatattttttaaatgttcctcctttctacattctacttaaggcatcatctgttgtatttatttcttctgtgttccttttgctttagtcttcattttgtatttattttttattttttattttttgagacagaatttcgctctgtcgcccaggctgaagtgcagttgcgtgatctctgctcaccacaacctccacctcccgggttcaagcaattctcctgcctcagcctcccaagtaggtgggattataggtgcctgccacagtgcccggctaatttttatatttgttagtagagatgaggtttcaccatgttggccaggctggtctcaaactcctgacctcaggtgatccacctgtctcagcctcccaaagtgctgggattacaggcatgagccactgtgcttggcctattttttttcttttatttataagtttctttcctgagttctgtcacctcatttctgagttctccaagttctttttgatgttgtgttttcatatatcattttctttctttttttttttttctgagatggagtctcattctgttgcccaggctggagtgcagtggcacgatctcagcttactgcaacctctgcctcctgagttcaagcgattctcctgtctcagcctcccaagtagctgggattacaggcgggcatcaccacactcagctaatttttgaatttttactagagatggggtttcaccatgttgaccaggctggtatcaaactcctggcctcaagtgatccacccacctcagcctcccaaagtgctgggattataaacgtgaaccactgcacctggccatatcattttcttaatacatttcagtttattttgaaaatagatgattatagtttttatctgttctctgttcacatcttattggtatgcttttattatttatagaaatataattctgctgcttattctcttatcataattttgtatgatatttggcttatatattttctgttattcatttttgtgtgaaattacttttcctatgcttttaaaaagagatgtggttcagggtagcattttgaacttgagagagcttcctcctctattgttttcatgtagtgttaaaaaatatggcagcttgctttctgagattctttagctctattagccttcctaattttttttttttttttttttttttttgagacagagtctcacgctttcgctaggctggagtgcagtagcaggatctcggctcattgcaacctccaccctcccgggttcaagtgattctcctgcctcagcctcctgagtagctggggctacaggcatgcaccaccacacccagataatttttgtatttttagtagaaacgggatttcaccatgttagccagatggtctccatctcttgacctcgtgatccgcctgccttggccccccaaagtgctgggattacaagcgtgagccaccgcgcctggccattagccttcctaatttttatctggatcttctcttttcttcatctttatttatgtctgtcctgatcaattttgattccatttctagcagtttttcctcagtatgagaccctgttctggagggaaaccctggcatgccagctttaggattcacataggccgagctgctctagtcctttaagacgttaaagcagttcccttgcatttagtcactattgggcaaaaaacctcccagtttcagctgttgttcgcaaattagtcaagctttctaatgaatgcctgctggctagttagaggaattcctatcctcagatctgttagctgtagcgttgcttccttctgcttctttctgcacagctgatgatgccacacaagtcttgcagctgccgatagtttgtcctcaccaatttggattttgcagttaatggggatatatcatcacctgatattagtctgtttaggctaatataacaaaatacagactgtgtggcttaaacaacagaaacttattttctcccagttctggaggctggagagtccaagatcaaagttcagcagtgttcaatttctggtgagggctcttttcctggcttgcacatggccaccttcttgctctgtcctcatacaatctttccttgatgcctgtaatggaagaaagagagatcttccccctcttataaggccaccagtcctattggattatggccccaccatcatgacctcattttttttttttttttttgggacggagtctcgctttgttgcccaggctggagtgcagtggcgcaaactcggctcactgcaagctccacctcccgggttcacgccattctcctgcctcagcctcccaggtagctgggactacaggcacccgccatcacgctcggctaaattttttttgtatttttcggtagagacggggtttcaccctgttagctaggatggtctcaatctcctgacctcatgatctgcccacctcggcctcccaaagtgctgggattacaggcataagccactgcgcctggccaacctcatttaatcttaataacctcctacaagcccaatctccaaatcacatttgaagttacactgggggttaagccttcaatatataaatttgtggtgggtagggggcaattcagtccatagcacctaggtttttttttttttctctttttttgagacagaggcttgctctgtcacccaggctggagtgtagtgatgcaatcctggctcactgcaacctccacctcccgggttcaatgattctcctgcctcagcgtcccgagtagctaggactacaggcatgtgccaccacacctgactaatttttgtattttttgtagaaacaaggtttcaccatgttggcaaggctgatctcaaactcctgacctcaagtgatccacctgcctcgggcccccaaagtgctgggatttcaggccatagcacctagttattttgtaaacactgtccatggattttttgttttgtcacccagttgctatgcttttaattgtggatccagaaagattaaaaagcttggccgggcggagtggcttatgcctgtaatcccagtactttgggaggctgaggcaggaggatcacttgagcccagaagtttgagaccaacccaggcaatgcagtgagattccatctctacaaaaaatttaaaaattagccaagcatggtggcatgtgcctgtagtcccagctgcttgggaggctgaggtgagaggattggttaaacctgagaggtcaaggctgcagtgggccatgattgtgccactgcactgcagcctgggcaacagagcaagaccctgttctcaagagaaaaaactatgtcacttaatatgctaagtgaaataagccagtcacaaaggacaaatactgtatgattccactaatgtgaggtacctagagtagttaaaatcatggagacagaaagtaaaatgattgtcgtccaggactggggttaagagggaatgaggaattattttttgttcagtggaacagagtttcagtttcggaagatggaaaaagttctggagatagacatggcgatggttgcacaacaatgtgaatgtgctaaatatcactgaattgtacacttagaatggctacaatggtcatttttggttatgtgtattttactctaataaaaaaggaaaaatagaaacacatacaacagcagtccccaaccttttcagcaccagggactagttttatggaagataatttttccacagaccagggtagggagatggtttcaggatgattcaagtgcctcacatttattgtgcacttgatttctgttattattacattgtaatataaaatgaagtaattatacaactcaccataatgtagagtcagtgggagccctgagctagttttcctgcaaatagatggtcccgtctgggggtgatgagagacaatgacagatcatcaggcattagattctcataaggagcaacctagatcccttgcatgtgcagttcacagtagggtttatgctcctgtaagaacctaatgctgccactgatctgacaggaggcagagctcaggcagtaatacgagtagtggggagcagctgtaaatacagatgacgcctcgctcacgccgctcacctcctgctgtgcagcctggttcctaaaaggcttcaaccccaaccccctggggttgaggacccctgacatagaagaccccaaaaaaggaccccatcaaaatttgaatgattccacccatcaatcactgtgctgggattccaccaacccttcacttgactggagaataaagaataaagactatgagtccactaaaatgattgtgaaatataaagataggtcttaccacatctgtaagtctttttcttctcctgtagcctgaaataaaaatagacaaagagactgggcgcggtggctcatgcctgtaatcctagcactttaggaggccaaggcgggcagatcacgaggtcaggagttgcagaccagcctgaccaacacggtgaaaccgttaagttaggaaagaacctaacttcttgattttgtattctctactgaaaatacaaaaattagccaggtgtggtggcacacacctgtaatcccagctactcaggaggctgaggcaggagaattgcttgaacctggaaggcggaggttgtagtgagctgagatcatgccgctgcactccagcctgggtgacagagcgagactccatctcaaaaaaaaaaaaaaaaaaaaaaggacaaaaaagaaatgtctacctttatggctgaagttttatttcacaaatattcaagtgcctattatatgcaagatattatgtcaggagctgaggaaaatgtgagaatgaagcatatacaagaagctcagaatcctgaaggggatatgtacatgcataagtttttccatgaataattttaatacaagagaaaatatgaagtatgccctgttctgtgcccctaaggtgctctgtgatcacagctcactgcagcctcaacctcctgggctcaaatgatccttccacctcggtctcccgagtagctgggactacaggcacatgtcatcacgcccggctaatttttttatttttagtagagatggggtttcacaatgttgcccagggtggttttgaattcctgagctcaggcaatctgcccacctcggcctcccaaagtgctaggattacaggcgtgagccactgtgcccggcctgatgcaaagttgtttgttgttgttgttgttattgtttttgtggtttgagacagggtctcactttgtcacccaggctggagtggagtgacatgatttcggcttactgcaacctcgacctcctatgttcaagctatcctcctccctcagccccacaaatggttgggactataggcgcacactaccatgcttggctagtatttgcattttttgtggagacggggtgtcaccatgttgcccaggctggtcttgaacttctgagctcaagtgatccacctgcctcggcttcccaaaatgctaggattacaggtgtgagccactgtaccaggcctcaaagttctttttcatctttagcatctcttgctgtgagcctcatgacctgcctagctgcccttctgatcttgtagaagagtctatgaagcagacttgaatcttacatgaacagatacttcaccaaaaaggatatctaaatgttcatatggaaatttactcatgctcactagtcataagaaatatgtaaattaaaacaaaaatactactatacacccatcagaatgactacaattaaaaagatcaataataccaagtgttggcaaggatgtgaagaaactagtactctcgtggttctggtaggagtgtaaattagtacagctacttgagacgtttggcaatatgcactgaagctgaatttacacttatcctatatcccagcaattctattcctaagtatgtagataacagaaatgcacacgtgctcacaaaagacatgtgcaagaatattcattgcagcaccattcctgatagcgctaaatgggaaataacacaaatattcaccaatagtagaatgaatgaatacattgtgttatattcaaactatggtgcactataaagtaatgagagttatggagccacccctattcacaataacctggaagaatcccattaatataatgttgaatgaaagaagctagacacaaaaggctatagatggggtcaggcaccatagctcacacctgtaatcctaacactttgggaggccgaggtgggtggatcgcttgaggtcaggagttggagaccagcctggccaacatggtgaaaccccatctctattaaaaatacaaaaaaattagccaggcatggtggcgggtgcctataatcccagctaatctggtggctgaggcaggagaatcactggaacccaggaggcggaggttgcagtgagccgagatcacgccactgcactccagcctgggcaacagagtgagactctgtctcaaaaaacaaacaaacaaaacaaagcaacaaaacacatggaaagccaaatataatcacaagcctgcctggagagctagaatcagagcaccacaatgggagagggggtcaagggagaataagagtgtgctttcaagaccctcacagtaaagatggatctgccgctagaattgcacaggatgtgactttggcccagggctccctctcccccagcagtgttcagatgagcatcaccagtgtcacctcagggactgtcctgggttcagcctctccagtggtaactcatcccctttcttgtctcttacttcagctatgctggaggacatttgttggttgtcttatccattttcccacatcactcccagagatccctggcctcttttcaacagaccatactttccctttggggatcaatccatgtagttcctgggatgtggcttcacataagccaagccattcagcacagtccatcctctgagcccagtgatgggttcagcatgttagccacaaatgctaggatgctgaaactatatttttcactgggcatgaatgagaaagcacatagccatgggggctttctgaggactgtaaggggagccagcctcagagtattctcacatggactaaggcagaagggagggctggaaagaacctaacttcttgatgattttggtaaactgctggatcaagtaacaacaacccctctgaacttttcagtttcttaagccaagaaattacttcttgtgtataaaccagtttgtagtggtctggcagacctagttgactatgcaatatctattcttatttatttatttatttatttatttttgagacaggattttgctctgtcacccaggctggagtgcagtggtgtaatcacagctcactgcagccttgacctcctgggctcaagtcatcctcccacctcagcctctcaagtagctggaaccacaggtgcacaccaccatgcccaactaattttttttttttaattttctgtagtaggcaaggcacagtggctcatgcctataatcccagcactttgggaggccaaggcagaaggatcacttgacccccaggagtttgagcccaccctgggcaacatatcaagaccccatctctgtaattaattaataaatatatgttttgcagtgatggcgtctcaatatgttgcccaggctggtctcaacctcctgggctcaagagatcctcctacatcagcctcccaaagtgctggaatgacagatgtgagtcaccacactgcctggcctattctctccttctcacagaacccccattttatttagagtttttagatatttatctccccacattcttccagagctaaggatgtcaatgtggccaataaggtacaagtgaaagtcactgggtggtatttttggaaaagcaattgattacctgattcaaaaagaagaagaagccagtctcaactggcacatgcattctgccttcccctacccacttcttcctacctgcaaaccagaagagttacagccaccttgtgatcatgaagccaaaagacacacactaaggatggctgaagaagataaaaagagccagattccttgagctgctgcgagagtcctggactgcctatcccagtctcctcgtaatgtaaaaaaagtaaacccctttcttgttaagcctttgctttgctgggtttgttaagtgcagccaagcgcattcctatcaaatagagaattaggtccactgaagtggggtgctgcacataatatcatctgaaacgtggacttcgttgagtggtagagacggagctttgggcagtgggggcacagatactgcagacgggaatgctgacaaccctgctatgctgtgggaaaacatttggtcgatctgctattttatgggagacaccccacataccagccaagtctgtagtgatagggtaaatggctagaataattcagaatgttggcacatgctggtgacttcattccactttcgatgaattcttgaaggagaccagtgaacttgaattatccaggctgaaggaaaaaaggaaggcagtgctacttcactaagtagtacttctgcctatggcctgcaaatctactttgaaggagcatttcataatttggagaattgcagggctgaaaaagacaattgctctgggccaggcatagtggctcatgcctgtattcctagcactttgggaggctaaggtgggcagatcgcttgagcccaggagtttgagaccaacctgggcaacatagcaagaccgcgtctctacaaaacatacaaaaacttagcctggtgtggtggcatgtgcctgtagtcttaactacttgggaggctgaggcaagaagatcacctgagcctaggaaggttgaggctgcagtgagccgtgatcacaccactgcactctagccggggcaacagagccaaacaagaccctgtttcaaaaaaaaaaaaaaaaaagataattgctcttttctccatataggagtagtggctgccaagcaatatggtagaagaaggtaagactggttggtatcttgggcctttcctaagcaccttcctctaagaattcattcagcagaggaagtggagtccgcaaagtggtttcttcccactagaatcttttgtttcaaattgtctcaagtcaataatcattaagttaaaggctaaagggacaggcaggacacaaaggccagtagccaacaaaggaaggttttcaggtctaaaagactatggccatataggagatttggctatggcgactcaaacgtaggatcaaccagaggcaaatacactgagagcctacaacaatttttaaggaatcatatcaccaaaaatgaaaatttaaaaacctggccagcaaaagcgtataattcttcaatcccaggttcctaaactcacacaacagaaagcatattctccccaaagttcacttcagatatggttaagaggataatgaacaagaagccgtctcaaaagaagatggaacttggaccacagagtacaatagagaagggaattcctcctagagaataggttggctgaacaaggaaattattccctgcctggaagggagtcctggccactcctgtctagcaggatctgacatttgttatagatccaatatttgcaatagctttgacatgcttaaaacagagagattctttcctttattcacattcttccttgtcctacattgaagttttattctgttccttctccattattgtatatgagacatgctgggggaagataacttgccttttagcttacagattactggactgtgaagattcacatcaagactaaatggagaaagctgtatatcagctgcagattctgggttttgagatggatgtaggctctgggtgagactttggcactgtctaccttagaaagggagtatattctgtgcatgtgaggatggatagccaagggtgggctatggcagtcactgctttccttctacccaatgactggtctccttttcttcttgactagtacaaccctgaatttgatggaggaagtaatgtgtatttgtccatttttcatgctgctgataaagacatacccgagactgggcaatttacaaatgaaagaggtttattggacttacaattctacgtggctggggacacctcaccaacatggcagaaggtgaaaggcacgtctcacgtggcagcagacaagagaagggaatgagagccaagcgaaacaggtttccccttatcaaaccatcagatctcgtgagacttactcactaccacaagaacagtatgggggaaccacccccatgattcaattatcccccactgggtccctcccacaacatgtgggaattttgggagtacaattcaagatgagatttgggtggggacacagccacaccatatcacaatgtgtccagctaaaacattacaattccctgcctcccttgcaactggggatgacctcgacctctctggccagtaaaacgctgccaaggttatctggaaaagcttcgtcttccagttgtaggtgctactccatctctcctttgcacccctttgccagaaccagatggaaactggaattttcagaaaagactgttgagcatcagaaatggttaatatgtgcctaaccttgtttaaacaaagtgagtgaagtaaggacaaatttataaatatgtgaaaagactactttttcctcttagtttctttaaaatgcatgcagccgtttaaaaataagtagaagctttctttttttatgctctggaacattttaagtagctgtgaaggtttggtaaattctcctgtgaatccatctgggccttgtgacttgttaaagagcaattcgttaatttgtttaaatgttctgtgtttaccagggtcaatttgggtaagtaatatttttgtagaaaattatttatttaatctaggttttcaaaggcatttgtctaggcttgagaaaagtagtatcttaggatttgtaaattgtcttctgtttcagtggttgtcctctttgtcatttcttatcttgcacactgatgcctttttcctttccttttttaaaaaaaaaattatgaatacataatagtcataaatatttatggaacgcatgtgatattttcataaaagcatacaatatgtaatgttcaaatctgggtaactgggatatccttcacctcaaataccatctctttgtgttgggaacatatccttttgttcttgattaggttagctagcagttcgtctacttgactgatttgttttctctaagaaacagcagttcagttaatttatgttttttatattttttcttttttttgaaacaatccattttttattcaaatagaataatatttaacaatcaaggtcatatgacttaaaatcttctgagctgggtttaggattcagatagatagtttattgtcagttgacattaaaacaatgttcttggccaggcacagtggctcatgcctgtaattccagcactttgggaggctgaggcaggtcaatcacctgatgtcaggagttcgagaccagcctggccatcatagcgaaaccccgtctctactaaaaatgcaaaaattagctgggcatggtggcgggcatctgtaatcccagctacttaggaggctgaggcaagagactcgcttgaacccggaaggcagaggttgcagtgagctgagattgcaccactgcactccagcctgcacaagagcaaaactccgtctcgaaaaaaaaaaaaaagaaaaaaagaaaaaaaattatttgcatcaaagttatacaaacaggttttttttagttttaaaatcaaatttatggccagacacagtggctcacacctgtaatcctggcactttgggaggtcaaggtaggtggatcacctgaggtcaggagttcgagaccaggctggcaacatggtgaaacctcatctctattaaaaatacaaaaattagctaggcgtagtggcacacacctgtagtcccagctcctgaggaggctgaggcacaagaatcacacttaagcccaggcagaggaggttgcagtaagctgagatcatgatactgcactccagcctgggtgacagagtaagaccctttctcaaaaaaaaaaaaaaaaaaaaaactttatttaggcctaatttccatgcaataaaattattttaactgtacaatatgatgacttttgacatatatacacaatagtataagtactaccacaatcaagattcaattataactcatgcctctttgtcagcacttttcatccccaatttcagcagctggtaactttaaggttttgccttttccagaatgtcacataaatggaatcatactgtgtccggaattggtgggttcttggtctcactgacttcaagaatgacgccatgggccctcgcggtgagtgttacagctcttaaggtggcgcgtctggagtttgttccttctgatgttcggatgtgttcggagtttcttccttctggtgggttcgtggtctcgctggctcaggagtgaagctgcagactttcgcggtgagtgttacagctcttaaggcagcacgtctggagttgtttgttcctcccggtgggctcatggtctcgctggcttcaagagtgaagctgcagacctttgctgtgagtgttacagtttataaaagcagcgtggacccaaagagtgagcagtagcaagatttatcgcaaagagcgaaagaacaaagcttccacagtgtggaaggggacccgagcgggttgccactgctagctcgggcagcctgcttttattctcttatctggccccacccacatcctgctgattggtagagccaagtggtctgttttgacagggcgctgattggtgcatttacaatccctgagctagacacaaaggttctccatggccccatcagattagttagacacagagtatcgacacaaaggttctccaaggccccaccagagcagctagatacagagtgtcgattggtgcactcacaaaccctaagctagacataaatgttctccaaggccccaccagagtagctagatacagagtgtcaactggtgcactcacaaaccctgagctagacacagggtgctgattggtgtgtttacaaaccttgaggtagatacagagtgccgattggtgtatttacaatccctgagctagacataaaggttctccaaggccccaccagagtagccagatacagagtgtcgattggtgcattcacaaaccctgagctagacacagggtgctgattggagtgtttacaaaccttgagctagatacagagtgccgattggtgtgtttacaatcactgagctagacataaaggttctccaaggccccaccagagcagttagatagagtgtggattggtgcactcacaaaccctgagctagacacagggtgctgataggtgtgtttacaaaccttgagctagatacagagtgccgattggtgtatttacaatccctgagctagacataaaagtcctccaaggccccaccagactcaggagctcagctggcttcacccagtgaatcccacacctgcgctgcaggtggagctgcctgccagtcccagtgccatacgcccgcactcctcagcccttgggtggtggatgggactgggcgccgtggagcagggggcggcgctcatcagggaggctcaggctgcacaggaacccacggagtgggtgggaggctcaggcatggggggctgcaggtcccaagccctgcccggcgggaaggcagctaagcctccgtgagaaattgagcgcagcgccggtgggctggcactgctgggggacccagtacaccctccgcagctgctggcccgggtgctaagtccctcattgcccggggccagcagggctggccgactgctccgagtgcggggccgccaagcccacgcccacccggaactccagctggcccgcaagcgcctcacgcagccccggttcccgctcgcgcctctccctccacacctccctgcaagctgagggagtgggctccagccttggccagcccagaaaggggctcccacagtgcagtggtgggctgaagggctcctcaagtgccgccaaactgggagcccaggcagaggaggtgccgagagcaagcgagggctctgaggactgccagcacgctgtcacctctcaatacagtatgtagccctttgagtctgttttctctcactcagcataacgattatgatatttgtccatgttgatgtgggcatcaatttataaaaacaattttaatgcaaacattcaatagggcttctttcccattttcccaagatttcatctctctctctgctatggacacagatggcttcactccatcctgtattcttcggaccatgataaaattccagactctcggtagtttttgcgttccaagaagtagagcctagagtggtggcctataattacagttactcaggaggctgaggcaggaggatcctttgagtccagcagtttgaggccagcctggacaccacagcaagaccaccaataaataaataaataaatggaacatg

SEQ ID NO: 1041 - DNA, 20029 bp, Homo sapiens; identical to SEQ ID NO: 1040

SEQ ID NO: 1042 - DNA, 15194 bp, Homo sapiens
ggagagttgaccatcaggtatattggggaagggagagatggaggcaccttcatgagtgcctcccaagggcagtagcctctgcaacttgctgggggttcaggggaagcagggagttcatggggctcctccagcaaagatgagctccagggctgcttggatgtccccaccggtggcctgcagggcccgcaggctcagctcatcgtcctggatgcccatgtcacgtagctgctgcagctggggctgccactggctctgtggaaagataggaatgggcagaagctgttagctgggatccagtgaagactcacttaggtctgtgctttccggggaaggaaaggaagatgggggagtcctcagcaaagctgctgatgctgagttccacagaacacggtgcttctaggaagactaaaagataggcttgagggttaagagaacaaatccaaagttttacaataaaaaaaggaaattcttggcataaggatcaaaagagaatgtacaaattattcactgtctgaattccaagaggctaaattactttctttctcttgctatgtgtacacacacaacagcaagattttgctctttatgtgatgagtgttacagatttttttcccagtttgttagcctttggactttgcttcggttttttgtttggtttggtttgccacgcagaaattttcacctttttttaaatgtcttaaatttttgtggtatatagtaggtatatctatttgtggactgtaagagatgttttaaatttttcgcttttacaaacccaaaatgcataacttttatttaatggctcctggatactgagtttcagccaagaaagcccttccctactataaggatttgaagaaattcacccatattttcttctagtactttcatagcttcattaatatctctatttcatgacagcagggatgagcacaatttagggaaaacaacgtgttcacatgtgggaagaaggcaatgcaaaggggaagaaaagcaaagtcaaagaggcaggcagtgatgagaacatggagggcttaaaaaaaatgcacacagatcaatttgaattcattttacaggccaggtggaaccagtgaaagcttctgagctagggaataaagtaaacaggcatctagcaacaggggagatgcaagaatggagaagacaagttgttcacgaatcctgcttctgttccctcactgtctacaaggaccacatggaacagtgaaaaccacacaggcttgaaccctatcgttacgacttcatggccttatgaccccagacaagttccagggatgatgctctacccataggcttactatgtggaatagaggaaaacagacgtgaaccaaactgctcatgcatggagctgtgaactacaatgctggcccctcaggtattccacttagctgctagggtgacctttctcctccttaaagcctcccatgggccaggtgtggtggctcacacctgtaatcccagaactctgggaggctaaggtgggtgaatcgcttgagcccaagagttcaagaccaggctgggcaacatagggagacccccccatctctacaaaaaatacaaaaaattagccaggcatggtggtgcatacctgtagtcccagctacccgggaggctgaggtgggaggatcacctgagcccaggaagttgaggctacagtaagttgtgatcacaccactgtactccagcctgggtgacagagtgacaccctgtctcaatcaatcaatcaatcaatcaatgcctcccagggatccctggtgactgctacatcaagtcatcaagtctaatctccgcaggttggcatgcaagcccctctcgtaggctcctgctctttctctggccccatctgcggatcttctacactggacactgcatcctagccttgtagttttgagtatgtcacatatacctccacacatgtgcacaaacaggtagctgtcttcacctggaaatcagccccttcctacctcaaacccccttccctggctagctaacttctaactaattcttctgacaatcagcttaaatacccctctctcagaaaagttttgtctgacctaggcccttacttcaagcagctgggtttcttgccttgttgctccccagctcagtgcctgcctggtgcccctccatggcagggatgagaaccagcttgccactagcccagcatctggactcaggcctagtatacacatgctcagtcaatgatcactgaatgaatgaatgaaatggccatgattatctaagccaggtggtctagggagtcaggccatggtcactaggggcaggagaagcctagtgaccactgtgtatggtctgagagtgtgcccttgctaggaacactctgcacctgtcccactgccatgctccagctgttcctagaatgaagcatgccaggtgtgaaggaccgccagagagcaaaacaaaggctgggcatccaaaataacaaggaagccacatggaaaccaagacgtggggaagactgacctgaaggctgggctgcccagaggcctgaagggcatgctgtagggcttggctgaagagatcattggtgatgggcgtccctgactggacaccagaggacattggtgaggtccctgaggaatgaccctagagacaaattagtggtcagtgccaccctcagcgccatctcaatcttatagcagatgctcgctgttgtcatatcacctcacagcactcctgaggtacccaacttctgcctcccaacaaagacctgccataagacaaccaaacaaaggtaactagaagctctctatgtgggcaggaaaggttccattctcttctgcactgagccccttgtcccagcctaggaccccagcactgcagcactgggagagatggccttgaaagctgaagtgacttgtcacccagaaatgcttaagctggtgatgtctgctccctgtcagggatgaggaagggcatattgtgtgcaggaagagtcttctgaactaataggggggactacacgggaccatgttaaaatctagacttctgagtcctcaaggcaagtgaaggggaggtcactcaagctgcagtaagaaatccccaccaggactccagggttcagcttaaactagatctagcaccagggtcagcaaaggcaaatctactctactgctggggagcttgttccttgggggcccagccttgatcttcccggccccgtcttcatacctgggtgccaggagtcggtgtgtgagagctgctctccggagtgctggccagggccaaggcggtggccagctcactctgggtgatgggccggggcccagcagctccactgtaccccagggaggctgggcgggagctgggagtactgctagagggtgtggacctggtgttctggagaaagaagacactcagaatcagggaagcagtactgtgaaactcccagatgaactccacccacctccagcaatagttcttggggaaactcttaagttcccaggttcagaaaggaatccaaaagcagaaatagtatgacatggtcttggccccccaatggcgtatgtccatctcccagccttgggagtgccaggtcccaggatgcagctcattcccagcaccatctcccccacatgtcagcatgtcaggcaggcaggcaggccacttactgggtgaaagtcatcctcatcatctgagagcccttcaaacaggaagccacctggaggaggacgaacagatttcaggaggaagaacagaaaggcacaggcgcagctccagaatctcagctcaagttactctccaaattcatattttcatctctcccctcggaaaattacaggacagatgcacttcctgactcaaaccgagagttcccaaggaacgccctctgccaacgctatacatagctgctgagtaaagcaaattcctgggccactgccggctcctgaggggcccacattacacttttcaggcgctcacctggcatatcccggtatgagctggagggcatgctccgggaagaggagtcagtcccaggcattggggcactgcctgctacggagtgcagaaccaggacaatggcattgacgagggctgggtgagcaggcaccaacctaggatagaagcaggaagaaacccaagggtgactccaaaagagcaccctcagccataacaggagttctgggtgccccctcacaacaatgcagccacctgtgcctgctctcaaattcctcagtctttagcatcttccaccaggaagctttatcctcctgctgatctgcccccagcaacgggtgcaaggccttcaaattcctggggtccgctgcagattcttcaccctctccacaggcaaggcatgatgggaaaggtgcagcctgggaggctcagggttctggcctgagcacatgaggagtgtctggtctaggcaccactactacatcaggcaaccctggactggtcccttctcttcccagggtggggctgttttcttcacttgcaaaatgaggacatgtcccttttagctttgacactttacggatctgtacacctgcttctccttttgccagcttaaaatccttgaaaagctccctaatttctaccacacgaaacctaaactgagcctggcagacaagaccctttccctcagaatcctgcttcctcccagcactcttgacaaaagccctgctcttgggctttgctctttctcaccccctgacgtatctaaggggtagacttggtgacagactatggatgggctcccagagcagactgcagggtgacaattaggcttctggcctgagcacgaggagagagaaggtaccctctaataggacaggtacacttacgtatcaagcatattgggatcagcgaagacagagaagaggtccttgtcctggagaacccctgaaaaagagcagagctcacctcaaagaaaggaaatcagccagatccaggagggagaagaggctttgcgtctcagagcaaccagctcaacagggacacaggacaacaagccaatcttcatgagaagtagaggaagcaaagcgccaagcaatacaattcaggtactcctcatcttggtctagtgaggatggtcccctgctctccacctcccctgcactttagtcacatcacagactgggtaccaagacacctgtctctttctcccgtatctctgggttcttcccttactcagggtgtgcaggacgccttccctgattgctgtgatgtgggctaactgctatcctcatttggcatcctcatacccttatttacgatgttagttaggccattatctctctgtgggactgagagctcttaaagggctggggatatcaaacacaccttgattactctccctcttcccacaagaccagtcattcttcaaaagatagtccaagtctctttagaggaattgtcttctcctgttttctccttttccgacaactcctatttcctcaaattcagtcctgcacttaccaagagcaatagggtcactgctgaggcctggggtggccacaatgatctgatccagagactccttattgctgagcatcttaaagacctgcaggagaaatggcgggggctgagcactccaaccagctcaatgtactcatcaaatgcccacactctgccaaaggacttcctccctctaagtgcttgcatgtacatcaccacaatggaacaatagccccagaaacagatgaacctctttttgctctaagatcttagcttactggaggggaaacaaacaatttaaaaaaaaaaaaggcaagaccacagtaaaccttcaaatctctgtgctccttttccccacctacagtttagtgcttccaaaataaaagctctcattacaagcccggtaacaaaggtttctctaggttccaatccaaaagtccttttcaatctctgtacaattactatttcatatttgtatatatcgctaagttcacagctatactaattttgcctctcaactctcctacagaaagacatcagcccacttccccagtgaggacatctaggtcaaggggcagtaagcaggcagttcagccaaagtcgaagaatgaggcccagcagaaacagtatgaggatcttttggctgtcaccatacgggcaggttgtattattatcattagagggaatcaacaacgcctgactgagacaggctctttggggaaagacagggctctactgaggcccacagacatggcaaaaactccccaaggaactcttggttgccatggcaacgggcttccagctcccactccacaccactcgccagccagcgttcacaccctctcctacagtcctggctgggggccgcagcacacactcaccgcctccctgtaagaggagctgctgtgcagggcagtgtgcaacacccggaactctctcatggcagccactttgtccacaggttctgggggacaagacattcagagttaccctatagcgcaggtcctgtctctgccacagacatggcaacatcatttcagcatgtgccaaggagcagcctggtctgtgcattcccttccctcatcaccccttaagaatgtgagtgcctgctcagaaaaacccatttgtgccatggatgtgaaaactgctagtaagcatctttacattcacttgtaagcatcttgcacagataaacaaacaaattcaagttgcagcagaggagactcttaccacatgaaaaacggtgctctgatcaacataccactgcaggaattctagactaataacatttgttttttggtgtttttgcctttgtttttcagacagtctcacctcttgcccagccagaatgcagtggcgcaatctcggctcgctgcaacctccacctccctggttgaagcaactctcgtgcctcagcctcctgagtagctgggattacaggtgtgcaacaccactcctggataatttttgtatttttagttgagatggggtttcaccatattggtcaggctggtctcaaactcctgacctcaagtgatccacacacctcggcctcccaaagtgctaggattacaggcgtgagccaccgtgcccagccctgggtcacactttttaaagtatggttatcctcacgaaggaccactacttgtgactgtactgactgtgtactgcccaactccagggcaccactcccaaagcaaggtgaatagcacccctggggttcagggtggcagccacatccttatcgacagtcctgatcatgaggctgtcttttgaaaaacagtcatcttaagtaaattacctaatttattcattcaacaaacatgtactaagcatttactccatgcctggctttaggcaaggaactagaatatgaaaaataagaacccctgccatcaaggaactcttagggcaggaggagaaatgagactacatcaaatacacaattacaaaatgccacgttgaagacctcaacagagacgtggatcccagctagggtaccaggaacacaaaggcagacaggcaccactgagagggagggtgaagatagacagctgcctcccagaggagaccatttgaaatgggtatcaaagagagagctgatatttactgggggggtgaaggtattccaagcctgaatgagaacatgtgcaaaggcatgggagaataaaagaatgtggtgctttgaacaaacagcaagtcattctttgtggctggagcttggggtacacattccagctcaaacagcaggttaaggtgacgtcctgaagggatttgtaacccgccatggaggactaccaaagagatccaggtgggaagacagacaacaatgggttcttctcctataggccctaatctgtgggagaacacaaaatgtgattcctttgtgaagaaaagcactcaaggagcaaatatctaaaacactgtcacaaaacagtttctttacagatctaaaagtttattgtaaccttccaataaaaaggtcatttgtttcaaaaataatcctccaggtagaaggtgggaggaaaaggactcttaatatcttaagccattattcagctaagagccatggctgtcactgtaagatctctgagctaaattcatcctttagaagtggaacgcagccagcccagtggaaatggttttcctcttgagccaggaaaacccctggtccatatcccagctcttgcattcactttctaagtagctgaccttgaataaatgccctaacccttttcttcctccataagatgctaatgctgttacctaccctgcagggccactgtaatgattaaatgaggtataaaagggaaaaaacctggctcacagaagccacaaatgttattttccttctgttaatgccctccagccaaagagctgaggggcatatctgtatttaaacaagttgggtttactgctcagtacagagagaagaatgcacaccacaggaaaccgtgggctgtctcagtaagaggatattagaaaggacttttttttttttgagacagagtttcgctcttgttgcccaggctggaatacaatggcgtgatctcggctcattgcaacctctgcctcttgggttcaaccgattctcctgcgtcagcctctcaagtagctgggattacaagcaggcaccaccatgcctggctaattttgtatttttagtatagacggggtttctccatgttggtcaggcttgtctcgaactcccaatctcaggtgatccgcccacctcggcctcccaaagttctgggattacaggcgtaagctgctgcacccggccagaaaggacttcttacaggattttggttttgtctggctgatttggggaaaaatttaaagaagtgaggttttactctggataggatgctttcaggcagtgggagtgattttataattgagtatcttaataactcttacctagaaggaaggaaaactagagcaaggtggaagctgtaattggccaagaagcagctgttactctcatcagccaagatagaaagatacttggtcacctttgtggtttggataatgctcatgtttttgtgtttctgttcagcaataatagggatcttgtttttgtcttaatccatagtggtctcagagtggccttgactgctactggggatctgtacaattgttcatgatccccaaaaggattccagggcctggctgtgagtgccaggccaacctctggatgtcaggaactctgttcctctttctcacttcccatcagggtatgaaagacatttttgtcttttacagttagaactgaaaggggggtaaatttcaaactgataactagtcacagcaatcatgaacattataaaaagatgtcaacctgccagtgtaacaaagctaatctcttttacacagcttagctttattcttagggaggcttttaaaacacacatgcaaaatttaaatcatgaattccaagcaccttctatttataaaccaaaaaggcatctgaggctttgtatattttctccaagagctatttaaatactctttgaatatcttcaggaaaataccagtatagcaagagcagttagctaactgaacaaatcaccacctgaggcagtttgtaggaagatttgttaacaagggaataaactgcagcattaggaaagtgccaaaagtttccagcttttttctaatgagaacaacgataataacaaaaggatacaaagtttactttgtatcactaaaaaataaactgttaacttaaaggagtttaagtagacacaaactccctgtcccattaggaaacagtggatgacaaacttagaaagtggagaaacaagccaggaatggtgcctgtactttgggaggctgaggtggggtggatggcttgaggtcaggagttcgagaccaggttgaccaacatggagacaccccgtctctactaaaaatacaaaaattgaaggccgggtacagtggctcacgcctttaatcccagcactttgggaggccgaggcgggcagatcacaaggtcaggagatcgagaccatcctggctaacacggtgaaaccccgtctctactaaaaaacacaaaaaaaattagccaggcttggtggtgggcgcctgtagtcccagctacctgggaggctgaggcaggagaatggtgtgaacccgggaggcggagcttgcagtgagccaagatcacaccactgcactccagcctgtgagacagagtgagactccgtctcagaaaaaaaaaaaaaaaaaaaattagctgggcatggtgactcatgcctgtaatcccagctactcgggaggctgaggcatgagaatcacttgaacctgggaggcggaggttgcagtgatccaagatcaagattgtgccactgcactccagcctgggcaacagagtgagactgtctcaaaaaaaccaaaaaacaaaaaacaaaatggagaaacaaatcttccattagtgatgccggcagtaagaaggtcaaaattggactctgtttatcagcatggtctaatccaataagtaataaagatatcatttatcatcagctcagtaaatcatccctttgttccacccaggcttgtgcctcaagaacacacagatccttcccttgcggatattacagaaactctgcctgcctaagggctgcccctcactcacccggtttctgatcaggttcaggccaggactttcgcagaacatggacagtggacccaggttgaatgccatagaagtcaagtgtctggtcatcttttagcttccgaccacagtagatcagatctaaaaaaagaactgtccacttatattttgctcctcaaaacaaatttacatggtttttgtcccgagaaccttattttgattagatagctggagaatgatacatgttttaaaagatactcttattcaataacttaacaaatacttttttttttttggaaaacagggtcttactctgttgcccaggcttgagtgcaatggcaccatcacggttcactgcagcctcaacctcctggggtcaagcaattctcccaccttagcctcctgagtagctgggactacaggcacatgccaccacacccagctaatttttgtagttttttgtagagacggggttttgccatgttgcctagactagtctcttaactcctgggctcaagggatcctcctgccttagcctcacaaagtgctgggatgacaggcgtgaaccaccatgcctagccaattaaatacatttcaacaactatttgcaaatataaactcataaaatggacttacatcgaatctggccagatgtggtggctcacacctataaacccagcacttttggagcctggccgacatggcgaaacctgggccatggcgaaaattagggccgggcacggtggctcacacctgtaatcccaacactttgggaggccgaggtgggtggatcacctgaggtcaggagttcaaggccagcctggccaagatggtaaacctcgtctctaccaaaaatacaaaaattagccaggcatggtggcagacgcctgtaatccctgctactcaggaggctgaagcaggagaattgcttgaacccaggaggcggaggttgcagtgagccaagatcacaccactgcactccagcctgggcaacagagcaagactctgtctcaaaaaaaaagaaatatatatatatatacacacatacacacaaaaattagccagttgtggttgtgcgggcctgtaatcccagttattcaggaggctgaggcaggaaaattgcctgaacctgggagacagaggttacaatgagctgagatctcgccactgcactccagcctgggcaacagagcaagactccgtctcaaaaaaaaaaaaaaaaaaaaaggattcacacagaatctatccacagaaaaactctggagtttaacattgtggaggctgcccaatttaaatcaatggaaaaacaacaaaataggatgaacccaatccaggtatgactgaaaacatctttcttgccagttggatcctttagctattaaaaattaccttttcagtgtaatttaattatatttaaattcctccctcctccacctggactgcccacgccactttttcttttttactgcctttcctttactcagtcaaccaagcaaaaatccttctaatcatccctgaagacctacctcaaatatactgaggagcctcccctgaccaacttctcctttcctaactcatcccaaacttctgttctttcagaaaaagaattcacaatgttggccaggagcggtggctcatgcctgtaatcccagcattttgggaggctgaggcgggcagaatcacaaggttaggagttcaagaccagcctggccaacatggtgaaatcccatgtctctactaaaaatacaaaaattagctgggcatggtggtgtgtgcctgtaatcccagctactcgggaggctgaggcagaattgcttgaactgggacccaggagacagaggttgcagtgagccgagatcgcaccactgcactccagcctgggctacacagcaaaacaaaaacaaaaacaaaaaacaagacaatgtcataaagaacctggtgataaggtagttcagtataatacatggctgaaatggcaaccaatagtttcattatatgatttgtgtttctatttacccaacattcacttccctggagtgttaacattatgaggcaacaaatcccaagcccttactttactcttgtaattccagaagtatcctcccccaaaagagatcagagcagcagcccaaccccagtccagagagactcaccaatcagctcagggtctggaacagactcctggagtttgccagcaataagctgcttcagaaatgaaatactatagccccctagcgagtattctcccagttctgtctctggcaaccgaagaatagactttggagtaagtggctggtcagccagcttcaccgccaggtgccagtctgagagagacatcctctctctttcgcgctctctctttctccctgtaaaagaacaaaacctcagtggttaaaagacagaccaccactctactccacccccacccaccaaagggttgaatgaaagacaattcaatgtgacactgttgaagaggcatagggcgtaccatcaggaggccagaactagaatctggggttctctctctactcatactgtgatggacagctctctaggcctcagtttcttcatccctaacgtggacataaaaacgccatccaatctaataggaatgttgtgagagagatcatctaaccctctcccttctgtatgcccctttttccaattttcttcaactgttgcttgaaccagtagaacagctttataacaagttccctgcctcttgcctctccctatcaaatatctatgctgccacctaacaacacccatcatttttttttttttttttgagacggagtctcgctctgttgcccaggctggagtgcagcggcgcgatctcggctcactgcaagctccacctcccaggttcacgccattctcctgccttcctgcctcagcctcccaggtagcagggactacaggcacccgccacgacgccaggctaatttttttttttttttgtacttttagtagagacggggtttcactgtgttagccaggatggtctcgatctcctgacctcgtgatccacctgcctcggcctcccaaagtgctgggattacaggcatgagcgactgcgcctggccacaacccatcattctaaaacacagatctgaccaagtcacttctctgcttagaactcttccaatgtcgggctgggcgcggtggctcatgcctgtaaccctagcactttgagaggcctaggcgggcggattgcctaagctcaagagttcaagaccagcctggccaacatggtgaaacccgtcactactaaaaatacaaaaattagctgggcgtggtagtgcgcacctgtagtgccacctactcggaaggctgaggttgcagtgagccaagatcacgtcactgcactccagcctgggtgacagagagagactctgtcgcaaaaaaaaaaaaaaaaaaaaaaaaaaaagccagacgcggtggctcacacctgtaatcctgtcactttgggaggccgcggaggacggatcacttaagatcaggtgtttgaaaccagcctggccaacatggtgaaactacatctctactataatagaaaaaatttgcagggcgtggtggcaggcgcttgtaatcccagctacttgagaggctgaggcaggagaattgcttgaacccgggaggtggaggttgcagtgagccgagatagcgccactgcactccagcttgggcgacagagactccgtccctccctgccccaccccggccccccagaaaaagacctcttccaatacctctaaaccatctatataaattaagtctaaacttcatcgcctggcttacaaaactccctgccagcctcattccccaacagagccctacccctgcaaaggacctccacaacatgtaagtacacactcataacaaagctctcccctattttacacctctgctcatctaactctgcatgtaatttctcttccctttttggccttttagcaaactcctaccgaaaccaacacagattcaataacctcagtcccctctctttcctctgttgttcccacatcccctcagaacaaaagggctacaaatatctgcttgccccctcctccaccccaattcttgaatgcccttgaaaacaaaagactaaagttttcttcatccttgtccccatacctggcatacatggaaccccagaaaataaatcagaaactctgacggcggaagaatcttgcaaagcaagataagttcttgttatagtcatcattattgcttccaaagagacctctgatagagaagaggaaagaaaaggctgtgaagctgcctagcagaccttcaagcatcctcaaggtatcttccacctcaagtttatgccagaaggaggtcgttttatataccatgtctcacttaatcctcacaacggttccctaaggcaggcattagccacattttaaagatgagggaagcaagactcagtaaaatcactggcccaaggtcacagatcgctagtaatggggcaggaacactatccggtggcgacctcaccgctccagtgggaccagctacttggctgacacacatcgagcccgcgctgcccagggccccagcgccctcacccgtcccgcggaaggaacccggccgcactgccgccggtgtaaacactcactctggccctctc

SEQ ID NO: 1043 - DNA, 15213 bp, Homo sapiens
ggagagttgaccatcaggtatattggggaagggagagatggaggcaccttcatgagtgcctcccaagggcagtagcctctgcaacttgctgggggttcaggggaagcagggagttcatggggctcctccagcaaagatgagctccagggctgcttggatgtccccaccggtggcctgcagggcccgcaggctcagctcatcgtcctggatgcccatgtcacgtagctgctgcagctggggctgccactggctctgtggaaagataggaatgggcagaagctgttagctgggatccagtgaagactcacttaggtctgtgctttccggggaaggaaaggaagatgggggagtcctcagcaaagctgctgatgctgagttccacagaacacggtgcttctaggaagactaaaagataggcttgagggttaagagaacaaatccaaagttttacaataaaaaaaggaaattcttggcataaggatcaaaagagaatgtacaaattattcactgtctgaattccaagaggctaaattactttctttctcttgctatgtgtacacacacaacagcaagattttgctctttatgtgatgagtgttacagatttttttcccagtttgttagcctttggactttgcttcggttttttgtttggtttggtttgccacgcagaaattttcacctttttttaaatgtcttaaatttttgtggtatatagtaggtatatctatttgtggactgtaagagatgttttaaatttttcgcttttacaaacccaaaatgcataacttttatttaatggctcctggatactgagtttcagccaagaaagcccttccctactataaggatttgaagaaattcacccatattttcttctagtactttcatagcttcattaatatctctatttcatgacagcagggatgagcacaatttagggaaaacaacgtgttcacatgtgggaagaaggcaatgcaaaggggaagaaaagcaaagtcaaagaggcaggcagtgatgagaacatggagggcttaaaaaaaatgcacacagatcaatttgaattcattttacaggccaggtggaaccagtgaaagcttctgagctagggaataaagtaaacaggcatctagcaacaggggagatgcaagaatggagaagacaagttgttcacgaatcctgcttctgttccctcactgtctacaaggaccacatggaacagtgaaaaccacacaggcttgaaccctatcgttacgacttcatggccttatgaccccagacaagttccagggatgatgctctacccataggcttactatgtggaatagaggaaaacagacgtgaaccaaactgctcatgcatggagctgtgaactacaatgctggcccctcaggtattccacttagctgctagggtgacctttctcctccttaaagcctcccatgggccaggtgtggtggctcacacctgtaatcccagaactctgggaggctaaggtgggtgaatcgcttgagcccaagagttcaagaccaggctgggcaacatagggagacccccccatctctacaaaaaatacaaaaaattagccaggcatggtggtgcatacctgtagtcccagctacccgggaggctgaggtgggaggatcacctgagcccaggaagttgaggctacagtaagttgtgatcacaccactgtactccagcctgggtgacagagtgacaccctgtctcaatcaatcaatcaatcaatcaatgcctcccagggatccctggtgactgctacatcaagtcatcaagtctaatctccgcaggttggcatgcaagcccctctcgtaggctcctgctctttctctggccccatctgcggatcttctacactggacactgcatcctagccttgtagttttgagtatgtcacatatacctccacacatgtgcacaaacaggtagctgtcttcacctggaaatcagccccttcctacctcaaacccccttccctggctagctaacttctaactaattcttctgacaatcagcttaaatacccctctctcagaaaagttttgtctgacctaggcccttacttcaagcagctgggtttcttgccttgttgctccccagctcagtgcctgcctggtgcccctccatggcagggatgagaaccagcttgccactagcccagcatctggactcaggcctagtatacacatgctcagtcaatgatcactgaatgaatgaatgaaatggccatgattatctaagccaggtggtctagggagtcaggccatggtcactaggggcaggagaagcctagtgaccactgtgtatggtctgagagtgtgcccttgctaggaacactctgcacctgtcccactgccatgctccagctgttcctagaatgaagcatgccaggtgtgaaggaccgccagagagcaaaacaaaggctgggcatccaaaataacaaggaagccacatggaaaccaagacgtggggaagactgacctgaaggctgggctgcccagaggcctgaagggcatgctgtagggcttggctgaagagatcattggtgatgggcgtccctgactggacaccagaggacattggtgaggtccctgaggaatgaccctagagacaaattagtggtcagtgccaccctcagcgccatctcaatcttatagcagatgctcgctgttgtcatatcacctcacagcactcctgaggtacccaacttctgcctcccaacaaagacctgccataagacaaccaaacaaaggtaactagaagctctctatgtgggcaggaaaggttccattctcttctgcactgagccccttgtcccagcctaggaccccagcactgcagcactgggagagatggccttgaaagctgaagtgacttgtcacccagaaatgcttaagctggtgatgtctgctccctgtcagggatgaggaagggcatattgtgtgcaggaagagtcttctgaactaataggggggactacacgggaccatgttaaaatctagacttctgagtcctcaaggcaagtgaaggggaggtcactcaagctgcagtaagaaatccccaccaggactccagggttcagcttaaactagatctagcaccagggtcagcaaaggcaaatctactctactgctggggagcttgttccttgggggcccagccttgatcttcccggccccgtcttcatacctgggtgccaggagtcggtgtgtgagagctgctctccggagtgctggccagggccaaggcggtggccagctcactctgggtgatgggccggggcccagcagctccactgtaccccagggaggctgggcgggagctgggagtactgctagagggtgtggacctggtgttctggagaaagaagacactcagaatcagggaagcagtactgtgaaactcccagatgaactccacccacctccagcaatagttcttggggaaactcttaagttcccaggttcagaaaggaatccaaaagcagaaatagtatgacatggtcttggccccccaatggcgtatgtccatctcccagccttgggagtgccaggtcccaggatgcagctcattcccagcaccatctcccccacatgtcagcatgtcaggcaggcaggcaggccacttactgggtgaaagtcatcctcatcatctgagagcccttcaaacaggaagccacctggaggaggacgaacagatttcaggaggaagaacagaaaggcacaggcgcagctccagaatctcagctcaagttactctccaaattcatattttcatctctcccctcggaaaattacaggacagatgcacttcctgactcaaaccgagagttcccaaggaacgccctctgccaacgctatacatagctgctgagtaaagcaaattcctgggccactgccggctcctgaggggcccacattacacttttcaggcgctcacctggcatatcccggtatgagctggagggcatgctccgggaagaggagtcagtcccaggcattggggcactgcctgctacggagtgcagaaccaggacaatggcattgacgagggctgggtgagcaggcaccaacctaggatagaagcaggaagaaacccaagggtgactccaaaagagcaccctcagccataacaggagttctgggtgccccctcacaacaatgcagccacctgtgcctgctctcaaattcctcagtctttagcatcttccaccaggaagctttatcctcctgctgatctgcccccagcaacgggtgcaaggccttcaaattcctggggtccgctgcagattcttcaccctctccacaggcaaggcatgatgggaaaggtgcagcctgggaggctcagggttctggcctgagcacatgaggagtgtctggtctaggcaccactactacatcaggcaaccctggactggtcccttctcttcccagggtggggctgttttcttcacttgcaaaatgaggacatgtcccttttagctttgacactttacggatctgtacacctgcttctccttttgccagcttaaaatccttgaaaagctccctaatttctaccacacgaaacctaaactgagcctggcagacaagaccctttccctcagaatcctgcttcctcccagcactcttgacaaaagccctgctcttgggctttgctctttctcaccccctgacgtatctaaggggtagacttggtgacagactatggatgggctcccagagcagactgcagggtgacaattaggcttctggcctgagcacgaggagagagaaggtaccctctaataggacaggtacacttacgtatcaagcatattgggatcagcgaagacagagaagaggtccttgtcctggagaacccctgaaaaagagcagagctcacctcaaagaaaggaaatcagccagatccaggagggagaagaggctttgcgtctcagagcaaccagctcaacagggacacaggacaacaagccaatcttcatgagaagtagaggaagcaaagcgccaagcaatacaattcaggtactcctcatcttggtctagtgaggatggtcccctgctctccacctcccctgcactttagtcacatcacagactgggtaccaagacacctgtctctttctcccgtatctctgggttcttcccttactcagggtgtgcaggacgccttccctgattgctgtgatgtgggctaactgctatcctcatttggcatcctcatacccttatttacgatgttagttaggccattatctctctgtgggactgagagctcttaaagggctggggatatcaaacacaccttgattactctccctcttcccacaagaccagtcattcttcaaaagatagtccaagtctctttagaggaattgtcttctcctgttttctccttttccgacaactcctatttcctcaaattcagtcctgcacttaccaagagcaatagggtcactgctgaggcctggggtggccacaatgatctgatccagagactccttattgctgagcatcttaaagacctgcaggagaaatggcgggggctgagcactccaaccagctcaatgtactcatcaaatgcccacactctgccaaaggacttcctccctctaagtgcttgcatgtacatcaccacaatggaacaatagccccagaaacagatgaacctctttttgctctaagatcttagcttactggaggggaaacaaacaatttaaaaaaaaaaaaggcaagaccacagtaaaccttcaaatctctgtgctccttttccccacctacagtttagtgcttccaaaataaaagctctcattacaagcccggtaacaaaggtttctctaggttccaatccaaaagtccttttcaatctctgtacaattactatttcatatttgtatatatcgctaagttcacagctatactaattttgcctctcaactctcctacagaaagacatcagcccacttccccagtgaggacatctaggtcaaggggcagtaagcaggcagttcagccaaagtcgaagaatgaggcccagcagaaacagtatgaggatcttttggctgtcaccatacgggcaggttgtattattatcattagagggaatcaacaacgcctgactgagacaggctctttggggaaagacagggctctactgaggcccacagacatggcaaaaactccccaaggaactcttggttgccatggcaacgggcttccagctcccactccacaccactcgccagccagcgttcacaccctctcctacagtcctggctgggggccgcagcacacactcaccgcctccctgtaagaggagctgctgtgcagggcagtgtgcaacacccggaactctctcatggcagccactttgtccacaggttctgggggacaagacattcagagttaccctatagcgcaggtcctgtctctgccacagacatggcaacatcatttcagcatgtgccaaggagcagcctggtctgtgcattcccttccctcatcaccccttaagaatgtgagtgcctgctcagaaaaacccatttgtgccatggatgtgaaaactgctagtaagcatctttacattcacttgtaagcatcttgcacagataaacaaacaaattcaagttgcagcagaggagactcttaccacatgaaaaacggtgctctgatcaacataccactgcaggaattctagactaataacatttgttttttggtgtttttgcctttgtttttcagacagtctcacctcttgcccagccagaatgcagtggcgcaatctcggctcgctgcaacctccacctccctggttgaagcaactctcgtgcctcagcctcctgagtagctgggattacaggtgtgcaacaccactcctggataatttttgtatttttagttgagatggggtttcaccatattggtcaggctggtctcaaactcctgacctcaagtgatccacacacctcggcctcccaaagtgctaggattacaggcgtgagccaccgtgcccagccctgggtcacactttttaaagtatggttatcctcacgaaggaccactacttgtgactgtactgactgtgtactgcccaactccagggcaccactcccaaagcaaggtgaatagcacccctggggttcagggtggcagccacatccttatcgacagtcctgatcatgaggctgtcttttgaaaaacagtcatcttaagtaaattacctaatttattcattcaacaaacatgtactaagcatttactccatgcctggctttaggcaaggaactagaatatgaaaaataagaacccctgccatcaaggaactcttagggcaggaggagaaatgagactacatcaaatacacaattacaaaatgccacgttgaagacctcaacagagacgtggatcccagctagggtaccaggaacacaaaggcagacaggcaccactgagagggagggtgaagatagacagctgcctcccagaggagaccatttgaaatgggtatcaaagagagagctgatatttactgggggggtgaaggtattccaagcctgaatgagaacatgtgcaaaggcatgggagaataaaagaatgtggtgctttgaacaaacagcaagtcattctttgtggctggagcttggggtacacattccagctcaaacagcaggttaaggtgacgtcctgaagggatttgtaacccgccatggaggactaccaaagagatccaggtgggaagacagacaacaatgggttcttctcctataggccctaatctgtgggagaacacaaaatgtgattcctttgtgaagaaaagcactcaaggagcaaatatctaaaacactgtcacaaaacagtttctttacagatctaaaagtttattgtaaccttccaataaaaaggtcatttgtttcaaaaataatcctccaggtagaaggtgggaggaaaaggactcttaatatcttaagccattattcagctaagagccatggctgtcactgtaagatctctgagctaaattcatcctttagaagtggaacgcagccagcccagtggaaatggttttcctcttgagccaggaaaacccctggtccatatcccagctcttgcattcactttctaagtagctgaccttgaataaatgccctaacccttttcttcctccataagatgctaatgctgttacctaccctgcagggccactgtaatgattaaatgaggtataaaagggaaaaaacctggctcacagaagccacaaatgttattttccttctgttaatgccctccagccaaagagctgaggggcatatctgtatttaaacaagttgggtttactgctcagtacagagagaagaatgcacaccacaggaaaccgtgggctgtctcagtaagaggatattagaaaggacttttttttttttgagacagagtttcgctcttgttgcccaggctggaatacaatggcgtgatctcggctcattgcaacctctgcctcttgggttcaaccgattctcctgcgtcagcctctcaagtagctgggattacaagcaggcaccaccatgcctggctaattttgtatttttagtatagacggggtttctccatgttggtcaggcttgtctcgaactcccaatctcaggtgatccgcccacctcggcctcccaaagttctgggattacaggcgtaagctgctgcacccggccagaaaggacttcttacaggattttggttttgtctggctgatttggggaaaaatttaaagaagtgaggttttactctggataggatgctttcaggcagtgggagtgattttataattgagtatcttaataactcttacctagaaggaaggaaaactagagcaaggtggaagctgtaattggccaagaagcagctgttactctcatcagccaagatagaaagatacttggtcacctttgtggtttggataatgctcatgtttttgtgtttctgttcagcaataatagggatcttgtttttgtcttaatccatagtggtctcagagtggccttgactgctactggggatctgtacaattgttcatgatccccaaaaggattccagggcctggctgtgagtgccaggccaacctctggatgtcaggaactctgttcctctttctcacttcccatcagggtatgaaagacatttttgtcttttacagttagaactgaaaggggggtaaatttcaaactgataactagtcacagcaatcatgaacattataaaaagatgtcaacctgccagtgtaacaaagctaatctcttttacacagcttagctttattcttagggaggcttttaaaacacacatgcaaaatttaaatcatgaattccaagcaccttctatttataaaccaaaaaggcatctgaggctttgtatattttctccaagagctatttaaatactctttgaatatcttcaggaaaataccagtatagcaagagcagttagctaactgaacaaatcaccacctgaggcagtttgtaggaagatttgttaacaagggaataaactgcagcattaggaaagtgccaaaagtttccagcttttttctaatgagaacaacgataataacaaaaggatacaaagtttactttgtatcactaaaaaataaactgttaacttaaaggagtttaagtagacacaaactccctgtcccattaggaaacagtggatgacaaacttagaaagtggagaaacaagccaggaatggtgcctgtactttgggaggctgaggtggggtggatggcttgaggtcaggagttcgagaccaggttgaccaacatggagacaccccgtctctactaaaaatacaaaaattgaaggccgggtacagtggctcacgcctttaatcccagcactttgggaggccgaggcgggcagatcacaaggtcaggagatcgagaccatcctggctaacacggtgaaaccccgtctctactaaaaaacacaaaaaaaattagccaggcttggtggtgggcgcctgtagtcccagctacctgggaggctgaggcaggagaatggtgtgaacccgggaggcggagcttgcagtgagccaagatcacaccactgcactccagcctgtgagacagagtgagactccgtctcagaaaaaaaaaaaaaaaaaaaattagctgggcatggtgactcatgcctgtaatcccagctactcgggaggctgaggcatgagaatcacttgaacctgggaggcggaggttgcagtgatccaagatcaagattgtgccactgcactccagcctgggcaacagagtgagactgtctcaaaaaaaccaaaaaacaaaaaacaaaatggagaaacaaatcttccattagtgatgccggcagtaagaaggtcaaaattggactctgtttatcagcatggtctaatccaataagtaataaagatatcatttatcatcagctcagtaaatcatccctttgttccacccaggcttgtgcctcaagaacacacagatccttcccttgcggatattacagaaactctgcctgcctaagggctgcccctcactcacccggtttctgatcaggttcaggccaggactttcgcagaacatggacagtggacccaggttgaatgccatagaagtcaagtgtctggtcatcttttagcttccgaccacagtagatcagatctaaaaaaagaactgtccacttatattttgctcctcaaaacaaatttacatggtttttgtcccgagaaccttattttgattagatagctggagaatgatacatgttttaaaagatactcttattcaataacttaacaaatacttttttttttttggaaaacagggtcttactctgttgcccaggcttgagtgcaatggcaccatcacggttcactgcagcctcaacctcctggggtcaagcaattctcccaccttagcctcctgagtagctgggactacaggcacatgccaccacacccagctaatttttgtagttttttgtagagacggggttttgccatgttgcctagactagtctcttaactcctgggctcaagggatcctcctgccttagcctcacaaagtgctgggatgacaggcgtgaaccaccatgcctagccaattaaatacatttcaacaactatttgcaaatataaactcataaaatggacttacatcgaatctggccagatgtggtggctcacacctataaacccagcacttttggagcctggccgacatggcgaaacctgggccatggcgaaaattagggccgggcacggtggctcacacctgtaatcccaacactttgggaggccgaggtgggtggatcacctgaggtcaggagttcaaggccagcctggccaagatggtaaacctcgtctctaccaaaaatacaaaaattagccaggcatggtggcagacgcctgtaatccctgctactcaggaggctgaagcaggagaattgcttgaacccaggaggcggaggttgcagtgagccaagatcacaccactgcactccagcctgggcaacagagcaagactctgtctcaaaaaaaaagaaatatatatatatatacacacatacacacaaaaattagccagttgtggttgtgcgggcctgtaatcccagttattcaggaggctgaggcaggaaaattgcctgaacctgggagacagaggttacaatgagctgagatctcgccactgcactccagcctgggcaacagagcaagactccgtctcaaaaaaaaaaaaaaaaaaaaaggattcacacagaatctatccacagaaaaactctggagtttaacattgtggaggctgcccaatttaaatcaatggaaaaacaacaaaataggatgaacccaatccaggtatgactgaaaacatctttcttgccagttggatcctttagctattaaaaattaccttttcagtgtaatttaattatatttaaattcctccctcctccacctggactgcccacgccactttttcttttttactgcctttcctttactcagtcaaccaagcaaaaatccttctaatcatccctgaagacctacctcaaatatactgaggagcctcccctgaccaacttctcctttcctaactcatcccaaacttctgttctttcagaaaaagaattcacaatgttggccaggagcggtggctcatgcctgtaatcccagcattttgggaggctgaggcgggcagaatcacaaggttaggagttcaagaccagcctggccaacatggtgaaatcccatgtctctactaaaaatacaaaaattagctgggcatggtggtgtgtgcctgtaatcccagctactcgggaggctgaggcagaattgcttgaactgggacccaggagacagaggttgcagtgagccgagatcgcaccactgcactccagcctgggctacacagcaaaacaaaaacaaaaacaaaaaacaagacaatgtcataaagaacctggtgataaggtagttcagtataatacatggctgaaatggcaaccaatagtttcattatatgatttgtgtttctatttacccaacattcacttccctggagtgttaacattatgaggcaacaaatcccaagcccttactttactcttgtaattccagaagtatcctcccccaaaagagatcagagcagcagcccaaccccagtccagagagactcaccaatcagctcagggtctggaacagactcctggagtttgccagcaataagctgcttcagaaatgaaatactatagccccctagcgagtattctcccagttctgtctctggcaaccgaagaatagactttggagtaagtggctggtcagccagcttcaccgccaggtgccagtctgagagagacatcctctctctttcgcgctctctctttctccctgtaaaagaacaaaacctcagtggttaaaagacagaccaccactctactccacccccacccaccaaagggttgaatgaaagacaattcaatgtgacactgttgaagaggcatagggcgtaccatcaggaggccagaactagaatctggggttctctctctactcatactgtgatggacagctctctaggcctcagtttcttcatccctaacgtggacataaaaacgccatccaatctaataggaatgttgtgagagagatcatctaaccctctcccttctgtatgcccctttttccaattttcttcaactgttgcttgaaccagtagaacagctttataacaagttccctgcctcttgcctctccctatcaaatatctatgctgccacctaacaacacccatcatttttttttttttttttgagacggagtctcgctctgttgcccaggctggagtgcagcggcgcgatctcggctcactgcaagctccacctcccaggttcacgccattctcctgccttcctgcctcagcctcccaggtagcagggactacaggcacccgccacgacgccaggctaatttttttttttttttgtacttttagtagagacggggtttcactgtgttagccaggatggtctcgatctcctgacctcgtgatccacctgcctcggcctcccaaagtgctgggattacaggcatgagcgactgcgcctggccacaacccatcattctaaaacacagatctgaccaagtcacttctctgcttagaactcttccaatgtcgggctgggcgcggtggctcatgcctgtaaccctagcactttgagaggcctaggcgggcggattgcctaagctcaagagttcaagaccagcctggccaacatggtgaaacccgtcactactaaaaatacaaaaattagctgggcgtggtagtgcgcacctgtagtgccacctactcggaaggctgaggttgcagtgagccaagatcacgtcactgcactccagcctgggtgacagagagagactctgtcgcaaaaaaaaaaaaaaaaaaaaaaaaaaaagccagacgcggtggctcacacctgtaatcctgtcactttgggaggccgcggaggacggatcacttaagatcaggtgtttgaaaccagcctggccaacatggtgaaactacatctctactataatagaaaaaatttgcagggcgtggtggcaggcgcttgtaatcccagctacttgagaggctgaggcaggagaattgcttgaacccgggaggtggaggttgcagtgagccgagatagcgccactgcactccagcttgggcgacagagactccgtccctccctgccccaccccggccccccagaaaaagacctcttccaatacctctaaaccatctatataaattaagtctaaacttcatcgcctggcttacaaaactccctgccagcctcattccccaacagagccctacccctgcaaaggacctccacaacatgtaagtacacactcataacaaagctctcccctattttacacctctgctcatctaactctgcatgtaatttctcttccctttttggccttttagcaaactcctaccgaaaccaacacagattcaataacctcagtcccctctctttcctctgttgttcccacatcccctcagaacaaaagggctacaaatatctgcttgccccctcctccaccccaattcttgaatgcccttgaaaacaaaagactaaagttttcttcatccttgtccccatacctggcatacatggaaccccagaaaataaatcagaaactctgacggcggaagaatcttgcaaagcaagataagttcttgttatagtcatcattattgcttccaaagagacctctgatagagaagaggaaagaaaaggctgtgaagctgcctagcagaccttcaagcatcctcaaggtatcttccacctcaagtttatgccagaaggaggtcgttttatataccatgtctcacttaatcctcacaacggttccctaaggcaggcattagccacattttaaagatgagggaagcaagactcagtaaaatcactggcccaaggtcacagatcgctagtaatggggcaggaacactatccggtggcgacctcaccgctccagtgggaccagctacttggctgacacacatcgagcccgcgctgcccagggccccagcgccctcacccgtcccgcggaaggaacccggccgcactgccgccggtgtaaacactcactctggccctctcgccggaaaccggaaattcc

SEQ ID NO: 1044 - DNA, 15209 bp, Homo sapiens
cagttttctcatctggaaagtggggcctcgtaatcctgtccgacccggcgcgggacagtaggtgtcagggattttggtgaccccacgctcgaggcctctgcaaaagggggctgtccagtggcccagagacgcagccggcggggcttttgtctagcgggggagtcttaactgagaggccacgcaggccggcaggaagccgctccacaggagggggctcaaggagaggggatctcctccctccagactccggccccgccagagtagctctagggtatcttcccagaaactgccccgcacgcactggcgagctgggagcgccaccacggctttcaaaaaacccgcacacaccaagataataatgtgtcgttcgctcgtttcgcgcaagcggagtcgcgtccgccttcccgagctccggcacacagacctcaggccgctctcgcgctctccggggccccgagaacaatgcccgtcctctccgcgcgcaggagggagttggcggaccacgcggggtcggggcgacggagcgggcccagccccacggccaggtcggggccccacctctcggctctgagagcccagccggcccgggccgcgcacctgtcaggtcgggggacctacgtgcgccgcgacacggcgggaggcgggccgggccaggctcgtcccctcggccctcccggaactagtctcctaggccgcggcgcccgccggagcggagagggctggtgccccggagccttcgagtcgggggctagagcggccaggcctccgagccgggtcgagccgaggctggcgacggctgcgtcacgcgagggggcggggctgccacgggcggaggtcgcagccggaagcggaagaggcgctcggagcggggagtggggcctagctgcagccggagcctgggagacggtaagtgtgggctggggtccgcggcggcgacagcggcggcggcggccgggggtgagtcggcggggcaggcgcgctggtgccattcggtctcggcctactccctttctttctcctcttcggcccatatcgggccgcgacctctcacccctgacccgctgcttctgccccggagggcggtcactgcagaccctgacctcgaccccacggtgttgaaggcggagcctgaacggcctctggggccgctcaagggtccagtttgggctctgtgcctgcccgcggaatggggtcggggtccgacgtagaagagccagagaagcccttcagacccctcccctacccctggcttcaggcttagtccgcagatgactcctcccttggcggcctggagtttgattctggcccagtccggctttccctctgtccccgggtctcccctcggcgccactggtggcggttacaggggatgggactctgagaccccctgggacctggggcggcaggaagggacgcgaacgagggcgcaggctcccctgtgtgttttgttgtggtggtagagccactccagcccggaggatgggctaggccaagctgacagttcaaatcccctggctgctcctccgtcccgcccgggagtctctagctttagttccgggtgtgggtgccctgatgtggagctggggtggaaattgcctgaaccaggcccccatcagaggcggagttggcggccttccagcttcccttcttgatgcccttgaaaaggaggagcgtttcaccgttggtggtggaggcttgcgaggtggcaggtttgaggttgcagtggtagggcagtccagccaaaaataaccatgggtgctggggtggctggaatccgggagggcagccgctgacctggctggctgcacttctagtcagcccagttctctggccaggaacagcaaatgagaagccgacaaggcctgtgctcaaagttgacatccttggcttggttttcttcatatcacctttttcctcattgtgcagagcagagcttcccaaagcataattgtggcctttagctgctttttaaacaagctgtttgctgaggttttcgagaatcagagataattgagaaatgggccctagagccctggctgggaggatgatatctgctatttccaatattttacttgcctagaatgtgttaaaggaaggatactcttctctgttattgctttgtgtgtggtaccttataactctcatgcttgtcatctcttttgccaggctgagagatgttatctccattttccaggcatgctaaccaaggcctagagtgacttgtctaaggtcatgaggctggtatgtgacagcactaggatttagtttagttttctgccagagctcttgcctcccagtttccttggaagggacttataaaatgtctgtaaggcatttaacacagccctgaagtgttacctggaactttcagatgttcatgaaaagctgccactagtacctctgtgggcacaaagctgtgctaggcatttcacttataggagagagatatttaatcctcacagaaccttgtaagagattactattcccttgttgcaagatgaagctgacggtcagagtagtgtaataatttgttcaaaggcacacagctagaagtggcaagccatgattcagattgacatctatatgactctgaaattttgttttccattgatgtgaatatgtatggacataagaatcttctaggtcccaggaggtagtctttggcgtggtgtgactgtgactgtgtcctccagctctggtgtttgtctgcccagtgaggatgggcaggaccatacttgccttgtggcacgacatgtgccctggccaatagagcatcttctgggtcaattagtggggtgtgagttcctgctttcattccatagcttgggcacctgacccagagtaattgcaggaaaacagtgaaatattagtcagctgattaccaaaacaacaaatctaagcttttggggaggtgatttcacaaaatatttatctccaaagacttcccaggtacacgggggaagacaagttagtggggagatggagggctttcttagggacacggagaggctcccaggggtttggtcacataggcctcactgtcctgctcaagcatggggagctgttctatgctgcttttctcctgacagaccctgctggtgagatggggcagcctcagtgggtttgtacaaaatgtgcttggccaggcaagctcaggactgaccatgactggaggttggctgtggccaagtgtgagtgttgggaagaaggctggctccatggaggcagtcagggattgacgtatgggtggagcaggttgctggcctcacatggccagctttctccgctggtggcagatccagcctggcaatttcatttggtggatataagtcctcactgaacagggatagtgaggtggggctcttttacctgccagatggctaaccctctggctatcctgggataggcggagggtaggatactagagccagagagctagaagaagggacagtaacggtactgttggataaaggcaaggcacctggcagggcactgtgggggtctaaaagggtgctaaatgggcctctggaaagaaagttagatgcgctgggtccacgtccccttgggttgaccctcaggagggctatggaatgtttgtgaggcctgtgtgcctctttctccaagggctgctcttctagtctcttgtggctcctcatgctcacttgtggtccttactcccttgagtggggtccagttcagggccctagccagacagcgttcagcttctcaaacttgagggctttgagccctcgcctcctgtgtacagccctttgcctggcctttggctttacagagcattcacttcacgggaccgcccccccgggcgggagggaatagagtgcaggaggctcccctttctcctgcctttgatctccctgtggtagtgttcaccgtccccacccagggttactgcctcagcccctggccctggctcacccagttccctgagcacccaggccaccaggctagtgatgctctgctgggagctgtttgtttgttcactggcagagaaagttgtttcctattgtctgctgtttgaccagtgtgacctcagagttcttcttcacttcataaacctctgggaggggccgccttcaaacagaacaatgggcctcttcaggagcaaccgggaagccccagcagccccatggctggaggtggctggctgtgtgtttagcagggctctctgttcctcgtggcctagatgcatcactgtaagcgataccgctcccctgaaccagacccgtacctgagctaccgatggaagaggaggaggtcctacagtcgggaacatgaagggagactgcgatacccgtcccgaagggagcctcccccacgaagatctcggtccagaaggtgagagggaactagataggagggaaagactccttctgtcagctgggctcagctgtggcagctccagactccttgagatgactccatccctgcccagctgtccctggatccctgccctgtcctctttgggctcctccactaacctcacctgcatgccttggcctcagcagtagctaccatccttgccgcccactctttctctgtcttggagtgccttttcttctccccacacattcccccattttctaggccagcatctttccgcttaacctcctaagccttccttggtgaggattaggaacataacctcacccctggaaagtttgctccctgggcctatcttagctcccaggtcaaacttagagttgcagcaggccacagggaactctggaagggtatagaacccttggaggcactctaccatactccccttcccctgtacccctcctcctacagctggaggatgctgtcgttggacagggctctggagggcgggcttagtacctttgcaccctcccctctctgcccacttcccaccagtgtggatgcttttagcacaggctgtccccctttagccctttacagtggccttaccacaggtctcttgcttgctaacagcaaggacccagctgaccagcgtccccatcccccttttggcagccatgaccgcctgccctaccagaggaggtaccgggagcgccgtgacagcgatacataccggtgtgaagagcggagcccatcctttggagaggactactatggaccttcacgttctcgtcatcgtcggcgatcgcgggagagggggccataccggacccgcaagcatgcccaccactgccacaaacgccgcaccaggtcttgtagcagcgcctcctcggtgagtggtagccagagtgtgctggctggggcttaaaggcctcatctcttcctagccttctctcaggctggctggtccgggtgagtactgccagccctgtgcacgtgcactggtgtgcgtgcatgtgtgtgtgtatgtgttgtctggtccaggtgtagggctgatcacagggtcctggcctctgtgtcttctggctctttccagtggcaactgtaggaactctggctccgatgctggctggcccctggcctgtctatgtctacacagtgctccagacaaaggccacgtggtgcaagtggctggggacacttcttaggacacttcttagggatcctagtagagtggctggtatggtggtctgcagctatatggcctggtccttcccacccagagactgcctcctcgtgtaactgagtgctctgatgtggactgcacccacctctgcgtctcatctgcacaccccttcccaaaggcccccagtctggagtgcctcacaggaccggaggatttgcctgtcagccagctcagactgggaacttcccttctgatctccagccaggccctctccagccgagcctctttacgaggggcagtcgcggtgaggaggggcaggtgcctgtgtgatggggcatgtgaagaaatggcagaaaggctgccgccccaggcctcgtccagttgcaggccacatgcccagagcagggcctggccagtattcctagcatggagggttgtaaggtctctggagcccacattgcgctcagtcccctggggaagcaaagccagttgtgtatttccgaggttacgtgcggtcttctcttctcccccatccctcttccctgcctccctcctgccggccttgaggcccctgaggagcagtggagaggccaggtgtcttctctgcccagcgctttctgtgacttctttgagtggctacaggttgagggttgactgtgcgggcgattgcagcgtggccctttcacctctttgcacactgccacatgctgccacaggatggcagtgcaggtctggctctgtttctctgtttggtgccctctatcgatcgtcgtgaggcttgggatgggcctagattgtgagcagcatgggtgccaaggccagggcaggagctggcatggggcctgtgtgggccattgtggtaggaagcctggcagtcgactggcccagaggatcccaggctgctttccttcttgaggctggtggcaggagggctgctgacggaaggctgtttctggtagtgatggtgaaatctggccaaggatgccgtctggaggcaggtagcagcttggctgtgagtggcagctgtcaggcatgtgcaagtctgcgtgggcgaacagaggcaggcaaggacaggctgggcattctgcagctgaagccggagcagccgctgaccagtctggatggttggacccaggcggggccagctgccttcttgcgccgccgttctcactgcatcttccgctctggcccaaagccacatgggagggtctgggagggagagactcggaggaggaggaggagggagtcggggcgatggctctcctcacagcgtggccctcagcagcagaggcaggtcatcttcctgagcgtttgtggcgctcctcttaaagataatgtccgagttttctttacatacctgtagctgtttttacttttctgtttttgaagtcagtttgtgtcttgacgtgtcccttgcaatatccctatcgttatatatgctgtgtgccttatgaaatgctgggatctggaaaatccaaccaaccaacccaccggctcctcaccgtctccacctctgcctttgactgacacctcaatctgtcaatcggaaccgcctaccatgcgattggtcggatggcgtttcggggggcggtgcatgcagagaagccaacagagcagtaagcgcagcagccggagtgtggaagatgacaaggagggtcacctggtgtgccggatcggcgattggctccaagagcgatgtacagccacctttcgtaaaactttacctctctactttctaccccccttgttagacgagacctctcctgcctggaggggcctctagtgcgcgtggtgccttagcggggccaccagtaattgcctgaatgacacagacactagcaacttccatttttaagagtgtagcagtgagagagaaaccttttttgtttttgagaatttgaatgctgtgaacttgcaggagctgccaaccccctgccctccagattctcatgcccaatttcttttctctcctagatgagattgtggggaacctgggtgaaggcacctttggcaaggtggtggagtgcttggaccatgccaggtgagcgagctgcggcagtacagctggctccggatgtgatcttcctgggaagagctggcctgaggttcttgagggtggcagctatcagagcttaacttttttctttttgaagggtggcatcaaagtagggttccgacctgtccatgttggggttttgctgaccccctgtaataagggagaaattcttgggtcctgcagttatgtggcatccctacccaagaattgttggtcagtgaaaggttctgctccaatctcttcacttctccagggctgtggtggtggatatcagaacagggccaaggccccggctcccctgtggcttggagctgcttcctgtgataacttttaggttcttggcttagcaaggggctaggagtaccaataagcccagcccaagcataagtcccattccctgagggtctgcctgagaggctgtgcagatctcagtcgagagaaacatgaccctgggctttctcaccaagcaggctgctgccttcttcagtgtgactagggtagtgtgtggtctccgctgagtgtgcctgggagagtggggtatacctgtgtgtgtcatgctgcacctcactctctcccaagcccaacagtacaatagttttttccccttaccattccacaagactagaacatttgcttcctctcctataggtctgggttggggaggccacctccagggagccagttgccaccctgccataggctctctagttggtttggcacttcagctacaaagtgcttgtgtcctcattggagccacatgccacccatatgtggccctctcgctatttcagagatgaataaacatgctcagggtttgcctgcatcatactccagttaacagcagagctggccaccactgcgctgtagtgctcctacattaaatggggtgttcaggtcattcagacccaggcgtccagcctttcctgtggccacgagatagactgagaggaagtgtccatttgctccaagttcctatgtaaatgcctgtacgactcagcgtggcccaagaggttagggttgggaccagtgggtggagggacatgcacaaccacaccgtggccaggtggagacatggcagactcaacagccgggatgcatgtaggcattctgggctgctcctctctcaggagctggagggaaaatgagcctctggagtcactagggggcaggtggagggtccagggaaactttacgggactcaaagggagccagggccagtgggggttgtcatgcagaggcagaattcagctcagcgaaaggcagggtcttattctaagagcagtgcaactctgacaggggctgccttggaagtgatgagctccctgtgctgaggactggaatgccacggagggaccctgttttaggaggaggccggagtgcatggcctttcccctgaggtcccttcctgccctgagaatctgggaaaataggtagggagaaaaaagcaggggattctctagaaggtccctttatcctgggcctgtgagccttaggcaccacagtcagcctccctgaggcctcagaggacacgcccttccaggctaggactgtctcgttccccactgggcatctgaattctagctgtcctttcctgacagggcctggcagttgagcctcagcaggtttccttctctgctggctccctgcagatggcctcctggggtgaggttgggggtgggaggcacagagcagggactgttaaaaccttctttggacacttaagaagggttcctggcattttgtggtcactgataaacactgtggcaggtaggtgcggctggagaggggtgtggtaaagggagtggccctgggcctcacagtgagaggtacccttgctggtacccctacctcttgccagatctttactcgatcctggaacccccatccctgtttgctcagacttgcagacaagctcaggaaggtcaagaggcgccgcaggagggttctcggtgggacagcctggccagggttggggctgcctggcctataggttaggtcactgtgtgagctcttggactggcactggttaagcaggattggcctctactctcccacactcctttgggagctggcagtggctgagaacataaaagcctaaggatggcaaggatgctaagagcattaactcacagatctcagggagcttgctgttgggtgggcaaaggtctggtgttgcatggggcaggctgggcatccagtatctgctctcttcagtgccggctgctcctggagtggtgtttgttgggagttgctgggttggggtggagggttggggaaggactgggcagctgctgatgagaacctctgtttccttcccgggtaccagagggaagtctcaggttgccctgaagatcatccgcaacgtgggcaagtaccgggaggctgcccggctagaaatcaacgtgctcaaaaaaatcaaggagaaggacaaagaaaacaagttgtgagtatctgcaaggagtgggagggaagccttcagtggggctgctggacccccaggggcttagtagtgtgccttcacccatccgcactgtgccttctccccacactcagaaccaggggagtgtggcaaaggtcttgctggaagcctttagactgcagtccagtcttcaccccagctgtctctgtgtcctgaggaaggcctcccagccctgcgttttgtgaattggggagctcactgggttatgctgggcataaaacaagataaaaacatgaagttggggctctcacatagtaggagatacccaaaggagggcctttctgtggcagacacactgagcactctcctccacgcactgtgctgagcctgggcagatgggtgaatccagcacagaccctcacgaagctcagcagagtgagcaagtggagaaaagcagcaccagtcctgcggagtgcactagcactttccatctctccctcagcaactctgaggcagggctgcttccatatcataagtagggaagctcggagggcttggaccagaaccgtggacatctcccctaccccccgcaggaagcttagtccttgcccagagctcatctgggtattgggtgatggctggtggggagaggtgctcttgctctgatttctcttgcactgtgtgtatctgcattctggtgtgtgacccggtggcctaggagagagttgggaactgtcttcatctgagagagggggtgaggcaggcccccagcacacagcctgagccctgcccatcctcctcctccagcctgtgtgtcttgatgtctgactggttcaacttccacggtcacatgtgcatcgcctttgagctcctgggcaagaacacctttgagttcctgaaggagaataacttccagccttaccccctaccacatgtccggcacatggcctaccagctctgccacgcccttagatgtaagtgtccaccctcaaaagaagcatgggcagccacatgcctgcagccaagtcatctggttacttgttgtccccattcattccagcacgttactaaccattctcctgggcctgagggacaccagatcccctttggcggaaaggcctgtctttgggtgggaatctcagtgtgaggatggaaaggctagggctccctccagggacctcctggaccagcctctctacccccaggcactcaggaagaaaacagaaacgaactgctctggaattggcctaaccaccaaccctgcctccctgcttcatgcatgggataaaaaggtagaagcctgacctgacagatagcaccacaggtcctgcccacatggagaccctcggtctaaccctgacttgtcatctccctgccagcctggaaaagcattatttggcagtgccagggctcagcgcagtaggatttgcaatggttgcagcagtacagaaaggctccttggtgaagttggtaggcgttgagctagaatcgctcaaggtcaccccgcatcgctcccctaccctgagcactgctactgtgataggctgcaggccactggggtgggaagccccacatggatgagaagacaggtgtcttcctcctcccacaggatctgcaagatgggacagggacaaggattccaagcaaggggaacagcttggtgaggcctggagcctgttaacgggctgagaattggctccagtggagtagactgccactggggagtggtgggccacatagttgtgagggtcttgagtgccagatgggatccttgagctgaaaagtgactactagcaagaagccactgtcagaaggggctggaggggaaaggcttgcctgcttatgactagcaatgagaggcggggctgtcttcctgggtatgcgacctgtgcactcagtcgcacaggaccctgtgcttgatttaatgtccttttgccaccaccttaatattcttagtaacttgaacaggggacctgcattttcattttgcaaagggccctgcaaattatgtagctggtgcagggaagagggaaccacctcgaggctgttgctgtagctctgctgagagacaggtgaggaggcctggtctctgcagaggagaggtggagggaggtttttcgaatggcaaatttctttcctacccccctgctaaagtatcagaaccctccaaggcctcaagtacagagaacccttgagagggaggccagcacagaggcaggctgtagtccagctccctgctgaggtgggggtgtgaggacctctggcagttgctggcattggaagaggggtctggcctagagctggcaggagagccagcttctcagtgcctacttccccttctttccctgctaccttagttctgcatgagaatcagctgacccatacagacttgaaaccagagaacatcctgtttgtgaattctgagtttgaaaccctctacaatgagcacaaggtattggtgggggtaagggtgaggccctgtttcaggggtgggttacccgctggtgcagactcctgacctggcaggcctgccttgcctttcagagctgtgaggagaagtcagtgaagaacaccagcatccgagtggctgactttggcagtgccacatttgaccatgagcaccacaccaccattgtggccacccgtcactatcgcccgcctgaggtgatccttggtgagtgactgtatggcctgtgaccttgtcatactggactgttgttgggagggtatgagcagaggcagtggcatgcctgtcattctctgccacccagggcaggcagagtttctcagaccaaggggccagtgtcatgagacacaggtgactgacctggctttatctgtcagccttactgagagagggcctcgtactgggatttgggcaagagtcctgccagccggtgtggtggctgccttgtgacttccaggctggaagcataaggccggatctcacagcctctccccatcttggcttgcagagctgggctgggcacagccctgtgacgtctggagcattggctgcattctctttgagtactaccggggcttcacactcttccaggtacagccaccctgcattggtcccctaccctgagtactgctactgtgataggctgcaggccactggggtgggaagccccacatggatgagaagacaggtgtcttcctcctcccactaatcatcatgtgagattcagaccctttaaggatgtagatgctaaagggaaggcagaggtcagggtagctggaacactcagaggagtcttatgctaggccatcgaggatggaggatggggtaggaggtgacctgaccttctagataaggggcacagatgactaaaggcatcgggatgggctgggacagggcatgttctgggcagggagtgaagagctaaccagagagaaatgtagtcacagcccagtccacctccacccacaagggctgaggagcctaggcacaggctggcaggagaagctggggctgccgcttcattggtaggtttgcatgtcctggggcagtgagggcacttgcccatctttcttgttcctttttctccttgaaggggccagagctagtactgacccccttgcactgtccctaatcttccacagacccacgaaaaccgagagcacctggtgatgatggagaagatcctagggcccatcccatcacacatgatccaccgtaccaggtaaggaccccagtagccccctcagggttggtatagaggcctttctcttcttggctgtgggtcagcagggtactggatgtggtgagtctttgctggacagtccatggttccgcaggctcctaaaagccttccctgtgtgcccctgcagacctgttgccctggttctgctgctgtcttgggagctgctcttccccacctcccaccagaggcttgtccccttactactcccacacttgactccacccccttaattttcaggaagcagaaatatttctacaaagggggcctagtttgggatgagaacagctctgacggccggtatgtgaaggagaactgcaaacctctgaaggtcagtttctggctacccccagctgaactcatgccaaggagagaccccaggcactgggcagacatacagcagagacaggccaggccgctaaaggctgcctccttgatccagctctatgggaggcggcacccaagactgctgggtgctggcaatggggcttcttgcaaactgccccagaggggcccttagccctaccccttccccatagggtggctatgaatgtaattggggaacaccagaagagccagatgtcagaagccctgctgcttcctgtccctctctctcctcgaaattttgggaagaactaggcaggactgaggtgagggggagggaagacctagacatggccaggaagcctctgtcaactgcatttggtgctcggacaagtgaatttcgcagaggtgatctctacccacctgtcaggactttgcatgtgggggcagaggcatcaacccagcaagacacctagtagcctggcaagttccgagcaaaacgttaaacaggcatgaaaggaaaggagctgctcattgtccaggagggcggaagtagagtcctccaaggaggcatcactgcctcctcgatccagtccagcaaggcgtcccagaggcaaggggacctgctgtggcttcccacgaccctgccgtcacactgaggcaccttgtgtccctgagcagagttacatgctccaagactccctggagcacgtgcagctgtttgacctgatgaggaggatgttagaatttgaccctgcccagcgcatcacactggccgaggccctgctgcaccccttctttgctggcctgacccctgaggagcggtccttccacaccagccgcaacccaagcagatgacaggcacaggccaccgcatgaggagatggagggcgggactgggccgcccagccccttgactccagcctcgaccgccaggccccaggccagagccacccaatgaacagtgcaatgtgaaggaaggcaggagcctgcaggggagcagacttggtgcccagctgccagaaagcacagatttgacccaagctatttatatgttataaagttataataaagtgtttcttactgtttgtaacccctggtaccagtgtgtccatctccaggctccttgccttccccttacctgaccttattaataaagtctttcttagcagttca

SEQ ID NO: 1045 - DNA, 56926 bp, Homo sapiens
cttccggtgcgggccccgccccggctgtggcccccggctgcggaggagtccgagacgcagctgccgcgccggggcctgagctgccgcctcctccgccgcccgaaaacccggagtgccccgcacaggtaagtggcccgggtccgggctccctcaggcatggcgggagaggaggctgcgacaggtggaggggccgaggccaggagccgaggcaggtgtagagagagaggggaatgcgcgagtcgggggcgcggggaccgcgaaggaaagtgagagcgccgcgggagccccgagcgccctgtgcccattagggcatttgagataaagcgtttgagataaagcgatgagaagggtgaggggccctggagctgagtgggcgcgcagataggtggggcgggggccatcggaagagccagcggattggctgggagggttggtagaggtaaaaatgatagggctgaatggggggaggtgaataaagaatggggggaggcgtgcaggggtgaccgggaaggtgggctgtggggcttacaggggcccggggccaaaagaatccggcagcaaaagcaggggaatggtcagcaggccgggttcaaagctgcaggtagtccgttgtacccggcttggtggtccgggaactttaggggaaatgggggaggggcccgtgtgaagggatgaagaggtttagatttgagacataagttctccaaatgtaggcaggtggcattgtttggatcgctggctgcttagggactgcgggaaaatgggctctttgggggagggtgtgtgtattgagttgtagaactgagtcatctcagtcttactataagaggctgtgggagggacacctccccctctgctggggacagcattcagagaagatggtgccacaagacaagaagcagttgttcagtgactggcaggacttggttgagaagttattccgatcgtgattgattgactgtaatgactatgaggacatttaaaatgaacaccgaattatttgctttattctgtaattttctttgacccaaattgttttcattttaaatgaacacttttgccaactgaatttaatgtggatgtaaatcttgtcatgcttttttacactgtaagaagagctaaagcagaatgaaagtattgctgcaagcgtaactcacactttctgaagtgccaagagaggaagtaaaggcagtaagaggcaaattggaatgcgaatctttcacagaacacaaaaggcacaaacagggctataagataaacagaaaatgagaatttttaatctctactaattggcctagctttaaaaattgtacccttttttactctaacctggaaaaaatcttaaatccaagcagtttttattgctgaagatgtgattacttctccgtgaatttttgaagatactaaagacactttgttttttgtctttcgacccaatcctaaaacactggaacaatgcagatatcaagtcccaacatgtgcagtgcagcttctttcatgtgatgacaaaattgtacgccatgttgcaagtcctgttcacctaaaattgcccttgcatagtaatccattcagttatggagacttgctgaagaaacataactcaagtgaagtttgttgggggtgagggcctgcaggggagaggtgggggagtaaaaggagaagagggtgtgaaagtgatgtgtgtttggagactgattggtaagaatgcagataaacctgcccccagaatgcttttggcccgaaagacttttctttttgtgtttgtcagagaatatcataatagaaatgaatcagaaagaaaggggatgtgaagagatttacttcgctgtttataaaaaagaagcagcattaacttgttgttcagacaatgttgatatctgtttcaaattaattaactttaaaatctccagaggaattcccccgtttgcttttgagtgacgattgcaatttgagactcttgcctccttgcgtgtttctttcatgttgttgaaattggattctttttgaggctataatgtccagttagtatggctcagtccactcaacaagcaggctggcaatttgatcagggaaatttgaaaagcttagacccaagagcagcttgcttggtcttgctttttctatgagagtaaaactgtctgcctgatagttctgtgtctagcttagaggtgatatctttctcctgtgggcttgggaacatactctctcctttgcaggcaggtccttcttttcctttattattgttgtttgcataattatgcttctgctacagtgcaaacccagttaccttttcagtaattaatgttcagtaacattagttcagtaacagattaatgtttgataatgtagaggaagagagatcagaacacgttagcagactagatattggctggatgtacttcttttaaagcctgctactactactgaaattcattccctatttcccctcttagatcctgtttctcttcttcacaccttttcctacccacccacgaaacccccaccactcactcatcttaaaactcaggtttaggagcatatgtttagcgttcggaactcatggccctctactggagaaaaggaaacctttttatacctgcttaacatggttgttttttccccctccttctttgtggtttctgttaatcactaaggtttagacccagtgtgcctggtgggctgtgcccaggttcagagtcatgccactctgtgggtgaagcttgaggcaaaaatggagccacttcagcagcagcagcagcagcagcagcaacaacagaagcagccacacctggctcctctgcagatggatgccagagagaagcagggccagcagatgagagaagcccagttcttgtatgcccaaaagctggtcacacagccgactctcctttccgccacagctgggagaccttctggcagcactcccttaggtcccttagccagagttccacccaccgcagcagtggcccaagtgtttgaacggggcaacatgaactcagagcctgaggaagaggacggaggtttggaagatgaggatggggatgatgaagttgcagaggtggctgagaaagaaacccaggctgcttcaaaatattttcatgtgcagaaagtagctcgccaagatcccagagtggcacccatgtccaatctacttccagcaccagggctcccaccacatggacaacaagctaaagaagaccataccaaagatgcttccaaggcctcaccttctgtctccacagcaggacagccgaactggaatctggatgagcagctcaagcaggtcagtctttctggtattgtaggtcatttggtcttcctgaaggccagagaggggtcatggactgacagggtcaggggctgtgccagtctgtgccttctcaccccacttcggtgaccaacagcctagacatgaatagactttggatttttttcttatttaatatttattttcttcattaaagcaatgaaatatatgttactctttttttttttttttttttgacatggagtctcactctgtcacccaagctggagtgcagtggcatgatctcggctcactgcaacctccatctcccaggttcaagcgattctcctgcctcagtctcctgagtagctgggactataggcgcgtgccactatgcctggcttattttttgcatttttagcagagacggggtttcaccgtgttagccaagatggtctcgatctcctgaccccgtgatctgcctgcctcggcctcccaaaatgttgggattacaggcatgagccaccgcccctggcctgtatgttactcttaatataggttttgccaagtttgatgtgaaagaatgtcaatacaatcttcttttttaaaggaaggatgaagttgcaacagtgttgtgaggaatatctaaaatgagatgtgtgactaattacagcttttctaataataatgtttctaacagtaatgtaaaagaaagttcttgcctaagacagtttcttagctccaggctaaccctctttaaggacagttggttgttttggagctaaacacagctgacaagaagcacttgcattgtatatattttccaacaaagagccttgtagacatgatttcatttcactcttacatcatccccttgacaacagggaagggtagacctcaaaatttcctttttagtcaaggaaagctgaagtgacttccaaatggctgagtatcagagtcagttagggagctttttaaaaaatacagattgctgagtcctaatgaattatcttggagggtggagcctagggaatctttgttttcaaccaagcctcttctctttgtgacccataatatagtttttcctcgcccaaaggatgggagtgatgataagttgttccagcttaagtgacttgttggtgcttagtaagggagttcatgggtaccctgcagaagcacacacacttcttgtgatccagtggtactgtttagaaatcatttgtgaaaagctgtgggttttcacagggcaactgagaagtcatataagaaaggtcctttggaacccaaaaaatcaaacatcttggatcaggaggtctgtacagtagatctgagttttacaacaatagtgtttgcagccagcagtgggattcaaatcccatcacttccaaatattgcccttgtgatcttttagtagggctctgatttgctctgagcctgtgtcttctcatctgtgaaataaaaagagtgccactgcctcccatggatgttgtaaggattaaccgagctagcacatgtgaaagcttgtccagtgccaggcacatggtaggtaatagtgcccgggggagctcttttatgtaaacagtgccatcctctcctgcatcacatagacatgcctctgaagtgggagatgtactgagatacacagaggttttcactcatcacccagggagatagtggcagagctaggactagaatcagagaatcccaacttccacgacagcagcaccctggccgccagcccagacccgcctcccactgattgctttggtttagcaaaacatctgtgagttgccggctgcccccgcactgctgtgtggttggcagagttccataccggccgctgagtcagctcatagcaggatcctgccctgacagcgctgggaaagttcaggcccgaggcggctgggctgcccccgccttggcagctggccagcgtctgcgtgtgtgcggtcgttcctagaaagtgcagccgcatgcgaggaacaagtggagctccagagcctgtctgtcttcaggaagtgtagcaggtgttgaggtcaagccattagaggtttaaaaaaagactcttcagaactggcgtgtgcatgtgcacacgtgtgcaccgtggcagggcacccagcatcatgttatctagatggtggcagccctatgactacgtagctcagtattcagggggctggctgttggcatttgaaactctttgcgttcactttatgtttctgaggcatattcactaattatagactgcttggcagagcacctgccaaaatgttttataaataccacagtagctgaggtataatccctcacccaaaatttaccttcccccaggatttggagatcaagaactgaactggggggctttgggtagcaatgacttaaaccgtcagatgtgcacgtccttttcccctttaatttttaacattgatttgatctgtgctctccttttctataaatcctgattttaaaggagtaaatcatatgcttggggattttaaaactttttttttagtatattttagaagggccaaaaataataatattcttggggagagcctatagaaaccattacagatcattagactagcttgttttgttgttcaaaatctttactttatgaaacttaatggagtgcaaaaatagaatatcccttgctccagcaacaattacaaagacctttacaattgacacagatctttcccccccgccttccccctcccccgccgacacagagcgcactctgttgcccaggctggagtgcagtggcgcgatctcggcttcctgcaacctccgcctcctgagttcaagtgattttcgtgcctcaccctccctagcagctgagattacaggcatatgctaccatgcctggctaatttatttttttatttttatttatttttttgtatttttagtagagacagggtttcgtcatgttggccaggctggtctcaaactcctgacctcaagtgatccgcccgtcctggcctcccaaagtgctgggattacaggcgtgagccaccgcgcctaccctgacacagatcttattgttaatgtgatacagtgtccatcttgttcttttgaacaacaaacttttacagaggcttctttgtgccagacctgtgctgtatgaaacaaggcatgtttctctctcagggagttcaggtctagcggtggcagtgtgggaacctcaagggggattcgaacttgggttacaataatttgattctgtcctgagtctactggagcccagccacccagtctgctatggcagagatattttaaaacagagttttgtttcaaacattcacatgccaaagtttaaaaagttaattttgtctacagcatagcatagcttggcaaaccaacaggaatactcagaagtattttgcaagattttggggtaagggaggacaggcatctgctaactgaaaagtgaaactgggaaagcttaagggttccagagattattctttgcatctgaaatcccttacttagaacatgtaaagtcaaaattatttcgtggattctctttgaagaaactcttagaaaatatttgcttctcaaggcctggattgttaaggtgtggtattattctctgacaccacagtgatgggaagatggataacgccattgagccaagtgttctaaaacccatcagattcctatgggcagagtaaataattgtaaaacaagaaaacagacaaagaactgagtgttccttttctcaaaggagatcatacagccaactaggggatgttgctggccttttgggggtggtgttctccccctctggtagaaggtggttcaagcagtacaggctgggtctgtcttgagcccattggtagagctaggttactagaagggtgtagacccccttcgatagaatagaaagaagaaagatggcttggcaggcatgtggggccagggtgcatgtgtccgattttctgcatactttggcagtcgctttggttactgcatgtggctgtgatccaaccacgggcttaacatactttcacagccaattcagttgaaagcactgggagccattgcacaataaatgttggccccctcctctacccttccccttctagcatgttttacaagattttgttttgtgactgccttctaggatggaagggtttaatttcagaatatttgcaattaaagaattcctaacgtcctaaagcttgctaatcacatgtgttaacaaggacagggtattaccaatttcaaacacctccaagccgcttggggcaccctcagctcatgacagcgtgggttctctctgaatttgttggagaagcacttctgcagtacagaagcaaaggaagctccatgacaaatgggaagaattgccatgttagatgggcactgggagagacaaagggaatgtgatttgagaagagggagtttcgtgtttgtttttgtttttttggggttttttttgcctattcttaaccatgagcaaaatcaatctcatcttaccgtgagagtcgacttcctgctgggcaattagtggagactactgtccatttcttctaatgccatgactgactgactggtgtccagaagccatccctctaattaaggtgtagtcccttgggataggcctacttttctttctttttttttctttttttttagacggtgtctcgctgtcactcaggctagagtgcagtggcatgatctcggctcactgcaggctccaccccccggggttcacgccattctcctgcctcagcctcctgagtagctgggactacaggtgcccgccaccacgcccggctaatttttttgtatttttagtagagacggggtttcaccgtgttagccaggatggtctcgatctcctgacctcgtgatccgtccgcctcggcctcccaaagtgctgggattacaggcgtgagccactgcgcccggccgggataggcctacttttcttggtagatactgcatgactatcattagctgggtgtggtggcacacgcctgtagtcccaactacttcggcaggctgaggcaggaaaatcacttgaacctgggaggcgaaggttgcagtgagtcgatatcatgccacttgcactccagtttggatgacagagtgagatggtgtaaaaaaaaaaaaaaagggaaaaagaaaagatacagcatgactatggaacatttgaggcttttttaaaaaactgtgcaaagtattgcccaaaaaagaaaatgttcgtaggctttcctcatgttctttatagagctaccttgcatgcccttgccttctgcagtcacaatggaatccatctagttgagtggttctcaattagaggtgacccctgccccttcccaggggacatttggcagtgtcaggagacatttttgattgccatgactggagtagggggcagtgtgctatgggcgtctagtgggtagaccagggatgctgctaaacatcctataacgcactggacagccccccaacagcaaagagttatctggtccaaaataacagtagtgccaaggttgagaaaccgtgctctagattgtgcaaccagaaagaacataagcttcgctatcatcagacagcaccagagactcttttcctttgtgtttcagtctcagtaactgaggagtttggcagccttgaattttcttgacttctgctttcaatatctgtaccgagctcatgtctttcctctagtcatctaggtgaacagactgtcacttgggaaaggtttggggcctagaacttgagatctcttacttgactctatcagtgattctttcagcccagcactccatgatatctttgatatctttggtgatatatgagagagcttggttgcccttgtagacattaaccccaaaaggttaaagtgtaaatacttggcagacttgttacctagtaacagatttaattattaaatcagcattggttttggagccagaggatgtggattaagaccctacttcccgccaggcgcagtggctcacacctgtaatcccagcactttgggaggcggaggcaggcggatcacgaggtcaggagatcaagaccatcttgactaacacagtgaaacatcatctccgtctctactaaaaatacaaaaaaaaaaaaagttagctgggcgtggtggcaggcgcctgcggtcccaagctactccggaggctgaggcaggagagtggcatgaacccgggaggcagaacttgcagtaagctgagatcacaccactgcactccagcctgggtgacagagtgagtgtccatctcaaaaaaaaaaaaggaaaagaaaaaagaccctgcttccactgcttgcttgctctagtactttggacaagcgttctaatctgcctctctgaacccatgcatcaatctattccagaggatgataatcctctcccgctatcctcaggaagtgattttaaggatattacaaaggtagaagaaaaatatgagtgtgaaagagctttgcagggttagggcgaattgtcatcaacacctaagtcctttttgaagctaccgtcgtccctcacatgcaggggattggttccaagacccccacatataccaaaatttgagcatactcaagtcctgcagtcagctctgtggaacccacatatattaaaagtcagtcttccatatacatgggtttcacatctcgtaaattttgtctttgatccaagttgggttgaaaatagtttacatataagtggacccaggcagttcaaatccacgttgaagggtcaatcataatttttcagtctttatgacctttgtagataagatgctccataaatcctacccactactctaaaacaactccttttcaggttttctagagccctgaccacactctggtgttctgaagttctctgaaacctttcaggattatgtgagcttaaaccatggcgcttctgaagctgtatctttccgtattagcatagggatatgtgtgtattgttctttaggtagaagtaagctttatagatactaagtccttataaatacacaatcactgacttgacttgggtccttaccctctcaccagaggctaatttctctacatgtgtcccagatcccatccccttccaggtttccagggacttgctccatcagtgaaccctccatttcctgactctttgggctcattctcttccaggccttttccacgtttacgcatcttctctctgtcagacttaaaaacaagcaaacaacaacaaaaacctttaatcttaaattttacctgagtcagttgttaacaaggaaatgagagaccacttttaaaaaatttcctcttgattgcacattattgccagctttttttctattcctaactatcccccacatccttgcaacaaagcttctcaaaggaattggttttactctttatttccatttgtcacctcctactcactcctcagcatactccagtctgatctctgtttcttccatgtccctgaagttccatgttgctaagcccagccttccctgacctcattgatttctcagcattattgaatacagagcactccctccttgaatattctcttcttttgctttctatagtccttcattctgcttatgcttattttcttttccttttcttttttctttctttcctttttttttttttttttttttctgagacggagtctcgctctgccgcccaggctagagtgctgtggcgtgatcttggctcactgcaatctccgcctcccgggttcaagcgattctcctgcctcagcctctcaagtagctgggacaacaggcgcatgccaccacgcccagctaattttttgtatttttaatagagatggggtttcattatgttagccaggatggtctcaatctcctgacctcgtgatccacccgccttggcctcccaaagtgctgggattacaggcatacaccaccacacccggctaattttgtatttttggtagaaacggggtttctccacgttggtcaggctggtctcgaactcccgacctcaggtaatccacacaccttggcctcccaaagtgctgggattacaggcatgagccaccacgcccagcctattctatggattttgacaaatgtgtaatgacatgtatccgccattgtagtatcacacagagtagtttcactgtcctaaaaattctctgtgcttcacctattcatctttccctcccccttaacccctggcagcccctgattcttttcctgtctatggttttgtctcctccagaatgttatatggtgggatcattaatgtagcctttttagattggctttctccacttagtaatgtgcatttaagcttcctctatatctttttatggcttagtagcttatttctttttgtgctgaataatattttgttttctggacataccacagtttatccattcacctcctgaaggacgtcttggttgcttcaaagttttggcaattatgaataaagctatcatacacatctgtatacaggtttttgtgtagatataagtttcagtttatctgggtaaataccaagaagcgtgattgctggattgtgtggtaagagtatttttagctttctaagaaactgcccaactgtgtctcaaagtgggtgtaccattttgcattcccgtcagcagtgaatgagcttctgttgctccacatcctcaccagcatttggtatcgttagtgctttggattttggccatgttcctttaactgaaatttttatttagctaattatagattcacagggagttgaaagaaagcaatgtcatgtacactttgtccagtttccctatggtaacagcatatacaggtatagtatgctgtcatacctggatattgatgttgacatcatccactgatcctacttagatttcttcttcagttttacatgtactcatttgtgtgtgttctgtttttaagccattttagttttacgttgaacacattttttgaaattcttgttacttaataaatgcattcaaggctatagagttttccctggatctcacttttgctgtaccccacaagttctgatgtgtagtggtttcattgttggctagtactaaacattttataatttcagttttaattgcttcttcaactcatgggttgttaaaagtattttttggttcccaaatatgtgggttttatctcttttccagtattattttatagcttgattacattgtagttgggaaacgagcatggtatcaattctctgaaatttaagatattctttatgttggccttatgtgtgattagtttctataaatgttccatgtgtgcttggagagaatgtatgttaatccatttcattataaggattagtgatacatttggatctatttctgccctcttttttttgttttgttttttaatttttatttatttatttatttatttatttattattttttgagacagagtttcgctcttgttgcccaggctggagtgcaatggcacaatctcggcgcactgcaacctccgcctcccgggttcaagagattctcctgcctcagcctcctgagtagctgggattacaggcatgcaccgccacacccagctaattttgtattttttttgttgttgtttattttttttgagacagagtctcgctctgtcgctcaggctagagtgcagtggcacgatcttggctcattacgagctccgcctcctgggttcatgccattctcctgcctcagcctcccaagtagctgggactacaggcgcctgccacaacgcctggctaattttttgtatttttagtagagaacggggtttctccatgttggtcaggctggtctcgatctcctgacctcaggtgatccacccaactcggcctcccaaagtgctgagattacaggcatgagccaccatgcccagccctgtttgtttttgagatggagcctctctctgtcacccaggctggagtgcagtggcatgatttctgctcactgtaacctctgcctcccgggctcaagcagccctcccgcctcagcctcccaagtacctgggattacaagcatgcgctaccacactcggctaatttttgtatttttagtagagacaggatttcaccatgttggcaaggctggtcttgaactcctgacttcaagtgatctacccgcctcagcctcccaaagtgctaggattacaagtgtgagccacagtgcctggtcatgccctcttattttggattttcaatttaactatacttttcttgttttctctttttctgtcttgtattgatttgatcgagttttatttatttagcctttatgtcctttgctggtctagaaattatacttttctgtttttattcttctattggttacttttagattgtaatttatattctttttacactaaaggcatatctcagagatattgcaggttcagttccagaccaccacaataaagcaatattgcaataaaataagtcatacattttttgtttcctgtataaaaattatgtttattctctggtctattaagtatacagtagctttcattatacctaaaaaaaaacaacaatgtacataccttaactaaaatgttttattgctcttgaatgttcccagcacaaagaaatggtagatgtttgtggtgatggagatgctaattaccctgatctgatcactatacataatatgtatgaaaacaactctgtgtacctcattaatatatataattattatttgtcaattaaaattaaagtaatactttattacaagaaaaacaataacaagtatctgagccttcagcgagttgtaatctttttgttgatagaaggtcctgccttgatgttgatggcttctgactgatctaggtgctgggtactgaagcttggagtggctgtggcaatttcatagaataagacaacagtgaagtttgctacgattgactcttttttttttcttttttgaagcagggtctcactctttcacccagggtggagtgcagtgacgcaatcacagctcactgcagcctcgacctgttgggctcatgtgattctcccacctcagccttttgagtagctggggccacgggcatgtgtcaccatgcccaactaatttttaaaaatcttttgtagaaacagggtctcactgtgttgcctaagctggtctcaaaactcctggttcaagcaatcctcctgcctcagcttcccaaagtgctgggattacaggcatgagccaccatgcctggccccagttgctattttgacctcctcccatgaatcatgaaatattcttgatgacacctagaacagtgaatcctttccagaaggtttccaatttgctttgcccggatccataagaggaatccctgtctatggcagctgtagccttacgagctgtatttctttttttttttttttttttttttgagacggaatctcaccttgttgcccaggctggagtgcagtggcacaatctccgctcactgcaagctccgcctcccaggttcatgccattctcctgcctcagcctcccgagtagctgagactacaggcgcccaccagcatgcccggctaattttttggtatttttagtagagacggggtttcaccgtgttagccgggatggtctcgatctcctgaccttgtgatccgcccgcctcagcctccgaaggtgctgggattacaggcttgagccaccgagcccggctatctgggctttcaacatgccttcctcactaagcttaataatttctagcttttgatttaaagtgagagacatacaactcttcctttcatttgaatacttagaggtcattgcaaggttactaattggcctaatttcagtatggttgtgtccaagagagtagggaggcccaagaagagggagaaagatggaggaacagctagggtggttggtggagcagtcagaatacatacaacatttatcagtgaagtttgatatcttatatgggtgtgattctaggctctccaaagcaattacaatggtaacatcaaagatgactgatcacagatcaccataacagatgtaataatttttttaagtgtgaaatactacgagaattaccagtatgtgacagagacacaaagtgagcacgtgctgttagaaattaggtgtgctgtgctttcaaacattggtaccttagaaattctagttttaacatctacctctccaatcctatttaccagtttatagtggccagtattttagttctaatttgttttaacccgtccccaaattagtttttttcccctcacagttattatttatttagacttacgaagtttatccatttcttttctcaccattacttgatcctactcattccctctgggctcactttccttttccttttttcttttttttgttttttgttttttttttttttttgagacggagtctcactctgttgcccaggctggagtgcagaggtgcaatctcggctcactgcaacctctgcctgccaggttcaagcgattcttctgcctcagcctcctgagtagctgggactacaggcgtgtgccaccatgcccagctaatttttgtatttttttagtagagacagggtttcaccatattggccaggctggtctcgaactcctgacctcgtgatccacccgcttcggcctcccaaagtgctaggattacagacgtgagccagcatgcacagcctcctttttctttatttactaactttttttagcagagacttatatgtaataaaagtcttggccaggcatgatggctcatacctataattccagcactttcggaggccaacgcaggcggattgcttgagcccaggagatcaagaccagcctgagcaacatgatgaaaccctgtctctaccgaaaaaaaaaaaaattagccagataggttggtacctgcctgtagtcccagctacttgggaggctgaggtgggaggatctcttgagcccaagagatggaggctgcagtgagctatgatggtgccatgcactccagcctggatgagagtgagaccctgtctcaaaaaaaaaaaattgtggtatgtttgaaactttcaaaaaatctttttattttgccctcacttttgtacagttgttcatagctttagattctacattgaccattatttttttcttcacccttaatgataagatttcattgtttcctaacaactgtttttgctgttgagaaatctagtgtcagtctgttaatctttttctagctttttatttaaagtgagagacatacaactcttcctttcgcttgaatacttagaggccattgcaaggttattattggcctaatttcaatatggttgtgtccaagggagtagggaggatctttttctctcttgtagcttttaagattttttctttttgactctgctattctgcactttaattacagtattctaggtttcgacttacttttttttttttttttttttttgagacggagtctcactctgtcgcccaggctggagtgcagtggcatgatctcagctcactgcaagcactgccttcagggttcatgccattctcccgcctcagcttcctgagtagctgggactacaggcgcccgccaccacgcctagctaattttttgtatttttagtagagacagggtttcactgtgttagcctggatggtctcgatctcctgacctcatgatccgcccacctcggcctcccaaagtgctgggattacaggcgtgagccacgcgcccggcctttcaacttacttttattccacttgggtctctgtctgctccttcaatctggtttgtgtcttttttttttttttttttttgggtactattttttcttaaccagtattctaatagaagtatttgaacctcctcattcagtctcctgtgcgtcttttcttttaaaatcttatgtatttatatcattctcctgcattctggattattttcacatttaattttctaatttctaattctgtcttcagctctatctgttctactttatggctctttaaaaaatggtttgtcgtaattattgtgtttgtttataaattttttggcatttaaaaatctgcctgtttttactttatggtttctattccttcagctctttgaacatctttgactttttaaaactttatattggaattgctaaaactcatttatggaaatttcatacatacaaaaaaaaaagaatagtaatgaaccatctgtgttctttaatcagctttcaacaagtatcaacagtctgccattctttttaaacatgcttattttaaagatgcttttagagtctattattatctctaattcttggggtgcaagttcttcctgtgtcatgttactgtcccttaagatggtttatttcctcttggtttgtttttgttttttttccagtgtaaattcattttgagtggggatttgtttctgtaggaatcccatgtgccttggatggtggaagcattcctaaggggagttttgtttttccctctgctggggctgcacaagtttagctcgttgcattggtttgggtagtgtgaatttgaagcctacatctgtgcctagtgagagcccctcaatatgagtcccctgccagatggcacggttccttgcagcttcgccgggctggtgggcagtgtttttaggcccagtttatggcgggccatgtagtctctcatggcctctggctttatgcagttgtttctgttctggttcctggcatgcaggggcctacagcctggactcccttctcttggggttgattcagtctccagctctcagttcagcactcggctcttaagaaccctattcgggtcatgttctcccttgagcccttcagctttgccacttgctcactgattgctaccattttgtttctgctgctgtggactctgctttctttctgggtttcaagctcagctatgtatgcaacgggtagagtgttaaatgttatccagcttttctatgtgaggttttctttggggaagaagcgagggagatggtggagttccttcacatcagactatcctcactcacagttttgtttgcttgttttcttgtttttgttttttaataactaagactttttgacctcttatgtgccaagtaccttatttcatttcattgtgtgaggcaggtcctaatattatcccctttatgtgtttgttttatttacagatgagggaaaaggtcaagtgggaagcttgtggtctcacagttgggaagctggctagtgaacccaggtggtctgacttctagctccatattccctcttgctcccttccagatagaacaggagaaaaataatctttccttagtggttttattactctgcaaatgacttttacttattttttctgattgtcaaggtaatgcaggctcattttagaaaacatggaaaatgtaaaaatttgtaaagaagaaaatacaatcactacagccacataacttagatttaatataactataaacatttgttgtacttgcgttttgaagaaaaatgcctactatagatacagttttaaattttatatacaggctgggtgccgtggctcacacctgtaactccagtactttggaaggccaaggcaggtggatcgcttgagcccaggagtttgagaccagcctaggcaacatggcgaaaccctgtctctactaaaaaaaaaaccacacacacaaaaattagccggagtggtggcacacacctgtaatcccagctactcaggaagctgaggcagaagaatcacttgaatctgggagatggagattgcagtgagccacgattgcaccactgcactccagcctgggcaacagagcaagactgtctcaaaaaaaaaaaaaatttatatacaattttgtgcttaacttttatcacctaacaggccttgagcaatttaaagtattactttaaaatattttagttttcaaagtatattacagaagtaataataactcaaataattttagaaatttggaaatgtatgaaataaaagtctgactcttcaggtgtaattgttaacagtttggtctacaccttcttggagctttttcttttcacaaatatattttgtctgttctacatattgttctaccacttgcttttgtactctgctctggcagtcctccatgagtgttcatgaagatctatttttcgtgtttttataattatttatttaaaatcacataagcggtatgaataggtgctcatgaaaattaaaacaatatggaaaaatacagagtaaaaattcgtagttaaaaaaataccatggtgtcctgttgcctgtcctgtgtccttacacctcacaagtaggagtgaatcagcttctaggactgtttctgtgtatttactgactgaagtgtgcagtcacagaacatgtgagtgtgaatgtacttgtgtatgtgtgtgtagtatgtgtaaccctatgccctggtatatgtatttctgtggtgggatagattattatagatgttgattaggtgtctatgtatatgttagcttttcaatatatactgttaattaccctcaaagatattactccgctttgctaccggtgatatattttcccaaacccttgtcaacattggttattatcagtccttttatttttgctgtcttttcatatgtttatgaaactcctgggctcaagcaatccttgtgcttcagcctcccaaagtgctgggattataggtgtgacccaccgtgcccagcccgtagtttgtctttcaacttgatgtgtggttctttaatcaagtaggggtttaaaattttgatatagctaaatttattgatttttctctttatggtttctgtcatacttgagaaggcctttccctaagattacaaaaaatattctctattcttaatactttatggttgtgtttttaatcgtagctctttactacatctagaatgaatgagaaggatgaatagaatgaataggaatcaagtgtgtttaaagagtattgctatttttgatggctgcataatgttttatcacatggatagcaccttcatgtgttgcccattcccttaatgtcagacatttagactgctttaaattttttactcttataaataaaattatactgtatttctagttatttccttaggatagagtcatagaccagaattacaagatcaggaggagactaagaaagtgaggcagttataagcagggacttaaagctgccctgcctgcaattgattcccaactccaccatttggtcactttgtaaccaagtcactggacttccttttgctttggttttctcatctgaagagtagggataataatagtacccacttcagagcactgtgctgaggattaaatgtcaatacatataaaatgctggaatagtgcctggcaggtagttagcacagatagtccctgacttaagatggttcaactcaactatttttcaaccttatggtggtacaaaagccatgcacactcagtagaaactacttcaagtacccatacaactattctgtttatcctcttccattgtagtattcagtaaattacaagatactcaacatgttattataaaataggctttgtattaaatgattttgcctaattgtaggctaatatatgtgttctgagcacgtttaaggtaggctaggttgcactccagccctggcgacagagcaagactctgtcttaaaaaaaaaaaaaaaaaaagcaggctaggttaagctatgatgtttagtaggctaggtgtattaaatgcatttccgacaacggtattttcttttcttttcttttcttttcttttttttgtgagttgaagtcttgccctgtcgcccaggctggagtgcaatagcacgatcttggctcactgcaacctccacctcccaggttcaagcaattctcctgcctccacctcccgagtagctgggattacaggcatccaccaccacacccagctaattttgtatttttagtagagactgggtttcaccatgttggccaggctagtctcgaactcctgtcctcaggtgatccgcccacctcggcctcccaaactgctgggattacaggcatgagccaccatgcccagtccaatattttcaacttctggtgagtatattgggttgttaacgccatcataagtatttttctgttttctgagacagggtctcactgtctcccggggggaatgcagtggtgtgattgctgctcactgcagcctggaactcccagtctcaaccaatcctctcaccacagcctcccaaagtgctgggattacaggcacgagccacctcacctggtccccatcataagttgaagagcacgtgtactcaattattagttgttgctgctgctgtttttattgtgataggcattttaaggcaagtgactttccagaaagtcatactattttatatttccagtatgggaatatgggagatcccattgtaccaacccttgttgtcactgaaaattattttttgaagctttgctaattttacatatgaatcatgggccccttttttaaaaatacaaattcttatgtttagctcttgggccttaaaatttacctgctatctttaggaaatgacttatattgccttctagaccccttttctagagttgtcgtttagaactagcagcccaccttcttttaagtgtgttctgattttccccccagattattcacttagcttgtgctgagtctcctaagtttattcccgttggcttgttcttcaggtatcaacattcatttgagcctcgaccacctgtcaggccctgtgcttgatgcaccagcctcacagaggagtcaatcactatccccatgtgagagagcctcagcctggtagaggtggccggtggcatagggacagttgtcatcagagaaggaatgtgtatatcatagtagcaccccaggatgggggtgtggacctggaggaagccttaggagaagctctgagaaatctgtgaatgcagctgacttttaaacacaaactgtgactgtgttctgcctgaggacacccaaacttgtggaatcccaaatttgaaaataaaggagggattttttaactttgtaaagtaacttatgatagtaatttttaaaaatgttgttcttcctatacatttaaaatgtgttgtttggggggaaaaaaaagttttatgaaacttttgggcaagtttccaacctcttaggtctgtttcctttctgtcaccagcgggtccattgaagtgttcttgtgctgggctctccaactctgactttgtgcaactctgtgtggagcctctgtggtgtggatggatgtcagcaaccattgtggaagttcaggtggtagctcaagggttggagtaagccgtagtgctgccaagtcagattctgcagagaaaaggagctaggacttacttacctctgtggctctcggacttggacttggctgggccagttcatgccttggtatcagggtgtcctcatcaccaacaatgtattttagtttttctgccacctttggtaggaacatctatttctgggaagtcttcttgatcattgcatggagtgattctgtgcttagtggaaaggtgggaccgctgccctctcttcctcccctgctctgcccgctttctacagcttaatcagagaagtgtcctttagctcttttccaagccactgagtttgaattgatctccgctgctagcaagaggtgggaaggctctttctggttcctgctaaagttacctgacagcggaaggtgtgcatctgataattataactctagtgtttccaaggcctgagcgatttagttaagagcactaatcctgatcttatcaagagggttttgtagtccaacagtgttgcttataacagtatctgttttacttcctggggctcccctcccctcttaggattctcctgtaatcctgcccattatgccttgtgcatgtctcattacctcctgaaatcagttaaaactggtatgagggcaaagagcattttttcttttcttcataccaagatctgagaattggatttttaacattacatcattaatcaggccagcagtagagtagtcacaaatgtggtatacgtaatgcctgcagagccatggatctggccaatgataagatagtttatttgttgcttattaaaaacaacaacagccacagtcagcccaaatgctttagttacattttgtattttggagcagttagttgccatccatgagcttgggatcagcccctttgaagtctaacgattttctttttctttttctttttgagacagggtatcactctgtcacctgggctggagtgcagtggttcaatcatgactcattgcagcctccatctttcaggctcaagcaatcctcctatctcagcctcccaagtagcttggactacaggcacatgccaccacacccagctaattttttaattttttggtagagatggggtttcaccatgttgccaggctggtctcaaactcctgggctcaagtgatccacctgcctcagcctcccaaagtgctgagattacagtcatgagccaccatgtctggcctgaagtctagtgattttctaatgattactttgaggttcaggtcctaggagtttgcttaaatccttgaccttgggattcataatctatttgatttatagagaatagacacattactgttctgtgtcttttttttttaaattaattattattttttatttttttgaaatagggtcttgccctgttacccaggctggagtgtagtggtacaattgtatctcactgcaacctcagcctcccaggctcaagcgctcctcccacctcatcctcccaagtagctgggactataggcatgtgccaccatgcccagctaatttttttatttttttaattttgtagagatggagtctccatatgtttcctaggctggtctcaaactcccgggcttaagcagtccttccacctcagcctcctaaagtgctgggattacaggtgtgagccaccgcaccctgttctgtgtcttcagagaactctcaagaatctctataaaagttgtcagtatgcacaatggcaatttaaggacagggcagtttctgagaggttccaaaatatcaggaacccaagtgaagacttgttagctcagcccctgggctttaaaccccaaggaagggttaacccttgccttggggaggaatgaggtatgggaactaaaattgctttggacatctgagctgtgctttaataagatattccaggtggtcaaggagtaatcctaaaatagcctagatacttaattgcttttaaagtcaggcgcttctgtctctggggaagtgcagctctaaggaatgcagagctggctcctaagatcttagaagcatggtctcgttgttttttttgttttttttttttttaatcccagtaaaaagaaaaggcccaaggtagccttcttggatcaggagacctttgttaaatctacctctttcttctcattggaagattggcagtaagccattggcttctcctgctgccaggtgccataacctggcttcttccagggctgtgagattggtgttgtcaccccacctcactaggcagtggtctgttttcattagtgcttaaaggcttcctgcttgatcccctgtccagcctctgtttgcatcagaacatacctttctcactataagaattcagattaatccttctctttctctttcatcccctcaatccagatccagttgattctccatttatggcactgatttctccctcattctgctactctccgtctcccccagtcccacattctcagcttgggctactgcacagccacctacccccagtgcaggctttccctctcagattttcaataccatttacaaaatctgtcagcattacaagtcattactgaggggcattaaaaatatttttgattaaatgaaaaatcatactactctcttacttgtaattgaaagactaaataggccaggcgcagtggctcacacctgtaatcccatcacttggggaggctgagacgggcagatcacctgaggtcaggagtttgagaccagcctggccaacatggtaaaacccgtctctactaaaaaaaaatacaaaaattagctgggcatggtggcgcgtgcctgtaatcccagctgctcaggaggctgaggcaccagaatcacttaaaccagggaggcggaggttgtagtgagcccagattacaccactgcactccagcccgggtgacagagtgagactctgtctcaaaaaaaaaaaaaaagagactaaataaattttgtgaaggtgtccgttctatgagaaattctctatgatttcagtgcagcctggttccaaatcttcattgtagggtggaaagcaaatgataagtcgtgacaaatggttcagattaatctagaaaataatataatttttaaaataaaaaaagagcataattgcattttgtaattgtttgtctctctctctctccattagacagtaagctccatgaggtgatcatctgtcttgttccttttccttcagaaccttttaccataactggtaaattctaggtgatcaagtgtttgtacatgaatgaatataatggaaaaaaaaggaaaagtgaaaatcccccagttccaatccgattaggtgtctatgtacatttgtatgtttctgttattttttttttcaacaaaaatgggccactaaagcagtctaaaacattgatttaatcatgtgctttcctgtccagaaaacatccactgcctccccactgttcacagttcagagtttaaatttccttctggtattcaaggcatctcacagcccctttcaactttaactattcagactttctgtccttatatcctccctgtcaaaacatgccttgtttataccccactccatgctcatttagactgcaaatctcccttcaacccattcttcaaggccagcttaacctccacctctaagccatccagccttttcttctacctcctgagtaccttgggttttcctatttgttgtcttgctattatatgctatatgtgttcagtttgtttttccaacttcatggtaagactcccagtggtgggaacaattttttttttttttagtggtattctcagcagcttgcacaatgctctacctggggtaggttctcaggaaatctgtgttgaataaacttgtcatcaggtctttgcttctcaggacagaaagggcccctagagaccatctcatccaccctgtctcatgttggattccacgccatgacatgccatacagatagtcatccagagacaggaagttgcccacctcctgggaagctcactccattaccaggcagttctacttgttttaaaaagtccttctgtagacctgaaatcttcctcagggtaacttctgcctatcacactagttgtgccctctggagctttagaagaaaggaggaaaaagcctagtttctcttcactcactacctttagattttcaaagatagtctgtttatttcccctgtgtgctgttgaaatgggttccagggttgagatgctggagaagcactattctaattttgagtagcagtcaggtcagaccttgattcattatttttgaaggcctgtgtgtgcatgtcacagtgtaagctgccatcttcctctggtccattcagaggtgtagccctcttctctttttctcctctcccctgatcctctgtcttctgggggaagatgggcccattctactggaatggtctattttggagggaggggtaaaaagttagcaattcttatttcagtaccgccagataactctcctgggcaagcattgtgtgagggctgcttttcgtttggctaaagtgcccaggtgaagccatgagataaagcaaagataaaagagtctcccattgataggagctgcccagtgccatgacatgggcatttcaggcatctctggacagaggattttattctcacttccttttcttcttttctcccttcctgatctccttatccagaacacttcgtgttattctttcaaactacaagtcagtatggtgtaacagcgagagccagacagacctaggtttacatcctggcactgtcactaagaagctctgagaccctgagcaggttatttgagctctttgagccattgttttcccatttctaaaataaccacttctacattatagaattaagtgagaaaatgcttgtaaggctcctggtacaatccttagtatgcagaaggcacacaaacactagcttcctgctaccttttctctttcccccaaccttcttttcctggggaaaattagctgaatgtaggtatagtagccaaagctagtcttgggtgtgtatttgggagcaaactatcagtttcctgtgagctcctggagagatcaaagatgttaaaagacagttctcaagtaggagaggctgagaaggctgtaaatggcagtaagtggccactctggctactgttgacttcccacacacgtttctgggctatataatactgctgcctgctgctgatggtgtaacaaagcctgttccctgggcaggttaaacttgcatgcagcaacccttcaactgaaatgctttcctcatcaacctcttttgatccctaaaatgttgagctgtctctttttgggtttgttttccccaccctccatctgcctctgctgttccctgctttcttccaccattacagtctcagtcagccacagtcagcatccgagaaaaaattatttctgggctgataattttctagtagtcacacccatactctattgataggccaagaaacctgctgcacacaaacttgaattgcataagtgagccatgttttacagcagttgatcagagttaagaaccaagaaaataactggttaagcctgtaacccacccaatgaaagggggaggggaagacggaggagctgtggggttggaggtcccacaggggagcccatctctgtcttttagcagatatatcggtgctccctcttcattattattattattattattatttttggtagagatggagtctccctgaccaacctggccaacatggcaaaaccccatctctaccaaaaatacaaaaattagccgggcgtactggcatgtacctgtagtcccagctactcaggaggctgacgcaggagaatcgcctgaacctaagaggcagaggtcgcagtgacctgagatcatgccactgcactccagcctacaagaaagagacagtcttcctatattgctcaggttggtcttaaagtgctggaattacaggcaagagccaccatgcccagctggtcagtgctttctatgtgctcagggctggagatacccagacgagtaactgaacacaggtggtagagcccagaggagaaaggtgttgaatctgcctggtgggcagaggcaggaggctctgctagactgcgaaaggcaggcagggctcaggaattactctcacctcagccagaagatcctgtgaagtgggaccaaagtttaactgccttaagacaaagaatggaatgcacgttggacatttttacatcagccccagctgaattgaccatccttgccttggagctggacgaaagaaaatacctcctctctgggcaactattttccccacattttctttaaatagagtaactgacagttcctatctgtggaatgggtccaacagtgggattactcaaagagttcggtgtctcatttctttcctgctctggcaagtcttcctgacctctgtggtcaccaagctggaggcattttaagctaagtgggtcacacttagtgggctctgtgcaaggcctcaccatctgactgtcagattctcttgcaggttggacaaagctggagaagccaagaggaccctaccagccccagcccccatcctgccaaggcattctccatgtgtggagccgagcgctcacacttgggtgtttattttcacacatagtcacatagtggtcacactagcgtgcttgttttcacactgctgtccttctgtggaaagccctgtctgactttttaggttgtggattccaccctttccacccaactgagtgttaaatagtttttgagtgagcattcagagtgcttggaagttactataattagcaaaaaaaaaaaaaaaaaaaaaaaaaaaaaaaaaaagtgttttcatctctcttggtgactgatagagaaagagtccttctgtgaatgagatcagcttcagagctctcgccagagaattgggaattgagctgccgcagtaaacagctgacataacagaagcggcaatgatcccccattaaatgtctttcaactgataggggctcctgggataattgactttccagcaggaattactggctcaaacaaaatcactgggcattagggcaacctactgcatcctttgaaagggggaatgtaactctgtctggttttgctgacctgacaggcataattcatcttgattattcattgtgctagttgccaccagatgacaccagatttctggtgactgtaattacaatgtgggatgagctttaacttttttttctttttaaacaatgttcctcccacttggctattggctcccctgtgctgaaggtgctgtaggaagggatccaacaatgtctgccttgagagatgatgagtgcatggtcagatagcatttaccaagcacttccatacacacatcttttactagataagcagggaaacaatttgatgtagtctgtttcattttaactgacagagtgtcacttcttagttatacttatgtcactgtgtgccagattgctgctatcggaaagtgggtcttcatctcagagcccactgtgaataggggaagcaaagttggccccaaaatataactgcataatgccttctgctttcagacaagctttattaaaggggcaggtggaagagagtggaattcaaccaagcttttatttcgttgacatggttttagaagaagattcctgagtagtccaaagaatgttctcccaagaaaccactgctccccagccccacatgtcctttcctcaccacatacacaccccagccagctgggtggcatggtacgcatgcacctgtggtcctgtgggagaaatgaatatgacaggttcagtgtgtccaggccactgggacctccactgaccagtgggtcggggtgaacaagagagttatactgtgagagttcataccctcactagcacaaagactttttgacccccctgtaaggtatgtgtatgttttttgaagaggtgcttaattggtgtgccaggcaatgtgctatgtgcctgatgacaaagataaataagatacctttcctttcaaggagcttaccatatggtgaggatgacagatacttcccaagtaatatgttaaaatctaagctagaagtgaacagagattgcttttagagggttgaagggaaggcttcctgctgaagagataactgattggaggaataagagttactggacttggctgggcgcagtggctcatgcctgtaatcccagcactttgggaggccaaggtgggcggatcacctgaggtcaggagttcgagaccagcctggccagcatggtgaaaccccatctctactaaaaataccaaacaaaaattagccgggcgtggttgcgcacacgtgtaatcccagctactcaggaggttgaggcaggagaatcacttgaacctgggaggcagaggttgcagtgagccgagatcgtgccattgcattccagcttgggcaacaagagcgaaactccatctcagaaaaagaaaaaaaaaaaagttactggactgattaaagataggaagcaagtttaaagaatatttgccatcccttcctatttagttgaatggtgttgcttcaacccaatcaattaagttgggcttagattttcactgtttctctaataaaaatgaactctcgccctagtggcacagagtctgtaccttggaaacaatctcaggccatggtggccctcatatcaccatgagttcttgccatgcggcttagggttttgaatggtgaggcttgactaagagaccaacttcaggatgtatgtcctgctcgctttgacccttatcacttacagtgttgtataggaaaccaggcaaggtgtcttcccagtctgcaggaaagtggtgcatctcagagtgatggcttctggcgatcagccgggaatgagccccttctaagcaacgtgggcctttgtgtcctcctcttccaggattatcaagtataaatgacacccacgacacctacccttctccaacaaatggagatgattcttccacccgattccctctttattttggaaccaaatcaaaagccaaaaaaaaaaaagatgtccctgtaagggtggcagaattagtcttctgagttgtcttttatagtatgagtgaggatagcacaattgctaagcatcttcatctttgccctaaatgattgccttgccctctgtcctaactctttctcttcctttgcccctctcaactttgtgttttgttcccttttagaatggtggtttggcctggagtgatgatgcagatggaggccggggaagagagatctctcgagattttgccaaggtctgtaatacttcctttgtgatacagataggggcagttctgcagtggcttgttacagctgattcccaagaaataaggaccaaggtagccagtgagttgcatttgtagtgattcagatggtcatagtatatctggtataagacttcagcaagatggaatttttcactgtgtgtttttcttgggggattgggattgcagctgtatgaactggacggtgatcctgaaaggaaagagttcctggatgacctcttcgtctttatgcagaagaggggtgagtgtgcatctactcatcattccaattcagggaatactgatagagtgcctactgtgtgctagtcactgttagacatcctggcccactaatcctcatccaggaggagaagaggcatttactgccagttggttctggatttagccaattaaccgatagccagattgaagaggacagagaaggtgttggcacaaagtagatggaatgatcgtccacttttggccctgcctgattttgtctcttcttccaattgactggtctctggagtcacttcaaattcaaatatgccttttttaagccttaaagctaccctggacttcacttaatctagcatgtgggccttcttgttggcatatctagtctcatggagaaaggtaagtgaaagaaaagaggcccctcaggatattttggaagggtctgaaatgatccatggaaagaaaaggccaacactttcttcttacccattggctttcgatgtttgtatttgctggcttggttagaacattcctgcagtttaatagtcaggtacataggcatctgcctttttttttttttgagatggagtctcgctctgttgcccaggctggagtgccatggtgtgatctcagctcactgcaacctctgcctcccgtgttcaggcaattctcatgcctcagcctcccaagtagctgggactacaggcgcgtaccaccacacctggctaatttttgtatttcttttttcagtagagttggggtttcaccatgttggccaggctggtctcaaaatccagacctcaagtgatccacctgccttgacctcccaaagtactgggattacaggcatgagccaccgcgcccagccggcatctgctttataatgcaccctcccaattctctttccttctctcctcactctgcacatccccaagagccatcttcactgtagactatggtgtgactgagtttagagctgagtgactcaacttcctggctttgtattcagtcatagcaatgggttcaccagccaggtcagccctcagaacacatggccagcaccccagcctctctaggagaaggccttcagcaacctgtgtggctccaccttcgtcaccctcaggacaaaaccataggagagagctactcccagtagcctgctcccagcatcctgttatagctgatcatgcatcccttggtgcctgtgtcaacaactttattgagacctaagaatgaaatcttcctctttatcctgggccaagctgtaatggcagcccccagcagctaaatattctaagttaacttctctctctctctatttccctccttcctccctactcctttacctttggcagccttattgccttcttggtgtagcctgcctgttactgttggtttgcgtaaaaaaggcaatcgaaagttttgaatcttggttttccccagtctctaagcccatcaaagcaatctgagcagccttaattagtttgctcctccagctgttacctggaactgcatgtgtcagtaaaaaacaatataatcctgaggctgggcgcggtggctcctgcctgtaatcccagcactttgggaggccaaggtgggtggatcaggatgtcaagaggtcgagaccatcctggccaacatggtgaaacccgtctctactaaaaatacaaaaattagctgggcatggtagcgcgtgcctgtagttccagctactcaggaggctgaggcaggagaattgcttgaactcgggagatggaggttgcagtgagccaagatttcaccactgccctccatcctggcgacagagcgagactccatctcaaaaaaaaaaaaaaaaaaagaatataatcctgaaagataatgtgactggcagcaatgaacctccccgtttgccctgagagagaaatccacttaatactttggtctccccttccaattaccttttaattatttacaagctccacaagcccagctggtgcaaacccaggagctgatcctgtctcaaaggggctgccatagcaatatagattttaatcagcagtggagctccactgctttattttccactttattgtttttctcccttccctgaaggatttttaaaggaaaatggaagtgagatcagccaagccgattgtgaagatcagtaattgtttactactatatgtccccactagactaggagctcctcaaggagggccactttgtcattctttcatgtccccagtgctagcacagggccaggcaggaaggtgctcaggacatgtttgctgtgtgagcagtcttgttggttttcctggctcagattgcaacatgcagggtattcaagctgccttgaggtttgggtgcatctgtgtccttcagccagctgccccgtaattgagagtcagcagtagagaacagtctttgctgcatatcctgctgttctgtggcaactgggactgccagattgccatctagtatatttctgagtgaacccaaagcaggagtgagtgactccctttgataatgtcactttatgattcttcaggtcctgagtaaatctttgtcctgtcttcagcacttacgtcaggtatttcactgtttgctggcattaccaacagaagggaaacggttctgtctgccacttgttactttaataaaaggtttctcagcctcagcactgttgactttgggatgggtagtccttgttgtggagactgtcctgtgcactgtaggattttgtttttaattttgagacagggtctcactctgttgcctcagctggagtgcagtggtgcgatcatagctcactacagcctcaaagtgctgagctgaagcctttctcctgtttcagcctcctgagtagctgggactataggtaggcaccaccatgcctggctaacttttttgttctgtagaaatgaggtctcactatgttgcccaggctggtattgaactcctgacctcaagtgatcctcccacctcggcttttcagagtgctgggattacaggtatgagccaccgcacctggttactgtaggacgtttagcagtatccatggcctctatccactagataccaatatcagcccctcagtcacaacaaccaaaaatgtctctagatgtcataaatgtcccctggagggcaaaattgtcccgttgagaccctctggcatggaaagatgagaaagagaataaagatgtaaaatatcctctgcaagaaaaactcttagctgagtgtggtggctcacgcctgtaatcccaccactgtgggaggctgaggtgggaggctcaggtgagtctcagtaacatagtgagaccttctctctacaaaaaatgaaaacaaaattagccaggcatagtgatgcatgcctgtagtcccaagctacttgggaggctgaggtgggcaaattgctcgagccggggacttgggggccgtcatggaggccaacattgcgccactgccctccagcctggccaaaaagtgagaccctgtctcaaaaaaaaaaaaactttttatgaaaatcatcttacctccagtcaggtacatgagagcaagccgtgttaggtagcattgtttcctgtgactgagtgccaaaggagtgagtgctggggcctcaccctggcctgcagtgcagagaaaggctctgagaagagctgtggctctagtgtatcagacccaaccatggaggtggaggaaaaaatgctgtgacacatgtggccctggtgtagctggaagaacccttgttgatggcccagagccaggggccatcctggatgggtcagctggcatgagactctgaagagccatgtttgcccaaaaagcgcttcagtctgtagatatagctgagttattgaaggcaaaatattggctttcaggaaacttgccgtggcagtgtatagttgggctagagaggagagactgaggcaggaagatagtgtagaggttgttattcccagcgatctcctttctagaaaactcttatctggtagtccgaactagagtgagtggttcaggagggttgggagtggggcatggtggctcatgcctataattccagcactttgggaggcctaggtgggaggatcacttgagaccatgagtttgagatcagcctgggcaacgtaacaagaccccatccctgtaatttaaaaaaaaaaaaaagaagatgtaatcccagctacccaggaggctgagtcaggagaatcacttgaacccgggaggcggaggttgcagtgagccaagatcgcaccattgcactccagcctgggtgacgagcgaaactccatctcagaaataaaaaagaagaagaaaattttaaaagaggggtgggagcagattgcacttttattttaattaattattttatttatttttgagacagggtctcactctattgcccaagctggagtgtagtggcgcaatcatggctcatcgcacccttgacctccccaggctcaggtgatcctcccacctcagcctcctgagaatctgggcctacaggtgtgcaccaccacactcagctaatttttctgtttttttgtgtgtgtgtgtgtggagacgaggcccttatgttgcccaggctggtagcaaattcctgggctcaagtgatccaactgcctgagcctcccaaagtgctgggattacaggcatgaaccaccacaccgtgctgggcctcagattacagttttaatcatgtgaggcttgctgtctttgttcctttttttgagacagagtcccagtctggagttcagtggtcgatctcagcttaccgcaaccttcccatcccgggttcaagtgattctcgtgcctcagcctcccaagtagctgagattacagccatgcaccaccatgcctggctaatttttatattttttagtaaaaacagtttcaccatgttggccaggctggtctcaaactcctggcctcgagtgatccgcctgcctccgactcccaaagtactggaattacagacatgagccaccgcacctggcctgtcttttttttgtttttttttgttttttttgttttaagcaaagtctccctctgtagcccaggctggagtgtagtggcaccatctcggctcactgcaacctccacctcctgggttcaagctattctcctgcctcagcctcccaagtagctgggattacaggcatgtaccattgcacctggctaattttttgtatttttagtagagacaggatttcaccatgttggccaggctggttttgagctcccaacctcaggtaatccgcccgcgtcggcctcctaaagtgttaggattacaggcatgagccaccgagcccggctgtctttgttcttaacagaatggtgagaacaagggcccttagacatttgtgacttgtcacttgtggagtgtctgggggacacaggaggcagatcttgctagttgggaccaaggaaaagcctcatagacctcagcagcaggtcagggacttggcctccatagctaatatgaaaggtaagcagtagatatcacaggagtcactggaaatagcctgagttagcctggacaacatagtgagaccctgtctctacaaaaaaaacatttttttttaattagctgagtgtggtggcatgcgcctgtggtctcagctactttggaggctgaggtgggaggatcacttgagcttggaaggtcaaggctacagtgagctgagttcatgccattgcactacaacctgggcaacagagtgagaccttgtctcaaaaaacaaaagaaagaaggaaagggaaagggaaatgcaaggaagaaagaaagaaagaaacgaaagaaaatagcctgagtttgaaaggcccggagacacccaggtgggctgtgagaggggccagcagctttgacacagcaggctgtgcccacagaggaagcagacagctctgagggatgcagcacacagcaggccgccccgaatgaccgcagctgcaggtgataaaatggctgtccagtgggagacagggacgggccataactgctgctttgtgctgtatctcttgcttgttaacatgtttgggtgaattgactgcaacagatgggcctttcagccctcagcaccttggtttctaggcaagaccggggtgacttgcaccttggcgaccccctcccctccctgagcagcagagcaacctgcgcataaagaagcctgagaagattggagtgggacgaggcgcagtgccctgtgggggtggaaagagctctggactggcagtgcaaagccagggctaacatcccttcgttctcctgatcttgagcacatcctccccactctggtggccacagtttccttatctattgaatgagagggttcaattagtgtcatcttggaagtttctattgtctgtattgtgtgtccatgattgtgtctatcgagctacccttgatgaacaaaaaataaaagaagaaaagcccctttagcagttttctatcaaagtaattgtatgaaacatcaccaggaatctccgagaccaaatgcttctctcctgtccttgctgtgtaatatatttcctcttttgctgactgaagccaaattcaactaagcaagttgccctcgattgtcccccaccaccctattcccgccagaatatttctctagaaaagactggttaggtttagaactctgatgcccctttgggctcacctgttgccgtgtgtgtgtgtgtgtgtgtgtgtgtgtgtgtgtgtgtgtgtgtgcgcgcgcgcgcacacgcaaaaaatacacacgtttcagctggacgcattggctcatgcctgtaatcccagcactttgggaggccaaggcaggtggatcacttgaggccaggggtttgagaccagcctggccaccatggtgaaaccccatctctactaaaaatacaagaattaaccaggcatggtggcacatgctggcaatcccagctactcgggaggctgaggcaggagaatcgcctgaacctgggaggcagaggttgcagtgagccaggattgcaccacagcctgagcaacagaatgagactgtcaaaaaaacaaataaaaaacaaaaaacgtgtttctttggcaaacataaagccaaaacagttgtaaataaaattgtctggctaatttaactccctgtgggtggtttctgaaataccattccctcatagattttccatttagtctttcagtgcccaaggggagggactaatttctaagtctaataagcaaaggctattataaacaatttcatttttccttcatcagtgaggaagaaaagcttgttttttgttccctaggaggtgaaacagaagtgtggtttcattaaagagtcaggatgatgatgacgataatggtgattttactgttacttgcatttttattataccatacacattacagaacccttgcaacccattatctgatctgctgctcccctcagctccagctctgtagagtagagagagcaaaggttatcacctgtaaccctgaagaagcagccccaaggttaagtgactcacctaaggccacagagcagacttagcacgcggtctcctaactcccaggccagtgtgctttgcttctcctgccttatctttgagaaacttgttccctagagctagcaaccccatcactcccctttggagaagcaggcaaacctcatgtcttcggcagcattcaccgcctccaagagggtggtggcctgcctccacaggccaccgttcagtagcgcttctgagcatctagctgatgaacacagggtagaacctgatgtgcaagatgggtcttcatctcagggtcagggctgtttctcagagaaatagggaagggcagatgtgacaactcagagtggcacagaggctgccatctgtcaaggcaggatggggtagggcttgggagacacaggaggcacccagaatgcccacaagcaaggctctcttttcctgcccctgccccatctgggcacaccaggctaaggaactgcctggtcacatggaagacaagttttgtcaagccctcacttgtagacctgccctcccgcccccatcagttctcttcaaggctgcaaactgaccttggttttcccaaatggattgctggatcttttttgatgtgtatatacaaagaatttactgtgggaaaagggcttggtctgcttcaaagtgcaacttgagtgtttttccttctgttgtgtgcttatctatccatctcaggcaaggaaatgttcatgacatatattgctttgccttttggtggaggcaatttcttgtatattctttgtatcttaccataaatggtctgtgccctggacacccttcctggcagacgaaaatatgttgtctttttcagacgatataggctttggggcttcattttctaactttatcccgaaatgaaagtctaaaatgcaaatcttttagtgtctggattagccctttgtctcaggccagatccttttctctctctaggtgacccagctgctgttaaaaaaatatactggtttttcccccatttttaatagtcattataatactctataaatacccagttatccacgatcataggaagggagtctggtttttgaaagtcacaattaatttgaatagcctgcttttgtcgttaaattcagcctcttccccttcaaaatcttttattggtatttctaacacatgggaaaattgagttatttgatagttttgcctcttttgtcccaaagtgaaccaatattcagtaaatcatctaagagttggtatggtgaaaagttgcagtgagtgtttggcctgcttacaccatggggaagttctgctgggttttgagagtctagtggcacaacagcattggaaactcagacagccgtgcactgctcaggccagaaggcccatgaggtgtgccccagcccagccagccttccactcctctcctggagatgccaggcagatctgcccagtggcaggcaaagcagggaagaccctgcagtccacctccttctgactcattggccagtttctccgaatgcagttgtcatagccataatctttttttttttttttgagacagagtctcactctgtcgcccaggctggagtgcagtggcgcgatttcggctcactgcaacctccgccgcccgggttcacgccattctcctgcctcagcctcccgagtagctgggattataggcgcctgccaccacgtctggctaatttttatatttttaatatagatggggtgtcaccatgctggacaggctggtctcaaactcccgacctcaggtgatctgcccaccttggcctcccaaaatgttggaattacaggcgtgagccaccgcgcccagccaccataatcttattgttaggcatagcagaatacaatattacatttaccgttgaacttcacctaaagagattagtccaagctggagtagcaaaaaaggtaatgagtttaaaattagcctccaaggttgtagaaccaccagctctcccatgcattacagctgggagtgtaaagggatacaactactttggaagtctgtttggcagtgttcgctaaagctaaacatacctggaccttgttacccagcagttgcactcctgggtgtattcccaacagaaatgagtgcttgtgttcactgaaagatacaggtaagcatattcatagcagctccattcattatagccaaaaactggaaagaattccaatgtccatcagtagtagaatggataaataaatgtagcatagtcacatatcggaacactacacagccgtagaaagttatgaactagccgggtacggtggctcacacctgtaatcccagcactttgggagggtgaggcaggtggatcacttgagctcagaagttcaagagcagcctgggcaacatggtgaaaccccatctctaccaaaaaaaaaaaaaaaaaaattagctggatgtggtggcacctgcctgtagtcccagctacttgggaggctgaggtgagagaagtgcttgagcctgggaggcagaggctgcagtaaggcgagatcatgtcactgcactctagcctgggctacagagtgagactccacctaaaaaaaaaaagttgtgaactactgctttacgcagctgggatgactctcagacctgatattgagcaaaagaagccagacacagaatatatactatgtgagtccatttatataaagttcaaaaaaatatatgtcagaatagcattttatttccagagtgggtagggtggagggatggatattgattggaaagaggcatgagagagttttctaggggtgctgtaaatgttctgtgttttggccagacatggtggctcacggcagtcatcccagcactttgggaggctgaggcaggcggatcatctgtggtgaggagtttgagaccagcctggccaaatggtgaaaccctgtctccactaaaaatgcaaaaattagccaggcatggtggcaagcgcctgtaatcccagccacttgggagccggaggcaggagaatcgcttgaacctgggaggtggagtttgcagcgagccaagatcacactactgcactccaacctgggcaacagagcgagactctgtctcaaaaaaaaaaaaaaagttctttattttgatctgagggatggttgtggaggtgtatttggaagtacacatctagtgagctgtatggttaaggttaatgcactataccatatgtaagttagacccactcagtgggcagttggaggtggaaggcttaaggattcttgtcagtctatactagcatattggcacatgcttgcctctggcctgtcttgtggaacagtgcaactacaagctgcacggcagactaccagacactgctgcctgatttcccagtgggagacctttttccttttcctttcccgtttctttttcctttccctttcctattaaaacttttgttagaggttcaggtggtacatgtgcaggttttttacatggatatactgcagggcactgaggtttggggtacgattgatcctgtcgcccaggttgtatgcatagtacccaataggtagtttttcagcccttgtcccctgtagtagttgccagtatctgttgtgatattctctatatgaacaagtcatggggggaaatcagcagtcatttctctgctggcttctggggagcagttctagagcagggcaagaatgaagatgcagaggaatgttcaggaagcctgcctgcctgcgcacattccctgcttaacacaggtcttaactcttccaggctctctggtcagctctcttgacagtcaggctatggaaatgattaatgatctttctcaaagcctggaaaaagcagcaagggtccctggcagggccacaccctgggtcctgggccctcacccctgcccagtgggcaggaaggcagccatatgagtctgtctggggtccctgcccctgtttgcttctggacttccctggaaccggcccattctctgcaatggggaggaagtggctttcccttcaacactcttaccatctctcatctttgtctccaaagccagaagaggccatctcttctgccctcacccctatccccagctacatcttggttgtctgagtggcaggaaggaaaacaaagtaccagggagcagcttttgtttggccacatctgcactggaagctcctgatcacagctgtggcctgctagtgccagcgcccagcggcattcccaccaacaagggttaaagccccaggagtcccgccagcttcactgggtccatggccctcataaaagccttttacatccgtccctcaggctgcaggctccctggctgaaatctgataaggggcctctttgttgcaactgtcagtctcctttattgaggagggaactggagaccagtggcacttcttggggtgcagataaggccctggattcctgtcagagagagcatgattaattaccctcaatcccagctcctgctttgatagcagtgactgacagtccacaggcttccccatcaggtgctcacccccttctgggaggcatgatgggggtggagatttggtctcctgtagggccaacaccagtgacccacaaagatctctcttcagtgggtgtttgcctccttcctggtgctctgtgggttgcttttgcatttcttgtggacagaggcctctctctctcaggtgaagagcttccttagaggaagatagaatacagcccagagagcaggccagagaccccttgctccctcccgcaaagactgggaaaggagccattgcttgtggacgtgaacttcacaaatctggccttaagccaggggcccttcacagagaaaatctcaaactatctgtatcaaggccacttgacaatattactctctaattcaggcaagttcctaaaaccatgtgattctccctttggtaataatcacaactgtcaatttttgtttatcgatttatatcttgctggtttgaaggtacatcagcagaatttttgttttaattttttattcatagactttagaactgaaaatcatctagtccaaattcctcacttcacatttgcggaaactgaggcctgagtctgtcgattgcctattggttcttgttcagcaggtaaacttagcttaaaggccttctctctttcttcatagtagaatctactttggacaagagaaatggctaccaggtccattaagcacaaagcaaactgctgagaccaacctgcagattctgcttctctcagttgttagaagaatcaaagacgcggcaggcttttgtgtctggattatctgatgggagaaagcgccactgtcatctagagagccctcggcatagcctccgctctgtttctgatggcaccaagggccagcctgcactgggagccactgacagtttcacagagggccagccacagggaataatgcgcccaatctccttatcagcttgatctccagaaccagggtgcctgatcagggcatgggggctcgtgtgaggagagttcactgtggagtgaggaaaacagcttcccaagtatgccctgggtggagctgggccacacagcagggtgcaggggccaccaccacggtttccagtgcacctcttacctgcggtttctctgtagtgtgatgacagttcccagaagagtacactttcccctctgggaagagatcacttattagttaggttacaaccttgacttcagacaccactgtgacccttccttgtctcctcaggttctgtatctgccattgttcccctggccctaagcagttctcagtctaatataatacagtcacgttgtgtgtgactataaagaggctaatttttaatgaaatttctacatctataacaatgttgtccttcaaagatgccatctcaaacagccaggcaattagtccaatgactactcaaaatgaatttgtaattcctctctggggagttgccttcagaggcagtttgaaccacactagaaaatctcagccgggtgcgtggctcacgcctgtcatcccaacactttgggaggctgaagtgggaggattgcttgagtccaggagtttgagaccagcctgggcaacatagtgagacctcgagaaacatttctgggtaggttaatttattaacactataaggcatggtaggcatggtaaaggaaagacaacccctgccttcatagagctgacagtcctcctgggatatcggatggacagatgtgaaacaattagagaaggacaatttgctaaacttataggggcatgatagaaattctgagagggaagaaacccacatgaactggggtagtgagaacatgcttcctggaaggagtggatatggaagaacactgtgaaggatttgaggggaggcacaaaagagcgtgttttgggggcaatagggagaaggcccagtgagttggagtacaagagagttgcttggatatgccaggaatacttcacatgtgatcttctaagggagtgttgaggaacatgggtcatgcgattggacatgtgagatgggctaggtaagcaataagagttttcataggtttttaaacaaggaggtgagtaatatggtaaaagtagtattttaataagattggctgcagtgttcaagttgatcgtatggctaagaggctgctgcaggcatctaactgtgggccagagagggcctggaccaggatggtggctgcaggccaaaaaggaagatgcctttgagaggtacctccaaggacgaatcatgaagccttctaacaccctgaaagtgggtgatagggagaggagaggagccagtgctgacacgaggttcctgccttcctgcctaacttccaagggtggtagtgttgctgggaaaaaatgaggtgtggggaaagggagctagtttaggggaatgaagatgagcccagcacaaacattctgacttggaagtaaacgggtcacacgtgtgaagatgccctaggagcttccggaaatgtgagcttaggagccctgtgtgaggggacctggggagtggtcctctcagacactccaggtaatgccttggaaggtgtggactcaaggccatgggtgtgtttgggcagataggcctccaaaaggaggtcgacgttagccctgtcctgctgggggcttttgtctttctggtagggggaaggtttactgtccagaacagcactgggagaagtcaaccagcacatgagctgtgtgtcttaggagtatgcccgtaatcctctgttattttacctatgaatttgtggatctaattccatgacccctttgtccttgaccctccaaggaccagcaggtcaagataaaggtcttcaaggtcactaaccccctccccacacttaggaaagaggcctaagccaggtgctgtggctcacgctgcagtccatgtgctttgggaggctgaggcaggaggattgcttgagcttaggagtttgagaccagcctgggcaacataggaagatcctgtctctacagaaaatgtttttaaattccctgagtgtggtggtgtgtgcctgtattcccagctacttaagaggctgagtgggaggatggctggaggttaagtctgcaataagtcatgattgcaccgctgcactccagtctgggcaacagagtgagaccctatcttttaaaaaaaaaaaaaaagaagaagaagaggcctggtcctgccgcagcagccccacatatccatgcccacagtgcttccttttcattctctggcttgaaccatcctgtaaaagagttggtgaggctgccattcagagctgagaaaactgctgtgcctttagggaaagaaggcggatggagcagaaacaaacagctcttccctgctcaggttggtttaaggtccaccaggcagcccagtgagacctcagcgagactggggcaatgggagggggcaaggcagaggagcagtagtctgtgtacagtaaaaggagtttgccatcaaaaggcaacaagtctcataccctgccctggacggtgacccttccctgtggaattctcccctctgacctccagatcattaatcccgaggctgccaaatgacagtcatccatcacgcctcctgatgagcatcccagccggctgtgaaaggacttgccccgccctcaccatatcccctggtgctcattagtagcccttcctcctcggtgccaggtttcctaatcaagtccctggctcctctcacttcccctcggggccattgggtggaagctgctctgaccctccccctttcagaggccagggagtgggtggagtgattggtgtggggagagaattgagtggcttttcattcctctggagacctgtgtgtccagcagctcctttgacatggcggggcacacgagagagaaataaaccatttctccatcaagcaggagaggagaaagcaggcatgtgcaaacaagcacactcttttttttttttttttttttttttttttaagacagtctcactgtcgcccaggctggagtgcagtggtgtgatctcggctcactgcaagctccgcctcccgggttcatgccattctcctgtctcagccttccgagtagctgggactacaggcgcctgccaccatgccaggctaattttttttgtatttttagtagagacggggtttcgccatgttagccaggatggtctcgatctcctgacctcgtgatctgcccgcttcggcctcccaaagtgctaggattacaggcgtgagccaccgcacccagccagcgagcacactcttataagcagcactgagcgctgccaggagggtgactaggcagggctccccttctaggaagtcagagaaaggcatcccagaggaagctgccgctgaatggagtctgaaagctgcagagataagtcgccagatcactaggaatagtctggaatcatactgccagcaaaacaaaaacaaaaacacacacacacgaactaaaaaacaagcacctttgaaatcatctagtctggccctcttatttacagacggcaaaacagaaccagagaggctaagtgctttgccaaaggcccacacagcctgtgcgttggacctgtcctgacagctagtctgagtgttcaggcttggggagtttgagttaaattacacttccaggttgatgagcattgtttccagctcggctaaaggtgggcatacacggaatctttcttctcagcctgatgatgatcccgctgtctctttctctcgttggacaaccacagggacccccatcaaccgaatccccatcatggccaaacagatcctggacctgtacatgctgtataagctggtgaccgagaagggaggcctggtggagatcatcaacaagaagatctggagggagatcaccaaaggcctaaacctgcccacatccatcaccagcgccgccttcaccctcaggacgcagtgagtggccagggcctgggagaaggaagctgaggctggagaaaggggatgttgtaacctagaggagaggaaggaaggaaattcctttgtatggttagcaagatgagtggattcccgaaacagtggggagctttctgagatgaatccctcactaaaccaagtagtgatgagaaccaccatttaccaagtgtctactctgtgctggtactttactatttcatttaaacctcacagtcaaccctgtaaagtaggtatgcccccatttcccacattacaaaaatgaagtctccatggttaaataatttggctaaggtcatataccagccagtaagtggtagagctgagattcagacctgggcttctgtctctaagacctgtgccccttccaggacattgtcttccaaacagcatctccaccccaagtggcccctcttacctgatattcagcttacccagcggcagaggacccagagaaaggcaggcaggaaggcccccttggattggtgacctggttttgtcagcatttgagttaattacatgggtgatggaagcggtgaaaccaatagtagcactgaagaatgagggccagagaggaatcttttcttctggaacactctggaagttgttctgtgaagagtatgcaatgaacaactgacatcagttaggtagcatgttgtagctacaaccagaatggcaaggttcttgggtagagaactgcttcttgggacctaagacacaaagaatgacagtgtctaggtcccatgcacaatgggaagaattgctcctatctgactagcccagctctgaatggttataagatcaagaagtcagaaagcccttgtaaaacatgggcctaatttttcccagggcttcaaaacaaatgtgaaaacgccaactaagatgttatttatttcccctaatgaatggtgcttcaaagtagagcctatttaggattgagtggcagtcagaggaggctggggcagagtgtccggccatcccagacttttctgccaagtataccaaggttgcaatcctttgccctagagtcctgcccaacagagactgcttccagagacccaccaacctcaactgggtggtctctggtgctgttttggattattctccctgcttgcttcctttcctccaggtacatgaagtatctgtatgcctatgagtgtgagaagaaagccttgagttccccagccgagctccaggcagcaattgatggcaaccgcagggagggccggcggcccagctacagctcctccctctttggctactcacctgctgcggctactgctgctgccgctgccggggcccctgcccttctctccccacccaagatccgctttcccatccttgggcttggctccagcagtggtaccaataccagtagccctcggatatccccagcaaccactctcaggaaaggtcagcagggctcctgggggagaaggaagaaagggaggaagggatgccagttccctgtgttcaagactggggttttggggcaagagggtcaattgtggattggtccagctccagttcctttgcaggtgatggagccccagtgacaacagtgcctgtgccaaatcgtctggctgtgcccgtgaccttggcaagccagcaggctggtactcggaccgccgcactggagcagctgcgggagcggctggagtcaggggagcctgctgagaagaaggcatcgaggctgtctgaggaggagcagcgcctggtgcagcaggccttccagcgcaactttttcagcatggcacggcagctccccatgaagatcaggatcaacggcaggggtgagccaggctcagggccgggccttcccttcctggaaaccccaagcccattcacgcctcctgggactggtggggcaggggtggtgaggcacatactcctgacctggaagaggcccctccaggttctgccttccaggcccctagaagagaggcactgagatcttagttcaccaagctgaggttgtttggtagaggggaccacatgttgcctcaggcagtgccctgttctctagtaagagggaaaagcagttattcacagaggaggagccagaggccttcagagagctgctgcgtttccccaccagccattaccccagcacctcactggatgtaggcaagagcagggcaccgtctgcaggtctgggaggaagacaccccatgttcctgaggctcagcgaggggccaagttgccccgggctggacagtgggactcaggaatatagacagaaggaggaaacacaagtttggcagcataattgacatcctttcccttcctcttcacattgttctggtgccccacattctcttcctcaagccacacgccccttttcccattcacacacattctttcccattctggtcctgatgctatctcaaagcaaacatgaatgagatgtgtgggaaggagccaggtgtgaagggagctatacatattcccaggctgcccctcctaccccattgcccttggggaccagaaggaaactgggaggtaacagctcatccagggccaggtaccctgctcctgcacaaagcaaagggctgttagaaaagacagctcaccgggaagaattctgagtctggggtgagccagccaaaggccgtgtgtgccagcacttgcaggcttccacaaacgccagctgcctgggtggtcatggaggggaggggctgagggcgtagactcctctctctgagggactcagagtcaaaggaaagaaagggcaggtgggtcctcaaagttggggctgggtctcattgatctctgatttcctgggcctggtgtatagtgtagttcagggtttgcccgtcacttggaaagtgccagtgcagagtggtggggccggagccggcctccttgcctactgtgattccttttctctgggagcagaggtagttgaggggatgaactgggtcagtggaaaaagccagcaacaggagattggcgagcctgggatctcctgccataccctacactcaggagaaggttacatagatgccttttaacagcgtgaggctttgaccaggggtggccaggcagcatcagagaggacaacaggagtgctgtggaaggcttgaccaggcccactgtctccctgtccccagcagaagacagagcagaggcctcggctgcagcactgaacctgaccacgagtagcattgggagcattaacatgtctgtggacatcgatggcaccacctatgcaggtgaggccctggagctctgggggaggcccacgtggccgcagctagccacagggcagctctgcggctggccctgcctcttaccctctgtctgaacacctcccacagtggcttcctttttcctggtctcagagttgcaaaggtcaagtggtcctctggactagtagactgtggattgttaacaggatgataggtccctcccactttggcagaaacccttcacctaacccttttagaccagtggttggctcgttaattgaagaagtcagtcagtgtcccacaatccccaggtcttctcatgcacagcctttctctgactgtaattcagctcttctcttccttttgcagactgagacacaggcaaaggaaccccagtataggagaatcagcttacattgttaagctccctgccccccagtcttttacagttatcttttcctaaacctaatttggcaacagtgttttgttggttggttgatttcgcacctttacagagtctttctaagggtttaacttagtattcatgactgggcacggtggctgatgcctgtaatccttgcactttgggaggctgaggcaagaggaccacttgagcccaggagtttgagaccagcctgagcaacatagcaaaatcccaaatctacaaaatacaaaaaaaaatagccaggcatggtggtgcacacctgtggtcccagctacttgggaggctgaggccaggaggatcacttgagcccaggaggtcgaggctgcagtaagccgtgattgtaccactgcattccagcctgagtgacaaagcaagaccttgtctcaattaaaaaaaaaaaaaacaaaacttaatattcataaaaacagcagtccttttcccattcccatttcattggtttacggacgagcttgggaacaagcccacctgactcttgttaagcacagcattgctgggcgcggtggctcacgcctgtaatcccagcattttgggaggccaaggcgggtggatcacgaagtcaggatatcgagaccatcctggctaacacagtgaaaccccgtctctactaaaaatacaaaaagttagccaggcgtgggggcgggtgcctgtagtcccagctactcgggaggctgaggcaggagaatggcgtgaacctgggaggcagagcttgcagtgagctgagatcgcgccactgcactccagcctgggcgacagagtgagactccgtctcaaaaaaaaaaagcacagtattatgagtgggggccaccaggcctggcccagggcatcacccacctgttttaccaagggcccaagggcatgcggagtgtcagccagcctggcaaggtgtctcgtggagacaggcgaaagccctacaactgcaccttctatcacaactgggagtgtttcctcagggcctactcccattctaagggccacactccctcagagcaccgccctgcaggcctcctgggagcatgctctggatctctgctgggccactcacttcagagagaggacagagtgtagaggagcagtggtgccaagtgggctcaccagtcatgctatgtctgcagactctgctcagaggtctctacctgtcacaggaggcccctggaggaggtggggcctggtgccctttgcctcttcattgtgctgtggtttgggagggttgggggttggaattaggtccatggagaaagcagggaagtaggaattcaaggcctggatcttgatatccttttgtcctctgtcaaggagaaaggagaaggtaactccttccctctcagaatgaggaagggtcagaagttgaaggctcctcaaacccctgacaagaagggagccagtcacccaccccacctggctctgtcacccaggctggagtgcattggtgcggtcatagctcactgcagcttcaacctcctgggctcaagtgatcctcctgcctcagccccctgagtagctgggactacccatgcccagctaattttaaaaaaaatttttatagagacaaggctcttgctgtattgcccagtctggtctcaaactcctggccttgagctattctcctgcctcaccctcccaaagtgctgggattatagttgtgagccaccacacctggccttggtgttcctctttgtgtaccctgggtacaccttgtctcagagcatttatgacattttagcaaaattactctgtcgacctatctgtccccctccccagcccatcagcacttcaaggcaggacagcatttggatcttctcccatcaccccctagcacagtgtctacagcggagtcaggcacaggctaggccagcggtgaatacttactgaaaggagctggccctccccttcgctcttcctctgcccacacttgcttctcttccacccaccaaggtgtgctgtttgcccagaagcctgtggtccacctcatcacggggtctgctccccagagcctcggcagcagcgccagcagcagcagcagctctcactgttcaccaagtcctacctcatcccggggcacccccagcgcagagccctccaccagctggtccctctgatgggcaggacccagcttcccacttgccactctcctgtcgagagtgaaggaagttgatgcacagaatttacctcatctcacagagcccacgtcgacgagcaccatttggccagacattgagagtttggacgtgtccgtctgtccaggctccattcaggtcctgctgtactctgggggcagggagaggctagaggggcaggacagacagcgttgtccaatcagggattgtcctggagaactgggtgggggtctgtgggtgtccagcttcctccagggttccccagccacctcccagctcagggcacagtgtatcgacaatctgtcagccgacgcagggctggaggccctccatttccctccccttttaatttatttccctgaccctgccttctgccatgaccccagggccactagtctcttcccctgtttttaagtcccatgtggggctgccaggagccaagagcatgccttcatgcccttctctgcagagcatgggatggggcccttccagcccactttgcctactgttaggttcctggggtacgggtccctcaaacacaagtcttgaatcagtcctcagggccccagatcccccttctaatagtctgaaggaagaggctgtgagggcagttcagggccagggcccacagggcatctgctgatgggaaggcagagcctcggggctgcccagccctggcacctgcttcacacggaccattctctgaccgcccccgccaaacctcatgctccccacttgcccttattggcctgctttcccaaaaacagcccactcatcctttccccagccctcttcagccctccccagtcctccccagccttcttcagccttcttcagctcagccctcttctatttcttatggggccatcttggcctcaccatccccacacgtgccgatgtcaggttcattgaaatacctcagatttgtaattgttgatgtttgagtcttcaggaagtatttgcatctctgaaatcttttttatatgtgttttgctgacttttgttttttttttattttaaaatttttatcgtagcaccaaagaaatgaaaacagatcacccccaaagccaagcaagtgattgggtaacccggcccctctggcccttccctcaagcccagtgaggaggtgggtggaggcatgcaggggagacgactcagggatcgcgggggcggggaggtggagtggagaggcccgctctcacaccgggtcgggccctgaaactgtaccagttctgaagaccgttttctgccacacccccacccccagctgaccagggaggcagaggacacctccccatcactcagcattcccagctcagggcacaggcaggctggggtcctcgctggccttgccagaggttgagccgccccagggtatgaggagatgaataactccacagctcctcctggaccctgcgcgggagcaggcagctcctgtgctgtaaagaaaattgattcgcttgcggctcacctcagtcgaggaagccctggaatgttcagcagaacaccaccactgtgacatggggctgtggcagtgggagacaccgcgcgtggcgtgggtgtgtgtggcagcgtggctcgcattcagtcctgtgtaggagaggaaagggaatcaaaagcttgagcacaaacagatacctcagcccggtaagctgcagctctgctcaactgcgtcttctctcagccctccacacacactcacccccactcccacacacatacacacacacacacacataccccatctcccgagggctgacctcctctggcctcagcctgcagggtgtgggcagagaagggcatctgggacgtggtgccagtgaggagcccagttggctggcactgggcccatttgaaggtgtctcagacatttggccagtatgtctttctcaggggtttggtcacaaaggatggactcttcccacccagaggatgcagggaaagcacactgtgtctttccggtcattggatcctctccctttccccaggcagctcgcctggccacaccgttggagtgaaccctcactgccctcaaggacaacagcagggtgtcacccagagcccgatgaggggtgccagcaggtgcccccacgagtggggccttggcccaagcagagcttcccctgaaggtgccatcagccagggcagctctgtcccctcctgctctccatcttatatgtattctaaccaggaaaaatgtgatagcacatgggtagcctaggcagtgagtaaatacctcagatgtcctcctgcagcaagtgtctatatgttgtggttattttctatcttacatgttctcgaatgtttatatttcaataaacctctacctcttcacacaa

SEQ ID NO: 1046 - DNA, 21831 bp, Homo sapiens
aggggcactggtacctccaggacctggagtgtactggaagaaatggtgcagtccaggtacagcatggaccccagatcacccccaccccactccctttcagtgattattgtcttatgaactaggagggggagtggggcagagatgcctctttcatggctccctgcacacacagaacccctttgtactgggcacttctactcccaaggaccctgacttgcacccagcagctaaggtcatctcacccccacctcccacctgcccctgggccagcaggaggggcttggccatatgtaggcgagacaggacttcttgaagctgaaagatttcccaccccataaaagagccagaatgtgacaaccaggagcgctgatacctggggaagggagactggctctggtcgtgtgattccgggtttagggctctgggccattccccctcagccagctggtgacagagactggcccaccgcctgctgagagggccatctcacctacagtgagaacagagcccccaccccagcctggcttggacactctgaggatgggcccaagcagccacctaccaggactcttggcccggggccacacccagtgctgctagcagccccaccttctcctgaagtagccaggtgtgctctgcctccagggcctgcaatggccccccaacaccatctgctctccctgcagatgctgcagctgctccaagcaggcccctagttgctggtggctctggcccagctcttctgagtctcttgttcacctggggagatccccaccccaccgagttgtggctcagcctccaccagggttgtggagctccagcctttacccatgcagcccctcctcagaggccccgaactccacttcctctgggtctcagcccttccaggaggcctctctgaccaccccagcccgcagaggcttctctacactccaggctacgactctggaccagtgcctggctgcacactagcaggggggccagttatgtgaagatgaggatggtgctctctggagtgtcactgtgtggacgccctgctagaatctctctctcctggtcattctcctttcctctgtgcccctagagccccttgccctacattggaatcccccaggaatggggcccaggctcccttgcctctgccccctggtacagatgggcatggcctggatcagctaatgcccagattccctttcctgtggggctgcccctgccagctgtcttgaccaacctcagtgagtatcagcaactgctcctgcagacggactgtgtcctgagcctgggcaggggtctcagctgctggcatggagactctgggtcccgaagctcctgggccctgcctccatcccagctctgctcttggatctgcaggcctggcaccagcatctcctgtagatacacttggtccagaatcctggggtctccttccagcttccagaccacactggggtggtcttggcagaccgttgatgcctcagggcatgttgtggcagggtcctggccccaactcaagttatgactctgaacaagctctcctctgctctctggtctcagttttcccatctgaaccaggagggaagtcactgaatgatcccagggtattcccaaatgttggaagaggatccctctcttggctggactaagcccctgcgctgccttccttctctagataatgcttcaataatgaggaccagagaataaagtgtggggcagagtcaaaggtacagcagggccagtgcgcagggcctgccatgcacccacttgggggatccccaggctgggctctgggccaacaggctgttgggtcatttggtccaaatgccgctaggccttttccacttctgtctgcagcagcaggatcctgtgggtagaagggatggtctgcctgttccctgccaccccacccctcccccacagcccagccccactcacttgtcttctatgttctggtctggcctcctccactcagcctgtccctgggatccctgcatctggtgcctctcctgctccaggcaggccagggagcactccacctgctaggaggaggctgagtgggagggctgaaggcagcacagagcctcagataggtagggctagcttccctgcctcccaccaggcagggcagtgtctgcagcctttgataacgcaggcggactggcagccagcagcccagctgacagcccaacatggacccatgccctggcttatatacaagggactgtgccctggggccctgaggggctgcttttggctgttatctatcacgacaggctccagctgtgcatctctacctccagctgggcccgagatacaccgcctctccagctgctctccagctgctgacagcttcagggtggaggccagcaggactgctgtggcatgctaaagggcaggcagacatgaggttgtcaactgggtcccaagggtcccccaggcctggtagggagcagtggctccaggtgggccagctgtgagctaagacacagagtcactgaaggcttgcgtaactgggccatcacacggtgtccctttcctaccctcacatgaggcagagatcctggtaaccttcccaagaaccctcagcttgcacagccatctccccctctctggggctcgcctgtttcactcggggagattgggcttctaaggaagctcttcagtctatggagctaaaaccagcccctccctccctcagattctccctggggggccacagggaccctggcccttccttcacctccagcagtgtccctagccacccccagcatatgcctctcaggcaacaccctgcacccttccaggggcaccattcagagacatctctgttcaacaccgcagccttgctggggactccatttccctttctcctctgggtgccccagaccccggaaagcctccctgagaatatggcaccagatgtggacaccagctctgggcattctggagcttcagcctgctaaggggatcttgctagctcaggggacctcctttcagctacagaaagcccaggaagaaggaatgggggaggacagggcctcactttctgctttagggaccagccaagtcccagcttgtgctcccgcctctgcagcaccagggcttgctccgacagggcctccggcactgcccgaagacggcttgccagctcggccctctgctgcctgctttctgccagctgctcccacaggtccttctctgcccgcctccagtcccgctcgggggccctgttggagcacatgccagggaaagaggagccagacttcagcccaggccccagggggctgccatgcccaactttcctatgctcacctgcacccttcagtggggcttggtgggcagacacggtccaatgccccgaggaaataggagttccagagacagcgggcagggctgggcatcaagtccatgggctctgcctcagtgggacctgagaacaggacagatcctggagctggggtagtcttggcttcccaaagcaccaggctctgaggcctcttctcagactcagaattgaggccctttggctgagcacgcactaaaacccttcaaccctgatcctctggcccgaaagtctcctggtgattggaacttcactaaacaccagcctcaactccactaaacagttctcagttcccagtggtttccatgagctgtgggtgctgccaggggtggccacttgctgaacacaaaccccattatcctcacagcagctggtctggggaggcgcagcaggcactcctgaggggaaattggtgcccaagtccggcagggagtcccgtgaggagctgcaatccccacccaacactgtctgcaccagagccacgttcccccttccagtgtggaagtctggaaatggcaggggagcatttgggggccaccacagtttagctatgatgtgggggtcagagcccttaagtcaagtcactgctcaggtacctctctggcttccatagcttcagctgtaatatggaggccctgacggacctctcacccaccagcttggtgaggaaggtcagagggtagacaggggctattctgccagtgttgccatccctacacccctcaccatcaccctcctcacctctagggtctgggcccaagtccactgcctcccaactcccaaccctgggcacgaggcaccctgccctggctctgaaagggcacaggagttgtcttcacctaagcagtggttacacctagcacctctaccacccccaccctgacctccccactcctcacattcccaggccttctccactcaggatggcaccatcgcccaccaggccttctccccactggacagcttgactctcctctccccttactccaggcccaggctcctgcagccccctccaaaattgtctcccctccaaaatgtcactgccacacaaggcttctctaagacagaccatgaggactggccgctgcccccacctcccatactgggtacagctcccacaatgccactctacctgggtgctctgtcttgccagttagaagtgacaggctttccatggcagccccctgcccttagtgagaagctgagctgtgcccagcttggtccgggaggggctcatggtccacagaatggagtgcacatgcaggccagattgtcctgagcaggggggcaggccagggcagccccaggaaggctttccagggaggtgaccctggggccaaggctcagaggtgaattaactgcctccagagaaggcaaagtcagatgaggcagacagaggagacagtaaggacaatagaacaaggagggcatcagagcagctgggcctggcgggcagtgaactgagccctaagcttggtggaagtggaggtggggggcaaaagggagaccaaaaggggtgagaggagctgtggggtttgggaggatgcagggcagcggcacctccccagtgcccttgagatatgctacagacctcaactccacagaggctgaggacccagacaggagcttgggcctgaggggcagtggaggtggagcaagcctcctctgaggtggggatgggagtggaggagttacccaaacctcacctgggggcagatctttctccaagtttctgaaaggtgtgaaagtcacaaaagaatgaagctctaagggtagaatctcaggcaggatggcctccaggctgcaaagtgtggagagggagacagctgggagatggcttctgttccacctcagaaaaagagagttgcttcgtggctgggaggtagggactcctggattctcagtggtgggcagttttgtgggaaggtgactaacttaccccatcagagcctatagctcagggcagggctggggacagaagcttctctgagaacatccatcccggggacagaagcttctctgagaacatccatccctcagggctagtatcctggagccatggaaactcaggcaacactaagtggtgggaggaggagacaccagagaggcctcctactccacctcatctgagctgatgaaaccccgagatggaacctggctagtgtggtcgaggccatgggtaccaggcaggaatggcatctcagatggcctgggatttttcaaaatcttcagcttttgagataggaccttagggggcaggacctcagcagccaatctgggtcacccactgtacactgaagcggctcctaactttcttttttgagacggagttttgctctcttgcgcaggctgcagtgaagtggcgcgatctcggctcactgcaatctctgcctcccgggtttaagtgattctcccacctcagcctcccgagcatctgggactacaggcgcgtgccaccacgtctagctaatttttgtatttttagtagagacggggtttcgccatgttggccagactggtctcgaattcctgacctcaggtgatcatccacctcagcctcccaaagtactgggattagaggggtgaaccaccgcgcttggccgattttttgtttattttttgagacagggtctccttctgtcgaccaggctggagtgcagtggtgtgatcatagctcactgcaatctcaacctcctgggatcaagcgatcctcctgcctcagtcccctgcaaggagctggaactacaggcatgcgccacccagtccggctaatttttgtaattttttggaaggggacccagttttgaattagcttctgttgtttacttcggatagccatggtggagctggcagagatttaggggatactaaacacccctacaaatcacgccttgaaaccccccgtttcagggagagccgctggcgaaggacttgatgcgcagccgcagctcggaagcggggggctcccctgcgacacctccccgcttcaggggcgggcccagacccgcggggaggggcatgggcggggccgcggctggctggcggccgccggggcggtgctggggaaacccttggcgcccccgcggagcggtcccaaggagggggcggtgcctggagggatggtccgccccgactgcgggtttctagccctcgcgtggcgtggggacaattaggcgccacgccctgtcgcttcactgcgcgacgctcgcgaggccggggacgccactcccagaccgggcgggacgcgcacgctcacagtgaggtctcaaaagatccccacctcagttttctcatctggaaagtggggcctcgtaatcctgtccgacccggcgcgggacagtaggtgtcagggattttggtgaccccacgctcgaggcctctgcaaaagggggctgtccagtggcccagagacgcagccggcggggcttttgtctagcgggggagtcttaactgagaggccacgcaggccggcaggaagccgctccacaggagggggctcaaggagaggggatctcctccctccagactccggccccgccagagtagctctagggtatcttcccagaaactgccccgcacgcactggcgagctgggagcgccaccacggctttcaaaaaacccgcacacaccaagataataatgtgtcgttcgctcgtttcgcgcaagcggagtcgcgtccgccttcccgagctccggcacacagacctcaggccgctctcgcgctctccggggccccgagaacaatgcccgtcctctccgcgcgcaggagggagttggcggaccacgcggggtcggggcgacggagcgggcccagccccacggccaggtcggggccccacctctcggctctgagagcccagccggcccgggccgcgcacctgtcaggtcgggggacctacgtgcgccgcgacacggcgggaggcgggccgggccaggctcgtcccctcggccctcccggaactagtctcctaggccgcggcgcccgccggagcggagagggctggtgccccggagccttcgagtcgggggctagagcggccaggcctccgagccgggtcgagccgaggctggcgacggctgcgtcacgcgagggggcggggctgccacgggcggaggtcgcagccggaagcggaagaggcgctcggagcggggagtggggcctagctgcagccggagcctgggagacggtaagtgtgggctggggtccgcggcggcgacagcggcggcggcggccgggggtgagtcggcggggcaggcgcgctggtgccattcggtctcggcctactccctttctttctcctcttcggcccatatcgggccgcgacctctcacccctgacccgctgcttctgccccggagggcggtcactgcagaccctgacctcgaccccacggtgttgaaggcggagcctgaacggcctctggggccgctcaagggtccagtttgggctctgtgcctgcccgcggaatggggtcggggtccgacgtagaagagccagagaagcccttcagacccctcccctacccctggcttcaggcttagtccgcagatgactcctcccttggcggcctggagtttgattctggcccagtccggctttccctctgtccccgggtctcccctcggcgccactggtggcggttacaggggatgggactctgagaccccctgggacctggggcggcaggaagggacgcgaacgagggcgcaggctcccctgtgtgttttgttgtggtggtagagccactccagcccggaggatgggctaggccaagctgacagttcaaatcccctggctgctcctccgtcccgcccgggagtctctagctttagttccgggtgtgggtgccctgatgtggagctggggtggaaattgcctgaaccaggcccccatcagaggcggagttggcggccttccagcttcccttcttgatgcccttgaaaaggaggagcgtttcaccgttggtggtggaggcttgcgaggtggcaggtttgaggttgcagtggtagggcagtccagccaaaaataaccatgggtgctggggtggctggaatccgggagggcagccgctgacctggctggctgcacttctagtcagcccagttctctggccaggaacagcaaatgagaagccgacaaggcctgtgctcaaagttgacatccttggcttggttttcttcatatcacctttttcctcattgtgcagagcagagcttcccaaagcataattgtggcctttagctgctttttaaacaagctgtttgctgaggttttcgagaatcagagataattgagaaatgggccctagagccctggctgggaggatgatatctgctatttccaatattttacttgcctagaatgtgttaaaggaaggatactcttctctgttattgctttgtgtgtggtaccttataactctcatgcttgtcatctcttttgccaggctgagagatgttatctccattttccaggcatgctaaccaaggcctagagtgacttgtctaaggtcatgaggctggtatgtgacagcactaggatttagtttagttttctgccagagctcttgcctcccagtttccttggaagggacttataaaatgtctgtaaggcatttaacacagccctgaagtgttacctggaactttcagatgttcatgaaaagctgccactagtacctctgtgggcacaaagctgtgctaggcatttcacttataggagagagatatttaatcctcacagaaccttgtaagagattactattcccttgttgcaagatgaagctgacggtcagagtagtgtaataatttgttcaaaggcacacagctagaagtggcaagccatgattcagattgacatctatatgactctgaaattttgttttccattgatgtgaatatgtatggacataagaatcttctaggtcccaggaggtagtctttggcgtggtgtgactgtgactgtgtcctccagctctggtgtttgtctgcccagtgaggatgggcaggaccatacttgccttgtggcacgacatgtgccctggccaatagagcatcttctgggtcaattagtggggtgtgagttcctgctttcattccatagcttgggcacctgacccagagtaattgcaggaaaacagtgaaatattagtcagctgattaccaaaacaacaaatctaagcttttggggaggtgatttcacaaaatatttatctccaaagacttcccaggtacacgggggaagacaagttagtggggagatggagggctttcttagggacacggagaggctcccaggggtttggtcacataggcctcactgtcctgctcaagcatggggagctgttctatgctgcttttctcctgacagaccctgctggtgagatggggcagcctcagtgggtttgtacaaaatgtgcttggccaggcaagctcaggactgaccatgactggaggttggctgtggccaagtgtgagtgttgggaagaaggctggctccatggaggcagtcagggattgacgtatgggtggagcaggttgctggcctcacatggccagctttctccgctggtggcagatccagcctggcaatttcatttggtggatataagtcctcactgaacagggatagtgaggtggggctcttttacctgccagatggctaaccctctggctatcctgggataggcggagggtaggatactagagccagagagctagaagaagggacagtaacggtactgttggataaaggcaaggcacctggcagggcactgtgggggtctaaaagggtgctaaatgggcctctggaaagaaagttagatgcgctgggtccacgtccccttgggttgaccctcaggagggctatggaatgtttgtgaggcctgtgtgcctctttctccaagggctgctcttctagtctcttgtggctcctcatgctcacttgtggtccttactcccttgagtggggtccagttcagggccctagccagacagcgttcagcttctcaaacttgagggctttgagccctcgcctcctgtgtacagccctttgcctggcctttggctttacagagcattcacttcacgggaccgcccccccgggcgggagggaatagagtgcaggaggctcccctttctcctgcctttgatctccctgtggtagtgttcaccgtccccacccagggttactgcctcagcccctggccctggctcacccagttccctgagcacccaggccaccaggctagtgatgctctgctgggagctgtttgtttgttcactggcagagaaagttgtttcctattgtctgctgtttgaccagtgtgacctcagagttcttcttcacttcataaacctctgggaggggccgccttcaaacagaacaatgggcctcttcaggagcaaccgggaagccccagcagccccatggctggaggtggctggctgtgtgtttagcagggctctctgttcctcgtggcctagatgcatcactgtaagcgataccgctcccctgaaccagacccgtacctgagctaccgatggaagaggaggaggtcctacagtcgggaacatgaagggagactgcgatacccgtcccgaagggagcctcccccacgaagatctcggtccagaaggtgagagggaactagataggagggaaagactccttctgtcagctgggctcagctgtggcagctccagactccttgagatgactccatccctgcccagctgtccctggatccctgccctgtcctctttgggctcctccactaacctcacctgcatgccttggcctcagcagtagctaccatccttgccgcccactctttctctgtcttggagtgccttttcttctccccacacattcccccattttctaggccagcatctttccgcttaacctcctaagccttccttggtgaggattaggaacataacctcacccctggaaagtttgctccctgggcctatcttagctcccaggtcaaacttagagttgcagcaggccacagggaactctggaagggtatagaacccttggaggcactctaccatactccccttcccctgtacccctcctcctacagctggaggatgctgtcgttggacagggctctggagggcgggcttagtacctttgcaccctcccctctctgcccacttcccaccagtgtggatgcttttagcacaggctgtccccctttagccctttacagtggccttaccacaggtctcttgcttgctaacagcaaggacccagctgaccagcgtccccatcccccttttggcagccatgaccgcctgccctaccagaggaggtaccgggagcgccgtgacagcgatacataccggtgtgaagagcggagcccatcctttggagaggactactatggaccttcacgttctcgtcatcgtcggcgatcgcgggagagggggccataccggacccgcaagcatgcccaccactgccacaaacgccgcaccaggtcttgtagcagcgcctcctcggtgagtggtagccagagtgtgctggctggggcttaaaggcctcatctcttcctagccttctctcaggctggctggtccgggtgagtactgccagccctgtgcacgtgcactggtgtgcgtgcatgtgtgtgtgtatgtgttgtctggtccaggtgtagggctgatcacagggtcctggcctctgtgtcttctggctctttccagtggcaactgtaggaactctggctccgatgctggctggcccctggcctgtctatgtctacacagtgctccagacaaaggccacgtggtgcaagtggctggggacacttcttaggacacttcttagggatcctagtagagtggctggtatggtggtctgcagctatatggcctggtccttcccacccagagactgcctcctcgtgtaactgagtgctctgatgtggactgcacccacctctgcgtctcatctgcacaccccttcccaaaggcccccagtctggagtgcctcacaggaccggaggatttgcctgtcagccagctcagactgggaacttcccttctgatctccagccaggccctctccagccgagcctctttacgaggggcagtcgcggtgaggaggggcaggtgcctgtgtgatggggcatgtgaagaaatggcagaaaggctgccgccccaggcctcgtccagttgcaggccacatgcccagagcagggcctggccagtattcctagcatggagggttgtaaggtctctggagcccacattgcgctcagtcccctggggaagcaaagccagttgtgtatttccgaggttacgtgcggtcttctcttctcccccatccctcttccctgcctccctcctgccggccttgaggcccctgaggagcagtggagaggccaggtgtcttctctgcccagcgctttctgtgacttctttgagtggctacaggttgagggttgactgtgcgggcgattgcagcgtggccctttcacctctttgcacactgccacatgctgccacaggatggcagtgcaggtctggctctgtttctctgtttggtgccctctatcgatcgtcgtgaggcttgggatgggcctagattgtgagcagcatgggtgccaaggccagggcaggagctggcatggggcctgtgtgggccattgtggtaggaagcctggcagtcgactggcccagaggatcccaggctgctttccttcttgaggctggtggcaggagggctgctgacggaaggctgtttctggtagtgatggtgaaatctggccaaggatgccgtctggaggcaggtagcagcttggctgtgagtggcagctgtcaggcatgtgcaagtctgcgtgggcgaacagaggcaggcaaggacaggctgggcattctgcagctgaagccggagcagccgctgaccagtctggatggttggacccaggcggggccagctgccttcttgcgccgccgttctcactgcatcttccgctctggcccaaagccacatgggagggtctgggagggagagactcggaggaggaggaggagggagtcggggcgatggctctcctcacagcgtggccctcagcagcagaggcaggtcatcttcctgagcgtttgtggcgctcctcttaaagataatgtccgagttttctttacatacctgtagctgtttttacttttctgtttttgaagtcagtttgtgtcttgacgtgtcccttgcaatatccctatcgttatatatgctgtgtgccttatgaaatgctgggatctggaaaatccaaccaaccaacccaccggctcctcaccgtctccacctctgcctttgactgacacctcaatctgtcaatcggaaccgcctaccatgcgattggtcggatggcgtttcggggggcggtgcatgcagagaagccaacagagcagtaagcgcagcagccggagtgtggaagatgacaaggagggtcacctggtgtgccggatcggcgattggctccaagagcgatgtacagccacctttcgtaaaactttacctctctactttctaccccccttgttagacgagacctctcctgcctggaggggcctctagtgcgcgtggtgccttagcggggccaccagtaattgcctgaatgacacagacactagcaacttccatttttaagagtgtagcagtgagagagaaaccttttttgtttttgagaatttgaatgctgtgaacttgcaggagctgccaaccccctgccctccagattctcatgcccaatttcttttctctcctagatgagattgtggggaacctgggtgaaggcacctttggcaaggtggtggagtgcttggaccatgccaggtgagcgagctgcggcagtacagctggctccggatgtgatcttcctgggaagagctggcctgaggttcttgagggtggcagctatcagagcttaacttttttctttttgaagggtggcatcaaagtagggttccgacctgtccatgttggggttttgctgaccccctgtaataagggagaaattcttgggtcctgcagttatgtggcatccctacccaagaattgttggtcagtgaaaggttctgctccaatctcttcacttctccagggctgtggtggtggatatcagaacagggccaaggccccggctcccctgtggcttggagctgcttcctgtgataacttttaggttcttggcttagcaaggggctaggagtaccaataagcccagcccaagcataagtcccattccctgagggtctgcctgagaggctgtgcagatctcagtcgagagaaacatgaccctgggctttctcaccaagcaggctgctgccttcttcagtgtgactagggtagtgtgtggtctccgctgagtgtgcctgggagagtggggtatacctgtgtgtgtcatgctgcacctcactctctcccaagcccaacagtacaatagttttttccccttaccattccacaagactagaacatttgcttcctctcctataggtctgggttggggaggccacctccagggagccagttgccaccctgccataggctctctagttggtttggcacttcagctacaaagtgcttgtgtcctcattggagccacatgccacccatatgtggccctctcgctatttcagagatgaataaacatgctcagggtttgcctgcatcatactccagttaacagcagagctggccaccactgcgctgtagtgctcctacattaaatggggtgttcaggtcattcagacccaggcgtccagcctttcctgtggccacgagatagactgagaggaagtgtccatttgctccaagttcctatgtaaatgcctgtacgactcagcgtggcccaagaggttagggttgggaccagtgggtggagggacatgcacaaccacaccgtggccaggtggagacatggcagactcaacagccgggatgcatgtaggcattctgggctgctcctctctcaggagctggagggaaaatgagcctctggagtcactagggggcaggtggagggtccagggaaactttacgggactcaaagggagccagggccagtgggggttgtcatgcagaggcagaattcagctcagcgaaaggcagggtcttattctaagagcagtgcaactctgacaggggctgccttggaagtgatgagctccctgtgctgaggactggaatgccacggagggaccctgttttaggaggaggccggagtgcatggcctttcccctgaggtcccttcctgccctgagaatctgggaaaataggtagggagaaaaaagcaggggattctctagaaggtccctttatcctgggcctgtgagccttaggcaccacagtcagcctccctgaggcctcagaggacacgcccttccaggctaggactgtctcgttccccactgggcatctgaattctagctgtcctttcctgacagggcctggcagttgagcctcagcaggtttccttctctgctggctccctgcagatggcctcctggggtgaggttgggggtgggaggcacagagcagggactgttaaaaccttctttggacacttaagaagggttcctggcattttgtggtcactgataaacactgtggcaggtaggtgcggctggagaggggtgtggtaaagggagtggccctgggcctcacagtgagaggtacccttgctggtacccctacctcttgccagatctttactcgatcctggaacccccatccctgtttgctcagacttgcagacaagctcaggaaggtcaagaggcgccgcaggagggttctcggtgggacagcctggccagggttggggctgcctggcctataggttaggtcactgtgtgagctcttggactggcactggttaagcaggattggcctctactctcccacactcctttgggagctggcagtggctgagaacataaaagcctaaggatggcaaggatgctaagagcattaactcacagatctcagggagcttgctgttgggtgggcaaaggtctggtgttgcatggggcaggctgggcatccagtatctgctctcttcagtgccggctgctcctggagtggtgtttgttgggagttgctgggttggggtggagggttggggaaggactgggcagctgctgatgagaacctctgtttccttcccgggtaccagagggaagtctcaggttgccctgaagatcatccgcaacgtgggcaagtaccgggaggctgcccggctagaaatcaacgtgctcaaaaaaatcaaggagaaggacaaagaaaacaagttgtgagtatctgcaaggagtgggagggaagccttcagtggggctgctggacccccaggggcttagtagtgtgccttcacccatccgcactgtgccttctccccacactcagaaccaggggagtgtggcaaaggtcttgctggaagcctttagactgcagtccagtcttcaccccagctgtctctgtgtcctgaggaaggcctcccagccctgcgttttgtgaattggggagctcactgggttatgctgggcataaaacaagataaaaacatgaagttggggctctcacatagtaggagatacccaaaggagggcctttctgtggcagacacactgagcactctcctccacgcactgtgctgagcctgggcagatgggtgaatccagcacagaccctcacgaagctcagcagagtgagcaagtggagaaaagcagcaccagtcctgcggagtgcactagcactttccatctctccctcagcaactctgaggcagggctgcttccatatcataagtagggaagctcggagggcttggaccagaaccgtggacatctcccctaccccccgcaggaagcttagtccttgcccagagctcatctgggtattgggtgatggctggtggggagaggtgctcttgctctgatttctcttgcactgtgtgtatctgcattctggtgtgtgacccggtggcctaggagagagttgggaactgtcttcatctgagagagggggtgaggcaggcccccagcacacagcctgagccctgcccatcctcctcctccagcctgtgtgtcttgatgtctgactggttcaacttccacggtcacatgtgcatcgcctttgagctcctgggcaagaacacctttgagttcctgaaggagaataacttccagccttaccccctaccacatgtccggcacatggcctaccagctctgccacgcccttagatgtaagtgtccaccctcaaaagaagcatgggcagccacatgcctgcagccaagtcatctggttacttgttgtccccattcattccagcacgttactaaccattctcctgggcctgagggacaccagatcccctttggcggaaaggcctgtctttgggtgggaatctcagtgtgaggatggaaaggctagggctccctccagggacctcctggaccagcctctctacccccaggcactcaggaagaaaacagaaacgaactgctctggaattggcctaaccaccaaccctgcctccctgcttcatgcatgggataaaaaggtagaagcctgacctgacagatagcaccacaggtcctgcccacatggagaccctcggtctaaccctgacttgtcatctccctgccagcctggaaaagcattatttggcagtgccagggctcagcgcagtaggatttgcaatggttgcagcagtacagaaaggctccttggtgaagttggtaggcgttgagctagaatcgctcaaggtcaccccgcatcgctcccctaccctgagcactgctactgtgataggctgcaggccactggggtgggaagccccacatggatgagaagacaggtgtcttcctcctcccacaggatctgcaagatgggacagggacaaggattccaagcaaggggaacagcttggtgaggcctggagcctgttaacgggctgagaattggctccagtggagtagactgccactggggagtggtgggccacatagttgtgagggtcttgagtgccagatgggatccttgagctgaaaagtgactactagcaagaagccactgtcagaaggggctggaggggaaaggcttgcctgcttatgactagcaatgagaggcggggctgtcttcctgggtatgcgacctgtgcactcagtcgcacaggaccctgtgcttgatttaatgtccttttgccaccaccttaatattcttagtaacttgaacaggggacctgcattttcattttgcaaagggccctgcaaattatgtagctggtgcagggaagagggaaccacctcgaggctgttgctgtagctctgctgagagacaggtgaggaggcctggtctctgcagaggagaggtggagggaggtttttcgaatggcaaatttctttcctacccccctgctaaagtatcagaaccctccaaggcctcaagtacagagaacccttgagagggaggccagcacagaggcaggctgtagtccagctccctgctgaggtgggggtgtgaggacctctggcagttgctggcattggaagaggggtctggcctagagctggcaggagagccagcttctcagtgcctacttccccttctttccctgctaccttagttctgcatgagaatcagctgacccatacagacttgaaaccagagaacatcctgtttgtgaattctgagtttgaaaccctctacaatgagcacaaggtattggtgggggtaagggtgaggccctgtttcaggggtgggttacccgctggtgcagactcctgacctggcaggcctgccttgcctttcagagctgtgaggagaagtcagtgaagaacaccagcatccgagtggctgactttggcagtgccacatttgaccatgagcaccacaccaccattgtggccacccgtcactatcgcccgcctgaggtgatccttggtgagtgactgtatggcctgtgaccttgtcatactggactgttgttgggagggtatgagcagaggcagtggcatgcctgtcattctctgccacccagggcaggcagagtttctcagaccaaggggccagtgtcatgagacacaggtgactgacctggctttatctgtcagccttactgagagagggcctcgtactgggatttgggcaagagtcctgccagccggtgtggtggctgccttgtgacttccaggctggaagcataaggccggatctcacagcctctccccatcttggcttgcagagctgggctgggcacagccctgtgacgtctggagcattggctgcattctctttgagtactaccggggcttcacactcttccaggtacagccaccctgcattggtcccctaccctgagtactgctactgtgataggctgcaggccactggggtgggaagccccacatggatgagaagacaggtgtcttcctcctcccactaatcatcatgtgagattcagaccctttaaggatgtagatgctaaagggaaggcagaggtcagggtagctggaacactcagaggagtcttatgctaggccatcgaggatggaggatggggtaggaggtgacctgaccttctagataaggggcacagatgactaaaggcatcgggatgggctgggacagggcatgttctgggcagggagtgaagagctaaccagagagaaatgtagtcacagcccagtccacctccacccacaagggctgaggagcctaggcacaggctggcaggagaagctggggctgccgcttcattggtaggtttgcatgtcctggggcagtgagggcacttgcccatctttcttgttcctttttctccttgaaggggccagagctagtactgacccccttgcactgtccctaatcttccacagacccacgaaaaccgagagcacctggtgatgatggagaagatcctagggcccatcccatcacacatgatccaccgtaccaggtaaggaccccagtagccccctcagggttggtatagaggcctttctcttcttggctgtgggtcagcagggtactggatgtggtgagtctttgctggacagtccatggttccgcaggctcctaaaagccttccctgtgtgcccctgcagacctgttgccctggttctgctgctgtcttgggagctgctcttccccacctcccaccagaggcttgtccccttactactcccacacttgactccacccccttaattttcaggaagcagaaatatttctacaaagggggcctagtttgggatgagaacagctctgacggccggtatgtgaaggagaactgcaaacctctgaaggtcagtttctggctacccccagctgaactcatgccaaggagagaccccaggcactgggcagacatacagcagagacaggccaggccgctaaaggctgcctccttgatccagctctatgggaggcggcacccaagactgctgggtgctggcaatggggcttcttgcaaactgccccagaggggcccttagccctaccccttccccatagggtggctatgaatgtaattggggaacaccagaagagccagatgtcagaagccctgctgcttcctgtccctctctctcctcgaaattttgggaagaactaggcaggactgaggtgagggggagggaagacctagacatggccaggaagcctctgtcaactgcatttggtgctcggacaagtgaatttcgcagaggtgatctctacccacctgtcaggactttgcatgtgggggcagaggcatcaacccagcaagacacctagtagcctggcaagttccgagcaaaacgttaaacaggcatgaaaggaaaggagctgctcattgtccaggagggcggaagtagagtcctccaaggaggcatcactgcctcctcgatccagtccagcaaggcgtcccagaggcaaggggacctgctgtggcttcccacgaccctgccgtcacactgaggcaccttgtgtccctgagcagagttacatgctccaagactccctggagcacgtgcagctgtttgacctgatgaggaggatgttagaatttgaccctgcccagcgcatcacactggccgaggccctgctgcaccccttctttgctggcctgacccctgaggagcggtccttccacaccagccgcaacccaagcagatgacaggcacaggccaccgcatgaggagatggagggcgggactgggccgcccagccccttgactccagcctcgaccgccaggccccaggccagagccacccaatgaacagtgcaatgtgaaggaaggcaggagcctgcaggggagcagacttggtgcccagctgccagaaagcacagatttgacccaagctatttatatgttataaagttataataaagtgtttcttactgtttgtaacccctggtaccagtgtgtccatctccaggctccttgccttccccttacctgaccttattaataaagtctttcttagcagttca

SEQ ID NO: 1047 - DNA, 7759 bp, Homo sapiens
agaagctccacaccagccattacaaccctgccaatctcaagcacctgcctctacaggtacctttcttgggaccaatttacaatctctgggatccccaactatagaacctggaagctagtggggacagaaagacggggagcctgggctaggtgtaggggtcctgagttccgggctttgctacccagctcttgacttctgtttcccgattttaaatgagcagtttggactaagccatttttaaggagagcgatggggagggcttcccccttagcacaagggcagccctggccctggctgaagcccaaccccaacctccaagactgtgagaggatggggactcatccctggaggaggtgcccctcctggtattgataaagaatgccctggggagggggcatcacaggctatttgaaccagccctgggaccttggccacctcagtgtcactgggtagggggaactcctggtcccttgggtatatggaaggtatcagcagaaagccagcactggcagggactctttggtacaatacccagcatgcatgctgtgccaggggctgacaagggtgctgtccttggcttccccattttggagtggtcacttgcctctactccagccccagaagtggaaactgagatgatgtgtggaggagagagccagcgttcatgttgggaatcttgaggctcctttccagctctcagattctgtgatgctcaaagggtgagctctgtgggcccaggacgcatggtagatggagcttagtctttctggtatccagctgggagccaagcacagaacacgcatcagtgtttatcaaatgactgaggaaatgaatgaatgaatgtctccatctcaaccctcagcctggtccctccttttttccctgcagttggtacagatggcattgtcccagtctgttcccttctcggccacagagcttctcctggcctctgccatcttctgcctggtattctgggtgctcaagggtttgaggcctcgggtccccaaaggcctgaaaagtccaccagagccatggggctggcccttgctcgggcatgtgctgaccctggggaagaacccgcacctggcactgtcaaggatgagccagcgctacggggacgtcctgcagatccgcattggctccacgcccgtgctggtgctgagccgcctggacaccatccggcaggccctggtgcggcagggcgacgatttcaagggccggcctgacctctacacctccaccctcatcactgatggccagagcttgaccttcagcacagactctggaccggtgtgggctgcccgccggcgcctggcccagaatgccctcaacaccttctccatcgcctctgacccagcttcctcatcctcctgctacctggaggagcatgtgagcaaggaggctaaggccctgatcagcaggttgcaggagctgatggcagggcctgggcacttcgacccttacaatcaggtggtggtgtcagtggccaacgtcattggtgccatgtgcttcggacagcacttccctgagagtagcgatgagatgctcagcctcgtgaagaacactcatgagttcgtggagactgcctcctccgggaaccccctggacttcttccccatccttcgctacctgcctaaccctgccctgcagaggttcaaggccttcaaccagaggttcctgtggttcctgcagaaaacagtccaggagcactatcaggactttgacaaggtgagcccggggtgcaggtggcaaggggcaccttgcagggcctgggtgcagcccctccctcccagctccagcatgcccacacagctgctgtgttgccaaggcctaggaaggctctggacacctcagaccagctgtgtgacctggagccgactcttccccttctctgggcctcagtttcctcatccttgaagcccccttctcagggctcctcaaagcccccaagaaaaaagccctggaaatggggccctagcagagtcctgcaatgtggggggcctatgagtgagaaagctttcattctgcagaaacctaaaccccaacagaggctaatccccagctctggtgtcacgttgcttccctgtgttcacactaaccttttccttctttgaaattggacccctggtgttattgggaggaagggtcaatggggcataaaatgacactttaagccatacccagggctgctaccagctcctgctgcaagctgcaaccccctgcctagagaccaagttgggaggataggggggtacccagccaccaggtacaggccaggggagtggagcaacgttcagcctttgaccttggaagtgccagaggtgcccctaagcttgtgccccctcagaacagtgtccgggacatcacgggtgccctgttcaagcacagcaagaaggggcctagagccagcggcaacctcatcccacaggagaagattgtcaaccttgtcaatgacatctttggagcaggtaggaaccagaaccttgcccctccatccaacaatgcctgctgttcacccacagccttgcccagcccctcagtccatgaaataacccaccaaccctacaccagatggtacaacatactgagatctggcttgggatcagggtttgagcctgggctatgccaccaattcccagtggagaaacagcaaagtccttctcctcccctaggcttcagtttccccatctgaacaataaggtgttctctggcctgtaagtctaggcccctataattccagcagctaattctgaaacctgtatctcaagtttatgttgaagagacccagcctctgtcttcaggaaactcacaggctagggccagagaaagctaatgctggatacatacatagcagatacttgggaaatgatggtttccttgtttctgtcttccttctttcctcaccttacactacacggttcaggatttgacacagtcaccacagccatctcctggagcctcatgtaccttgtgaccaagcctgagatacagaggaagatccagaaggagctgggtacatgggggcccccaaccctatagccaggagaagccttgagacccaggttgtttgttcagtctacaaacacctgttatgtgcctgctgtgtgcaagccctgggcacacagtagtgcctgcccttgcctagaagatgtgggaggttagtggggtcgcagacttgtgaatagacagtcttacataagagtgacatggggtataagaggggataattcatggggcagttagggcagcccctgagctctgcttgtcctctgtgttctacagacactgtgattggcagggagcggcggccccggctctctgacagaccccagctgccctacttggaggccttcatcctggagaccttccgacactcctccttcttgcccttcaccatcccccacaggtgaggcctgccggttctgccctcccacctctaaagtgcttgccatgttttctcttcctggcttctcagccctggccctggctcagcatctccttcccgacctcgttccccacagatcccggcctcagtctgcccccatccagtccaaacataatctaacccccagctctcaggagaaagttccacttgtgatctcagcgctcattcccctctgttcatattccctccctcccagtgccctctgtgccagtcaggtcggcctcaccctcacaagcatgaccctattggcctccaatcttgctaacgctgaaccttctgcctggaataccttctagcctcttctctgaccaccagaatcctacccttgctcaaagtcaatgccgacacgagcttcctctccccagaagccttttgactcatccagctggcacagcttcattcctgatgtcttataggacttacagccatcagcccttgatcatgccctggaattttaacaatgtcaagagagttagtgagcatttacttctacccaaacgttgttctagttattcctgcagtaagaggcctgaatccccagccaggctagaaattccccggggctgccccaggctgcctgctgcttttttttttttttttttttttttcatagaaaatagaaaaacatttatctgaaattgcctgcttcttggctccagagaacagccaagtgcgcagccaggcgcaaagagaagtttagtaaatacttgctgaagttaaagaacaggacgcaaggaagagggaggatgtttctacctcttccctgttcctcccctcccctcccagtgtagggatggagatggcggtgggcaggctgtctggatggggtggaggtaggagcaacacatgccccagctttccagccctgagcctcacagtgccctcttccctcctcagcacaacaagggacacaacgctgaatggcttctacatccccaagaaatgctgtgtcttcgtaaaccagtggcaggtcaaccatgacccgtgagtacatacccctcacgaaaaaatgtgtgcaggttcagcagtcaggaaggctgtttgtccctgctaggaactgtttatataatgaaaggaggggacctcaattgctatagtctgctctaagtgacgatatttacaaaagtttcacaaactttagtgcacaggaatcaactaggatggccaggcgcagtggctcaagcctataatcccagcagtttgggaggccgaggcaggcagatcacttgaggtcaggagtttgagaccagcctgggcaacatggtgaaaccctatctctactaaaaatacaaaacaaaaattagccggacatggtggtgcgcctataatcccagctactccagaggctgaggcaggagaattgcttgaactctggaggtagaggctgcagtgagccgagatcgctccactgcactccagcctgggtgacggagtgagactctgcctcaaaaaaaaaaaaaaaaaatcaaccaagacgtttgttacaggtgatggttcccccaggattctactgtggtatctaaggtggggtacctcaggcgattctgatgtgaatggctcagagacctctctttggaaagccccactttagtgtataggtagggggaccatatatataatttaccatccacactgggacatttgagtgtgaaaatgctatcaatgtttatgctagtcatcattactccaaaacaataaacataagccaggacatactgttgaggccccttaggaggcatattttgagtaggatgaagaaacgtatgtctttctttcttcctttcactttaatttttaaatagagacaaggtcttcctatgtggtccaggctggttttgaactcctgggttcaagggatcttcctgcctcagcctcccaaagtgctagggttacgggtgtaagccaccaaacccagcctgtttttcttcttttaatttcttttagataaagcattatttaaagtaaattaatattaaaaggcactatctttaaggctggtcattttagagagagctttgtaaaagaaataagcatcaggccaggtgtggtgactcatgcctgtaaccccagcactttgggagtccgaggaaggtggatcgcttgagctcatgagtctgagaccagtgaaaccccgtctctgcaaaaaaaaaaaaaaaaaaaaatacaaaaattagccggatatggtgcctgtagtcccagctacacgggaggctcaggtgggtggttggcttgagctggggaggcagagagagtgcagtgagctgagatcgcaccactgtactccagcctgggtgataggagccggagggtgtctcaaaaaaaaaaaaagaaagaaaagaaaaagaaataagcatcaaagttcagtttggttccttcccacctacccttcattgctttcaaagtgccctcacacttgtgttctcaacagaagtctccctcccccaggcacctcctcccagggcctctccagccctgaggtcccatctcctctgttcctcttgcagagagctgtgggaggacccctctgagttccggcctgagcggttcctcaccgccgatggcactgccattaacaagcccttgagtgagaagatgatgctgtttggcatgggcaagcgccggtgtatcggggaagtcctggccaagtgggagatcttcctcttcctggccatcctgctacagcaactggagttcagcgtgccgccgggcgtgaaagtcgacctgacccccatctacgggctgaccatgaagcacgcccgctgtgaacatgtccaggcgcggctgcgcttctccatcaactgaagaagacaccaccattctgaggccagggagcgagtgggggccagccacggggactcagcccttgtttctcttcctttctttttttaaaaaatagcagctttagccaagtgcagggcctgtaatcccagcattttaggaggccaaggttggaggatcatttgagcccaggaattggaaagcagcctggccaacatagtgggaccctgtctctacaaaaaaaaaatttgccaagagcctgagtgacagagcaagaccccatctcaaaaaaaaaaacaaacaaacaaaaaaaaaaccatatatatacatatatatatagcagctttatggagatataattcttatgccatataattcaccttctttttttttttttgtctgagacagaatctcagtctgtcacccaggttggagtgcagtggcgtgatctcagctcactgcaacctccacctcgcaggttcaagcaatcctcccacttcagcctcccaagcacctgggattacaagcatgagtcactacgcctggctgatttttgtagttttagtggagatggggtttcaccatgttggccaggcttgtctcgaactcctgaccccaagttatccacctgccttggcttcccaaagtcctgggattacaggtgtgagccaccacatccagcctaacttacattcttaaagtgtcgaatgacttctagtgtagaattgtgcaaccatcaccagaattaattttattattcttattatttttgagacagagtcttactctgttgccaggctggagtgcagtggcgcgatctcagctcactacaacctccgcctcccatgttcaagcgattctcctgcctcagcctcccgagtagctgggactataggcatgcgccaccatggccagctaatttttgtatttttagtagagacgaggtttcactgtgttggccaggatggtctccatctcttgacctcgtgatccacccgcctcagcctcccaaagtgctgggattaacaggtatgaaccaccgcgcccagcctttttgttttttttttttttgagacagagtcttcctctgtctcctaagctggagtgcagtggcatcatctcagctcactgcaacctctgcctcccaggttcaagtgcttctccagcctcagcctcccaagtagctgagactacaggcacacaccaccacgcctggctaatttttgtatttttagtagagacgggtttcaccatgttggctagactagtctcaaactcctgacctcaagtgatctgcccgcctcgacctctctcaaagtgctggcattacaggtgtgagccacggtgcccggcccacaattaattttagaacattttcatcacccctaaaagaaaccctgcacccattagcagtccctccacatttccccctagcctgcctcccctgcctcaccagccctggcaactgctaatctactttctgtgtctatggatttgccttctctaaacatttcatataaatggaattacacaatg

SEQ ID NO: 1048 - DNA, 87 bp, Homo sapiens
ggttctgaagtggggagaccagaaatctgggggccgaagttttagacagcttatgggcctccagccgtcagtctccccacctagaat

SEQ ID NO: 1049 - DNA, 7136 bp, Homo sapiens
ctcaactagtgtgattgcatttattcttataaatgtacagagctgtagaagtgcaagccaagagttctatagagtagtacataaacaccatatggtaccactcctgctgggaggtaagcctggatacacccctctcctcaggaaactgtcacctgcagaacacacagcactcagaattaaggcagtttggccctgggcacattggtggtattttggtatgtggccactggccctaaacaactgaccatttctaccctgcctcactgcactgtcccaccaggtccctccagctttttctacaaggtaacaccctcctacatggggtcagccagctcagaaacctcttcttcagggacagttgcagctgaatatgccagagctgattattacaacaacgatgcagagggccttggttttggggtcctgccaccctcacccctagaagctgctaaacacccaggccattctgccctgaccacctccccaacagagatgtaggtctatacttaccttccacagccacctcccagcacacactgggtccctctacctgtgttgctgtctttctttacactgtgctacatttgatccctttccacatgtgcacttcacctctgcagacacaagaaaggcctggacatggtctctgcagatggggaaggggttctggatggagatgttcttgagctctacaagcatttgcacaaagtgctcagaatgttggccactgcatagagctgcagagtcccattccagaacagagtaaccatctgcctctcttcccaagaccccaagctggcatgactctggtctctgtcctatctctctgctgtgatgctcctagctagtagagtaagtcagcccccagatactgtatattcctctcaaccttccatggtttgagaaaaacacaaagatagatgtccatcaggcactcacaggattaccatcgtaaggatggttgtcagacaaataacaaataaggccgtatctttttattagacttgctcatcttctagtcaccccttgtggtagagcgaaaagagtgtgttgtccctctcatgcctctggtggtcacaggacactgagtaaagcaagagactggatactttcccatgtagaacctataccccaatcccgactattgggctgggaaccctgtctatgcccattcaaagctcaccatgtgggaggactgcttgggcctgggaggttgaggctgcagtgagctgtgattacaccactgcactccagcctgggtgacagagaccctgtctccaacaaaacaaagcagaacgctcaccatggttctgagttaagccaaaaaacaaaacaaaacctgttggaaaaattctagaaagaggcttggtatagagtatagcaagatatactctccaatttgtgggtagggggtgtcacagcagaaattatgcctatttctgctgtttgggctgggggctgaaagaggctgtgtcacacccagaggtctgcttaaagcccaatcctgagtatccagtaaggcccatgctgtgaccagaagaatctggcaatagaatggtccatgctggagtgaagggaggccctctacactggtggactgatttcctcaggcaagggtctaggagctggcttaggtctctcttacccttcctgtctgtaagcctcagtctaggacaaagcccacacagctgtatacccactctcacgagtccattgctacttctcaaaagtttaaaaagtaaacaataggaaggcaccggactgctccctgtagctccctctgctggtaataataaaaactgcaggcttctggggccagccccagtaccttcgacctaatctttagctcaaagactgggtgaagaaactcacccagaccaaggaaatacaaataaataaatatgaacatgtcagagcagtttttctctaactagggaagggcaaaccagaatcactaaactcacccggacggttggaccagttggggatgccccaggtccagggattctggaagccaggatcctgctgtatcattaagcaacctgctatgatccctgtcatagttagacaggtgcaacctgaagagggacaaaaggactcactttatgctgtcttgaaggtcaagcctgcaaaccatcttagagctaggaagaatagagcaaacggaatttctcgaactggtctcaaacagtttcttttttggattgccagctataataaaccataaagtgctattttctgcctccattcaacactatctagcacagcctgggcacaagagctccctttttgcctccctgaagcactatgacaaataccaatcaagctgtctgcaagtgttttccttagccacctttgtcacccaccataagaaccagaattttctgtcttgcccttattaaagtgacttctccaaactctgctccaacagcagaggaaaactacagaattctacctatcagcccacagcccagatgggggcctctggcctgagaagcaacaggtaagggctacctgcaggtcactttctaggggtcagtgacttcagtgctcactgcactgtgtgagctatgagtggccaacagggctctgtaggcctcatggtgagcagggcccaccttggagggtaatgtctactggagggtacaggaagaagagtccccaagacagcaccagcagcaggagcatgttgaagaggccatgggcttaggggggatgaggtccaagtcctcgtcatctggaatctcatccaggtgatacccatcctgaagcagctgccggctcacatcctggttcacctgctaagagaaggagaggagggaactataggccaagatgcaaagcagaagtaactgctacccaaaagacagaaccacattccgttaccagggcttcctgtccatgtcccaccccaggccaaccccacacatccctggactacaggaggaagtaccaccttctcctacttgtgcctcagccagcagtaagccttagtactgtccagacttcactgtcactgacccccagggatctgttctcactaaatcctgaggcattcatgtaaatatcgagttcccaatatgtttgaaaatcagtgctctgacagttcccactgggagcccagactagtccctatcaaagctgaagaatatgggataataacagaacaatgggctagcgtagtagagcatgggttacagtggaagggggtggtgagcagctttgtctacacactgctggttagacttatcctttgatgccaacagaggtgggttcctgcaaagtggaatttgttggttggtttcatcagttcactgaacataagaaaaataaggctgggcgtggtggctcacgcctgtaatctcagcattttgggaggccgaggcaggtggatcacgaggtcaggagatcgagaccatcctggctaacatggtgaaaccccatctctactaaaaaatagaaaaaattagccaggcgtgacggcgggcgcctgtagtcccagctactcgggaggctgaggcaggagaatggcgtgaacctgggaggcggagcttccagtgagctgagatcatgccactgcactccagcctgggccacagagtgagactctgtctcaaaaaaaaaaaaaaaaaaaaaaaagaaaaagaaaaataaatgaggctggggaaagtgtaagacttcctcttacacacaatctttgacactcagacatttaaggaggacaaaatttgcaaactgctctattctctgtgacagaaactcagagattagccaagatttccaggagagtaagaaaagcaagtggtgtagagtcaggtccccagcacttcacctctgtcaaagggaatgggcttcacttgccaggattttacatccctgtttttctatctgggacagtcactctagaaaaatgtctacatggctatcccaggagtgttttagcctgagttttcatagatggaacaactgaagaaacagaagttgtttggtctggaagaaagcaagcttggtgaaagatgggcaggggagagacggaaatgctgatctcagagaaactagagttgctgtgtgacactggaaagcaggtcaaggaccaatggaaccattcagattaataaggaagatttctctaacagctactcaaagaaaaaattctgtgtgtgttgagggaagggtgggtagcaaggctccttggaggtggtcagtacccaattacaaaaagcattcaagtaagcacagactagcaaacacttagctgggatctatcaaaagggttccttttgtaagctgtggcctagaagacttttattttagagtcttattttagagacagggtcttgctatattgtccaggctggtcttggaactcctgggctcaagcaatcctcctgcctcagcctccctagtagctgggactacaggcatgtaccaccatgcccagcttacatgacttctgagatcatttctagccctgagtctaaatggtctcctcgattctcaacagccctccttggtcacctatacctccaccgggggaagagggcagagtggaagatcgtagaacagaccagaagtctggcacagtgctgtgctcacagcgggcaccaaacaagcatttggcagtggtggtaatgctgcctgcagcctggccctgcacagaaaggtgttctggacttgcctctgcagatgaatacccggaggagtatctggatcccagctccccatcactaggagaagaggaaaacagtcagttccgggaggtacctgtggtgcacagctgtaaatcatcaggcggagagcatgcaagggcatctggaagacttttgaagcaaaggccacacacaacagaactcaagtccgaacaggccttgaataatactggttccctcaattggttctggcagggacagggtcactctcactaacaatgcaaacataacagggcaggatgatcccccggacattggtgctccgaattctagagcagcacgattacctatgagtcttctaaccaagccatcctgggaagggatattgttcagaagagaacggccctggaatgtacatgaagggccttggaggagacagggaacaagcaaaggcatcaggcgatcttcagtcccagccaagttgcttcccaagggggtatttccaaggggagcactcacctgtcagagtcgagggacaccaggttttcatctggactctggctaagagcagtatagcccttgttaaacttcactgacctgaggggagacgggggagaagagaccaaacatagatgaaagcataggcatttcacagggataggcagagtcctcgccctgaaggagaaagaattgactgcactactgacttgccttctccctggtcacagccaccactgcctgcagctccatgtacctggctacagtgcctcagaatgtgtatgttctcattctttttttctttttttggagacagagtctggccctgtcacccaggctgcagtgcagtggcgcgatctcggctcactgcaatctccgcctaccatgctcaagtgattttcctgcctcagcctcttgagtagctgggactacaggcgtgcccagctaattttgtatttttaatagagacgggctttcaccatgttggccaggctggtctcgaactcctgacttcaagtgatccacccgcctcggcttcccaaagtgctggaattacagtcgtgagccaccacgcccggcctgtattctactcctcccataggtcttggaaaaaagcacacctccccttgcctgatctaggaaaagcaccctctccccacttatttaatcagaggacacaaaaactgcaagtctttgggtaaaaggttagggttaaccttcacttctccgagtttcaaccctcatctgtaaaaggaggcactgaataaggttctatgcagctccgagtttactattctgttaaaaacaaacaaacaaaaacaggtctagccattcccacactgctcttcgtcctcattgctggggactccagccaccattctcctccctaacagaggaggagaatgatagtgaatgagcctgtgcactcacagaactcccttattccgaagccctttatctgatcctatcacatccttaaaggaaaagagagattgttcctcttcccattttaaagatagtgaacctgacaggttgcatcaggggaatcgctagctcggccttaaaccagagcaccctgcctccgtcctggggattaaagccttctctaaagctgctggcacagaggaggtggcgcctgctgagaccttttccctgaagagtctgggcggttcggcgaggcccccagcatgccttttctccgcagaacggccttggccaggtcccggtgcttctctggaagttaaaggacccgggtcagccgggtcttccccactccgccgcgtctcccgaaggctgggaggccgctctttccgaacggattttgaggggcgagagcaggctgcagctaaccccttccctccggggccgaggcccagcggagctccggaacccgccctggggacgcggccgcccgcccagggagaaacctcccccgaccatcgggccacactcacgcagcttggcttgaatggagggtgcgcgcgtcaccatgtatggcccccgcttttccacggccgcgggggtgcgctcccccagacggagggctctattaccgatctgcccggagggtggccccgcagctcccggcgcgcggtcccgagccccgctgggccggggtcccggggtagacaaccgcaacgcgcgcccgctgggctccgcggtcgccatggccgggccccgccctgccggatggtgcaaccccgcccgtggcgaaagagtgaccggccgagggagaggcgggctcttttaacaagatggcggtgcgcaggcgcaggtagtcccctttcggagctctccggttcggtagtctgaggacttggccgaaatgttccgcccttcttttcggggggaccgggcagttccgttctcggttttggggtaggcggcttgagcctggtgatggttaggcttagttctgtctctagtggaaattaaatactgatactgtcgtggggctgcgcgtgtgcgtcggtcgggtgcccacggttt

SEQ ID NO: 1050 - DNA, 5187 bp, Homo sapiens
gagctgtccgcgaaacctagtgctgaagtaggcgcggacgtgcccggtgcctggcgcgtggtagcaggcgcccggtgccccggccggcgaagaccatggcgttcatggtgaagaccatggtgggcggccagctgaagaacctcactgggagcctgggaggcggcgaggataagggagatggggacaagtcggcagccgaagctcagggcatgagccgggaggagtacgaggagtatcagaagcaactcgtggaagagaagtgagtgggatcccttcctggctccaacgacctcccctccccacccccacagctgctcagtccatccccgggccagcctcaggtcccaatcccttctcccctactttcctagacacggtaagagaccgggaggtgtcctctacactgcccccagacccatcctatctgacacccaaaaccccgctccagcatcatgctccggccaagggggagtggggggaggggcgaccggacgagggaccgaccggagcctgggacgaggaagggggtgcacgtgcgtttctgacgaaacgataatcccttaatccgatctggtcccagccgcctatgtcttccaactggggctcctctgaacttgaggctctgaaaaaagtggtgcagccgctcagagtcgcggagacagaccctgagatgggggcactcacaaacattgagcacttgtgtgcccgcagtgctgggacagagtttggggctggactctgctgctaggctacttgggttcagagcctggctttgcctattagctggataactttaggcaagttacttaacctttctgtgcctctgtttccttttctggaaagtggggatggtaatcataatacatgccttgtatatttatgaagattaaatgccaatgcatgtaaactgtttagcacagcacctggcacatgataaagtctcataaatgatagctattatttcgctcaatcctgataacagttttgtgagttgcaaaattttatccccattttacagaagaggaaggtaagtgacttacctaaggatatacctaaaatggtagtggagctgggatgtgaacccaagtttggcctgaatacttttccccacatgacatagcttgtcagtgagggaacagcagaccaagttggaggccatgagggacaaataattaggatctgcagagagagccagacagactgccaccctggttccctagttccatccagtggcagagacgacaaagggcactgtgatgggcagaggcagcagaaacctggatgtccgggttggagcgcttttgctacacacagggaccaatgcagcagctgctaggactcagagaccccttctgtccctccctcgaagacctcaacccccttctctcagccctcgtggtgactctgcctccggtgaccctgcaggatggagcgggatgcacagttcacacagaggaaggcagagcgggccacactgcggagccacttccgagacaaataccggctacccaaggtaagctggccccggctgtgaggcacatctgggaccctgagctctgggttctggactccttcgccccattctgggcaccacagccctcagctatgagactcacagggtatttggttagatccttccttctcattcatttgttcttttattcattcactcactcgtagttaaatctgtgcccaccaagggccagggctttgtgctgaggggaccccagtcctcatgagactgacaggtctgtatttctggagccaatctaggcctcttctctcctccaccccccatatccccaccaagcctgggccaggcctgggcagaggaagacacaggggaggcagaaatcagtagatttgactgcagaggtgagtgttctgggggtttctgaacctactgaagggcagaacttacttaaggtgggggagagaagccctgtgtgtgccaagtacttgaccttcatgtcctcatctaacccccaataatgctgccaggcagctatcacccacagcgacaaaagatgaaactgaggctaagagaaatggagggacttggctaagatcatacagccagtgagccatggagctgggaccagccctcaagccggtgaatatgagcctgcctttgctccagggccccaggctgctttccagagtatggagtctgcccgtagagagccaagtacccccttggccggccaagcagccagagagtatatctcaggagatccctgcccccacgctcccctgggcagtgcaccaccagatgggcgtgtaagtgtgctgctcctgttgtctaaggaggggaatgaagcacaaatctctcccagaatatcaccctagtgcatccagaactgtgctggactcaggggaaaacagcacagggctatagcgctcctgattttgatcttccacttgaattgaatgaccaaatatatgaacatcacattcactcattcaacaaatatttactgagtccccagctgcttctgactccccacagggcaccaatcttttggaaatctgtcacggggaaaaaccggtccagaaagcctgcctcactgcaaactcttctaggaataaaatcattcctcagatgcttgcgctaggcatataagagacacctgccatcagcaaagtcagagttgagcagaagagccaagacttggatgcaactgagtaggacataaggcgccccccagaagaatagtgaagggcaatggtcatcgtaggtgccatgcaaaaaaacacagatgttggaatcagtgacataggtttgaatctagctccccaacatcctgcctgtgtgatcttggataatttaagttacttaagttacttaagttagttaagtaacttaaatttaaagtaagttacttaaatcctgtaagcctcaatttccttatttgtgaagtggaaataacaatacctacctacctcacagggttattgtgagaattaaaagcacccagctcaacgtctgccatgtaatagatataatagatgtttgataaatggtacccatcactatttttggttacacccttaagcataacaagagtcaaaacatgacttagctgactgtaacagtgtgactcataggtattttcattttgtctttactcactgtgctggtccttcagcatctcagagtgaaataaggtaatataaaaaggtctccatgtccaggcatcaaacgcttgatcctgggatgtgggggtgggagctgagctcactggaacatggggctcaagaatctaaggggccgggcacagtggctcattcctgtattcccccggcactttgggaggccaaggtgggcatatcacttgagcccaggagtttgagaccagcgtgggcaacatagggagacctcgtctctacaaaaaaaaaaaaaaagaaaaaatagaatctaggggcctggaacccagtccaagcctcctccctgtcctctcaactctgggtcctcacagacttccactccaccccaccccctcttcccctcttcccttcagaacgagacagatgagagccagatccagatggcaggtggagacgtggagctgccccgggagctggccaagatgatcgaggaggacacagaggaggaggaggagaaggcctcagtccttgggcagctggccagccttcctggcttgaacctgggctcactcaaggacaaggcccaggccacactgggggatctcaagcaatcagctgagaagtgtcacgtcatgtgaccacttccccggggttacccactgggctgggcccccatgagggctaagagtgtgtcaacttccagggacccatactccatttggggctttgtttcccttgccccatcctagttccaagacctttcccatccatgccccaagcctatcttctggtttcttcctctccgctgggagtaaagtccccatcttcactctacccttcaggaccctccccaccagctcagcctgtggaggcctcccaagattgtaggaataggcccatccctctctggccatggccccaagttcctgcacacaggagcacccacagagagacacacacaggacacaaaacccctggcacgttcagagacagaagccacagatacatcccggcacagacagacacacacgaggccagctcccttgcgtgtccagcccctccagacaccaccactcagaaactctgagagagagcatgggcagacaccctcagcagacaggaggcctgagttccagtctccacctttattgttcttgaaagcccctgctctctctgagccttatttcatcatctgtaaaatgggaatgtcctgaatgacttctaaggctctttctggcttgaactgtcagagccaagcccacatccctccttgggcagggcagcagctgctgccacagcctccagcggctgccactgtgggctctgggagccggagcgatgctgtgtgagaggcagagtgccaaggatgaagctggcactgaacagtaagcggctccaggcctcctctgggcccagggcccagccaatttctgttctgttcctgtagaacgctctctggattccatagctggaatctcctctcttagctcagtgaaaaataaaaatcccaaatggtgtgcctaccttcccacttcttactggcttccaggagtcttggagttcatagccccccgagcctgccttaaaggggtgtcctccaccccccacctacagcttcacaggaggggagaaggcatccagtgctaggagtagaagtgtctccagctctgttctcttggggccctgggtgaaggtggggtctggggcttatgaaataggtctgggctttgaggaggatggagcagcctcattatgtggggaagatggggcctctggggcgtcactgagaccacaggtggggccggggctggaccgcagctgtcttgggtgcctgtgcctacacccctcctcaccctagagacggaagatgtgcaaaaagaaagaaggaagggcaactgcattccagccccacactgtgatgactttgagcctgtcctttccctccttgagcctgtcttgcttgtcccctgtaaaatgaacagtccccctctcccccaaatagtaataatacatgtttcaaagggtgaccatttataaagcatatgacaaaccatatcaataaatgtaactcattctttt

SEQ ID NO: 1051 - DNA, 8157 bp, Homo sapiens
gcgagcatggccgctccgcgaggtgagccattggctggggtgtcggcgagtgtgttcgtggagcgcgtcctggggacgactcccggcattatcggccaggttgagtccgctcctggcattccgcggaaagatgggtgggtgccgggcagaggtgtggccacctgcgatggggattgacctccgaggggagggggcccttctagacgtcgtgccgtgggataggtaccttctgctccctccccgccaccctgcctcagatcagcacaaggtccttactgctgcccatctgacagttgggaacatcgaggcctgcagcggaggggggtctcatccaacagcctacaaaacccttatttgactctgtccccagtgagcacccccagctcttgcctggtttcccgggacactagggtggggcctgaggagtggagtggcagctgaccctgtctgtgcccctagtattcccactttcctgtgcggtgcagcagtatgcctgggggaagatgggttccaacagcgaagtggcgcggctgttggccagcagtgatccactggcccagatcgcagaggacaagccttatgcagaggtgagccccgggctgtatttcagcccactttacccgcaggtcaggagaaagggcctgaggcaagtcataagaatcagctgggaagggtgaggcagcaaggagggaggagacccacttggctcttcaggctaatggactagatagtgttatcaaaaagaagagaggttttgtcataataggctgggatttccagcactctccttcccccaaccactcttagcacttagtgaattttaattcagccctctttgacaattaagtttttttactttgactatttttttgcatttttattaacctaaaatatttctcctgcctatttagtggagaaaaagccaaagcataggaaggctttcgcctctgcttctgaaactggaagatgtatgttaacccctgaaagaatcatttaagagtcatagtttttctgctaccttgacagtgcagatgtcattctcctctttggacagacaaagaagatacatctaaagaagggaaataactagtccaagtcttcatagatggctagaggccgagtctggacaagggcctgggtctactgcctccctgtatgtccatgatggcatgaacatttgtatccagacctgggaggcctttcccaggactcagttgccctgtggggagcacagcataacggattgggacaggccaactcagggtggcaggtttcttcccccttcccctcccaagtttcctgtctttccagttgtggatggggactcacccccgaggggatgccaagatccttgacaaccgcatctcacagaagaccctaagccagtggattgctgagaaccaggacagcttgggctcaaaggtcaaggacacctttaatggcaacctgcccttcctcttcaaagtgctctcagttgaaacacccctgtccatccaggcacaccctaacaaggtaaaggacagagtgcggtgcagaggtcagggtacagaagggcttatgctaaggccctcccgtgacttttactgccacttttaccccacccatgccaggctcctgcccaaggccaaatccaggctgacaactcccaatttagctctgcaaagccagatggtagtgacacatgcagcaactaagtctaagcaaacagctcaccggcctgtgccaggggagtttctctaagctcattccaaggggcttgttcctggtcttccctcatccaacccatgtctattcatatctgccatttactcatctgctttcaggaagagttcaacttgcaaggcagggcaggtaccctcagccccacccccatggagtctccctacacaagccggagtcccatcctaagcaactgtggatcaaaactcctttttttttttttctgagacttgagtcttgctctgtcgcccaggctggagtgcagtggcgcgatctcggctcactgcaacctcctcctcccaattcaagcaattcttctgcttcagcctcgcaaatagctgggactacaggcacgcgccaccacacccagctaatttttgtatttttagtagagatggggtttcaccatgttggccaggctggtcttgaactcctgccctcgtaatccgctcgcctcagcctcccaaagtgctgggattacaggcgtgagccaccatgcccagccaaaactccttatttctagatacacaaagtaagacccagagaagggagggatttaccaaagccacacagcttgttagtgtcagagcttggtctggtatttgggtttcctgattcacaggccaagcctcttaaagtctgccccagcttttccctgatttgccccggggttgcccctgatttgcccctgccctgggttggctgagccccaagtttctgcaacatgctttgactgggctccttgccagaggtaggtagtcactgccatcctgcaactggggagggtggacagcaggggctaggtggcactggtgtacctgctaggtaatggctgtaccctcaccatcctcctcttcccctggccaccccacaggagctggcagagaagctgcacctccaggctccgcagcactaccccgatgccaaccacaagccagagatggccattgccctcacccccttccagggcttgtgtggcttccggccagttgaggagattgtaacctttctaaagagtaagttgggcagaatgctgaaggcatgcgtactgggccagggatacctggggaaccaagatgataggaacagtggctgagaacgggtcacatgtcacaggaactgaagggcctcatgaagcagtttttggagccagtgagccaggccagtgagaccaggctcaggtgtggtagtcaagggctggtggtgagtgattggtttccactgcaaagtttacttagcattgccggctctttggttagggctgggatggaaaggtgtcctccaactccccacttgtgtgggttccatcttaccattcctgatatgggccctgggccttgccttcctgtagaggtgcctgagtttcagttcctgattggagatgaggcagcaacacacctgaagcagaccatgagccatgactcccaggctgtggcctcctctctgcagagctgtttctcccacctgatgaagagtgagaagaaggtggtggtggaacagctcaacctgttggtgaagcggatctcccagcaaggtggacacagttatattcctggttgggtgcaatgctctggcctgggcttcccagcagacaccagactctggggacagttctcaacccccttgcccaagtggaacactaaaaggggccccacttagatgacctgttggcaacttagcattgcttgcctagtctttgtggagcagggcccttcttagttgagtgctgcttcccaactggtcatcttctccagatggttggaggcagactggcatagaggactcttaggatgccttccacctaggcattctgagattttccctagccctgcagctgccctccatggatggacttgtatctcggggctaaagaggcaggaaggggacacgagcatcctccctctcctggaaaggactgatgcctccagcactcagtcatttgatctttcctttaccttctgtgtgcccaaccttgtgctaagaagagttcaggaaatgactgtgatgggtgtggtcactgtcaccctaaaggtggggagtcaacacaagcagtaagaaacccaaaacagaacagactcccagcaatgagcttatgtggtgcaggcgatgaggtctcagcttcttagcctggcagccacaaccccttctctaggtggcccagagctctctttttattttacctctacaggtttcccattacctttgagccttagggcattatttatttgacccaagcatatttttttctgttcagtgtgtgtgtgtgtgtgtgtgtgtgtgtgtgtgtgtgtgtgtgtgtgtgtgtgtgtgtgtgtgtgtgtggtctctttctgttgccccaggctggagtgcagtggtgcgatcttggctcactgcagcctctgcctcccgggttcaagcaattctcctgcttcagcctcctgagtagctgggattacaggcatgtgccaccacatctggttaagtttttatattttagtagagacggagtttcaccatgttgcctaggcgggtctcgaactcctgagctcaggcaattcacctgcctcagcctcccaaagtgctaggattacaggtgtgagccaccacgccaggccccttgcctcactttaaagaagcctggctgggcacggtggctcacacctgtaatcctaacactttgggaggttgaggcggccgtatcacttgaggtcaggaattcaagaccagcctggccaacatggtggaaccccatctctactaaagatacaaaaattagccaggcgaggcagaggttgtggtgagcctagatcatgccactgcacttcagccggggcaatagagtgagactctgtctcaaaaaaaaaaaaaaaatgctgggcatggtggtgtgtgcctgtaatcccagctactcaggaggctgaggcgcaagaatcacttgaacccaggaggtggaggttgcagtgagtctagattgcaccactgcacttcagcctgggagacagagcaagactccgattcggaaaaaaaaaaaagaaaaagaaaaagaaaaaaaatttaaaaattaaagaagtccacccttgccactctacccaggctgagctcattttcccttgtcgtttccaggacacattttggccctcagcgcattctgcctcatgctctctggagcagaccgagagagattctctgagacatagaactttcttttttttttttgagacggagtctcgctgtgtcacccaggctggagtgcagtggtgcaatctcgatcactgcaacctccgcctcccgggttcaagcgattctcctgtctcagcctcccgagtagctgggattacaggcacgtgccaccacacctggctttttttttttttttttttgtatttttagtagagatggggtttcaccatgttggtcaaactggtctcgaactcctgacctcgtgatccgcctgccttggcctcccaaagtcctgagatgacaggtgtgagccaccgcgcccagctgagacacagaactttcagtgctaaaaactagaaagtcgccgggtgcggtggctcacacctgtattcccagcactttgggaggcctaggtgggaggatcccttgagttcaggagttcgagaccagcctgggcaatatagcgaccccctctctctgcaaataataaaaaacttagccgggcatggtggcatgcacgtgtggttctcgctactcaggaggctgaggtaggaggattgcttggtcctggacagttgaggctgcagtgaggtatgatcgtgccactgcactccagcctgggtgacagcgagaccccgtctcaaaaaaaaaaaagggaaagctcgggcatgttggttacccttcatgaaactcttttgcgttatctccctagattttgagctccaagggcagtggttctcatacaggggacatttggctgttgtctggagccattttttgattgtcaaaacccagataggggttgctagtggcatcttgtgggtggaggccagggaagctgctacacatccatcagtacacaggacagcccccacaataaagaattacctagcccaaatgtcagtagcgccaaggctgagaaatcccatcctgaaaggaccatactctagctcttttagtggctagtatagtcctgggcatatgaatagtcaagatatgatgaaagatggtatttgtatggactggagtatcaagcaaggctcgacccccaaagggctggaggcgtggccagaaggacagggccactttggcttctggattcctgtggcagggaccttttcctaggactccctggccaatgtggggctatgaacagcactgagtatccccctaagtgaccttggggtgctctgtgaccctcagcggctgccggaaacaacatggaggacatctttggggagcttttgctacagctgcaccagcagtacccaggtgatatcggctgctttgccatctacttcctgaacctgcttaccctgaagcctggggaggccatgtttctggaggccaacgtaccccatgcctacctgaaaggaggtgagccacatttcagcagtgagccccactgccatccctgctgggccctgtttccctatctggacaaaggaaggagaagggtggtcaaggagacccccaaggaccttgcagctctgacctctgagggttcctgggctcagcaagcaacagctggtagggatgatgaatgcatttagcattgaacacgccttgaatcctgacaccaaccctgtgatgccatgctactctgattttaagtcctgccagtcagtgtgggaaccacaatttgaacgcaggctatattggatcaaagctgttgttctgtcacagcctttgtatgtctgtcctacctaccagggatttttacactaaaatatgcatgttgccatggaaggatgccacctttcgactgttggctgcttatccacacatgcctcatgcacaggattctggggtagaagtgggagactacagagttggggctccccaacccccaggggttaacatgactcccctctgacaataatgggtgacctgtcacctgtttttggtatttgatatcttaaccccattctcccagagaatacaattcatggaaatttttacctaacttggcatggggttcatggagctcaggttaggaggcccagaactggagagctaaggcatacttcatcagcttagcacatgacgactgtctctccagactgcgtggagtgcatggcgtgttcagacaacacagttcgtgctggcctgacacccaagttcattgatgtgccaaccctgtgtgaaatgctcagctatacccctagctccagcaaggacaggctctttctcccaacacggagtcaggaagacccctacctctcaatctatgacccccctgtaccagacttcaccattatgaagacggaggtgagtgaggggctatgatgggtgtccttcgtgtgccatgaaaatctctggcaagggtcacgatgtggaggacacctggggctgggtttcctgtcaagcccacttggcggagggtggccccagggcctgcccattccttcctgtaccagggaccaggcctctatgctgactgagcctgggttgtgcgagaaggtggcagagctctccctcgtgccctggggactgtcctgggcccatgagctgatgagagcagagtctgagctgcactgccttatcatttcttcctgcccaggtccctggctctgtcactgaatacaaggtcttggcactggactctgccagcatcctcctgatggtacaggggacagtaatagccagcacacccacaacccagacaccaatccctctgcaacgtggtggcgtgctcttcattggggccaatgagagtgtctcactgaagcttactgagccgaaggacctgctgatattccgtgcctgctgtctgctgtaaaggctgcagcctccccagctctcctctgccagccaccctaaattccagccaacctcacctcctcgggcccagctcaagcccccttccttgctctggaccccttaggtataccctggaagagctggggtgggggaggagggagcgtgaaggtagtgactcctgaacacacccaggtggaaccatctttggggaggagaggcccgtgtgaggggtctgatactccctttgtcttccctctctactcctcgctacacctgagccaggctcttgccaactctgttccagcctatggctttaggctagctgttaaatatgtgacccagcattagctcagcatctgtcagagcaagagaccaggtaatttctaagaacagggttctagcgatgggactgcccatttcctcagctgcagaggaggaaagggaaagggtaggcctgtagactaacgctgtttacacccttgttctgtcaaagcaattaaagatcacttgtgt

SEQ ID NO: 1052 - DNA, 12907 bp, Homo sapiens
acgatgccggcggtcagtggtccaggtcccttattctgccttctcctcctgctcctggacccccacagccctgagacggggtgtcctcctctacgcaggtttgagtacaagctcagcttcaaaggcccaaggctggcattgcctggggctggaatacccttctggagccatcatggaggtgaggggcaggggtggggaccagctatgcccagggtccctcaaagtgctggaggggctgtgacttggtggggagtgggtctgtcacagccatcctctgtccagggtggggcaaggcctgggacagtgccaggcaccccaggaccccttccaggcttgtctcctgctccaccgcctcaacaccccccacccctgcccaagctgtttctcctctgcctctctgcttccctgccccaggacttctctcttctcctctgcctctccttggacccctgcccttcctctacctctgacctgtgaacacacagacacatgctcacacactaagtcccaggcacacagaaggcaatgtggaccagcacaaacctccactctcccggctccatcccagcgggcctgtggctggccatgagaactgggggctacctggagggaagcatcctcatcccaggtgagtgggcaccagcccttccctgtatgtgtgttgtgggtggaagcaggcatgagagcatcttagcccataggtttgtattcagggacttccaaacccagacctacaaagagtgtgtcttctaccagatcttgttcaaaaaagggtttgtgatgatggaactacacgatagagggagtgagcaagaacaatgaggattagagtggagcgtgaaatagtctaggagcatggcttccaaaacatatgctgtgaggtctgtccacctgagagttgggccatggatttaattctgagcctcttagcaggcaaagcaaagacagaaagcagatcggctgtggatttctgtctataaaatgtgagttcttggccaggtgcagtggctcacgcctgtaatcccagcactttgggaggccaaggcggatgaatcacgaggtcaagaggttgaaaaccatcctggccaaaatggtgaaaccctgactctactaaaaatacaaaaattagctgggtgtggtggcgtgcgcctgtagtcccagctcctcaggaggctgaggcaggagaattgcttgaacctgggaggccaaggttgcagtgagctgagatcctgccattgcacttcagcctgggcacagagccagactctggctcaaaaaaaaaaaaaaaaaagatgtgagttctgagaaatggcacgattcctaactaaagccaggacaaaatatcccttttttttttgtgagatggagtttcactcttgttgcccaggctggagtgcagtggtgtgatcttggctcactgcaaccttcacctcccagattcaagtgattctcctgcctcagcctcctgagtagctgggattacaggtgtgtgccaccacacgcagctaatttttgtttttgtttttgtttttttttttttgagacggagtctcgttctgttgcccaggctggagtgcagtggcgtgatctcggctcactgcaagctccacctcctgggttcatgccattctcctgcctcagtctcccgagtagctgggactacaggtgcctgccaccacccccagctaattttttgtacttttagtagagatggggtttcaccttgttagccaggatggtttcgatctcctgacctcgtgatccgcccgccttggcctcccaaagtgctgggattacaggcgagccaccgcgcccagcctaatttttgtattttttaagtagagacgggttgtcaccatgttggccaggctggtcttgaactactgacctcagatgatccgcctgcctcggcttcccaaagtgctgggattataggcatgagccaccgcgcccagcccaaaatattcctttaagatgataggccctgtcagtagggtttcttccagtcctccttcatagagacacaggaggtaacaaaaaggtgggctgtttctcacagcaccaagctgggccctgcttcaggaccaggatggcaaaacttatacaacactcactgctatgggccttgccaaatctgggtgtcacagatcatgtgagggagcagaggcaccttctccaagatcacccagtgatgtgtgcattgtctgttcattcattcgttcaccctgatgttcctctgtgcccagcccagagataccaggcagagtgaggctgaaggagcccatggtctggggcaaggtctcacccacaggccttgtaaggctgaaagccttctgcaaggatttcagaggcagtgacagcttccagaggccctgggacttgtggccttgcagctctgagcctccctacccccatccctggcctttatagagcaaacaggctggattagctgcctccagaacgtcctggcagagtctgggccctgggccaggttccaggctggcaggttggagggtggggagcgagctcgagtagggcctctgagttccctgcccccagttcctgccaagactgcctcagtttctctcccattcctttttcctaccatgcagggctccttcctccccgccccaccaccgccagtggcaattctcacacacatactccatcctgcattctttcatcgcagtcctgtgggccggttctcaccttcacatctttgctttcctgctttcctcaccttggaatgccccctaggtcctgtccaccaggaagctctggcctcatttggccacagcctagagtcttgggccttcttgcagttactccctcctaaagtgctctcctgtgttctgtggtctcaggcacttccttttttgtcacaaggcctcagtttcgtcatctgagaaatgggaagggttagacacaaatctctctcgtggtggaaaaagcttgtgctttggagtcatatggagctgaattccatccaatccacttagttccttaacttttatgagcctcaccttcctcatctgttagatggggtcttataaaaacagacagcacacactgcggtgaggcttcactgacgacgtggatggtgctggcattcattgccctccccagcaaaggcccctccagctgtgctgggctctgactcctgcttccctggctggccgcttatttaatggtaggccttggcattgtcgccttctcttccgggagcccagcccgggccaagtgagagagtgaagggggagatggggtgtagtggagcctggggcttgagctgcccttgtccacagacgccatcctgggcctggaggaagtgcggctgacgccatccatgaggaaccggagtggcgccgtgtggagcagggcctctgtccccttctctgcctgggaagtagaggtgcagatgagggtgacgggactggggcgccggggagcccagggcatggtgagtgtcctctcccagagctgacagagcggggtgggtcagggaggcgggtgatgagccccggggtcccagtatcccacacggttccctgagctgaggggctggggacctgcaggccgtgtggtacacccggggcaggggccatgtaggctctgtccttggggggctggcttcgtgggacggcatcgggatcttctttgactctccggcagaggatactcaggtgcgtagtggtctcctgcctgccagcccgcctgcccgctcacaccctccccctcccgccatgtccgcggctcaggctgcttctcacctccctgcaggacagtcctgccatccgtgtgctggccagcgacgggcacatcccctctgagcagcctgggtaagggcctgtctggactgaccactcacctccatttttgcactgggaggggcccatcccccccatccgagcccctgccccagcctcctccagcagggggcccaccctgccgggccgccatacttgctggactctctcacttagccgacgtccgcccccctggggcttgattccttcgacccagcagccccaggtgaaatgacacaggctggggcctgtgatgagtatctttgctcccatgatctcatcccatctccaacaccctccataagtggggggttattcgtcccatttacaggtcaggacattgagcccagagaggggaagggatgtgccgtgcgcagtgctgaactttgagcccagacttacccctggagggtcctcgcccttccctgcatagctgtcccttccctttcccctgatgatttggcttctgtccctccccggccctactgcctcctcagtagctgggccggtttgtcagtgtctctcagcaaccttctctcggctcataacaattagagtaattgcctgcatttatggagtgagctgattgtatgccaggcacagcaccaagcccttctcatttactgtcttagttaaccctcataacattgttatgaggtcgttccaattaccatcctcgttttagagatgggaacactggggtttggagagatgagatggcttgcccaaggtcacatagctcggggcacaaacccaggtggctgctgtggtgctggcttctcccctgccctgtgctgcctccctcttggcggaaggcggcactgtcagacgctctgctgtgagtagcctgaggtgtccagagacactcagcgtttaacactcttctcctgactccccagagcctgccgagccgacctgtcagggaggcagcctggtcacattgtccttggctgccgggacatgtccaggtcatccgtcctgagtcagctgcattctgagccctggcagctgggagaggaaaaggaagccagaggcacagaggacttggagtttaaaagaaggaggagggagaggccaggcacagtggctcacgcctgtaatcccagcattttgggaggctgaggcgggctaatcacctgaggtcaggagtttgagaccagcctggccaacatggtgaaaccctgtctctactaaaaattaaaaaaattagccgggtgtggtggcgagcacctgtaatcccagctactcgggaggctgaggcaggagaaccgcttgaacccaggaggcaaaggttgcagtgagccgagatcgcgccactgcactccagccagggcaacagagcaagactccgtctcagaaaaaaaaaaaaaaagagagagagaagaaggagggacgtaagggtgataggacgagggtgataggtgggtcgggggaatggagggcagaaactgtattgttggtccaggcctttgtccccttaaggaagggccacagggaggcccctggccccttctgtaaatccaagtcccaacactccgtcaggcagggcttgcttcccctgctcctctctcttctgccaagggagcagggtacaacaagggagactcaagctagacaaggtacatgtcccatgccagctcgcccagcggaaagggaggtggcacagcaaatctgggcagagtggcttctgggactgccctcactgtccaggccttgagtcctgtatatcctggctggattccaactgcccacaagagtcaggcatggtggctcacacctgtaatcccagcactttggcagccaagacaggtggatcacttgaggtcaggagtttgagaccagcctgaccaacaatgtgaaaccccatctctgctaaaaatacaaaaattagccgggcatggtggtgcatgcctgtagtctcagctacttgggaggctgaggtgggaggatcacttgagcccagcaggcagaagttgcaatgagccacaactgcaccactgcactccagcctgggcagcgactctttctcaaaaacaaacaaatgaacaaactgcccacagggatggagctagccaagggctgggctcctgtcattgggacttccggaaccggccacaccccttcagagcacggatcacctactgggggcagaggctgcgcgtgagtcacccttcctgcttctgacagggctctgagttacagagctgctatgtgtgcgtgcccacggccccaacacaccagtgcctgtgacaccacgtgaggtccctggcacacacgggccaacatccacaggggatcctccatccctacacagaatcctaacactcacccagagcacatacatgtaagggctcacatgagaccaggagtgcgggtcacctccatgccattctgataccaagccctagggccacctgccatcccacggccaggggagccagggagtcagaggtagggacacccccccactgctcactctctccatgtccctcagatgtccttgaacagtggcctcactcccagtgatccaggtgagttctgtgtggatgtggggcccctgcttttggtccctggaggtttctttggggtctcagcagccaccggcaccctggcaggtgaggatcccactggacaggtaagagcagaagggcagtgatgaataaatcaccctcagcacaccttctaaagagcactggggtggcgtcagccacttcaccacatgacctgggcttctgtgacccttgggagaagtcatgtctgccttgagacttgcaagtctcaaatgggataaaacaagagaagctttgatttcagtgctggccacataagtgcccctagctgtgagttgcgggacaagtggaagacagacagcaaagaggggcatttaggaaaatggagcaaagaaatgtgacaccatggagagtccacggagggtcccacagcgggaaagctgagggcaaccagagcgtgggagtccttgaatgccaggaccttggtctggtttctgaggaggagagtgacatggtcagagctatgctggaaaggtggccactgtgcagttgctactaccagtagcagctgtgctctgggggcctaagagtgtcagatggtctgctgccatggctctagcccaggatgttttgggatcgtccagttctgccacaggggcctgcctctgactgagtgtgaggttcaaccctcaccacccacccgtctacctgtcaaccctcacacctttcctaggaagtaagcaagacaagcatcagacggtggcccaaagtcacccctcttgcctcggtgggatatcatggcggttagggtgaaggctgagcgagggggttgctgggtggaggggtcttacttctccttcatctgtccccttccagatgatcatgatgtcctgtccttcctgaccttcagcctgagtgagcccagcccagaggtgatgccagccctggcctacctgggaatggcagcccagggaccctgccctcacccatgtcatggtgccctcagacctgccattccagcccttacctccacctggcctctgagctctgctcaggccagaccttgtgcagggcagtgctgcgggccagggccggtgtgtgaggtctcgcaggctggctggctcaggctgtgacattacagttcagagcgatcagtgccaggtctcaaaaggtgcagggggctgtgggagcacagaggaggagtcccaaccagccagggggtcaaggaaggctgcctggaggagatgagcttaaaggagcctcggaccagcacatataggcttgaggccacagcagggagggaagatggtggggatctgcgtgaaggcagaactcagagggctggaaactgcagggccagctggccagggaggaaggctgggctcgtggggaagcctgtgggaaggctccccttgcttctggatctcccatgggtttggggcccgactttctgtcttcctcccctaggttccccctcagcccttcctggagatgcagcagctccgcctggcgaggcagctggaagggctgtgggcaaggctgggcttgggcaccagggaggatgtaactccaaaatcagactctgaagctcaaggagaaggtagggaccgagagagcgggcaggtggcgcccatctgagtgtcacagcatcctccacccttatgaccaggggtcctttaatcagtagggaaactgaggcctgaggaggccacatctaagcaggccctgggcccaagtgttctgtgctatccccaccttaccactcagactcatcttccaggagagggtcttggaggcagcagccacaccttctggcacccctctccaagaagccaccccaaagataagataggctgtgttaccccaccatggctggctgcccatcccagctctgccctaatccccaggggaaaggctctttgacctggaggagacgctgggcagacaccgccggatcctgcaggctctgcggggtctctccaagcagctggcccaggctgagagacaatggaagaagcagctggggcccccaggccaagccaggcctgacggaggctgggtgagaagccctacaggcatccaaggctccacctgcgggcctgaaagaggagcaagcactgtagtcagcaactagtctcccctaaggcctggagggaaaggaaggcagggatgaaatgctgcaggtcacaggatggggcagggcagcatgcaggatggcatctctgcacaagcaaatgcgcacggggctggggctgaggctggggctggggagaggagatgccagctatttggactcagctctgtagatgaatgacagaaatagactaggtgctaatttgcatgtagcttcacatgcgatttgcatagggcttgcttaatgctcagttgcaccagaagcctcattgcatctccattgccatctggctcctcccccagggagtcataactcgggtcatgcccagcctgggggcctgagagctaaactcagccaaggtgttagatactgggcagaggaggccagcagctcttgtgggctttgctgggctctgacagctcgaggttttaatcttgtgtcagagcagcttaggctgggctgctagtgtggggaagaggggaggggacttacactccagggccaagcctctctgatcctatccccaggccctggatgcttcctgccagattccatccaccccagggaggggtggccacctctccatgtcactcaataaggtagggacccaaacactgggtgttgaccagcactggccccagcttggctggtgctctgggagaaccagggcagagaggactgggctgggcctctgcttccttcaggggacagaaccacttttagaagggagacgtattttggcttggcatggtggctcacgcgtgtaatcctagcactttgggaggccaaggcggacagatcacgaggtcaaaagactgacaccatcgggcagatcacaaggtcaaaagatcgagaccatcctggccaacatggtgaaaccctgtctctactgaaaatacaaaaattatacaaaaattagctgggcgtggtggcatgcatctgtagtcccagctacttgggaggctgaggcagaagaatcgcttgaacccaggaggcagaggtagcagtgagctgagattgtgccactgcactccagcctggccgcagagcaagactccatctcaaataaataaataagaagggagaagtattttgagaaaaccctgaagtggccactgttgggaggaaacaaccacccctggggagaggggcgtgagtggagggggaatgtggatgcccttatggatgaggtcagagaaacacagtgtgtccaaataaggaggccctggtaatctgggaaggcctctggaaggaagaggctgcagtgccgctgggaaggtgggctctgagaagagaggggctatgtcctgggccctagacaagaggctgcccctctgcaggactctgccaaggtcggtgccctgctccatggacagtggactctgctccaggccctgcaagagatgaggtaagggactgggtggggacccctccaccaccttgtttctccgccttaagttcctccattagcccttcattccttccatcatttcctgagcgcccagcacacagcctgtcaattggaagggctactggtggagttaggtttgttgagttgacttgaatttaattgaatcaagtttaatgttttgcaagtcctagttaaaaagcaattctctcctggagaagcccatcatgaaggccccctcagacactcccaccctcaggaggcttaagaaatctgagcattccttcaatggcagctcctaggatgaggggcattttgttgggggctcttggagagggagcacagccaagatcagaccagttggatgagacagtccctgacttggttttgtgcccccattaacttcccggtatcccactctaggccaggcctctggagccctgggggttgggggagtcctggggatgctgtggaggaggcatgcatcccaggctgaagcctaaagccccacctgtacacacacagctagatgcctagggttgggggtggagaggcacctagatgagaagaaggaaaggagttaaatccccaggggctgggaatggaaggcagagccggggagcctggggttgacacagatagctttagggagatctttatctgagctaaagtctcaggatctaggaagaaggttggaggtgaaaagaccagcccccaagaaggggccccatggatggtacctgttccccatccatgtgctgcccttggggagatgggaaatgattaggccatctgggtggaagcagaagaggtaatgagtcatcttacttggttaccacccccggttagggatgcagctgtccgcatggctgcagaagcccaggtctcctacctgcctgtgggcattgagcatcatttcttagagctggaccacatcctgggcctcctgcaggaggagcttcggggcccggcggtgaggggaaagtagtgggcagcatggggtccccaaccttgacgtctgggctcagccacccttcttccagcacttcagcagccccaagccctcctgcctttgccctcccctcccaggactgctggcaagcacatctgtgcctgcgtcagtgtctgtgtgtccgtgcatacgtgccaccacacatctcatcttttctctgtcctctctcctctctgaagagtcccacagactcagcagcagcagggccctggacacccctcgatccaatatccaatgaccagaggggaaacagggtgggctgtgtccaagatcactgagtccagtggtagtcagcgcttccccatgccctgtcccatcctcgttccctcgccctcaccctgctcaccctgtctttggctctttacttctctcttctcttctcttgaaccctgggccccttgatgatcccaggccccaggccttcccagctgttcccacagatgcagccatgggagctggggtgggggaggcagctttgtacactgccccctctccaagttccctggatgagagccaggacgccccaagcctggggaaaggaaacggagcatgcacatggcctagattccaggtcccccactccttctgggtaagaagctaagctaggaccttagactttcccctttcagaaggcagcagccaaggccccccgcccacctggccagcccccaagggcctcctcgtgcctgcagcctggcatcttcctgttctacctcctcattcagactgtaggcttcttcggctacgtgcacttcaggtgggccaccccgtgagcaggatttcccacagcactggcatctcttggttctcagctataaccattggatttaggagaggggacacttcagctcagaggggacctgccgagtccccaaatcacaaagagcacagtgcgggatagggcccattctctcaccaagcactactgaccacctgctcggcccccagccccatctgggtcctgctctcacggagctcactcacacaggtctaactgaccctgtgtcgtcaatgccatgatgtcaggaagctgaggggctacgagagtgcaggagaacacacttgaccccccttggttagggaatcaacctggaagggacatttgatatggtcattaaggtgactaggagttttccaccctgacaagataggtaaaggcatagaggcagagggaacagcatgagaaaaggcagggaggcatgagaaaaacataatattttagagaaaaagtggcaagttcagtaatgttggagcaaagggcaggacgagtttgtgaaattgggcaaagagatctgaaaaagtgagaggaggtcactagttttgcttggtgtgtgtttgctgaatgaacgtgcaccgtttagagatgtggggtgtgctaaaggcctcagcaatgagactgacaatctttgttggtggaatttcaagacaagaagagtccgtgtgggctgggatggtcctggaggaggagtaaaatgagctaagctttaaaaagcacaaggtagaaatgctcacaggcttcagcacatgcacaggagtgcagtggtggcaatcagcctggagccactaggacagaccttacatgcccagggggaaagcgtggaccatatgcagcgggccaaaggagccacagaaagtccaagaacagcggaggttgtggtgcagtgagtgtagcaaggcaagcatgagagtcctggtttttcaaaagcccataaaggagagacgcaagtaacctgtaaccttctctctggcagcaggcaggagctgaacaagagccttcaggagtgtctgtccacaggcagccttcctctgggtcctgcaccacacacccccagggccctggggattctgaggaggcagcctctccctgccagcatgcctgcctgacccacctcagagcctgctttgcatcactgggaagcaggcagtgtcttgggtgggggcttggtcagtatcctctccgtctgggtgcccagctcccacgcacacctgagctttcggcatgctcccacctcgttaaaggtgatttccctctcccca

SEQ ID NO: 1053 - DNA, 7095 bp, Homo sapiens
atagagaaaataatttaatagagaaacaatgaatgatactctttacactcagcctcctgcagggaggacagacagctcttgcccaaggaagcatttaagggcagaagggctacaaatcaccaacacccgctgattatttaaaagaaactctcaaatacattcttttccaggttaaattcactttgtcctcataagtgcccatgctgtgggctgtgaaggtatcagccccattgaagagatggggagacccaggcccagaaaggggaaagagcttgcccagggctccacggcggcagggcaggcctagaagtgggtggcctagagggcactgggtcagactgtctccaagcctccctctccctgtcccaggctcaaactccagcacaaggcccgcgctgtggctagtgtggggcccagagggaacggaggtgggagagatgaggaccaaggaaccctcctgagtgctccctaggccagggcaggaacaaggcttgggcttcttaaaccccaaaagatccagctttcatgcttgagggattaacctaaagtaccaagatggcgggcaggtgtgagttcccagaaagactggtgggttctgtggggctgagtgcatactgtggggagggtggtccctgaggggtgttggagtgccccattccagtgcaaagaggagctgagttggaataaggggtcccgggaagggcaggccaggggcacagctgcctgctggcagggcgagggcaagcacagaagtaccctgcgggggccccttgccctcttctcggagccaaaaatgatagagggctgcatgccccaaaacggacaggcacaggacccagtaaccaccgagtaacaaaggtctcatgaaagaagtgctgttctcccagagtcctgccctcccctccagtatacagcacagccatcaaaccatctgtggggtgcagagtaacctgagggaggctggggactctgggatatgggggtctcagcactgtccatccaagaagcctgctcgccagggctgcagtgggccacttcattcttggcgtcagcctgggttagtgcccctctgctccagatggctcacatctgtccaatcattcttctagggtcactgaagggtgcaagctacgggggtgagggggacaatgggggagggtcagtctcaggtctttggtaagggaggcagaacccagggcccccagccctcacccctccttggatggaggatcgaccccagggcaggactcacagctacgaacagattccgacagtccctctttgtccagggtgtcagcttcccagcgagattccctcatctgtgggatgtgaaggcagcacaagggatgagaggcagacacacgagccacagcgcagtgccgagcaagtgagagagtgaaggacggggacacgagccacagcgcagtgccgagcaagtgagagagtgaaggacggggacacgagccacagcgcagtgccgagcaagagagagagtgaagggcagatacagggacagggaggcctgcagaggaggcgagagagcagacatacaccagcagggggggacgacagccacaagcagagagcaacagaacccacagaccctagccccagcgtggcccccatgtgcccaccttgacctgctccttcaagtattcagctcgggccatgaggttctgaacctgccaaggaaagatatgcccttgggtgtgggggagagtggcggggggtggggtttcaaagggaactcctcctcacccctgatgctctccagaaccctctgccccatcagaacaacttgcctcctgagtcccttatctgctccttcctccaggaagccttcccagactttttgctgctgggttcccagatcccccactgccctgtctgagcaccccagccctatggtttgacttccagacttggaacaccctgacagtgggacattccagagggaacccaaagaggtccccacaggtaagagcagagaaaggggaagaggaagccccccaaccctctcaagctcagtgggcacctcagtgtgaagcagctcccgcctccggcccgggggctccgctgtaaagagagggtgtgtggtgaggacagggtggccagaggccctgtggggggcataaatgggggccctcacctgccagcaacagcagtagctcccccaggctgtgctggtacaggtccagggcatcctgctccccgccggcggcctcctcctgcagccacaaggacaccaggctgcttagggtcatggcctgggtatctccctgccctgccccgacccacctggacccctcccactggcacaaaccttggccatggcagctgaagccacttccagggcagctaggaggcgtggcttgtcccgggccatctctgagatgaggggaaaggctcagggtgagggaagcaacctgcctgttcgctgcaggatgcctctccccacccgcctccccctcaggctgtggggaggtttgctgggggccctggggtcagccagaaaccggagtctacctctgagcaggtctcgggcagaggtcccctgcctcagcagggcctgattggaagaggagacgatggccttgagctcctcagcccgggacacgtactgccccacctgtagcagggaaagggcctgaggaggggctgtctcaccagctacccttgccagaacccacctccaagttctccctttgcattgttagtgactgcctcaagctataaacatgtcagggggcaaatgtggctggcctgacccattcccagctctgtgttgcaggagaggaagttccaattctaagagagccattccccagaggcccccgagatctccgggccttaccccctgcccccccacttcctcatggggactctcacccacctttgccttaattgcctccttccgctgggcatccacttcatctgcagaaagtgaggtcatatgaggagtctgggcgaacccctccctgccccacaacgaaccctctggaatccctcaaaacacaatattccaggtttacgctctgctttatcgcctacaaaattctagatagagaacttctggaatccacctactgcagccacagatgactcccatccctgctgcacccacgggcttcaggcatggcctgggactcacagtgcagggcaggtacaaagaagtccagagccttgcagtagagtgataaggcagctgctgaatccccctcctggtctttcttcacagcctgcaccaccagggcggtctggggatgggcagatcaggggtcaggtccacctccctaccctcccacactcaccaagatgggagatcagctcccctgagcccgccctctgtctctgttgggtgagtcaccaattcaccaccaacgggggcaaggagacctccagcccaccctcagcccaccccagccccagccgtctgctcactgctcgccccagactctccccactgggcatgtgctccaggtccacccaggggtgcgcaaaaaagtcctggaaggagatgcgacggctggggtcccgctccaggagccgctgcagtaggtcccggcagtctcgggagagcaggggccgcaaggggagctgcagggaagggaacggcagggacagatcacactgggctcctccacccctacccctagcccaggggtctgcgaggaaccccagaggtacgcgttggacaggtggggaatctgagaccgaggaggaacaggatgggtcaggatgatggagccagcggggagcgaggcctccatccctgggctcccggtgcaccctcgctggagccctgagctgagctagaatcgtgtttctgggtccttatttccctccctggactatgctcctaggaaggctgggcctggctctgctttgcattctccccacaagggcctgcaaaatgggcactgtgctgccagctgtgggctgacctgaggccctgggacagcctggcacctcgacttccagcctagaacctgcccctccaccacaaaggcagcctggagcccatactccagtctctgcaggtcagaacgaggtctaaaccctcagggccctgactccctctgccccccagtggtcgctaaggccctgctagacacacctcgatgacccggttgctacggatcttctcttccagctccgagaacgacctggaggcaaaggggggctgcccgaagagggcttctgtggaagggaggcagagcggaggctgggagggaatgggtcaagcctggcctgacgcccctcagcaggggccctgggccagcagtcagttttcatcagaacccttcagaagtggcccagagaggccttgcctgaggaaactgtaggcctcagggtgagaagcagggaaaagaggtctcaccatacaggatgacccccatggaccagaggtccacgcgggcgtcatactgccgctggcacaccatctcgggggccatgtagaggggggagccacggagcacgtgcttctcatcccacggggacatgtgttgtgcgaaaccaaagtctgcaggcaagaggagaggcagcagggcttgaattccagctgcttcagctcctgacttgtaaagcctcaccccaggctcctctccaccctccagacccgccaggatcaaccctatttccaagcctctgctcatcattaggctggaacaccctcctatatctgcctctggggtataaaacctacccatccttcccagctcccttgggcaccttttcctaggaagcccacctgatcacaccagctacctgcataagcccccaccctctcactgtccccccaggcttaggttctatcacagtctctggcctccagtgtcaattatccaaatcttatcaagggtcaccacctcctactcccccaccacacccctcctatgtggccacagatggagtcacagacttgagccccaattctgatgacagaccaagtcctgtccctgcccacagagggatccctgatgcttgtcacacgctgaaccctggcactgttcccagattgacccctaaacctggacacacagtgagtcccaactctggccacagactgagccctaactccacccattatgctgctggacttgagcatgggtagcctgagaaagcttccaccttttgatgacagggcccaaccccagacttcacggcctgtcactctttgaggactctatagagggctccataagaaccagggctgctgagtgagcccaggcagagggaggcctctgcactctccaaacctcatccctgctgtttcagacacagacctgccagttttaggtggggcttctccaaggagctcagtagaatgttctgtggcttcagatccaggtgagagatattccgttcatgcaggaattgcagggcgctagctgaggagcaggacccacgaagagagacagttcagagcccattcccgcctgcctctcgcctccccggctcacatctgcctcctcaagcctgcacaaccccagttcctgcctggctggtctaatgttttccatataagcaccaagatcacaccacttctaggagtttgccaccccacccgagtgcccaccctccttccctctgccccttcacaagtctccccacctctcagaagcttctctggatgccccagcccttgagatcctgctcttttccttggcacagcacttgagtcctacctacaggactctggaatgttctacaaggtccttatattatgttctatgtatggaagcctgaacaccccacagaggggttaccccctcatctctcccacagcgtccttgagcaagggttgagtgtatgagataaacaggaccataaaatttcaggctgtgcaggaggcagctgcaatgcgtgccaaggctctaagcctgggggaggggtgggatggtggggggcagagaacaagggacagagtgtcaggctggtgtcacaggcctttacctaattgctgcatgaagacacgcgccaccttctcaggcagaatcctgcgggtatggatgaagcgagacaggtcgccccctgcgcaaaactccatgatgaggtagatattgtcactgtcccactgtgtttagaggcagagaggcggcctgaagagagtgtcccttctccagctccctttggcagcggccccgccccaggctcacacctgaaagtctttcagctgcacaatgtggggatgtcgaatgcccttgaggatctcaatctccgtgaggaggttctccaccgatgccttgttcagacttttcttggctacacactttatggctaccacttcacgagtgtccttctgcgagacaggagatttggggactctgccttgagggggccaggacccttgtctgactggaaaggctctatctggttccctctgttcccccaccccgcccctccccgggtctacctactgcacaccagcaccgggcttcccagctttcccttgtgaggccagtgaggaatgctgattctggaatcctggcttcccgacacagcctcagcctggtcttctccaaccctcggctagctgatccatttctttgcattctggagtgctcccggcagaggcatgtcactcagggttctagaaccgcccactctgcctcccaactggctccagtcccagactcctcccagcccaccaggtaacctgttttgagcctgttcttcagccactgaccctgcaggtgggtgcaggtgcgctctttaagacctaagcgtggcagtcggctccaacctccgccgagggtcagctggggcgaggccggcctcccgcccctaactattcccacactgtcgctaacctctcagagtctccccggccggcaccagccgagctagctcgggcgggcacggggccatcggccggcacccaccttggcgtaggccttgtacaccgtggcgtacgtgccgctgcccaggcgctcggtgaggatgaagccgtccaggcgcgggggaccccagccgggccccgccattccggccgcctgcgcccgcgcgggcgcttcctcgctgcgggcggcggttccggcgggttgcggggcgggccgagcactgggtggctccacgctgcccccagcgccg

SEQ ID NO: 1054 - DNA, 28475 bp, Homo sapiens
caccagagaaggaaagagagctttgtttttttttgtacatagagggggaaaaaattccctgtccctcccgttccagggagagctggtcgctgagggaggaggaagagccacggcaagaaccctgccaggtctgtgctgggcacaaccaccaccacataaggcacccacggaaagtgcagctcagaaggcaggcgagagaaaggctgagggggagagaagagaggaggactaattcccctggaaggctccttgggcagcagatgaagcagctctgtggaaggttctgctgctgaagatgccctgggaaaactcctcctgggcctgctggaagctggcccctgtccgtcggtagagggagtgcacctggcgaagaggggtggggtgagagaagcctgtcctttgggcccaccaggaagccagccatccaggttatactcccaaaggggtcaccagaagcctggcactgcctgaccccccacccagatccctggagaaaggtactggacctttgggggcctaggatgcccaactgcagtggtgaaaaacatctcgtggcaagggcaggaaacggttgcctgcctcctcccatttgctgtcagccctgcccacaccactcacccgctgcaggaggaagactgagagcacggcacagagggtgaagaagccagccaccaccatcatgatgactgatatggccagggaatgattatccagtgtagacagggctgcaatccaaccgctataaagggaagaagaggccagagggagcaaagtgggagtgggctccaaaagtcagcataaggggctcttctccaagtggctgctgtgtcctgaccatcaccttggcatctccccacagcacagggagccctgtgagccagaagcccttggcctgtgaggccagacctccgtgaaggctgacaggcccacactaccccattcacaaggggaatcttctggttatgtgaggtctgaaagggaggatgtggttgctgccttcacagagtcagaagtagcaccgggctgggtgctatggctctcacctgtaatcccagcactttgggaggctgaggcaggaggatcgcttgagcccaagagttcaagaccaacctgggcaacagagggaggccctgtctccataaaaaataaaaaaaggccaggttcgtgcctgtaatcccagcactttgggaggccaaggaaggcagatcacttgaggtcaggagtttgagaccagcctggccaacatggagaaaccttgctctactaaaaatacaaaaattagctgcgcgtggttgcacacgcctgcaatcccagctactcgggagactgaggcaggagaatcacttgaacctggaaggtgcaggctgcagtgagccgagatcatgccattgtactccagcctaggtgacagggcgagactccaactcaaaaaaaaaaaaaattagctggctgtggtcatacatgcctatgctcccagctacttgggatgctgaggtaggaggatcacttgagcccgtgaggttcaaggctgcagtgagctgtgatcacgccacggcactccagcctgagcaacagagtgagaccctgtctccaaaaaaaaaaaaaaaagaaaagaaaaaagaaaaagggctgggcacagtggctcaagcccgtaatcccaacactttgggaggccaagatgggcggatcacgaggtcagcagatcgagaccatcctggctaacacagtgaaaccccatctctactaaaaatacaaaaaatgagccaggcatggtggcaggcacctacatagtcccagttactcgggaggctgaggcaggagaatggcgtgaacctgggaggcggagcttgcagtgagcagagatcgcggcactgcactccagtctgggcaacagagactccatctcaaaaaataattaattaaaaaggtagcactgggccgggcctttttctgctgctttgggggtggggagtatggaaagcgtggctgctcactcctgaggacccaccttctgtgaaggaggatcactggccaacttgctgtcacctgtctgagccccatgtcctcatctgtaaaagggatatcctcatatttcttgacatcaaaacttactacaaagctacagtcactaaaatagtgtaggactggcataaacatagacatatagatcaatagatcaatggaatagaactgagattccagaaataaacccatacacctattgtcagttaatttttttttttttttttttttttgagattgagtcttgctctgtagcccaggctggagaacagtggtgtgatcccggctcactgcaacctccacctcccgggttcaagtgattcttctgcctcagcctcccaagtagctgggattataggcacctaccaatgcgcctggccaatttttgtactctctagaaacaaggttttgccatgttggccaggctggtctcaaactccttcctgacctcaggtgatccacccgccttggcctcccaaagtgctgggattacaggcatgagccaccgcacccagccaactcaagccttctgattcccagtacaggtgcaaacggcagtcatgaatcacagcttttctaccagggtcttacttaggtaaggagtaatgaaattgggtcactggtcaaaagggaccagattaacaacagcagggcaagaagcatgaggggtggtgggagggcagcgtgcacttgtttggagggcaaggggaggcaacctttctctccccactgctctggacttgccagctctgccagagggaggggaccaaaatagcaccgcccttccaggctcaggctgtcagccaagtgccagtctgacctttctgcaatgctccctgtgcactggggcagaaaggaaaacatcagccatcagcttttcttttgagattaattttgagctgaggactgaggtaccctggaaactcaaaccagccgtatgctcaaagagggcagccagaagaagcctgtccaggggaggtgagggaaccgtctccttaagttacaaggcatctggaaaaagttgcagctcagagtctgcaaaggcctgggcatccatcagctttcaggagggtgtggcaggagaaaaggaagaggctgcaatccagtgcaggacactgtcatggtagcctaaagagtcaagccaagttcacccacaataccctggaaagtggagagcaagggaagatagtgtcttttttttttttttttgatacaggatctcactctgtcacccaggctggtgtccagtggtgcaatcatggctcactgcagcctcaacctcctgggctcaagtgatcctcctgcttcagcctcccaagtacctgggactataggtgcatgccactgcaacaggctaatttttttaatttttggtagagacaaggtcttcctgtgtttcctaggctgtctcgaactcctgggcttgagcaatctgcctgcctcggcctcccaaagtactgggattccaggcatgagccactgcacctgaccaatagtgagtgtcttttgatgcctttagtatcaaggagaaaaaaaaagtgagtggctactgatgaagaactggagagaaggcccaaagcagatccgagctggcccactcacccactccccgccatgggaaaagcagggcactggcggggctctgtgggagctagaaaacagggcaagagaggctgagtcccatatccaaagcctaattccctctgtgatgcccaggtctcacctgtcccccaggccagggatgccaaccaactggatgatgtagatccctatttgacaaaaaaatacaaagaagaacacaaagaagctgaaagagttgtcggacctgtggagagagagggaaataagtcacaagagggcttgggctgtgttcctcagcatccttacttggtgtgacatccctcctcactaggagccaggaggcagcatgggcaagagacagagctccaggggcccagccataccacccgtaaggacacgcacacaccccccaccataatcaagaagagcttgcctttcactgccttccaatttaaggggtcagtgcttgaccccttcctcaaagagctgataaagttgctcccccaaaggacaatataaagagcctaacactcctgcagtgagccaagatcacgccactgcactccagcctgggtgacagagtaagactctgtctcagaaaaataagtaaataaaaaacaaagaacctaacactccatctcctggagtacttgcgtttcataacaggcaagaaaaactaagccaatctcttaataataagtaaatctctatataataagtaaaatctctaataataagtaaaactaagtaaatctcttaataataaaactgtatgaggccaagaatttgagaccagcctagccaacatggcaaaaccctgtctctactaaaaacacaaaaattagctgggcgtggtggtgtgcgcctgtaatcccagctacttgggaggctgagacaggagactcacttgaacctgggaggcggaggttgcagtgagccgagactgcgccattgcactccagcctgggtaacagactgagattctgtctcaaaaaaacaaaacaggctgggcacggtggttcacactcgtaatcccagcactttgggaggccgagacaggtggatcacttgaggtcacaagttcaagaccagcctggccaacatggggaaaccccatcgctactaaaaatacaaaaattagccaggtgtgattgtgtgtgcctgtaagcccagctactccggaggctgaggcaggagaatcatttgaacccaggaggaggaggttgcagtgagccgagatcgcatcattgcactccagcctgggtgacagagcgagactccctctcaaaacaaaaacaatagaacttgaggatacgtggtaacaaagaacaatgagaaaaaaacaaaacctgtacatctgactggaagaaaaaaatatttgggaaacaggggacaccagacaaaactctctcacgagctgaggacttccatctctgtgtccttgagggctagatcacagtgagggttcagggcctccagtggtacagggatggttcagccactaccctaatccctcttcccagggcctgctgggctcccagccctgaaagcataaaccctgaggtacaattccagaacccctgggggtctgtaaggtgtatccagctatgttcccagtatctagcttaggtgttggcagtctttattgggaagcatcaatagtcatggagaaagagccctggagagcactcatctgatactaccagagaagcacaccttagagcctcagaagggagttcccaaagagcgtcccctccctcttcccagtaacggcatcagccagactgggagcagtgggatgggaggtcccttctctaggtctcctgtgcctggtccaaggacagggcccagagcagacctcaggtacagaaactgaggaacggggcccccaatctctgctctgggtgggaacagaggaacagaatgtagggaaagtggatttccctacattctattctgctctaagactcagatggggtcccagggcctatagcccttagcctgctacctgggatgccagccataaagtctcaccccttgccccggcctcactcacctaaaggccttatagatgggtcggtaccaacaaaggaaggcacagggagtgaagatcagaaaccacaggatggagaggccaaagtccactcccttggagctgttgcccgagaaccaggccaggcaggcaagcaggttcagaaacagagtcactgaatgcactggggaaggggacaggacagagttatgacttgtgccacagtggctgaggggctccaatgtggcagccactccctaggagaggtgaggttcatgctgcgaaggcagctgctgaaacagaggagcccgctctgtacctaggcagggatagttcccatatcctggttttctgggacctcaaaaccagggatcaaactacgttcctgagaggtgatgggacagcccgggtatctgaggggtgtggagggaggatgcagacccagggctggtccttggggaaggaagtctttctcttagcaatgcttttccctggccctggatggcccctgatggagctgcagggggagtctccttcctcacccctcagagttcacaggcctgtgggcagggaaggccttcacctaaggagggccttttagtgcagtgagctctgaaggaacttggaagcctctagttagtcccaccctccctgatcggtggtctggactgcccctttcaaggaggtttccagacagggggcagcctgtgggcagaggcatctccccaacccagcccaggcactgaggaaggctggagtctgctgaaagcctgtataccagggaggagcagccaggaccaagatggggctctcaagtcacacccaattcgcccttgcgcttggaaggcaggagtgggactcacacatccacagatagtagagcatcttgcatatccgctggtagtcggcagggatctctgtggagaaatcctgatagaagcagggcttcacagggcaccacgagggcagagggggccagttgttctgtctcactgggtagggcaaaaagagtgacgaggtaagggcccagcctcagaaggggcatcaaggtgcatgcacgccagcatagtgtatgggccaaaccagggttcccagaggggctccagcaagcggggcttggagtctgcatggagcatggagtgggacagaacaggataatggaacccaaagagataccaacaagctcacatggagataaaagaccccaaatgcactgggaaatacagacagctaaatggcctaagtgattatttttattaacaagcagcccataagtgtgagaactcagttcatcatcattagcaaggaattgtgggaccaaagcccctatgctatcaaagaatcaaggaatttgagagctaggaaggagtgcagaagtaatctacagccattacaactacactgcaggtctcctgacttgcaacttactgctcttcccaggaccagcatcctgtgatgagaagagccccacaaaactctaaggcagctcagggtgaatgctgggaggccctccgcacaggtttcaggacactcttctatgccaggcagggcagccccaggccccagcagcctcccttaccatgcaagttggctacagtgttctgcagctcccgctccttgcgttccagctcggcagctttcctgtccagttcttcctgctgccggagcaggcctgcctgggctgcagacaccacggcctggagagaacaggggaggtacagggacagccagacacaacaaacagaaacagtgtcagcctgggtaggcaggcagagaggccttgccccaggcagggacagccatcaaggagtcccagaagcagtccccgccccacagagtgtcttaggtaccagagaccaccttagagaggccaacctgtcttccactgcccccacaccttcctgaccccttggccatgactaagctgtcctctcccctcatccctaagcttgagttgggaaaactacccccattggcttctccacctcttccccatactgggtcaaggcagcgctcagtgattgtgacctttgggaaaaagacctcacaagaaactaaactataataagaaacccacagacccaagcctcatttgaagagcctggtggatgtgtgagaaggaaaacagtgcaagcctgctaacagtgagtggaaaggggagacacgtgaaggcagatggcgtgtgcctgagcctcaggatctgtacaagcaccctgccccatggcctgcccccaggagctgcctcctgaggtccccctaaactgcaattggctacaccccaggacagccccttaggtgtggccctgccctgcctggctttagtggcatgcagagtccacacttatctcctctccaggcggggtagagcctctgagtaacagtaagggactgactgtatgtgaggctgaacagacctggccccggggccctgcacctgctggcagctgctgccatttgggccaggttcctcctgaaggatgagactacagtcctttttagggagagatctcaaactggtcatttcacaggatgacaaaccaggcacatgtgtacacacacacatgtatacacacaccaacctctccaaaagctcttcaaagacctaaggctgacgtggagagccaagtttcaggcactgggggcggaagcaggagcagaactgaccccgctgtgccacgctgggggtcttgacctcctccaagtctgtgacgccagctgagaaggacccagctccctacagcccaccacccagctgcacagaaaggcaactccgcatgtaaggcctgcctcacctccacagggctctggggcctgggaggggtgtggggcaggctccgggtgccctgcccttcctcctgctcatctacattaggcctaccttcggaagctttcgcatgtagctgtctctgagaatactttctcctcctaggagcatctgcctctctgagagctcgctcactgccaggaattgggcaggcgggaacttgctggcctgtctaagcaggagctgcaacacacaactccaccatgggtcacgctcataggggcagcgaggggtgcagcgggagggcagtgaggcggcgcagtggagcaccaggcacaaagcaggcaagattcacagtatttggtgaagggacaaaggaagacaggaaggaaggtgagaattaatgaagttaaaaaaaagagagagattctgggccccaaggaagagagaacaagccaaaggcccgaggaggacctggaggggtacaacagggacaaatgccctctctggaggcaccgaggagcccggcctggtgagtagagcttatttctcagtggtggtggtgggtgggatggagggagtaaggatattaattggcagagcagcccctctacttgtaggtgaccagctccgaacaaattagcaagagggcccttagggggccaaggctgaaagctctctgcttgcccccagcctcagggctcagctactggtctggatgattccctcactggagagaaaaggccagagttctttgtcagcactacctggggggtcggctgggttggttccactgatggctggagaaccgctggctgtgaggacccagggagttgggtgacaggaactgttgtcgctgcatttgtctacatggaacaaatcaaaagacagaattgagtgggactccattagctggtgacgagggggcaaacccacagcaggatgagtgatgtgcccctgcctgtgaggggactccctcggggcctgcactgggccttcccctgtggcttcccagccaacaagcctcaggttcaggccatctgatccctaacccggcacccctgggctcgctgggtccagcacacttgggcactgccctgacctccttggggaggggccccggtcacagatcccaaggggagaattttacagagcgtttggtggctttgccatccttaccctgcctcccgggttcatgttaggactgtccctttgaggactgccgcttctcagagctgcttctgtccttgccaaggatccctgccccggacaccccagcaccaccctagagggccatgggacttggaaagagggcctgctcaccaacctctgagaaggggttgaattccgccaggccgccctgcggggcgttggtcagctgggtcacagagggatcctgagaaggtgaaaaaaagcccttagacacagtggagaaaatccgggccaggggccggcaggcgagccggtgacgcctgactgaagcagggcagctgatcaccctcccgggaccctgagaagcctctctggaagggtcctgtgcctgcctctgccacaccacagctgcggtcccttctcccttcccccttcctggaaaaggttcagcccagaagagacccagagcaagctttacccagaagcttgagagtacacaccacacaggctcctgttggtgccctatacagattcaaaatggttcatagtatttacctctagggagtgggtttttttttttttttgaggggtggggtgctgaggggcaagtgaatggggtggtgagggtagagacttactattgactttataacctttctgtactgttttacttattattcatttattcctctttttttatatttttttattttttcgagacagagtcttgctctgtcacccaggctggagtgcagtggcgcaatcttggctcactgcaaccttcgcctcctgggttgaagcgattctcctgcctcagcctcctgagtagctgggactacaggcggccgccaccatacccggctaatttttgtatttttagtagagacagggtttcaccatgttggccaggatggtctcaatctcttgacctcgtgatctgcctgtctcggcctcccgaagtgctgggattacaggcgtgagccaccatgcctggccattcctcttattttgtaaaagacagtctaaggtagccgggtgcagtagctcatgcctgtaatcccagcactttgggaggctgaggcgggtggatcacctgaggtcgggagctcaagaccagcctgaccaacatggagaaaccccgtctctactaaaaatataaaattagccaggtgtggtggcgcatgcctgtaatcccagctactccggagactgaggcaggagaatcacttgaacccgggaggcagaggttgcagtgagcccagattgtgccattgctctccagcctgggcaacaagagcaaaactccatctcaaaaaaaaaaaaaaaaaaaaaagtagtctaagtttctagaacaaaaacatgctgctggctgccagtactgattttattaaatcgggcacacttgctaagagcagagatatgatgagctgaggtgaaaattcaagaaaatgtttctgggtttcgggggttttttaaagtcttttcataaaatccaagaatgtcctcagaacacaaccttgtctccctttcccatctgatctctgcatggggctctgccatcctctttactgtgcccctgctggcctggaacagttgtcttcaccctgccctgccccaagaagagctcctccacaccctccccttcctagtaacagatgcagggctcaggtccagcttcacagccatgcctgggctccatgaggaacagccctgagggtggccaaattcagggctgttcctgcctgtggagacaccgcttgggttccacacctcaccccacacccctaattattaaaccagatgctcccaaacttcaggcccagcctcacctccactggaagcctctgcagagccagttcttttttttttttttttttttttttttttaagacagagtcacgctctgtcacccaggctgaagtgcagtggcatgatctccactcactgcagcctccgccttctgggctcaagctattctcgtgcctcagcctcctgagtagctgggattacaggcgcctgccaccacacctagctaatttttatatttttagtagagatggggtttcaccatgttgggcaagctggtcttgaactcctggcctcaggtgatccgctcacctcagcctcccaaagtactgggattacagatgtgagccactgcacctggcctccagttcttttttttttttttcctttttcttttttagagacagggtctcactctgttgcccaggctggagtacagtggtgcaatcatagctcatggtagcctcaaactcctgggctcaagcattcctcccacctcagcctccggagtaaccaggactacacacatgagccaccaggcctggctgatttttaaagtttttttgtagagatggggtcttgctttgttgcccaggctggttttgaagtcctaagctcaagtggtcctcccaccctgggctcccaaagcactaggattacaaatgtgagccaccttgccctgtccagatccaattgttaaatacaatgctaatattagacatagccacagagtgaccccctcagtttacagatgtagaaactgatattcaccatgatcctaggacccaaaatgggagctctctccttactctgaatatttatagagctgagggtcagcattgaatatgttctctggttttatcacagatacttcctcttatctcttatcttcccacctgagccaccagttcatagagggtatgaatgtctgactgcctccaggcatacagccagaactcactgtgtctggacgggcctcatactacagcctccaccccttccaacctcctctgcgacagactgtggctatgttcttcctgctgaacaccacctctgccctgatggctcctgcaacttggacaaagtgacaaggtgaagttcaggaggctctgtgttgctgaagaattggccttgaggttatttcatgcctgaatgaccagtggtttactaccagaatcatctggcttcctgcaaggaagatttggggcttggtatctgttcccctctcagactcagcagacacctagccaccgctgaagtcactgaaatcggatctaccatccacagaagtggctcctcgagtctgagtcaccagaggacagaggaagaggggccactctggtagcagtttcaggtaatggcaaacagacatctggccaaggtgcacatgtttaataggtgatctccaggcccacaaagagatgccatttcctttatgaatggcagacagaaggggactgtgatggggatcatagggtgactgccctgtccactctgatccctccctttttcctaaaatcttaaagacatggccttggactcctcaccgggctcctcataaacaaatctgatctccatgattaagttagaagctccctgcagccatgtgcatctgtgtctggttcatattctagttccttggtgcttggtgaagggcctatggcagcacagcagctcagcggtttgagaagacacgcagcacgctgtagggcctccctctttttagaaagcactgcccaagtgccagggcatagcaaacaggaggcacctgcatcacagcagtagcccaagggcctggaagcacgttgcctaggaagagcaacctaaaacgctgagacaagtggatattttcccatctaagaaaacctaggctctttctgaaagatgtgcgtggcttcaagacaagctgagccctggcaagaaagggagggaggaggagggactggggaaggaagctgacatttacttagtgtctacggtgtgccaaactcaccacacaatgatgctactgtgaaattctagtcaccccagaactagccactgtgtcgagttgtcagaaaagagggttttactggccttccttgacctggttcttcaaaagacttatgaccccctaatccactatttataatgactttactgctctcctggtacctagggtggtactagttatactccatacttgagagagctgagagagtcactccaatcagcttctctgttctgtggctcagctcgggaccctggctgagaaaagctacaatacagctcctcatttaaccctcacaacagccttatgaggaaggaatatttatattttgcagctggaaaagctcaagctcagagaggggaagtagcttgtcttaagatctcaggggtagtggctcagccagattttcaatccaagtctgtctccagggacacaagatggtaaagctgagtggggcaaagcatctcgaagcctggtacggagcctgacaaattgaaggcgctcagtgaatatgtggcaggatgaatgagccccactccaggaggacactgacaagggcttctgcttgtttccttgcttccttctttccttcaaagagctggttcttttttttttttttttttttttttgagacggagtcttgctctgttacccaggctggagtgcagtggcgcgatctcagctcactgcaagctctcccgggttcacaccattctcctgcctcagcctccccagtagctgggactacaggcacctgccaccacgcccggctactttttttgtatttttagtagagataggtttcactgtgttagccaggatggtcttgatttcctgaccttgtgatccgcccacctcagcctccgaaagtggtgggattcaggcgtgagccaccatgcccggtcctaactggcttttaaatgggtcaagtaggatggtgagggctaagtttcacctacaaggaggaataacctaaaactcccctgcagtgccactcagagtggctattgccctttactgaatttgtaacaaataaaaggctcttaacctcagttcttttcattcagcaaccagctacagtgtgaggaacataccacaatgcataagacacagctctcacccttctggagtccacaatctggtatctgagacaagtgggcaccccctgaaggggtgctggggaccacggcaaggtgcagagcaaaaaacaggaagaaggggagacacctcggtgggcttcaagaaaggccaggttgtagaaggaagacagacagcaaaggcccagatcagtaaggccccccaccactgcaaggcaggggggcacttccacatagctggggggtaaaggcagtgagggaagagaggcaggcagagttaggctgcagctctcccaggaacggccatgaaaaccacacttttttttttttttttttgagatggagtctcgctctgttgcccaggctggagtgcagtggcgcaatctctgctcactacaatctccacctcccaggttgaagcgattctcgtgcctcagcctcctgagtagctaggattacaggcacataccaccacgcccggctaattgaaaaccacacttgtcactggtttggaaacctcataccatgcgtttcacaggtgctggctgtctgagctctctgtgacttttccttgccttcccttcctgtattccacccaggctcccagtgtgaggtttatttcaggctccaaataaacacattaaataaatatcttatctcacggactaaaaaaaattcagggccagccgggcacggtggctcaagcttataatccagcactttgggaggctgaggtgagagggttgcttaaatccagtttgagatcagcctgggcaacatagcgagaccctgtctcttttttttcatagtaaaaataaaaaataagtttaggcctggcgcggtggctcaggcctgtaatccctgcactttgggaggccaaggcaggcggatcacctgagaacaggagtttcagaccagccaatatggccaacatggtaaaaccccatgtctattaaaaatacaaaaattggccgggtctggtggctcacacctgtaatcccagcactttgggaggccaaggcaggaggatcacctgagaccaggagttctagaccagccaacatggccaacatggtgaaaccccatctctattaaaaatacaaaaattggccaggcgtgatggctcacgcctgtaatcccagcactttgggaagctgaggcaggtgggtcacctgaggtcaggagtttgagaccagcctggccaagatggcaaaaccccatatctactaaaaatacaaaattagctgggcgtggtggcaggcgcctgtaatcccagctacttggaaggctgaggcaggagaatcgcttgaactgggaggcggaggttgcagtgagccaagattgtgccattgccctccagcctgggatacagaggaagactccatttaaaaaaaaaaaaaaaaaaaaagccaggcgtggtggtgcatgcctgtagtcccagctacttgggaagctgaggcaggagaatcacttgaacccaggaggaggctgcagtaagccaagatcactgcgcagcactgcactgcagcctgggcagcagagcaagactctgtctcaaaaaaataaacaataataataataataaataaattctggccaggcacggtggctcatgcctgtaatcccagcactttgggaggctgaggcgggtagatcacctgaggtcaggagtgtaagaccagtctggctaacaaggtgaaaccccatctctcctaaaagtacaaaaattagccaggcatggtggcgggtgcctgtaatcccagctactcaggaggctgcagcaggagaatcacttgaacccaggaggcagaggttgcagtgagccaagatcgtgccactgcactccagcctgggcaacagagcgagactcaactcagggaaaaataaataaataaataaattttaaaacattaaaaattcagggtcatgctgagaggcagagagtcagcaacactctggaacctctgtgaagtcctattggctttggagatgaggctgagtgtcacagagcacgaaaaagcaatcacccccagagtggctagctgggtcccagtgcacaaagagccacaattgaccttggtgctctctgacctgatacctgagaatctgtcctaagaaaatatcacaaaaacatgtaaaaatctgtacctgcaatgatattcataggaccaggacttacaataggagaaaaaagcacgaaacaaacatccaatgacagagaccacaggtatgttttggtacgcatccccttgaaggcccacaacgccactaagcatcacagctatgaagatggtgcagcaatacagaacaggctttctggtcgggcatggtggctcacgcctataatcgcagcactttgggaggccaaggtgggcagatcacgaggtcaggagatcgagaccatcctggctaacacggtgaaaccctgtctctactaaaaatacaaaaccaaattagccgggcgtggtggcgggcgcctgtagtcccagctactctggaggctgaggtgggagaatggtgtgaacccaggaggtggagcttgcagcgagccgaggtcacaccactgcactccagcctgggcaacagagcaagactctgtctcaaaaaaaaaaaaaaaaaaaagaaagaaagaaaagaaaagaaaaggctttgttacatcaatactaaattatgggccaggcccggtagctcatgcctataatcccaacactttgggaggccgaggcaggcggatcatttgaggtcaggagtttgagaccagcctggccaacaaggtgagaacccgtctctaccaaaaaaaaaaaaaatacaaaagttagccaggcgtggtggcatgcgcctgtattcccagctactttggaggctgaggcaggagaatcgcttgaacctgggaggtagaggttgcagtgagtcgagatcacatcactgcactccagcctgggtgacagagtgagactctgtctccaaaaaaaaaaaaaaaaaaaaaaaaaattcctggccaggtgcaatggctcacacctataattctagcactttgggaggccaaggtgggcagatcacttgagatcaggagttcaagaccaccctggccaacatggtgaaacctctcactactaaaaatgcaaaaattagcagggcacggtggtgcatgcctctaattccaggtacttgggaggctgaggcaggaaaactgcttgaacccaggaggcagaggctgcagtgagccgagatcacaccactgcactccagtctgggggacagagtgagactccatctcaataaataaataaataattaacaatggttgcaaatgactggtagaaatatggaagacttattttctgttttccaaattttctataatatggtcatgttattttgattttaaaaacacatatacataatcccagctacttgggaggctgaggcaggagaaccgtttgaaccagggaggtaaaggttgcagtgagctgagatcgtgccactgcactccagcctgggtgacagggcgagactccatctcaaaaaaaaaaaaaaaaacaaaaaacaaaccatacacacacacacacacacacacacacacacacacacacacacacatatttttaaaaagagaaagaaaaaaaaataggctggacacatggctcatgactgtaatcccagcactctaagaggctgaggtgagagaatcgcttgagcccaggagttaagaccagcctgggcatcatgatgaaaccccgtctctacagagaatacgaaaattaggccgggtgcagtggctcatacctgtaatcccagcattttgggaggctgaggtggacggatcacctgaggttgggagtttgagaccagcctggccagcatgatgaaacccagtctctactaaaaatacaaaaattagccgggtgtggtggcaggcgcctgtaaccccagctacttgggaagctgaggcaagagaatcacttgaacctgggaggcggggagattgcagtgagtcgagatcactccattgcactccagcctgggcaacagagtgagactccgtctcaaaaaaaaaaaaaaatcagccaggtctcgtcgtgggtacctgtggtcccagctacactggaggctgaggcaggagaactgcctgagcccaggaggtcgaggctgcagtgagccatgattgcgctactgcaccctggcctgggtgacagagacagaccccatctccaaaaaaaaaaaaaacagtaagtgagcaaggtacactcaggcctcgcttcctgccaccggctgcaatgtgtggaacccttcagaaaagcaagtctgagtcacctggccgggcattcaaggccttccaggacctggcaccaatcctctaaaggaatctaccctcaaaatgggacacttactatctcctcgcacctctgtgtagtctctccatacacaaaccattccatgccaagcactgggctagggaaaccaagaaagaaccttgattcctgcctttgagaagcaaatagtacagagaatcacacagaagccagggcaagaggtgatggcacatgatcagcactgtaacagggtgagggcagacacagggtgagacacagtgtgatcatagaggagagagtaattaagctgtctgggagagtcagggaaggctctactgagctggaatctgagttggatcttgagagatgaaagaaacctagcaaacagtaaagaggaaggcaagaaccacacttgcaaagccacaggatctttatttatttatttattttatatatgtatatatttttgagacggagtctcactctgtcgtccaggctggagtgcagtggcgtgatctcagttcactgcaacatccgcttcccaggttcaagtgattctcctgcctcagcctcctgagtagctaggattacaggtgtgtgccaccatgcccagctaattttttgtatttttagtagggacagggtttcaccgtgttagccaggatggtcttgatctcctgaccttgtgatccgtccgccttggcctcccaaagtgctgggattacaggcttgagccaccgcacctggccgagaatctttaaaaagagcttgcatgtgttcagaagagagaaggttatggaggctgtggaggggtgtgtggagagaagagtctggagtatcagggaaccagtctgaagagggtggggccagattgtgggactttggatgttgctctacaggcaacggggaacaactagagatttgcagtcaggggtgacatgatcattctatcagcagtgaagggagtgcaacagcatggtaggacaacagcgggaagactggctaggacacaactgtcaacatgggtgaagtgaggaccaaattgagggacagcagctggggatggagaagaggaacaagagggacttcagagaccttcctcacatcaatcccacaggctcagcaactctctgggttggcctgggaatggaaagactacagggcaggaaagggaagggaaagaatagagttgaggccaggcacagtggctcacgcctgtaatcccagcactttgggagggtgaggcaggtggatcactagaggtcagaagtttgagaccagtctggccaacatggtgaaaccccatctctactaaaaatacaaaaattagccgggcgtggtggcacattcctgcaatcccagctactcaggaggctaaggcagaagaattgcttgaacccaggagaggtggaggctgcagtgagctgagatcacaccactgcactccaccctgactctatctcaaaaaaaaaaaaaaaaaaaaaaaaggccaggcacagttgctcacgcctgtaatcccagcactttgggaggccaaggcaggtggatcacctgaggtcaggagtttgagactagcctggccaacatagtgaaaccccatctctactgaaaatacaaaaattagccgggcgtggtggcatgcgcctgtagtcccagctacttgggaggctgaggcaggagaatcgcttaaacccagggggcagaggttgcagtgagccaagatagcaccactgcactccagcctgggcaacagagcaagactttgtctcaaaaaaaaaaaaaagaaaagaaaagaaaaaagaaagaaaggagtgcccaaaataagtgactgtgggagaggaggaacaggtttttcaagggtgggtgtggtggggtagggagaggatccgagaagatattgagtcaggttggagatagctgtggaatatttctggttggaaggattgggaaggtgcaggtgtgagtttgaaatagtggtctgagctcaggaggaagctgagaactagagatctagatctgggatcgctgaaatgtggatgctattctgaagtcatagaaatgaaggtataaagtgagaacagggtaaacccagcactttgggaggttgaggcaggattgcttgaatccaggagttcgagactagcctgggcaacaaagtgagacctcatttctccaaaaaaaaaaaaaaaaaaagccaggcacgatggtgtttgcctgtagtcccagctacttgggaggctgagatgggaggatttctggagcctaggagattgaggctgcagtgagccgtgattgtgccactgcacttcggcctaggcaacacagtgagactctgtctcgaaggaaggaaggaaggaaggaaggaaggaaggaaggaaggaaggaaggaaggaaggaaggaaggaaaggagggagggaggggaggggaggggaggaaaagaaaagaaaagaaaaaaaagaaagacaaagtttaagttctgaacttccaatagcatgaataaaaacaaaaaaagaactctggaatactcctaaatgtatgagacaggaagtgaaaacaggctgaggaaggtgagaattatcaggataaaagaggccaaggatggagagaatttcaagagactggccaaacaagcatgtgagtcacaagcagcagacgcatcccaggctcatgactccctaagagaccattaagatctaagagtgaggacatgcctgggggtgcaggggtaagagtggacacaggagtacagggatgacagcaagcaggagcgacttttggttcttggcactacttcacccaaaaatactctgttttctggccgggcgtggtggctcacacctgtaatcctagcattccgggagaccgaggtgggtggatcacctgagatcaggagtttgagaccagcctgaccaacgtggttgaaaccccacctctacgaaaaatacaaaaattagccaggcatgctagtgcacgcctgtaatcccagctactcgggagtgtgactctgtctcaaaaaataaatgaataaccctgttttcccatctgccaggctttctgctttcagtccaagccctctgtgccacaggtctctgcccttcctcctgagagccctcccagctcctttggacactgccctgatcccacttgtgatgtgctgtcactctcagtgagcatttattttctttcttttttttttttttttgagatggagtctcgctctgtcatgcaggctggggggcagtggtgcaatctcggctcgctgcaacctccgcctcccgggttcaagcgattctcctgcctcagcctcccgagtagctggaactacaggtgcccgccatcacgcctggctaatttttgcatttttagtagagatggggtttcaccatattggccaggctggtctcgaactcctgaccttgtgatccgcccgccttggcctcccaaagtgctgggattacaggcgtgagccactgcgccccagcctcagtgagtatttcttagctctcctgccagaagccattgatcacatactgtgctcatttaccatggtctcctgcacaggcctgcagagcagcatgacctcagtgatgtgcactaacgtgaacatctcaaagcagcacttgctggatgggtcacagtttgcaaatgtgcacagcactcttctctgaatgaacagcaagtaccccttgtttgtcctggttaaatattaccatttctctgaaattaagattatcttaccccaagtgtttccaaagaagacttaacggaagagtcaaagttcacctatctctctacccaagttttaacacccagcctggctccaggtgccaaccataaaggcaggaatcctatctgggcagctgtctgtagtcacagtgaagctgtaagaaccctgccattttcaaatttcttgagacaatgctctgttacacaggaaagttctaccaggtccatctggttattccaagaattcccaaagttatggtcaagctggggccaaccctctctgggaaggtcccactgtctgcacagggaaattcaagtaactttgttcacacccaaatcacgtttctgccaccacttcttccttccacaggagagaaatatttcaaatccttgggaagcagccacaacactgagattatcttttaactgcaaggaggcaatgtgtgaaagtgatattgtgtgacttggcaacttacaaacactgaaaggttttctctgttcaatgccaccacctattccacttcctctccttgagatcaatgctgtctgcctgggataatctggcagaagtgctgagtgggaaagcagccctaggcacttgcctgggtggtctgatttttagtggactgctgaaaaatggacagtacaatgactccctttagctttccaccccttcatcacctgacaagacttaatgagaaacttttgggagcagacaccctggatcattccaaagcagagaccgaaatactcagagggtacaaagcagctgccataaccaacagaggaattagggtgtgccagtggaggctgtgaaatcaacaacacttggcttgcagtttcctgcttcctcctaggaggtgggcaaacctctgtggcacactcatatcttaacttcccattcacagctctttctgtgcaggaagttttctaatcatcccgatcataaccacacgcaaggaagaggtcataaaagcacatgcccacagtgcggggtggaagcaggcacttaataaagaaccttggatgaggaagtcaactaaatggtgcactgggagtttcaaaggatataacgactgagcagaaaacagattccatggtcgaataaccttgagaaatgctgggtcaaataaagctgagccaatgtctttttgtaggatttctcagagcctttaacaaactaacaggccttgtgaatctttattttggtttgtttgttttttgagatagagtttcactctattacccaggctggagtgcaaaggcactcctcagctcactgcaacctccacctcccaggctcaagtgatccccctgtggcagcctcccgagtagctgagcccacaggtgcatgccaccacacccagctaattttttgtatttgttgtagagatggggttttgccatgttgcctaggccattctcaaactcatgacctcaagtgatccacctgccttggcctcccaaattgctgagattataggtgtgagccaccatgcctggccaagccttgtgaatctttgaaaaaacaaacaggctgggcacagtggctcacgcctgtaatcctagcactttgggaggctgaggcgggtggatcacctgaggtctggagttcgtgaccagcctggccaacatggtaaaaccctgtctctagtaaaaatacagaaattctgagcgtggtggtgggtgcctgtaatcctacctactcaggaggctgaggcaggagaatcgcttgaacccaggaggtggagactgcagtgagccaagatcgcaccattgcactctagcctgggcaaaagagcgaaacaccatctcaaaaaacataaacaaagaaacaaaaacgaaataggtagcaattcccaaacctatttgaccacagaaccatgagcacctttcaggactggcattactcagaatatatattgctttaaagaactgtcttaaaaagcccaagaattgttctccagtggaaaaaaaaaaccaataataaaaaataaaaaaattaaagaacaaaagcacaagatctgtattattccatcccctcacactggagaaaaaatgtagcttagctaatactaatttgttactttcaccactcccagtactctcaagaatggtgacaactgtgatgatgttacattccattctttccttagccagcctaaaatagccccagtgcagtttaacaccaatgtctgagcttcaaaacctttaaaacagccctgtcctgggaatgagacccaggtcagcaccttcctgctgctaaacaactgatgactctggcacataccatcctcattgaggtcttggtttcctcatctctaaactgaagaggttagaatagagttctaagaatgttctcagctcttaacagtcaactatgagctctgaacactaggtatatttttgcaatccaccatttctgtcactgcatgacggaaataaaaacgactgttctggagtgtgactaggtgtgacagtttctgagtctatcgcctctccacctgctctctcctgagcttggtgccaacaccctgagtaaatgaagctgggctcacacccaggcacccaagggctacacctcccaacgtcctagccctggcagtcaaggaagcagacatcaccatctcaaggaaaaggtgggcagctctgaccaggagaaggttcagaggcctcacatccaaagctgtttctccccacaccactgtgtgccaagaggaaaagcccagcccaggatgaggaggagcaaatcgcagccagccagccagctttcttcttcccacccaggactccccaccagatgtggctggttgacaggaccacagctgcttcctgtcatgccatatcctggggcttcctgatggacagactgtctcgctagaatgcagaagttacttctaccacagtttgcacagtcatttttggagccagagatgaggtttaagactttcaagcagctattaatacagggtagaactatcttgccctctgctaacactggagcaaagctctctgcatttttagacaactgacttcctctctgtcagacagcagcagactttttatttctgattctgagaggacaaaaaaacacacataaaaaatggaaaatcatcacatacaacatacaccataaggctacaagatcctactaaaacccaaaccccagtattatacagcagttttgtaattaaagtctgttaccagaagacattggcagaaaaaaaaaatgcaaatcttctttctttactcaatagagatgactgtttgccttacataagagacaaggtccttgcaaacgctctgtcaagaaacattaagctacgagaggaatgttcagaattccctgatgttctaaggaacaagctatcagaatttgccctgagggctcctgttggctaagacaccttgagaccaagaaagaagcaaaacattttcactctcctgacagcgtataattatttagttcaagtctcctttgattttgctctgacccttgaagcgattcaaagtgggaaaactcatgctgtgaatgacaggaaggactccttcaaggacttctctgacacctgcaggaaacttaaaagctgccaatgaccaaaataaaggacaagcagggtgagttaatgtgcctggtgacatcctgacagagcagaatatcagggctcataattcaccagtcagcacaaacaagcttccctagaacgggttttgagcagacgtgaaacaagaggcataggagctctggaggtaacagttcagcccctcatggtggaaaaagatcatccctgtgctctcagctgaaaggcagaaaggtgtgggctttaagtaggaagactgtcctgtggctcatgcctgtaatcatagcactttgagaggctggggccagaggattgcttgagaccaggatttcgagaccagcttgggcatcacagcgagaccccttctctacaaaaattttttttaaaaggagtcaggcccagtggcacattcttgtagtcccagctactcaggagactgaggtgggattcaaataatcatttgaatcctggaggtcaaggctgccatgacctccactgtgctacagcctgggcgacagagtgagaccctgccttaaaaaaggaagaaagagggctgggcgcagtggttcatgcctgtaatcccagcactttgggaggccgaggcaggtggatcacctgaggtcgggagttcgagaccagcctgaccaacgtggagaaaccccgtctctactaaaaatacaaaattagccggtcgtggtggtgcatgcctgtaatcctagctactcaggaggctgaggaaggagaattgcttgaacccaggaggctgaggttgcagtgagccgagatcgcgccactgcactccagcctgggcaacaagagcaaaactctgtctcaaaaaaaagaggccaggtgtggtggctcacccctgtaatcccagcactttgggaggctaaggtgggtggatcacttcaggccaggagtttgagaccagtctggccaataaggtgaaaccccgtctctactaaaaatacaaaaattagccgggtgtggtggtgcacacctgtaatcccagtttctcgggaggctgaagcacgagaatcacttgaacccaggaggctgaggctgcagtgagccgagatcgcgctactgcactccagcctgggcgacagagcaagaattgtctcaaaaaacaaaacaaaacaaaacaaaaaaaaaggaaaagaaagaaagcaggaagattgtttcttccttgattgctgttcaaaaggtcaggccaggcgtggtggctcacacctgtaatcccagcactttggaaggccgaggcggatggatcacctgaggtcaggagtttgagaccagcctggccaacacggtgaaaccccgtctctactaaaagtatgaaaattagctgggtgtggtggcatacgcctgtagtcccagctactcaggaggctgaagcaggagaattgcttgaactcgggaggcagaggttgcagtgagcggaaatcgtgccaatgcactccagcctgggcgacaaagcgagactccgtctcaaaaaaaaaaaaaaaagtcaggccagctcacacgtcagtgcatctcaactatgttgccaccacacacagttccatcagacaaacgttccctgtgggtccagaatttttcacagtcccccgcacctctcctctctccctaacccgggctctcctatctggtcaaaacccactccaaactagacccatggccaaaatgtggaattcttatcaaggccatttttcaacttgggctaccttcccgccctctcccatctttctttccctgacaaatctcaggggctctcctgtactttatacactagtttggctggtggtggagcggtggcaggtgtcctgggcttttcccacatttttcccctccaccagaggcttcaccacctcctcatatgttgctgtcaccccctcttctaaagtgactcaagacaggtgtctatccaagaatgagggaatgcgatagccacatttcgcttctccctgacgctaggagacttccggaagggtccgaccgtacctgctccagtccccttccctagcacagcccagcctccgggtgctagaagaccccactgtctccaacacttcagcgccccgcctcctctgcagttccacctgctgctagtcgcgcccctcacgcgttacgataggccagacctcaaagcccgctctcccattgggcagatgacccgtccctcctacgccacgtctcccggctctagcgagaggcccgggcggcggccgtgggccctagggaaatctgagagctggatggcgggagaggggctctacctggaaggggtttacatccactgggtccgcgaaggggttggtgtcgaaagccgacatggtgatcgggggccagcgggcgaactccgcgaacgctgctgcctccgggcacccagacccagcggcgcttcgtg

SEQ ID NO: 1055 - DNA, 2334 bp, Homo sapiens
gggcggagtgggggaggagagaggaagaagccagggactgggcagtgccttgcaccattttgaagctgttcagtctctgtgcctgaccctgaagactccaaagactcaggacgcaaggctggaggggaggggagacacaaggggccaggcgagagctgtctctgcacaggcgggtggttagaaaaaaaatgggggacacagccatttttgtgcttgttttattggaagcaagactccagccagctgcagggctcaggggaggaggcctggagagttcagtcctgggtctccctctgggccagcagggggaaaaggggtgttaaaagagctagaaccctcagagatgctcctctgaagcaggggaaagaaaactagaaaggaaaactgtcccagggcggggagcggaatagggcccccacatctcagactctcctaccctcaagcagttaattctcaccccctgccttcctctgtcaacggtgggggtgattccaataactcttctcagcttccatacttcaggtgctcttcgtgaatgctgggtggctttaacccttgggggtcccaaacaagtttccagaatcccactgtccaccattctcccccaaagaaggtcccagaaaaggtgaagttccgtgtcttcacgcaacacgggcataagcagcaattatcgcacgaagtttccctagggtggtcggggatcctctcctgccactcctggggcccctctcttgtcgccttaaggtccatgctacctgtcttgaggagctgtgtccaggttgtgggctccggaggaccgaggagtgaaaggctggaggtacatctgaaggtggaggcgctggcggaagatcctgccggactaggtggcccacagtccggagtttcaggccgtctgatcctcgtccgcaacccctggctcgggttgcgatcgcttcgcggagccttctccagctgcgggttcccctaggctcctcttggacgctggcgcggctggcggggacgagggaccaggatggggattcgggggctggtagccgggctgtcgcggatccagcgcgtccttggaaagtaggatggcgaggccgggcacgttcttaagtacgctgagactagcggccggctcgccaggcgtctgaccctgcgtgggcccaggcgggaggctctgccacacctcgcgtacgctccggtagcgcagccgcgtgacctggtgcaggcccgccaggcggcgcttgaggatctcggcgcacgtgacggttttggtggtggcccggccgcagccgctgaagacgatggcgcgcgtggctggctgcgccatgctggcggtggcgaaggccatcaggttccggatcttgctgccttccttgacccgcatgtgcaccgcgcccggcgccaggtctgcgaaggggccggagcccgggccgcctccctcggccccgcaccccgctggcgcctcttcggagcgcaccttacggaagttctccatgcgccgtcgtcgccgggaccgccggctttgccatggggcggcctcagccccggggctgcatggccgccggtcgcgccttgcaagggccagcaggggtaagggcgccggagcagcgcagacgccggcgggcgggctgggacggcgcgatctcggccccacttctctcgagcgggcgccgctctactcagcgctctcggcgccgggtgctccgcgcctttagctgaggccccgcccctgccgccaggcccctcccctgacccggcccggccgggcccgcccgggccccagcctcactagcctttcctggcgagtctgggtcctcagctacgcgggcgtgggagcgggcgcgctgcggggcgcatgagcaggtgaaggtgaagttccactataatcgccatcagcgctctgagagccaaccctcacaaaccggcagtctaaataaaagctgcgcttgccgtgcaaacactgcttcaaatccggtatccgagcccttcccatttgcaactgaaggccgcccctcgtcccctcccagggagagatttccaagaggcttgctggggccttgcccctcctcccccgccccggggaacacccccaccttttttccgctcccaagtattcttgcctcaaggacagctagtgcgcggtcagcagagtgcgggaggagctggctgcggctccactccgcgcctccccgcgggcgattacgtcgcggcgtggtcctcgcggggcgcggaagacccagacttcagcctcgccacgcctgcccggagctcgaggctcccggacccccgtccacccctgggacgtgaggagtgaggctttgggccaggctgttccccgaggcgcgt

SEQ ID NO: 1056 - DNA, 25962 bp, Homo sapiens
cctcgggcgcgcgcgcgcgcgcgcgcgctccccgcccccagccccggagcggctcgcggccggctccgcgccgcatcgctcgggtgcagcgcagctcagcgcagcgctgcggcctttcggcagccgaacggccgcggcaggtgagtctgggcatgaaggctgggaggagagctttgaagggaagctgggcgcggggcgagaggtgtgggggtcgctggctgcagctttgttcctcctacacttcacctttggatgcaggaagaaggccgaactgctggagaggtgggagtggaggtgacctttactgtttggggctgggggagagcgctcagggcgcacccaggccccccgagccccccaagcccccccattcccatctgtggctcccgcagagggaactgggcctttgggtgacgtcagaccctggatctggagcctgagctttgggccctccatcccccccgccagccccacctggcgttccctggaaaccggccttctggagatggcgtgcgcagccggggatgggggcgactggaagggggtgcccgtggcttcctttgggcctttccttccaactagcgcctgcaggtggacccgggttgacttccctcacctccctcgggcggccgacctttggatggcggacctcagccgccccagggttgcgaggcgacgggcgcgctggcccaggccaccaggcgggctccatcagggctttgggtggtgagttgggggcgccggatttggctcatttcaacgctggccggaggtcacgaggatggaggtgaggtgtttgtgaaccgatccttgtcctccgcctcggggagctcctggtctgtgggttgggggaaccaagtagagactcggactgagcattcactgtcacaggcggcttaaacaagtaatgtcccagcttcccgatggggagatcagtgagggcctggcagactttcccagggacacagagagaaagggaggcgacagctagcgaataggagacttccagaggtgatgggatttgggtgggaggagaggcaagagagggcattccaggagaatgtatgggcaaaggcacagggatgaaaacgagcacagctgttgggggctgagcctgggagctcagccatgtgactgcccatggggtggtggagtctggagaaatttgcaacctgtcccctacatgttctgcctcacggagcagggctctgaaagagggagatggttcttgcaggggcatgattggcagagagattttgtttggggctacacaggtcttgctaacttaggtttgttctgggcttggtgagccttagggcaaagtctctagagctgagagggggctgtctctggtgaatgggcccctgaaagagggtcttaggtttagcaaaccccttggagagttagtggggtcccaggaggggagttctagagagagaccttgggctctgtggctgtttctttaaccgtttcctgagtggccacctccaagcaagttccccaagtcacctcccctctctgggcatctctttctagcacctttctctagagatgaaataataggactaagtagtgacctcccttgaggatgctccttgttctagtttagagcatcccccctttcttctccctcttccttttcctttcctcccctatccctctgcctccctgtccctatccccaccccttgccccccacagcatttcctttacaggctgcacttccttccctgctgccagccaggagtttcggaaggtttcctggaggaagtgtgatacagcaggtttgacagcagctttgggcttaatctgattgggggagggcgttaattgcctccctcccacccattgggaaagtgtccaagtcttaagcaagtatatggattgactgtgctctgtgctgggtccctcctggaaactccatccaggagggagtgaggagattatgggagaagacgtgaacacttagtgcccaatgactgactcaaaatgtatgcagcgggatgcagagcagcgatttttggaaaggcttcccagaaggggtgggatgtgagaaggtagcaggacttagaggagctgatagtgctgccaatttaggggcactggaagcagagggggcggctagagatgatctcctgcatgaggctgggagtgtaggaggcaggtcaacctgtgagcagccaaaggtggtgggagggaggtttgtagctgactggcacaaagccttgaatgccaggcaaagatctgtaggaggctactgaatagtcatcagtaggacagggacagcatggccaggagactgctgttttctgaggattattcatagttctgggatttcagggcagaagatggggctaggagtgggatgaggggattggaggtagagcaggagggggaaacttccatcttagcaggttggctctgggcagcaaaaaggaatcaccatttctgtgccagggatgaggggcccatactggtgagcagggagccctggagttagccccaggactctggcctgatctgaagccaggcttgaccctcgtctgctgccagaggcctcagtctccccactgtgggggcttctgtcctagcttcacaataaggaatggaatacattatagttagggtttcatgaacaaaattcaggtagtaactgctatcttattgataattaaggtgtttccctaggcctacatctttggagggatatgtagcccttatccccattataaaagattatcagttgagcagattgctaattcttctgttttgtagtctaagaactttggtttggccggcgcggtggctcatgcctgtaatcccagcacttggggaggccgaggcgggtggatcacctgaggtcaggagttcgagaccagcctggccaacatggtgaaaccgtgtctctagtaaaaatacaaaaattagccaggcatggtggtgcacgcctgtaatcccagttactagggaagctgaggcaggagaatagttcgaacttgggtggaggaggttgtagttagctgagatcgtgccactgcactccagcctgggcaacagagtgaaactccatctcaaaaaaaaaaaaaaaaagaactttggtttgcagaggccagtgattgctgtcttcccctccaaccccccaccccccatttcaaaggcttcccagaaacaagggcagagaagcctggagccttccatttctgtgaccctagtcttttaccaccctctcaagccccagattctctctgccctaacctttatatacaaacaaggcagctttgccctctgctctggtttctgctctgaattattcatactttgctgcactgacttctctggaactgtaagcagacttttgggagattgtctgggaccagggacaggggttaggctggagcccggttagggagaagactcctcctttgaggcccctatgttctagttgttttctcctctccctctgcttccttgttttcctggaggtctttagtgctggaccacagtctcccactccatgtcccattgtctcaggggaggtagtgcctctttcagtcaccattttaaccaactacatctgaatgtggtcctcattggcatgtggccacctctgaaatcttaaactctagtatttctctctgaccacagtctaactaatgctttatgtgctctgacctcaaggagacctctagttctcagacacctccattttctccatctcatgaattgcctcttccgtgttctttctgaactccatgccctcaaccactttgccactttgcctgtgtgtcacccgagctgccaggaagggtctccagtctcagccatcccttcatcacttatagaaacccctctcctcattcccatcagttcccctttctattccatgggaggagtattccaaactggactactctccccaggccctttgctcatgtagagggtggttggggtgtgtgtgggggaggtggaaccacccccatgttttcccgaggcggagcttgcagtgagccgagatcgcaccactgccctccagcctgggcgacagagcgagactccatctcaaaacaaaaacaaaaacaaaaacaaaccaaacaaaaacaaaaataaaaaaacacaaaagttagccaggcatggtggtgcgcacctgtagtcccagctactcgggaggctgaggcaggggaattgcttgaacccaggagacggaggttgcagtgggccgagatcgcgccactgcactccagcctgctgacagagagagacgctgtctcaaaaataaataaataaaataaaacacttcctgattgccatatcaacttgtcacctgactgcttcatggccatggatattgttgacccagtcgaccagtcattaaaaagattgagatagatctgtattcattaacatgaaaaactttcacgagatattgttgagtggaaaaaaacaggttataaaacaggatgtgtggaatgatctcatttttgtcatatatgattctatatacgttaaaaatgaaagccaacaaaatccaccaaacctaaagatcagactgttaaaggggtggcatctgagaaagtggattttgggaagacttttctactttatgcacttagattttttttttaattgcatatatttttacagatagctaaaaagcaacatattaattaactaattagtttagagatgaggtctcactatgttgtccaggctgtagtgcagtgactattcacaggtgcaatcatagctcattgtagcatccaactcctgggctcacaatcctcccacctcagcctcctgagtagctgggactacaggcacatgccaccgggctaggcatatttaaaaaacctttaaggccatttttttttttgagagggagtcttgttctgtcccccaggctggagtgcagtggcacaatctcggctcactgcaagctctgcctcctgggttcatgccattctcctgcctcagcatcccgagtagctgggactacgggcccgccaccaagcctggctaattttttgtattttttaagtagagacgaggtttcaccgtgttagccaggatggtctcaatttcctgacctcgtgatccgcccacctcggcctcccagagtgctaggattacaggcgtgagccatcgcacccagcctttttttttttttttttttgaagagaagaagaataaaatccttcagtggctcccgtgacactgaggacaaagtccaaatactgcccatggtcttcaaggccaggatgacctagccccatttacctttcaactccattttgcctttcctttgctcccttcactttgagattcatccttcctctgcctctttcgttccttaagtatgccgtgctattgctcttctgactttcacacctgctttcctgattctctttccctggccaactccctattccttgttaaaaattcagctccaggccgggcgcggtggctcacgcctgtaatcccagcactttgggaggctgaggcgggcggatcacgaggtcaggagatcgatactagccgagaccatcctggctaacacggtgaaaccccgtctctactaaaagtacaaaaacaaaattagccgggggtggtggcgggtgtctgtagtcccagctactcgggaggctgaggcgggagaatggcgtgaacccgggaggcggagcttgcaagtgagccgagatcgcgtcactgcactccagcctgggcgacacagcgagactccaaaaaaaaaaaaaaaaaaaaaagattcagatccaatatctatgaagccatccttgactcctgtaagacagaccagggaggtgttctgtgttaccacagctttctgagtctgctctcccagagtgctcaggctgtgtcagaattgctccttgatttagctgggtcctgtacgcttatctcctccctctcaccttcatcttgtctcctctatcacagagaaaattgggctaggtgcagtggctcatatctgtaatcccagcactttgggaggctgaggcgggtggatctcttgagtccaggagttcaagacaaacctaggcggccaggcaccctggctcatggctgtaatcccagcactttgggaggttgaggtgggtggatcacgaggtcaggagttggacaccagcctggccaacgtggtgaaaccccgtctctattaaagatacaaaaaatttgccaggtgcgatggcacgtgcctgtaattccagctactcgggatgctgaggcaggagaatcgcttgaacccaggaggcggaggttgcagtgagctgagatcatgccattgcactccagcctgggcaacagggcaagactcggtctcaaaaaaaaaaaaaaaaaaaaaaaaaaaaagagactaacctgggcaacatggtgaaaccccatctctaccaataaacaaaacaaaaaattagctaggcatggtggcacgcatctgtagtcccagctacttgggtggctgaggtggaaggatggattgagtgtaggaggttgaggctgcagtgagctgtgattgcaccaccgcactccaggctgggcaatagagtgagaccctgtctcaaataaaaaataaaacaaaattgaatgcctgtgaaaataaaataataaaacagaaaattgaagcagacatccaagatgctctcactgcccatctaagacctcaaacctgcctgcatctgcttggatcctgttcggcttcccacctgttaggatcaaggcttgtccacctccttgcactggtgcccctgtgtctccctcttcacgggctttgtctatcaggtaacatctgtctctactgtaattgcaacctttctatgtatcctacacatctctggcttatttccacctaaaatgacccccagctgcagccctccctgggccctctccctacccccatatcctacccaggtggtaccctatctctattctctctgtatattgtcagccaggcttctttatcactgctgtcaccaccaaaacgattcttgctggattcacagctgactcgatgctgttagtgtcatgaacgcgttagtcccggtagtgccatcctttcacatgggagccctcagtggcattatcacatttgtccaatctctgcccctggctatggagactccacgctctctgggctttcctcgtgtctcatcagctgctccttctcattcttccccaactatcctattctgcttgccttttttttttctgcttaactttcttgactttttatttttttgaataggtagtgcatttatatatgatttacagttcacaaagatgttccaaattttgtcagttctaagatgaacattttgatatttctgaaaacattttcatgtctgtgttttaaaatttctggcatcttacagttacaaattggcatttttatttttattttttggagattgagtctggctctgtcactcaggctagagtgcagtgtggcacgatctcagctcactgcaacctctgcctcctgggctcaagcgattctcctgcctcagcctcctgtgtagctgggattacaggcgcacgccgtcacacccggcttatttttagtagagacagagtttcactgtgttggccaggctggtctcgaactcctgacctcaagtgatccgtccatctcggcctctcaaagtgctgggattacaggcgtgagccatggtgcccagcctgcaaattggcaatgttttttcttacttttggtcaataaaataatggtctgtcttaaaactgatgatgtcatcaattatatggaaatggtataaagttatatagtaaatattctgcttcccacctactctatatccattcagttcctttgttccccagagagccacaattaccatatttttttcttgatatccttccagagattctttgtgcatatattgtcaaatacagatatgtatatttccccccactttttattttgaaaaatttcaaagctacaaaaaagtttaaagaatagggcaatgggctgggcacagtgacctcatgcctgtaatctcagcacgttgggaagccagggcgggtagatcgcttgagcccaggggtttgagaacagcttgggcaatgtagcgagacctcgtctctacaaaaaataaaaaaattagctgggcatggtggcgcacacctgtattcccagctacttgggaagctgaggtgggaggattgcttgagcccaggagttcgaggctgcagtgagctatgattgcaccgctgcactccagcctgggtgacaaagtgagaccctatctaaaataaataaataaataaaataatgcagtgaacaactgtatacccttctcccatcaattattaacattttgcaacatttgctttatcttttatttttactttttttttttttgagatggagtttcgctcttgttgcccaggctgcagagcaatggcgtgatctccgctcaccgcaacctccgcttccggggttcaagcgattctcctgcgtcagcctcctgagtagctgggattacaggcatgcaccaccatgcccggctaattttgtatttttaatagagacagggtttctccatgttggtcaggctggtcttgaactcccgacctcaggtgatccgcccgcctcggtctcccaaagtgctggtattacaggcgtgagccaccacgtctggcctatttttactttttagagacaggatcttgcgttattgctcactgaaggctcgaacacctgggcacaagtgatcatcttgccttagctcctcatgtagctgagactacaggcacacaccaccatgcttgtttctgctttatgtatatgtataaaattttttcgcagaaccgtttgaaaggacgttacagaccagacactgcttctaaagaccagcgtgtgtcttctaagaacaaaggtgttctacaggccggcatggtggctcacgcctgtaatcccagcactttgggaggccaaggcgggtggatctcttaagcccagaacttcaagatcagcctaggcaacatggcgaaaccttctctctgcaaaaaatacaaaaattagctgggcatgatggcacacacctgtagtcccagctactcaggagactgagactggaggatctcttgagcctgggaggttgagactgcagtgagctgtgattgtgctgctgcactcctccagcctgggtgacagagtgagaccctgtctcaaaaaaaaaaaaagaaagagagaaagaaacaaaaacatgcacacatacaatacccaagaaatttaatagtgaatagtagtatctactatgcagcctatattcaagtttctctagttgtcctaaaaatgtcctttatagctgtgattttaaaatccaggacctggttgggcgcggtggctcacgcctgtaatcccagtactttggaaggcggagttgggcggatcacgaagtcaagagatggagaccatcctgcccaacatggtgaaacccagtctctactaaaaatacaaaaattagctgggtgtggtggcgtgcgcctgtagtcccagctacttgggaggctgaggcaggagaatcgcttaaatctgggaggcagagcttgcagtgagccgagatcgtgccactgcactccagcctgggtgacagagtgaggctcttgtctcaaaaaaaaaaaaatccaagatccgggcctgtaatcccagcactttgggaggccaatgcaggcagatcacctgaggtcgggagtttgagaccagcctgaccaacatggagaaacgccatctctactaaaactacaaaattagctgggcgtggtggtgcatgcctgtaatcccagctactccaggctgaggcaggagaatcgcttgaacttgggaggcggaggttgcggcgagccacgattgcaccattgcactccatcctaggcaataagagcgaaactccgtttcaaaaaaaaaaaaaaaaattctgccaggcttccccattgcatttggttgcatgcctcttttgtctccattaatttagataaattccccctgccaatttctgtctttcatgacattaacatttgtctcgtagaatttcccacaatctgaatttgtcggattgttttttcataattattttcagattaaacctttttttggcaacagtattcatacatgaccttgagtccttctgtgcacagcatagcaggaggcacatgatgttctttctttctttctttttttgagacggagtctcactctgtcgcccaggctggagtgcagtggcgcgatctcgtcttactgcaacctccgcctcccgggttcaagcaattctcctgcctcagcctcccgagtagttgggactacaagcacgtgctaccatgcctggttattttttgtattttttggtggagacaaggtttcaccatgttggccaggctggtctggaactcctgacctcaagtgatccgcctcggcctccctttttttttttttttttttttgctttgtttttttgagatggagtctagctctgtcacccgggctggagtagagtggcgtgctctcggctcactgaaacctccgcctcccgggttcaagctattctcctgccccagcctctggagtagctgggattacaggcgcccgccaccacacccagttaattttttgtatttttagtatagacagggtttcactgtgttggccaggctggtctcgaactcctgaccttgtgatcctcctgcctcggcctcccaaagtgctaggattacagatgtgagccactgagccaggccctccctctcttttaaaaaataaaataataatgtcactttggactcatggattaataataaaaaaaatctatgtgggccgggcactgtggctcatacctgtaatcccagcactttgggaggctgaggtgggtggatggcttgaggccaggagttcaagactagcctggccaacatggtgaaaccctgtctctactaaaaatacaacaattggccgggcactgtggctcatgcctgtaatcccagcactttgggaggccaaggcaggtggatcacgaggtcaagagatcgagactatcctggctaacacggtgaaaccccgtttctactaaaaaaatacaaaaaaattcgccaggtgtggtggcgggcacctgtagtcccagctactggggaggctgaggcaggagagaggcagagcttgcagtgagccgagatcacgccgctgcactctggcctgggtgacagagcgagactccatctcaaaaaaaaaaaaaaacaattagctgggtgtggtggcgggtgcctgtaatcccagctactcgggaggctgaagcaaaagaatcacttgaacccaggaggcggaggttgcagtgagctgagatcatgctgctgcactccagcctgggcaacagagcgcgactctgtctcaagaaaaaaaagagagaaaaaaatccacgtggttattacttttgatagtctaattgtcccaaatttggttggtggtagccctttcagactggttcttgtgtccttttgacttgcctccattagttattgagtactttcttctttatgataccacaagatgttccaggctaaccttgtatttccttttcctggcttgggaccagccatatatatttttaaaattctgtgttcatactgatacctccgctttgaatccaacaccacaaggctctttcttacctttccgcggtctgaattgtatctcctacagtgagaaaccaccttccccaaataatcagcacactgattcatttgccctctcctgtagtatacgggcaaagctttagagtcgtcacagcagtaccagcagtaagagtaaacttgctaaaattcatgacttgtttgcagtttctttttctttttttgagacagggtcttgctctgccgcccgggctggagtgcagtggcgcaatcacacttcattgcagcctcgacttcctgagctcaagtgatcctcccacctcagcctcatgagaagctgggactacaggcgcacatcaccatgtcccgctaatgtttttttttgttttgtttttgtttttttgagacggagtcttgctctgtcgccgggctggagggcagtggcacgatctcggctcactgcaacctctgcctcccaggttcaatcaattctcctgcttcaacctcccgagtagctggaactacaggcacatgccaccacgcccaggtaatttttgtatttttagtagagaacagggtttcaccatattggccaggatggtcttgatctcttgacctggtgatctacccgcctcggcttcccaaagtgctgggattacaggcgtgagctaccatgcctggccatgtttgtattttttgtagagacgggggtcttgctgtgttacccaggctggtctcgaactcctgggcccaagcgatccatctgccttggtgtctcaaagtgctggaattccagtcatgaaccactgcacccggcctgtttgcagttatttttgcccttgaggtttatctttctaggagaacataggagaacccagaattactgtgatcaaaagttacttgggctcttttttttttcttgtctgtgagattgttatcaatttaaagtatagttagcttgatttgtttttgtttcagttttagagtttgcttttctttttggtttaagtttttgaaatatggaagtcattttatgtgtacaagtatattaaaaaaacttattaataagtatataaagaatggaagtctctctactcatcgtagcccttccgttatgtaggtgactatttcattactttctggttgattcttcctgtgtttcttttgcaaaaataagcaaattcatatgtgcattcttacttcccctttcttacataaggggtagcatatgatttacactttttgtgctctgcttttttttttttacttaatatatcctggaaagcattccacagcagtttactgagctcatctttattcttttttttttttttttgagacatggtttcactctgtcacccaggctggagtgcagcagcgaaatcttggctcactgcaacctccgcctcctgggttcaagcgattctcccacctcagcctcctgagtagttgggattacaggcttatgccatcatgcctggctaatttttgtatttttttggtagagatggggtttcaccatgttggccaggctggtctcaaactcctgacctcaagtgatcctcctgccttcgcctctgaaagtgctgggattacaggtgtgagtcaccatggctggcatcttttttacatctgtgtaatactctattgtatgatgcacctcgtatattcaaatagtcacatttaggttgctttaagcattttgctaatgcaaatagtgtcatgtcgaataacgtgtgtgtttgtcatttcttatatctgggtaaatgactaacaggagcaggattattaggttaaaaggaaaatatattcttattatcttctcttccttttttttaatatgaaaagtataacatacagactgttgtacatcttgctttttttaactactcatctttttggagacttttgcatatcagtacccagagaactgcttcctctttttaaaatttttaacagctgcaaagcatttttaaaaatagctgcggaacagtccattgtatgactaccattggtttaatcagtcccctattgatggtttctaatcctttgttattcaaaacagtgccgcaattaatgcacctgtgtatgggtatcatttcctgattgtctctatcatacccttctcttctctttttgtggtagatgttactgggtttttgtatctgtatttgatcccatatcacaaaagagtccgaagattgtaattgcccgatcttttaatcaggtccagaagaatttgactggaatgctagaagtttgtgtgtgtgtgtgtgtgtgtgtgtgtgtgtgtgtgtgtgtgctttttttcctttgagacagtcttgctctgttgcccaggctggagtgcagtggtgcaatcatggctcactgcagcctctacctcctggactcaagcaatcctcccacttcagcctcctgaggaactgggactacaggcacgcaccatcgtgcctgcctaattttttattttttgtagagatggagtctcactgtgttggccagactggtcttgaactactgggctcaagtgatcctcctgcctcggactcccaaaatgctgggattacaggtgtgagccactatgcccagcctgaagtttttattttaaagcaaacttctcatggaagtctaacacacaggagattgcacaagttgtaactgtatgcttggagaatgttcacaaaatccatacctttgtgtatccagaaccccgaccaagaacagatgccgggcccccagtcgctgccccatcaagggtaatactatcttgacttctaacaccatagatttagtttttcctgttccaaaactttaagcaaatttctgcccagcttttaaatgttgcattgccttagcacttggttgtggaccattttctgctgttgactatataaatgtccaccaaagtcactgttctaacaaggtgattgctgcttggtttccttggccttaacttgccagtgattacttagcatgggtcagccaggcctcctgctgaactcccaggagcagagcatgtttgtaccctccagattcctataagacgccctgtccaggtgtcccccagcgtctctaccctgtatgtccctagcacagctgctcgtcctcccctggaacctccgcctcatctcacacaggcttgtcatgatgggtctccaccatccactcggggttaagtgggcagggagtcttccaattgctccctttcccctactccttaaaaccaagaccccttcaaacttgtctcctaagggtctcaggaagcacatcctgcccaccttgcctttccagcctcatctgctgccccctcatttgcactctgctttggccatagtggctttctttcccttatgatgggtggctcatgcctataatcccagtgctttgggagtccaaagcgggaagattgcttgaggccaggaatttgagaccagctgtgcaacacagcaagacctcctctctacaaaatattaaaaaattagcatggtagtctgtccctgtagtctagctactcaagaggctgaggcaggaggatggcttgagcccaggagtgccactttactccagcctgggtgacagagtgagaccctgtctaagaaaaaaaaaaatgtgaagctccttcctagtaaggaactgtccctgtacgatgctttcccatctgcctagaaggctgttttgcccggggaactcctcttcatgcttcaggtttttactaccacttgtatttaatttccctgaggctgggtgcagtggctcatgcctgtaatcctaccactttgggaggctgaagcaggtggattgcttgagcctaggaattcaaattagcctgggcgatatggcgaaacttaatctctacaaaaaaatataaaaattagctgggcctggtggtgcatgcctgtagttccagctactcaggaggctgcgcttggaggatcacctgagcctggggaggctgaggctgccgtgagctgggattataccactgcactccagcctgggcaacagagagagaccctgtctcaaaaaaagttttttaattaaaaaaatttaatttccctgcctctccagaccagattagatcaccaggacatgatgtgtatgttttcacggtggctgtgcttgccttttgtatgatttactgcagaggtgattgactgtttcatggggagagcagggaccacatctgtctcactcattcttccagcaccatataagtgtcctaataaatgaacaaaggcaaaaggagcaaagggaggctagcctgtgaccaaggccgaggctcagtctgtaattcaaggtcaaggaatagaatgtcacttggctttccctgtatgggatcccctcccaggttcctttcctacccttggatggggttttcagagagtagattttgtgccttgaagcagagggcgggagcagctggtaagatgcagctggtggaagggtggctctgggaggaggggagctgcctccattgcattcacggcactgtgggagtatgtgctgggtcctgtcctggggagcttgcagcccagatgaggagtagagagggactgggttgggtgtggccctgatctcatccttctctggcttttctttccttgcagttcaggacaaagaggtgtgggcaggccactgggccagctggtaacatcatggcaggtaaggagaggggcaggctgtgtgggtaggacatgacagtgagcatagcgtggatggccctcttcctggttcccttatctcccctagtctttggaggccaggttctttccatcttactgtccccaagctttccccactctctccactgaggcctgtctgagaacttcaacatgacattgtctagccctctgtcagatctttggtcctatggaccaggaattgagcaccttgatgtccttgtcttactgtccatctgcctgattagctgcatgagtggctcagccctcctcccctctgtctctattgctttctaatactctgaggccttttttatctggttcagaaggctcagaggtgtagaatgccagagctggagggaactttagggaccgtgtagcccagcccccactccagcaaataaactgaggtctagagaggggcgatgatttgccccagagcacaaatgctgagtggaggctggaacccacgtctgtagattctcacacatccgcttcttctgcctggagctgcccccactgagagggtggtaccttgaggccctgagacagtgtcactcagaattaaaaaataataaatgctgtctgtcaaggtgacattgttttttattctgagtgacactgtctcagggcctttggctactttgggatcatcacagctgacccggggaggtagggacggctgggtggggaaagcagagtggccggtggccacaggggccaatggggcagcacagccaggggaaggatgggcgtcttggattgtcgggtggaagactggaggtgatgttgtgcaatgtgtctcatccacagagaaagtgaacaacttcccaccattgcccaaattcatcccgctgaagccatgtttctaccaagacttcgaggcagatattcctccccagcatgtcagcatgaccaagcgcctctactacctctggatgtgtgagtgccatgggatgggggtgggccagggtggctggaggaggcaggaagactgggcgtgctgggcagcggggtggggtgcccacaggcctgactgtccttcagtcccacttgtggcatatgcatggaccataagtcttcccctgccaggctcccagaggcttcttccatgggccacctccccgactgggcctcagtttccctcaacctcccccatctaggcctctcttcccttccttcccctccaccctcctttcacagagcatctggacaggggtccctctctgcagtgtaatccctgtcttcttgcttcccctttcccttccactggagtaactttccagggaacctctggggactgtcaggacctcaggattctggatttggagaggaatccttccctcaaagccttatttgtcttgctttctctggaagattgctcaaagagaggaggattcagctgggagttgggagctgtgggatcaagtttgcctggtcactgtgcttgccaagcagcaggttcctcatttgtaggaagaaagtattggcttggcgattgctgtggttccatgcagctctgtgttgggtggtctatacctgtaagagtctaatgtcaggcacagtggttcacacctgtgatcccggcactttgggaggctgagccaggaggatcacttgaggtaaggagtttaagaccagcctaggcaacacagcaagacccctgtctctacagaaaataaaaaaattaggcctgtgtggtggctcacacttgtagtcccagctattcaggaggccaaggcaggaggatccaatgagcctaggagtttgagaccagtatgggcaacatagcaataccccatctctttaaaaaaactagctgggaatagtggcacatgcctgtagtcctagctactcaggggactaaggtgggaggatcacttgagcccaggagttcaaggctgcagtgagctatgatcatgctactgcactccaccctgggtgacagagtaagagcctgcctctaaaaaaataattaaataatctagaattctttatttagaaaaccttagcatcaatgttctaaggttttaaggctgagagtgtaaaggcctcatttctggtgatctgtagcagggggtgggaaaggtgtcttcttggggggatgggacttggctgtgctgaggctagttagaaggtacctcttaggcatgtgagggggaggcaagctggctatcctgtgctgggtgtgagccccaggatcccaagatacccgcaatgtaactgcagttgggttctgctatatgtgacactgccctgagtgaggcctgcacttagctgcctacctgggcagatgcttgcatgtgccgacaaggtggtaaaatatactgtctttgcagcaggtccctcatggcatggtaggaagaggatggggcagacagactcagtttcaaggcctggcttggcctttgagtgaagaagggatctcccaccatgtaacctgagagaaggggggatgggacaggtgtgggtaagtctgtagatgttgggaagcaaatgaagaagttacctctgatggcttccattttttccatcaaatatgatgtagtgtggagagtgggctcacaacgaggccatgtttgtcgacggatagtgaggacactctccaaagaaacccggcccctaagatttctgggccacacacaaggttcatttgacattggctgatgtgaatttacagtcttcctcatggggtccccttttttcttagcaacattcagctcaggtacagatgagaattatgttcatctagggtgagtgtggccagaaggcagggcaggggagggaataagaaaatgagtaatgaattatggaatctaagctggataaggagaagagtgaagacagaaagaagctgatggctagagagagagaggggctgagctcatgggtatccattccagagaggaagcagaataattgcagcagaggtgtttgagcaagggagctggggcaggttggactggggagagatgtgaaccaatataataggttagtgtcttttctatataaagagcaaataaaatcagttttaacaccaagcctccaggagattttggggcaatgaacagggatagaggaaatacagctgaaatgtacaggaagaaatgcccacccatgaggggccctgagatgggtgacacggtggtcaggccaggcttgtaggtcactgtgtctgacctgggctctgggaactcaacttctgggaacatctcatccagaagctggatttaagggctataaatatctccttaagtcctcactaggcacccgcaggtgctttactcccaaggaaatgtatataacccttgaggtgcttaagggttctattcagaagacaggaccacagatgcctggctgtttgaggccacggttgagccctccttcctttgtttattcagcaggtctttgtggacttagctttgttttcaaggaagggagtgccctgatgttagataatgatgtgctgcacagacccgcatgtgtgttagtaccagcatcacttttatctgtaaatctttgaggtccctgctggccgtgactcagtgacactgtgcctcctagttcagctagatgaggtggggacagaggggggggggcctgggtcctgttcttggggaacttttagtctggttgatgggctgggatttatatctggggaaccttgagagcagcccaggtctgtagaaggtcagagggatgggagatgatgaggttgcagtagcaaaggaagacttcttcaaggagctggcatgagtgttatctaagaaatagattagatagctgggcactgtgactcacacctataatccggcactgtgggaggccaaggcgggtggatcacctgaggtcaggagttcgagaccagcctggccaacttggcgaaaaaccatctctgctaaaaatacaaaaattagctgggcgtgatggcaggcacctgtaatcccagctactcaggaggctgaagcaggagaatcgcttgaacctgagaagtggaggttgcagtgagctgagatcgcgccactgcactccagcctgggcgacagagtgaaattccatctcaaaaaaaaaaaaaaaaaaaaagaaatagattagataaagactgagattccagccgccaatgcctgccccatttaagtgcaaggtagatggcacaatggctagaagagatgtttccacaaggccttttatttttccctttccatgcccatatctcgaaagagaaagtgtaaggtcggtttcccatgtcttgggcttggtgattgctgtgagtctgggagggtcaggggctgaagccattcttgacaaggacaagagcatttctaccaccctgaggctttggggcccttcaaaggggcttgctgggcagaagctctgggttctggaggctgtgctctccagatttctcaggagtgggtgctggggttgaggggtgggggttggttcgagctcccagcttgcgttcttacagtctttactcctctgcgtgtgtatgtgtgtctcctgtgtctctgtatgtatttgttggtacgggttgtgggtcttttgtgtgggtgtgaatctgtgaatgtgtctgcatctctctgtgcttgtctgcgctgttggcctggcttgattgtgggtctctgttgcgttactggtgtgtgtgtgcccatgtccgggtgctcatgtgtctctctatgggcctgggtgtctgtctctatgtgtgcatgtgctcctgggcctgcagtgaacagcgtcacgctggccgtgaacctggtgggctgtctcgcgtggctgatcggaggcgggggagccaccaactttggcctcgcctttctctggctcatcctcttcacaccctgctcctacgtctgctggtttcggcccatttacaaggccttcaagtaagtggttggtgctatccgcagtgcctagccgtctctgcccatctcccctgtctcttctccatatcttttctcacttctttttttttttttttaccctcccccaaactcactttcccttgctcacctttggctcagattgctaggtagggcctgggctttctgggggtgccaagttgaggtgagagggctgagagttagtttctttcctcctcactctacccttgggtgggggaaatatagacagaccaggcctattttttcttctgtcatccccttcctcaggcagctgcatgttaaattttgcctgtggggctgcctgtcttggtggagctgcccatcctagtacctgtggggctagccgacttggtgccaaggacaccatctatccatgtgccaatgggaccagccagccatgtaccattgacactgttcatgtgcaatgaggtcatccaactgtgtgccaaagggaacacccatccacatatcagtggggcttgctgtcttggtgccagtgggtgtctacctagtgccaaatggcattttcaatctttgtgccaatgtgactattcatcaatgtaccaaggctatctgtcttggtgccagtagaatatccatctcaatgctaatggggccttaaatctctttgtgccaatcaggccatccatctaagtgccaattagctactgttttggtgccaatagggtgtccattctagttccaatgagactttctatctctgagcctatgagaccatccatccatgtaccagtggagctagctgtcttggtgtcattgtccatccccttgacaatgagactatttattcctgcctcagtggagccatctatttctatgccaatgaggccgtccatccatgtaccagtgggtggtctgttcatgggaaatccctccctgtgtaatgttgcaacacacaggtctaccacgtggaaacttgcaaagatgtatgggtagaactaaccccttctgacctctcaattaaggcctttaaatgtcttctgtccattatgcacttaaacttggaagggcttgggggccttgaaggcagggaagccctggccctctgcccaggtgacgggagccacctcctctgccgcaggactgacagctccttcagtttcatggcattcttctttaccttcatggctcagttggtcatcagcatcatccaggccgtgggcatcccaggctggggcgtctggtaagaggcaggggtgtggcctggggctggcaggggtggcgttgtgggtgtatcttttgcttacctttgtgtgctaagctgtctagcctatggggcctgagtgatgggttgttgggagagtgagaggattcgggatagtgtagtagtacaaccatagcatcagagggaaggagaacctggcagtggtttcttgggggctgaggggtgtcagggattataggaaaacctgggggaagaaagtgttgtatctgaagagcacctctgagccacagggatggggtcttcttgagccactggcacaggttctttgggtatcagtaagatggtccctctgcatccagtgatatgtttcctccctgtggcaatgagacggtcccttcctctagcggggggctcctgggcacctcttatcctgcccgcagccccacactggcctcttcctgcagcggctggattgctaccatctccttcttcggaacgaacattggctcggcggtggtgatgctaattcccactgtcatgttcacagtgatggccgtcttttccttcatcgccctcagcatggtacgtggtcccctcaagggtgagaaggtggctttgggaaggggccatgttctgaaacaagccctcctccaagttgcaagaggatcccgaggtcttccaagggactcactctggaatggcctgcaggactctcctacagaggcattcatggggagggagcactgttttttttttacagatgggtcccatctatttcctggatgggctgccttttctctttgattaacccttctttacgctctttttcctacaggttcataaattttaccggggaagtggggggagtttcagcaaagctcaggaggagtggaccacaggggcctggaagaatccacatgtgcagcaggcagcccagaacgcagccatgggggcagcccagggtgccatgaatcagcctcagactcagtattccgccacccccaattacacgtactccaatgagatgtgaaccagccacgcctaccaggtggcagagctggggccattgggacagggggctcaagccacatcgtcatttgtggttaccaagcagggttcccccttcccttttctccttccctactttgtacaaaggaccagagttatatatatatatatatgtatatgtctgtaccccagcccccacctttcagattctgctcttggcactcagctgtgggctgcacgtggagctgtcccgtgcggtagtagctgtgtctgtgtcccctcgtgaaatagtgtgcagtggaggtctcttgtggtgctagatgtgtgtttagagctaaaccagcccccacccccaccctccacctgcccctcttgcctctggcccctctgaccctggcccagggacccctcacggggccaggggaggcatagcagaaagactggccccttcctagggttatgagctggaactgtttctactttcagtcttcctgggaagtaacagtacttagcactcttggtggtgggtgggagggtgggtacaggccagggatattcccttgctcttttgatccctccaggcctcgcctccttcagcctcctcctccctcatctgttccctgatgtcacattccctgtgcaatcttcccttgcccatggtctgtctatctctttcctatgtggcttttctttgtcttccccaaggctgagtgtcccagttttatctgctcctgagactgagcccagatccccaaatctaatctgatttacagttcaaggaagctgatggggagctgggccttacccctgatgtaggaggggcacacagctgggggtgcagagcccacctgggtacctgacccccaggggatgaaaatgcaaggatgagtctgcttgggcctgagagtttgatctgcaggggcaggctcatcttttctctcccctgccttctcctccttctctccccagagcccccttgagcccctctgcctatgtccctctgcctcctccccatgcccccagttgctgtggcttgattctgctaccctgaccccaccatgtgccaggtggcatctgccttactgccttccctgaggagctgggacatgctgggcagttgtcagatgtaaaggcacagctggagcagagggcatgtcagtaatgattggtccctggggaaggtctggctggctccagcacagtgaggcatttaggtatctctcggtgaccgttggattcctggaagcagtagctgttctgtttggatctggtaggacagggctcagagggctaggcacggagggaaggtcagaggagaaggcaggcagggcccagtgagaggggagcatgccttcccccaccctggcttgctcttggtcacagggcggttctgggcacttgaactcagggcccaagcagaagcacaggcccagtcctggctgcaagcacaatagcctgaatgggatttcaggttaggcagggtgggaggggaggctctctggctttagttttgttttgttttccaaatcaaggtaacttgctcccttctgcctacaggccttggtcttggcttgtcctcacccagtcggaactccctaccactttcaggagagtggttttaggcccgtggggctgttctgttccaagcagtgtgagaacatggctggtagaggctctagctgtgtgcggggcctgaaggggagtgggttctcgcccaaagagcatctgcccatttcccaccttcccttctcccaccagaagcttgcctgagctgtttggacaaaaatccaaaccccacttggctactctggcctggcttcagcttggaacccaatacctaggcttacaggccatcctgagccaggggcctctggaaattctcttcctgatggtcctttaggtttgggcacaaaatataattgcctctcccctctcccattttctctcttgggagcaatggtcacagtccctggtacctgaaaaggtacctaggtctaggcccttcttccctttcccttcctctcccctaccccagaactttggctccctttcccttctctctctggtagctccaggaggcctgtgatccagctccctgcctagcatccatgacctgttggatgttacctccaatcagtttcctgtcctacctgcctctttggcttggacctatatggccatgctctggctctacccttgggaagcctgatcccggtgtgtggcccagcttgttcaggccctgggatgctgcatctccaggcaactatgcactttcccggggagagaaccagtatgagaagtgggggcagggcacacattcatctttgtaggaaggtctggcctggggtcgggtgaaggagggcccaggtcagttctggggtcccagtgacctgctttgccattctcctggtgccgctgctgctccctgtttctggagctggatgttccccagctggcagttgagctgcctgagccaatgtgtctgtctttggtaactgagtgaaccataataaaggggaacatttggccctgtg

SEQ ID NO: 1057 - DNA, 25962 bp, Homo sapiens; identical to SEQ ID NO: 1056

SEQ ID NO: 1058 - DNA, 25962 bp, Homo sapiens; identical to SEQ ID NO: 1056

SEQ ID NO: 1059 - DNA, 27142 bp, Homo sapiens
accgcgatatttgggagcggccccgagacgcgcctggcgcgggtgagcagtggaagggggctgggaagctgggttctcgcggcggcgcgggaggggaggttcggggagctgtgtccgcgagcgtgggtccacggctgtctgtgtgtgtccttattttcccctgtgtgcccatgaagctctgtttgcgactgtgcgtgggtaggcggccgtccatctgtgcgacctcactttcccggctgtacgggtggggccgcctggagcaggagggacccccgagccctgagtggagggtttgcatctgtacccgtccagcccgactttgtgctgctctgcgattatttgtccagtgtcgtttaatctagtttaaatgatggccgtgtcagctcctcacactgaacgcttacccgggctgcccaaagtacaaagtgtatttaaaaagttggtaaaattaaaaaaggaaagccatgggatgttggaagtagccctaggcctgccaaaaagtgctgagtgctatttaaaaattaggccaaatcttgtcagaaaagaacttcctgctgtccttgaagtatttggaagcaggtgctagatggtgagcaggagaggttgccaagttggggaagtggtggttgtcctggagcaggggtttccacatctctcacagtggctgggaagtagcaattcgcagtcactgcctttctagtagcccacgtgtgtgagtgtgtgtgttagatacatttatccctcagtatccgcaggggattgctgtatactttttttttttgagacaaggtctcattctgtgacccaggctggagtgcagtggcaggaacatggctcactgcagcctcgacctcctgggctcaagggatcctcctgcctcagcctcctgtgtagctggaaccacaggcataaacaaccatacccggctaatttttattttatttcatttttgtagagacagggtctcaccatgttgcccaggctggtctcaaactcctggctcaagctatcctccttccttggcctctcaaaatgctgggattacaggtgtgagccaccacatcaccctcctgtatactcttttttcttttctttttttttttttgagtcagggtctcactcttgtctcccaggctggagtgtagtggtgcaatcatagctcactgcatcttcgaactccctgggctcagataatcctcccacctcagcctcccaggtagctgggactgcaggcacgtgccaccacgccctccatataatttaaataatctctagattacttataaaacctgatacagtgtaaatgctatgtaaatagctacacacttttttttttttgtggtactattattatattttgaaatggtctctctctgtcacccaggctggagtgcagtggcacaaacatggctcactgcagccttctaggctcaagcgatcctcctgcctcagcctcccaagtagttgagaccacaggcatgtgccaccacacctcactaacttttaaattttttgtatggggtcttgctatgttacccaggctggtctcgagtacctgggtttgctcaatcctcccaccttgccctcttaaattgctgggattacaggtgtaagctggagcagaagcctgggcagccggtagtgaggggctttgatgttaggctaaaggattcaggctcataatggatcttggatccctgcctacccaccacccacttcccttgtttggttctgctttgtcttaggctcagttctcatccttcctgtattgagcttgaacgtataccctgtctggccttgctttccttgctctgtctttagtctggttctgtgccagctccacctttgcccatatagggactggcaggtatccctgaaacctaaaactctgccctgaattaaactcatcagaggagacttaaacatcacaagctgaggctctttgctctgtctgtccctgtctttctggaggatagagaagctgccatttttctggctgtggcttacctgcttggctagtgccctgggatcttgaggctcagtaatcaaagcgtgtagccctataacctgcccacttgccaactctttttgctgctcaggagttcctgtgaattcagcagagcccggggaagtcaggtactacagctacctgtgcaaataggtgactccaacaggttctggttacagtaatagacttactggtttggaatttgatcctctttgcaagcaaatgaaggaatcctgccagccatcacccttcctggaattctcaggttgaactgattggacctcgcctccaaatgttggttaaatgatccactttctattcttcaagtatattaagcacacacatacacacacacaccctcttttttaggaaggtaggtaggtttgatccttagcacagctttgctaagcaggctaagtactgtatttcggactatagtgcctgctgtggggaagcagttgaagtcactaatacagattcctgccccaagtttaactgactgctttctgtaacctgtttcctaggaatgagatcagcttgatgtggaggaggttcaggggcctcagagataaaatttggcttctggttttgcaggaatctacctatcctagcaccagttggctagggtgggacagggtcagggtttgcgatctggcaggtaggtttccctggagaataaagaatgtgcctccatcacctaccaatgatgtgttctgggaagaagctggctggtagcccttctgtaccttgtcagattctaacagggctccccactccctggggtaaactcagttctccaactctggccaagcattgccctggttggggccctgcagtggagcagacattgagattactggcaaatcaaactttgggtgatcttgccctagggaaccagcctgtgcttaacccctgctgagaagtgggataatgcagccaaacatgatcctcagcccacgtgggttgtgctcaagtgctgaaggcaaatcctgggcagagaggctagagagccaaggggcctgtgagtgaagaggagataggcccctgtggatgctcagccatggaggtagccattggacaactcaccagcgctgcttcctgggcagctgcctgggtttcccttgccatgctgattcttttttgagtgcatcttctaggaccttctgtcttggaaggagagccccttactgctctctttcatgtattgactcaaagtttctgctggaaggagcttcagagatcatctggtcctacctctgcatttttcagatgaagggacaggtccagggagggaatgaccctggaccagggtcactccaggtcaggagcacaccatggtcagggcccagggcttctgcttcacaggctaggtatctgtcttctgctcacactgccttggagggtatagttattcattcagcacctgttcaggactgccggctagtggactgctggttggcaattagacccggtcacacattcagggagcttgctggtggagggagaggcaaggaaactgatgtgttaattgagtctgtgatcaccaaaaaggtgcatcccagggaaggactgatctcaaataatttcagacaggtgtcattcctgtcttctcaaactcaacctacagattccccagaggcagctactgtgttttccacaattcctttgcatggtgttctttgtaatcggtcctcagtgatggttgctgatgaagcacgttctgctggcccaacccgccacgtgtaggttttggtgtccatcagccatattatcatgagtgcacacttctagcaacgtctgagagccagaggaagaagcaaaccagctaatctcctggggtggcctgcatcccctttatgctggtttcttcctgggctttgatttgtacggtggtgcccatcttgattaacagggacagggacagagaggcaaatctcttggctccctggagcacccaaacctccctgttgcccagggttccacctcatgagcatctttggaacccatcccttcctgccgcttcctttcaccagtcagcccagtccaccgcagcagctcctctcgccctccagtctctccactaacagggtccctttgacactgtcaccaggtgccagcaccgtctttctaaaaccaaaactcctcaccctggccctcgctgcccacggcattctggcctcaccctgactttcagtctcactttctgcccctctaccaccccccatcacagtccggcctcactagtaagccactccctgttccccaacctgccaccctcctcaggaccttcaccttggcaagattgttccttcctttgaagtgatttcttcctgtctctgaaaaactaactcatccttcaggactcaaccccaatgtcattttttctgggatgcaatctctgacttctagagatggtcaccctgagcagccacgcacctggtacagcccttccccacagcactgcatcattcccttgtgactggcccatgtgtggggaaggtgtctcactttcttatcaaactgtgtgctccctgaagccaggactgctgatcccttccgctgcctcagcctctggcctggggcctaatacgtggtgctccatacattctggtcgactgtatgaatgaagggggtggcccttgttctccttttagatcctaaatcccgacagctttatagagcccaggcctggcaggctcccagaacttgaagccaccagaccccacatggaaccaaaggcctcctgtccagctgctgcacccttgatggagagaaaattccatgttcttgtgggtgtcacggggagtgtcgcagccctgaagttgcctcttctggtgtcaaagcttttggacattcctggggtgagtatcctcaccagataagcatggcagcctccggcatgggaggccggtgctcccggggatggcccattgctctgcagtacatgcaattttctttttctttatcatgttaatcatgcttgtggaggtcctgtgtgtgtggtgctctgtggaggattcaggagacagagaccagtgcccagtgtaaccaggggctagattagatagtacagacagggcatgaggggagactgggaaaggacccagtgaacggagggtttgggctcccatacattaaccctgagaatccgtgaagtcctgtgtgggaggagggctggctggagaagtgcagcaagttctcagtatcccctcctgccttgggcttccccatccctgctttcattccgccttgaacactgcggctgtgttctccctcctcgtgagacctcatggttgtcttgtcagtcaaatgctctgaaaccccattgtctgaagctctaggttcaaactttgctccttcaggtgttcagagctgccccaggggcccccgactgtgtgctggggtgagggactctagcccccgtccttggccagaccctcaacttggatctattttctatattggggttctggtgcagaagttcaaggctttaaacagcgtgaaatctaacagggagtggccccacttcctagttccacctccagggcccttagttggtctgtcttatcccccttggtctttgcgtggctgggccctgctaggctggctgccctctctgctcctctctcgccttttcacattctgtgcaaagccttccctgtctgccccagcccagcccctgtggttttggccccttcttttaaacttatttgacatagaactataggttgccttagacactgctggtgttactggcccctagtttttggtggggtcttgtgaagttgctgggccccaggcctggcttttccctcttgttatcagctgagcacccaaggtgcagtggccgtatctggcatgtccagcagggggcggtgcttactcacagatgaccacgtggtcacatcagctggggctgggctgggaagtgtttcacttttttactttccaccaacttccacccagaaagtcaccccatcaccccacccccagggctgggataagccatgaagctgccagccagggatgacagccaggccagagtgggggagggaggagagtctcgtggcactctgacactgggtgctgcacttttagggcagtgctgcttaggcccagccacccgctgtgtacccagaagcattggtaggagctgcccagctagagccgtgagggtgggaggcctctgccaccaccccctggggagggagggagccatgcagttcccttttcccatagccccagggcaagtgagtttccggactaggggtggataggggcggggagtcctatcccaggaaacagatgggcagcctcagagcggagggaaatggcaaccctaccgcttcctcccatcccacgcagccagcgtttggtgggaggggggttgtgaggaaagggttgcctggagcagggaggtgctccagcccaccccagggccttttagcctgggccccatgggatggcaggccatgtctggaacaggacttggcttcccctctctggttggagttgatgccaaaagtgaggcagccagagggcactgaactgggagggagggctccccgactcagcctcttggagcttgcctttcccatttgaaaatagggctgattcctgctgcccatcccccagactcttgtcaggctccctgagatgttggctggggtgggaggggtcacagatgaaaatggtcctgtgccagtgactcagcacagagcctggcatgttgaagcactcggttgtgtgtgtttcctggccatcaccctgtcctttccccttgttcatgtcctttgggccagccacatggtgtggggcaaccccactgggaagagccatggaagccacagttcacctgctcttgtggagggcccatgcctttcatctgcagggagacagctctccaagcctggccttgcttattagggccctcgtgaggtgttgggatccaaaggtaatccctggattgccttgtgttggccccagtggtggcgtctatccctgcacactccccttcactccctgatggccctgatctccacattgcctcctgctggatctcctgcaggagcatcattgtcccttggagcagtcactttcagctcttcacctgctgagtcgtgggttcaggtgctcaaggctttccggaacttccttaggtacatccagattttgtctagcacatgaacagctggggtgtgggctgcagggagctgggggattctacagatctggcccatcactgttcctgattgaccagtatgtccagacatcccgggaaagccgctaatgtcaaggtagccaaatcagggagactgtgaggggtggtggagagacatggattagccacaagccacacacaccagcagtcagggagagtagtcactagcagagatgaccttgagtatgttggggcaggtgggcaaccgtgtcacaagagaggcagctgagcacatttctgacgctgggaccctgggcaagtccgttctttttggccataattttcttatccacacagtgaaggaggggcaggttctcaaatgatccatctccagggcctcttctggcactggtgttagaagattctagatgtgagggcaaaaaggactaggacccaaaggcagcctgagagaaggtcctggggctcaggagcttcaggatgccgggggttttgtagttccgtagttgtcatgtaattgagtggcagtaaaatccgggttgtcagctcaggcagtttcttccctggggttggcagcctggcccatgcaggggagcaaaaatggctttcctccatcttgctaggctgcttggctgggctatgagttcaactgacttataaacaaaattaacagggccgggcgcggtggctcactttgggaggctgaggcgggcggatcacttgaggccagttcgagaccaccctagccaacatggtaaaaccccagctctactaaaaatacaaaaattacccggttgtggtgggcgcctataatcccagttactcaggaggcggaggcaggagaatcgcttgaacccagaaggcagaggttgcagtgagctgagatcatgccactgcactccagtctgggtaacagagcaagactccatctcaaaacaataacaacaaaaaacaagatcaacaggagaaaaccatatttagttacatatctgcacatgggtgtaccacaaaatatgagattcccagaagggtgagatggctgaagcctgtatagcagcctgagctacagaaggaaataggggcttggggcttctgggggtggtggcgacacaagttatgggagggtgaggggaggaattatacggtcttgttaggcagataaaaacctctcagataataaaagatgcctcagcagattgtcaataagtcagtcttcctttctcagggagggggactcaggacaaggggaatccctctttaggcagataagagaagttcagagaaagttcctccctgcatttgtttttcccccagtgccttcaggtttgaaataatcagcataccaaagccgcatattatggggtggcatttcctgaactccttcatccacacccttcaaacttgggaggagaagacagacatcgccctagcttttgccagggcaggtgtcagcagaattcagagccaaaaggggatttctaaagatagagaaaacccccaactcaaggagtcagcaggcctcgggctcagagaaggatacatttctagggtgtctgtcaggacatccaggtctgtcgagggtgaggaaaagaaggctctgctcatatgcagtgtggagtaaattctgactttctggaggaccacttgacaatattgagagaaattaaaacatcttcatagtccttgatttacccacaggattaaactctgtggggtgtatttacaaagtgaaaggatgtccattatagcattatttataatttcaaagcaaaactggaagcaaacaaaatatccagcagtagagagctgtggtgcccttatgatttatgggacaatctctcagtggattacttggcaatgattcagaaaaatggggtggctctctctgtgctgaagggagcaatcatcaagatggaagcggaataagcagggtgtaggagctagcaaactggacccccccccccaaggccaaattcggctctgcctgtttttgtatagcctacagctaagaatgatttttacattttaatttttattatttatttttgagacagggtcttgttctgttgctcaggctggagtgcagtggtgtgatcactgctcactgtagccttgacctcccaggctcaagcagtcctcccacctcagcctcccaaatagttgggactgcaggcgtgccatcacactctgctaatttttttgcattctttttgtagatacaggattttgctatgttgcccaggctggtctcaaactcctgggctcaagtgatctgtctgcctccacctcccaaagtgctgggattacaagcatgtgccactgtgcctggcctgatttttacatttttaaatgattaagtcaaaagaaaaatagtattttatgactcggaaaaaaagtgatatgaaattcagatttcatgtccaagacaatttattggaacacagccatacccattcatttacgtattgcctatggctgcattcgtgctactacagagttaaatcattacgacaaagcctaaaatatcatctggccctttatagagaaggtttgccgacccctggtatgcagcctgattccttctgtgtgttcttatactgagttactgcacacagttttttcctctggaggtggttacccttgtgaagggggaccagtggaggaagggaaacttgcatttttcatttttgtatcattctgttcagttttaatttgtaacctatgtgtatatttgtgtgtgtgtgtttttttgtttgtttgtttgttttaagtcagtggggcttttggtgggaatattggggaacattcttgataagtttgtgctttttttttttaaagtgctcactgaggaaagagcagaagacataaggcctggtttgaggatttctctttttttctgggtgggggccacctgcccgctctgtgtcctgatgtggaaactctgagacctttatttgtgcctctgcctgcttggctggccccttcctcctctggcctgcagccctgtcacctgctcctctagggacagagctctgtcggcctctgggcagagggtcccgcaccccagggtccttccctgattgcccagaacaacgttcctgtgcagagcctccctagaccacctccctggtttccttcttgagaattttctgaagttggggaagcacacagaagggttggcatgaggagctgacacaaccagaacaccagctcccccaggggcagatgagagcacgactgtttcctgcagagccaggtgggaaaggtcagggtcacagaagggctggggtggtacggtgagctagatggagccctaccatgtggtctaaatggcccatgcatgggtcataaggggaaaccaggcacagaggaagagggtctcgcccacggccttccagggagtgagtgagttagcagaactgggggcttgaggccaggtttcctgggtcctatcagtgagtgaattgaagagctcagacctggagctcattctctgctcaagctcaccaatgcttgaggatggtggaatttgtggattcctatcttggtctgccttgcagttaggggttacctgtaccccacctatctgttagactgagccctaggagaggccagagcttggatcttatcagccctgcccccaccatataagaggcttagtaaatgtttgccgagtagaggcatcatcatgagccatggaacccactgagccaaccggaactcccttgggggttttgttaaggaggccacctccttcacagctcccgcgcctcatgtgccaaccgcactgggccccaagaatcctttgtcctagaatgtacccaccaactcccctgctcaggttagtgtcagcttcttagctggccgctaggacctgggcacagatctggagcatgccatcgtcaacactggtagacccaatgtcagagtcctctgctgtgcgtcctggcccagaggactgggccaccaaagccctgggttccttgtcttgtcacagattaagtgcggggctaccacttcctctttagaatcctccttggtctccagtggaggcatcatcacgccctactagaaacgcctgctctccagccactcagctgctagttccagttgggctcttctccttttcttgtatatgccagagctgtgctatctgatatatttaaattttcttgtatattccagagctgtgctatccgataaatgtaaatttgaatgtggcagccgcttgccacattcaaatttaaatttaaattaattagaatttaataaaaaattcagttcttcagtcacagcagtcacacctcagatgctcagtggccacatgtggccagtgctgccacaccctacggcacaggtagggccgttcccatcattgcagagatggaaatgctcttcacggataatgctgtagagttgtggttctcaacgggggtgattttccctcccaggggacattggataatgtccagagacatttttggttgtcctaacttagggatggtggtgctactggctcttggttctagtgggtagaggccaggaatgggcttggcggtggagactcaggccatgggatttgtctcatcctgtggctgcgaagtgcctctccacgagttcctttgataatctgccccagacgtagcctggccacactaggggcctgaagtagaaacgggaggtatcactctaaatcctcattccatttctcctgaccagacccaaatcaggattcctgatgtctcttcagcaaagaaaaggaaactagacttgccaactggtttcgggaaggaatctctatacatgctagataaaatgcaggcagcttatgtaatagggtctgtccaagcctcagtcacatacacaaagagatttagcttaaaactattagctgtaaaaacttttctcaggtaggctgagcgtggtggttcacacctgtaatcccagcactttgggaggctgaggtgggcagatcacctgaggccaggactttgaaaccagcctggccaacatggtgaaacactctttctactagaaatacaaaaattagctgggcgtggtggcgcacaactgtaatcccagctactctggaggctgaggcaggagaatctctggaacccaggaggcagaggttgcagtgagccgagatagtgtcattgcactccagcctgcacagagcaagactgtgtctcaaaaaaaaaaaaaaaaaaaaggaaaaaaacttttttctaagtggtgtcagcaggggactaagccgggagctgcctttcaggaattctgtagcatatgggggattcttttttaatgcccagcgctgcttctaccaggacccacaaaggtgtaagagaaagccaaggaaggctcctgccctcagggagtttctgccctgccagggctccttggcatttgctgggaaaaggtcaaggtaaatgagtaaacggtcagaattatttagtatcatagaagataacacatggttttatttatttatttatttattttaatgtgtacagggcccagcccttggctcccaggaccttttggtggagtgaatgaaaataaaagaacaaagcccatagggctgatgaatcagatcaagtgacatccctctaaaaccagaaaaactagtctgggcctgctagacagcactggggtcagtcagggtcacctccaaggagagtcagctgcttcagtgggtcagaggtggggcatcaggaaagacccgcccatcacatactcttcgcattactccttagtgaagaccttgaccccaggaggctccctaacaatgtgactgtaacctgggagggtggctagagagtggagcctctgagaggttaggcaaagagcttagagggaagatctcaagcagggtgagaggcttaacaggaccccgggtggagctccccaggggacagtgggggcctaaaggctctgagaccttgagtgacggtgtagggaaggaagaaagggtagagttgagagggaggcgagaacccctgaatcaagggcattaccaatttggggatgattctttttatttttttattgatggatgattgattgattattttttttttgtagagaaggagttttgccctgttgcccaggctcatcccaaacttctgagctcaagcaatccgcccgtctctgcctcccaaagtgctgggatgacaggcatgagccaccatgcctggcgcccaatttggggatgattctgaaggccagcactaggcaaggttctccgctttgcaaactggaagatggttttgggagctggggagagtggaggacctagaccttcaggaagtagctttccaaatttcagaatagaggcgatgaacctgggacattcttaagtagcaaatggttcaggatggttgggaagctcttagaaatgaaagatggtggtcccatgagcagaagcaggcagtgtattagcagagatgtggtctctggctacctgaagccttctgttgaaggagctggaaaacagttaagtggaagggaggacatgtaaccagagatgaaggaagaatgtggtccagagccccccagggtgagctgaagcttatggcaaaactcaggaggctcgagagggctgttttatgtatttggaagaagaacaatgaagcagtgtctggtgctggaggccagtggtaacattagcagaggataagaagaaatgggaggggctgggcgcggtggctcatgcctgtaatcccagcactttgggaggcagaggcatgtggattgccctagctcaggagttcgagaccagcctggccaacatggtgaaatcctgtctctagtaaaaattcaaaaattagctgggcatggtggcgcatgcctgtaatcccagctacttgggaggctgaggcaggagaattccttgaacctgggaggttgcagtgagccgagattgcgccgctgcactccagcctagatgacaaagtgagactctgttgttgttgttgttgttgtttttaacaaagaaatggggggattctttgatctcattttgttcatcttctcttttgagcttgtggtggtaggagggacctgaaccgaggctgggtgattcatctcctgtcctgggcaagttctctcctggggtgctagggtactgtggttggtgacctacaggaagtgtgggaaacgtcaaaggggccaggggcaggagatggctagtatccatttatcaaaaaggtgaaggaggtgagctccacaaattgctacagatgaggcttgtaagtgctaagaaaagctagattgggatcactaggaacaaggcatatcgattttagtttatgttttggatagtagacaaagtatttttcgatttagatgaggcctttgatggaatcctaggacctctccctagaccacctggggatgttgtcagcatgttatagccagtgaaagatccaacttggaaagagtttcttcttggttctttctcaccccttgctctgctgccacacccacgcccgtggacattgtgggtggcctctgcccttgactttgttctgttcataatttggattagtgtctctgggggctactgatggtggtgctggctgagaggaggagcaacaggattgagctctcaggagctctctgtaggctgagcaaacagcagaccaactctggtgaggggaagtttaccagggacatgtgagggacagcatttgggaccagaaaaataactgctcagatacagcctggcgcttgtggcttagtagcagcatgaatgagaataatttttttgagtttttgctgattgcaaactccatacatcagcagagggatgtggccaccagaagagctgctgtgggctcaggctgcaccaatagacatgacgctctaatttcttcatgaacctaacagtggggttgccttctccgacccctggaggcagagtaaatggctctcacctgtgggttcgtcacttctgggaaatttaatttaattttttttttgtaattttctcctatttttctgttctctctggaactctttaatcgtcagattttttaacctactgaattgattcaattttctcatcttttttctactattatccgtttctttatctttttttttctcctttctggaagatttcttttagacttgtgttgaattttttatttcactgtttataatgttaatttctaagagttcttttttgttccttgaatactcattttaaaaagtgttatgttcttgtttcttgggtgtagtctctcatctttaagttttcttctccctctattgtctctgggtttctattttctgtttgtttgtgtaatctctttcttgctagaggactctcctcagatatctgatactccttggctgttcttatttgggtgccaaaagttgattggaaactctgtcttcactgccagggacttggtactcatctggtattgaaatgttttgttggtggacctctgaattccatatctgaaggtttccttccctaccacatctccctactgccagggttatttgttttttccagaaggaccctatcagtagtctcctgcctggttgaccttgcgttcttagggtcaagtaggggaagcaggcttgggtctctgtttggtctgtagatactcacttctgctccaggactcctttgacctctgttgtgctaactctgcaagggtagtatgtttggctgccttgggtgggaagaagacctggggggactttagctgttccttctacaggtcaggaagtcctcctgtattcagctatctgcctcatgctcacctttgtggtactcactgcctcaagtcctaggctcctgggctctaattggcttgtgtctcagttactgtgtaggctttggatattttcttttctcatctaatctaatcttatcttgtaggatctgctctgctagtgcttcctttcgcttccatcttctgaaagcgcattggcacgtcttaactgctgttggttcctcttctttttgttcttgagaatttacttcttttctttctttgtttttttttttttgagatggagtttcactcttgttgcccaggctggagtgcaatggtgcgatctcagctcactgcaacctccacctcccaggttcaagcgattctcctgcctcagcctcccgagtagctgggattacaggcatgcgccaccacacccggctaattttgtatttttagtagagatggggtttctccttgttggtcaggctgatctcgacctccccacctcaggtgatctgcccaccttagcctcccaaagtgggattacaggcgtgagacaccatgcccagccgttctcttctcttctattccttgacaaggtctcactttgtcacccaggctggagtgcagtggcatgatcttggctcactgcagcctcgacttcctgggctcaactgatcctcccaccttggcctccagagtagctgggactataggtgtgtgccacgatgctggctaatttttttgtattagagatgtggtttcaccacgttgcccaggctggtcttgaactcctggcctcaagcaatctgcctgcctcagtctcccaaagtgctgggattacaggcgtgagccactgagtttagatcgttttaaaaaaaattactttacttttattttaatgggcttctgggagggagcagagtttaccttatttaactaaaagctttttcttctatttaacctttatatgttcttttgctttaaatttatctttttatacaagatattgatggattaaacaatatccaagataagaatctgaattttaatacagaagatgagcctgttatatatttactataattattattatattaggatttacctatgctgtcttatttaatgcttgcttgctttttatttttttatttttttattttttttggagttagggtctcaccctttcacccaggctggagtgcagtaacttgatctctgctcactgcagcctctgccttcccaggctcaagggctccgcccacttcagcttcccgaatatagctgggactacaggcgcacaccaccatgcctggctaatttttgtattttttgtagagatgggggtctcaccatgttgcccaggctggtgttgaactcctgggctcaagcagtctgcctgtctcggccttccaaagtgctgggattacaggcatgagcgtaatcccattactgctcccggccaaatgctttatcatatattctctctgcttctttttctcctttcgtatcctttatgtgtagattgaatttccttctgtgggtttgaaaggtaaaggttattcttcttatggttaccataacttattgtgccctcttctttacctcatcactatcttgtgtcttccccacgaaagagacagggccttcagcatggccccgccctgccctgctctcccaacctgtgctggcccagtggcatctccaggactgggttccggggagggataatgcagccctgctcatttgccatcttactcagaactgggcaaggcttattcagggccatcctagggagactccagcattcagtgggagtttggtttaaatgacctctaggctgggcatggtggttcatgcttgtaatcctagcactttgagaggccaaggtgggtggattgcttgagcctaggagtttgagataattctgggcaacatggtgaaacactgtctctaccgaaaatacaaaaaattagctgggcatggtgacatgcacctgtagtcccagctactcaagaggctgagatgggaggatcacctgagcccagggcagttgaggctgcagtgagccatgatcacacaactgcactctatcctgggcaatggagtaagactctgtaaataaataaataagtgatggacctctgaaaaggtccttgaggtttttttgcaggttctgggcatggtagatcctaagggggagtgagatggagaatggacaagtcaatagaactcagaacgccagactttctgaagttcttcctcagtcttcttctctgagacttctactccttggtcctagctttgttcctaggcgctgtgccgctgtgtcatccaccctgccctgtacaatatgcaggaagcaagcgaggagggggtgcctcagagagacagtaaggaggaatgaggacaaggtggaattggcatgggcacgtcctacagagtgagaggcaggccttagggcaccacgtcgctctcacgtaggaatgtgtgtccagcagcgcctagccttcagcttttcacaagaactcaggaaattgaattttctatgcgaaatcttccaacttggacatgttggctcaaaaatgttaataatcttgtgtaggccaaacagcatgtctataggctgggtctggcccagacatggcccatgactatagctctggctggttgatggttctgtccttgtcacccttgacttttctttcttctggataaatgtccagagaaacaaatgtcctctcctgattcattggtttcccccaaagatgtggttccctatacacccctctccccaacagctacttcctctgggcccctgtactttgccagctcgttagtctaaaatcttgttttacaggctgggtgcggtggctcacgcctgtaacactagcactttgggagactggggcgggtggatcacctgaggtcaggagtttgagaccagcttggccaacatggtgaaaaacctcgtctctactaaaaacacaaaaattagccaggcgtggtggtgtgcacctgtaatcccagctactcgggaggctgaggcaggagaatggcttgaacctgggaggcggaggttgcggtgagccgagatcataccactgcactccagcctgggcgacaaagtaagactccatctcaaaaaaaaaaaaaaaaaaaaatcttgttttacaaatgatagccaacccatctagtgcccttcacactcctgggtgctgtttttcacagccatgtgttctgttaagcagattgcaggcagccctggtttgcgttagtaatttcttagtgaatgggtagtgtacaccaggtaaacctcattctcaccccatgagtgtagggcacacacaggctgggttctccaggagcctgtctgcagcctgtgcccacgaggacttgttcctagaagtacgtgaagggatactgtctgctttctcttcgggtcatgcatgcacagaggacatgccgcgccccagcccccagcgccttggcctgcagagggcagagctgctgtgtggcacagaactcaggacctatgagcctccttgggtggcccctcctgcctgctgtggcctctgcggccctggccttgacttcctttcctgtcacttgcgtgcctctgccactgggcctacctctgcccgagtggcaggagcttgcagctttgtatatacgggcagttggtgactcattcctcagcagcccctcagatagggaagtgaaacagccacacctgatagggcctgacctttgggtgacagcagaagtagctaagcagacatgaggcttgcagctaaggagggaagtcctctctcaagccagcctgtgaagacagcacctgcctgccctgaccctcctgtggcctccaggcctgtggctctggtaacagtttcttcctccctccccgccacccccttcttcttggtgacagctggaagtagcagtggtcacaactgagagagccaaacatttctacagcccccaggacattcctgtcaccctctacagcgacgctgatgaatgggaggtcagtgctggggcccctgggctgagttccattgagtttccaccagcaggacagaacagtcctccctacggcctatggtctggcagctggaacagacaggctgggctcaagtctgtggtcagggccctctgggcagaggcaatgaagaaaacatctgtctagcttctggcctgcaggaggccctagtctcctcccggcccaggcagagctgggctttggcctggtgcctgaggttgagtgtccttgtacttatctgggctgatgaaaccacagaggagctctgttcccaccacccttgtccacgtggttcctggcgtcagggctgaagagaacgcctcacttcccacggccgccgggctctgctgcatctcccctgcggatgggtgggcactggctgattcaccagacgctgagtgtgggcctcacaggggttccctgccaggcattttcaaacattcttagcctagaacatttccggctggcctgtcttccccgcccccaccccctccatttctcactgccccggagctttccactggcttggacaacccaagcatccgcctcaagcagacaggccgggagctccctgccagatgtcagttctcttgaaagccaaaccatgaagggaatagctcagagagacaaggggcacttgtttcctcaggcctggttctctcggctgctggctccatggctagcgctcgccagcttagctgcaggagggaacggaggttggcctgggcagggcaggtcagtgggttcctcagtctcctgacttaccgtacctggcctgccttggcgctgcatcctgcttcctccacactgacccctttttcttccctctgccagatatggaagagccgctctgacccagttctgcacattgacctgcggaggtgggcagacctcctgctggtggctcctcttgatgccaacactctggggaaggtggccagtggcatctgtgacaacttgcttgtgagtgatgtcctggtgccctcgtccgtccctgggcctcacacccagtttgctgagctgcagacatccttgtacaaggagacctgctgctgtggggccccggtctgcccagggagatcgtgctccgccattccccacatcgcccccagtgctctcaccttctctgtagcacatgggcacagccctggtcctgatgggtcagtgtgacctgccactgctccccaggagtgtccccctctcccctgcccttgcacccagccaggtgcccacaggaagacccttcttccttgctctttgtccctcctcgtgggctgcctgggtgtgctcttccactgtctctgcccagccccatcgcctcccgcttcagctctgccttctccgcagatctgggtatacacgtgggcaatgtaattgggggttcacttcttcatagatggctcatatacactttatcacccttgtagctttcctgtatattaggggaagcttagaggggaagaggggagaaagacggggcagtggcgagagccgatgggtggtagggagaaatggaagtccagctgtccaaagtgggcactgtcctaggcctaagatgcctccagggagctgttgcccttaaaggggagctgcctttgtttatatgatcgtcctgggaagatttgggtgtgatttctctcctccttctccctaattgccaccccccacctcatttattgagctttcgcctaccacgtactgtactggggtctgttctgagagcctcacaggacacagggagctcccaggctggaaggagaatgccaggcttgatcacccatgccgttgggaagggagtatcctctggtgaggggtacagtcctgaatgaccccagtcagtcctttctatggagtcaccaccttgcatagtgctgggcctgtggtagacatccaataaatacttactgcatgtatgcggtaactagcagttttacttttgcgagtagctgggagtttttcagagtttcatgtggtgaagaaggtggatgatgaagctgggacaggatgttttttggggtcacagattagtgttcttgtatacttgtcaatgggctcttaaggcactcctcaaagaatctgccagtgatttaagcatcatttgaataagagcacagggtgagcagaagaacaacttgtgtggccaggagcaggggtagggagtgcagagaagagagagcctgggtgcaatgtcatcaagaaggctttccctatagtcccagctacttgggaggctgaggtgggagggtcgcttaagcccaggagttctaggctgcggtgccccttgattgtgcctgtgaatagccagaatagccagtgcgctccagcctgggcaacatagcaagaccctgtctctagttaaaaaaaaaaaaagggaaaaggctaggcatggtgcctcatgcctataaccccagcactttgggaggctgaggcaggaaaattgcttgagcccaggagtttgagaccagcctgagcaacatggtgaaactccatctctacaaaacatataaaaaaaattagccaggtgtggtggtgcatgcctgtggtccccagctactcaggaggctgaggtgggaggatcgcttgagtccaggaggtcaaggctgcagtgagctgtgattgtgccactgtactccagcctgggctacagaggtgagactctgtctcaaaaaaacaaaaaggcttcccagcagcactggtgccacaactgacatggcagctgcagctagaacagttgagtttcttggctgctctcatcaaattgggtcagagttgtgtgtggccagcaccatctcaccaaatctccaggctccctgctggcgggtcagcagcagctggtgtgacaaagtactggcctctgggagctaagccccggcctgggccagctctgcaagggcgctttccttcttcctgcaagctctgcttccccttttccttctaagctgccatcacttcatgaaatccctgggcttccctcctccagagttggctgggaagtgaaacatgttcccaagaccagcccccagatcatttgcctcaaaggttttccctcgaagtcacaaatgtttcaaggaatctcaaattttacaaagtttgaagtgtgggcattggtggcctgtggctgtgtcctctctctgtagctgttttctccctacatccctgaaaggaagttgagcctgctcctccatccgcagacctccctttccagcgcccagggcatggggtgctgtgagggcagcatgctaggtgtgaccgtgctcctggcctccaggcccgtgtccctctgtcctctagcccactaaggccctggcccatttgtgctaaacaggcagtcggacctagaaagagcagacaatctctctgggtcaccagtctggctaggagctggtctcctgactgggatccaggccttctcccctgcccatgtgaattcccaggggcagagcctgaaatgttgaacacagcactggccaaagagatgtcaccgtgggaaccgaggctctcttctcctcctgcctgctttcgtgggttcagagtagctgaggcttgtctgagaggagttggagtgctggttttcaccctggttggtgtgctttgctttgagggcacttagaaagcccagcccagcccttgctcctgccctgcacacagcggagcgacttttctaggtatgctcttgatttctgcagaagcagcaggtggcatggagccaagaggaagtgtgactgaaactgtccactcatagcccggctgccgtattgagagggcttggtgggaaactaatgctggtggctgatgcaagcagccaggtcccagggctgtttgctgtcctgcttcctccctgtccctgggacttgggggaggtgctggtcctgtcctgtcggggcattgttctctggactccttcgctcttttcccagatgagcttcccttcaggggaggggtttccagcctgttaccctgaggagctcacagccctggaagaggtgtctggagtagtcagagcactgggagcttctctctcccccaggcggcccccagcccagggagcctgtgcctgtgggaagcccaggagtcactgccctggagcctgtgttttgtgcctggccctgcgctcagagctttgtagccattctcacctcagtcctcacagctgcccagggagggacctttctagagaggaagccaggccctggccttcagtcccatgtccaggttctcacagctagtaatacacacacagctagtgctctcacagctagagcacagtcaggatttgaactcagggctacgtaatttcaaagtccgtggcacaaaggactctgtgagctggatggctcctttcacaactgctcaggtctgtggcttggtgggacggcctggatttgggagatggtgaggctgtgcagtggaacattgcctgggtggtgcccattgtccgggtgtgggcgtggatgactgcttacctctcagggagcagctccctatctgtgaaatgggacagcaccttctttataaggtctcagtgagggttaatgagatcctatatatgagaaggttttggtaacggcagatgttttcattgccagactttagttggcctcggagagctgatgtcaagtagatgagccccacctgaggagcagcctggtcctttgctttctggtgcaaccaaaaaagcctgccttctgctccccagggttgcttttcccaggaggtgtgagcctacctggaggaggcttaggcacagggatacctgctggaggtctgagcgttggttgagcacctcctgtttgtaggatcctgtgccagagcctgtggggaggtggagagaggcgaggagacatagcccccacccctgagggatgagacagctccctgcaggcaggctgtgcccagtcatctcaagcctacagctgggctgctggctgcagggtctggagggcggtggggagggtggcagacagagtagcaagacccccacttccctggccttcttcacagacctgcgtcatgcgggcctgggaccgcagcaagcccctgctcttctgcccggccatgaacaccgccatgtgggagcacccgatcacagcgcagcaggtagaccagctcaaggcctttggctatgtcgagatcccctgtgtggccaagaagctggtgtgcggagatgaaggtgggtgtcttgccaggcttatagcccagggctgtagaaggggctcagctttggggtcatatctcagttcagttcctggcctgttaatgaccttagcaaaccattctctgagcttagctttctcagctggaaaatgggaatcgtaattcctgcctccagattggtagggtaaaatggggtggaatgtgtaaagtacctggtagagtccctggcacgcagcccacacgcagttaaggatggctactggaacgagtcccagggtcttgccaggggtcttgggagagatctgatgtgtctggctcaggcaaagacagaccttgccctctcaggccttgggctctgggtggagcacttggagcaatgggcaggggtctgcagggctacaggcactgttggcctgtctggccacagcggaattttgctcccaggtctcggggccatggctgaagtggggaccatcgtggacaaagtgaaagaagtcctcttccagcacagtggcttccagcagagttgacctgggatttctgtcatgggtgtccctctgtactcagaatgggttcaggccaagtcggtgaagatggatgttggcaaaataggaggataccctcatttgctgaatgggggacctgctctgagcctgcccaggggccaggcctgctccaggttaaactggacggaaggcccaggtctcagtttctttcaaccaggagaggccgctgcctagagcccctccccaccttttcctggatgggtgaggcaagccaggagagcaagcagtgttgtcctcacgggaggaggactgagcgactgggaaaactcggctctacatctcacccagaacggcttttagaaacaccacagctggagagtcctggctgagccttgggagtttcagctctttggcggggtgcccaggtgccatgcgatcagcgaagcctgcgagttggcaggactctgaggtttcctgcagaccatgccatgagattgaaggtgcggggaaataaagaaaaatcaccatttaggagactccattctttccctacaacccagctgtggtcccagagatcagggggtgttgccaggtgtggctggggaagggtctgggttcacaactcaccggcactctttagtccccgtataacatggtggttaaggataaagatctgaagccagacagcccctagttccaatcccagctctgccgcttactagcagtggcagtttggttcaggacttagccttcctgaccttcacttacctcagctatcttgttatcctaccctcagggagttgttgagaggattcagtgaaattttgtgtgcagaatacccatgccactgagtgcctggaacgtagtaaatgtcaaatcaatggaagttaaaactaggcatgcatatatgccagagagctttcctagcatttactgcaatgccctgtctcattttgggaaaaaggaaatcctggatgctaagttgacacatccctttatgcaagtgacaggtaagcagccaggagggttgaccctgccctgggtcccaggcctcttgcctgcttcttggtttcctctgttctcatcctttcagctttgctggacctgaggcaggggcctgggtgtctgtgcctccctaccccccagtacacatgaccaagggaagtagatccagagacaccatgcactctggcccagaaaccctctgctacccagcttttgacttaattgccatttggtgtggctgcagcggggagggcttgtctgcgtatttggagctgaggctgaggctggcttcctgccctctggcttccaggccaggtgtgagggacatcccatgtgggctctgagagcactgagagtagaggtgccttgaggggaccaggaagcctactggctggaatcagtgctccagcagcctccacagcctttatctcaacagcacttgacttcaccaggtgaccctttgggataaaattgccttagggtatgaaataaactataactaaaatggta

SEQ ID NO: 1060 - DNA, 25962 bp, Homo sapiens; identical to SEQ ID NO: 1056

SEQ ID NO: 1061 - DNA, 14899 bp, Homo sapiens
cagtcacacagcagccttgtaggtgactggaggtgttcgctgatgtggccccaaccctacctccctccccaccccatgatgttagaagaatctcgacagaataaattggcagcagccaagaaaaaggtaaaaagccaagaaaaaggtcatggccccccaacctagccagagatcccctctgatgacaagaccactcccagagtccataccactcctgaggcacaccgggctgggcccccctaccccggcgcctctgggctccccccaccaaagtcttgtcagtcagccccgccccttcagcaagcagcccagcctctgccctcgccaatcaccctgcggtgactttgggcggatgactactggggatacctgctccatattcagccctcacgtcctgccaccccaagcccaacctccctgggttctttgggctcacctctccaaggacctgggtcccccagccccaaccccccagcatcgccagtcatcccggggtgactttgggctggtgactcctggggttccctgagcagactctgctctcccctcctgctgacccaagcccgacctccctgggctctctgggctggcacctccaaggacctgggtcccagccccacgtcccccctcccccatcgtggatcggcaactcagccattgcactgatgaggtttcccccacccccaggaggagtggaatgtagtgatgtcacagtcctcctaggaactgtcattactgctgcaagaccggcctttgatcttataacccagtcccctaagcattctcaccccatttctggttcctctggtcacagcacaaatttccagctagaagggaaatggggaccatgggacctaggagcaagaggtttcaggctgccttactcccttcacatagacatcgacagtgtgaaaagcctacacttcccctgtgagctcaaaacgttgacagtatctctgggtggtaatgggagaatgggtttggtttggttttctcccaggcttctactctccagagagactttaacatttttttccgagttctccacctcatattctaattctccacggttctgggaccagactgcccttcagtcagtggtctctgaagtgagatttgctcatcttctgtggaataggtcttgggaaactgaacttgacagcttgaatcttcctcatatcatctcaacttagggtacattgagtgccacaggataaatgtgggagatctttctgaagcatcagtttcccttgattctcttgagagagaaaaaacattaatgtacttaggggtgaccctcacataggtttctaagagtataccagacttctctctgaaatgagacttgggttgtcctctttctgataaattcccagatttaacaaaaaagctgccttctgccatgaggacacattgatataaaagtttgagagatactggtgcacttcttcacactaacagacatttgaggatgtatgactctaaaccacacagcgtgtagttcatgcctatgtaatgtttacttttctacctctgcgtctggttttggtccccggcagctgctgattcatggcaaaaccccagagcttggagtcagaagactgagtttaagttccattattgcccccccacacttttttttttagccataatatccatccctctcagtcacttaagtgattgtgacaacaccttgtacagttgttggtggcattaaatcagatggtgtataagagtattttgcaaaaactgtaaggagggtgtggctgtaagggctggtagttctcatgtgtattactgctcttctttcccacagctaaaagaatatcagcaaaggaagagccctggtattccagcaggagcaaagacaaaaaagaaaaaaactgacagtagccctgagacaaccacttccggtggtggccactcacctggggatgtgagtcttggctggccaggctcctggggacagggggcccaaggggcagtagagggtaattgttgagattgctgggtactggttaagaattctgggtttgaatcctgcttcttcatctgctagcgatctgatttatggcaagttgcttgagctctttgagcctctcttttcacatctgtgaaataggggtagtattgtttgacttccatttgtgaagtttaaatgagattccttattgttgttgttttcatgttaacccctagtacgtggcctgctgtaaacacccaggatacccaggaaatggtcattgctgtttgattttcctgatccccactcgcaaggggaagctgggctaatgagtacagccacttgccatcaggctgtccctctaggagtcactgaagggggcccagggtgtggtgaggagagcccaaggcactaggagcaagagaaggtctaacttgccaccagcttgctgggtgaccacagaaaaatcacttcttctgctgggcctcagtttcctcctctgtaagatgatactggataagatcagtgtctttcaaacttgttttttagctgaagtccccttagttcaagtgaactcttactcaggagtctgtttttttttaatggaggtggaggtctggagctctaccagattcatcgcccatgtcctgggcctgaggagaggggtccagtgagcgtattaagatctgcattggtcagctgactccactctgtgactgcgtcactcgggggacttttccatctattttttcctgcccctggcaaggcagcaggtggccatttggaagaatggcacaggccatggttttaatctcctctgctcttcttcagcgtttccttttcctgaacccacatcttcctcctaccctgactttcttgcttctctctaagccacttctgtctttcaccccctgcccttgtttttcccttgtcacctcctgtagattcaggacattctgaaggtgcgggtgtccaaccttaaccactccaatggggtagtgctcccccattggacaagtggaaggtgaggcagtgccaagacccctctctggcttgctgtctacagctgtgcatggccctgaggcttctctggcttgggggatgcttggcctctgccttgttttatgttgctgccattaaccttcagcctgtttctgtctgcttcttcacctgcttgattgattgggttttttccttccccgcgtcttttattatcttggaaatggtgatgcctaaaagtttaaaagtaatctgggaataacgtacagagcaggcatgtgggatttgggctctttttttttttttttttttttttgagacagagtctcactctgtcactcagactggagtggagtggtgcgatctcggctcactacaacctctgcctcccgggttcaagtgattctcttgccttagcctcctgagtagctgggattacaggcacctgccactacgcctggctaatctttgtatttttagtagagatgcagtttcaccatgtcggccaggctgatcttgatctcctgacctcaagtgatccacttgtctcagcctcctgaactgctgggattacatgtgtgagccactgtgcccggctccttgctgtttttatactttctccatatacataactatttcccatgtaagtttttttttaatttctcatttttattactcctgcatcatctgttaccctgaaggatctggaagtaagaggccctgggctgaggtgcagtgactttgcaggccagccctccaacctcctctcacagtgggggctgggtgaccctctgccagctgagacagcccacacacaccccagccctaatgattgttctctctacctctccccacaatcctcttccaactcctcctctctgcatgtgcctcagagccagtaccaagaactagcagtagccctggagtcaagctcagtgacaatcaatcagctcaatgaaaacatagaatcattggtaagtccagtggggtcccctgattccatgctgccaatcctgggctttagtttccccttggggccctgaagaaaggggctgggggcccctggtgccaagggcaaatggggagctggagcacccaggcctcacctggagggaccccagagcaaggagcacgcagcatggctcttctgtcactgccctctttgccgactctctcttctccagacacccctgctccagtccttgccacacacgccctgaggttgtcacctctcagggaagcgctagcctgactggttgtcaggggccctgtatttctgccctgactcagtccctaatttgctttgagtctggacaagccacctgtcctccttgggcttgtgtttctggaggaggtagagcatcaaagttctctgttagctctgagagtctgagatttaaaggcccctagaatggaaacctgagggccaagggctcctgtctgtccttttccatcctatatctgctgtgaagaaccgtagctggcccgtatgtgttcagtaaatgtttgttgaatgaaggcacctttctaaatcacaagctggcagaagggtgggccttcctgagactccctctctagaggtttatgttactgtcctttcaagagaatccagattcaggctttgagttctgtggctgtgggcaaaaaccaacaaagacccaagtcctctgtccttgggagcttgaggagggttgaccagtttgtgttgccattggttctgagaatgttgcctttaaaatccattcctggaccctgcctaccgcttccaggtctggggaatagagttgagggggccactctcagtcacctgaatttgactctccccacagaaacagcagaagaaacaagtggaacatcagctggaagaagtaacgtgatttctttgctcacaacatgactgctgggtttgggggacactcagatgcagaggcgccagtctcatcttgcccactcccagcctggggaagaaggctcacccatcagattccaccccatccccatagggtccctgataacctggtcccatgggtgggcctgtcctggggcattggtggcattctgggggcatgtctcttgctgtgccatctctgcctccctgtgataagagctctgtcttcctcttcctacaggcaaagaaaacaaacaatgaaatacacaaagcacaaatggagcagttagaggtgagtggagggtggggagctttctcctgtcctctggagaatgtttctttccttctctttcagcatttccttggcttttctcccaaacgttcaattccagacaatcaacatcctcacattggaaaaggcagacttgaagaccaccctttaccatactaaacgtgctgcccgacacttcgaaggtgggaatctgggcatcccgtcatccttcaacctggcactttgacaggtctttagggggagtcttttgggccccatctcaacctctctcattacagaagagtccaaggatctggctggccgcctgcaatactccttacagcgtattcaagaattggagcgggctctctctgctgtgtctacacagcagcaggaagaggacagggtgagtccaaccagctgccccatcccctggcagcctggcttcccagatagaggagtgagcctaaaggtcccttctgcaggatggagtgtcctgcccagaaggcagcatggtcatttctcactacttttgtgtatggttgttagaggcagcctggggctgagtcagctgctgtgggtgagttggggggcactgtggggagtgagcactggatgcagagctcagaggccaagtgcctgccctgccctttcctggctgtggccttggccaagtcctaggtggggtattgggtagttgttctgtgaaggtacagaagagcacatttagtatgttaccatttctgtagagagaggaaaggggtgtgtgtgtgtgtgtgtgtgtgtgtgtgtgtgtgtgtactatgataatatacaaaaacatgtctgcaagcattcataaaaaactcaggagagagtaacagggtgcctggagacacctcccttctgtaccttctgagttttggactatatgaatgtatcatcctttcaaaaagtgaacaaaagattaatttcccccttcctatctgtgtccccacccccagcaagaaaaatgggcttagagaataggatagacctgggtgttcaaatcccagctctgtctaagtgatcttaggcaagcacttaaccttgaacactcgatgtttttcatctacacaatagaggtaatcctagtaaccgtctcatatggtggttgtgaggattaaatgggattgctagcatggaacctggtgaagcactccataacggttcaaacagtggtagtaataacagtaataacaatagcaatattatctgatctctctgggcctctgttagccagctgtaaattcgatctctttccctctcccttccaactttactgagttcttttaataaccaggccacgggcttggaaatgccttgacctttactaaccgagttgtatattgagcctagccctagcccttttaaggggcactgcccgggctccccagatcaaaacttctcactcttcaccatccagtcctcgagctgcagagaagcggtcctccagcggcggttacagcagaccataaaggagcgggcgctgctgaacgcacacgtgacacaggtgaggctttgcagagggagggatgtggaaggaagatgaccccaggtggccaggagcaggtgaggaccagtgacagcccttcctaacttctgtgcccatttcttgcaggtgacagagtcactaaaacaagtccagctagagcgggacgaatatgctaaacacataaaaggagagagggcccggtggcaggagaggatgtggaaaatgtcggtggaggtgaggtctgacccttcagcccccactttagataggtcactggatctttctgggcatctgtaaaatgggaatagtacagccagaggtggtcatgggtctgggctttgtggagatggggacagagaatgagatggtagcctgtccagccaccagcccctctctccagggccctttcccctgtgctttgggcaggctcgaacattgaaggaagagaagaagcgtgacatacatcggatacaggagctggagaggagcttgtccgaactcaaaaaccagatgggtaagatggggctggtgtgacctcggagcaggactggcatcagaggtctgtgggggtggcttagaatgccccagggaggtgggtgggtggaagggctttgaggcagagggaaagaggtctgtgccaggagacggcaagttttgtcatctccatgagcctcagggtccccatcagcaaagagggaggagtgcccgttgtcagccacccacagtgctctctatgtgaaagtggcttggaaattggctaccattgggtgcgaggaatgattagcagtgaggccaagtttgggaagcctgagaggagctgtgcatcaagaggaggtttttttttttttttgagggggatgtgggtagaggggttggggaatccagaggcccttattgtctgcttcatttctcagctgagcccccatccctggcacccccagcagtgacctctgtggtggaacagctacaagatgaggccaaacacctgaggcaggaggtggaaggtctggagggaaagctccagtcccaggtggaaaacaatcaggccttgagtctccttagcaaggaacaaaagcagagactccaggagcaggaggagatgctccgagagcaggaggcgcagagagtgcgggagcaggagagactgtgtgaacaaaacgagaggcttcgggagcagcagaagacgctacaggagcagggtgagaggctgcgaaagcaggagcagaggctacgcaaacaggaggagaggctgcgaaaggaggaggagaggctgcaaaagcaggaaaagaggctgtgggaccaggaggagaggctgtggaagaaggaggagaggctacaaaagcaggaggagaggctcgcgctctcccagaaccacaagctcgacaagcagctggccgagccacagtgcagcttcgaggatctggtgggttgccccacctggggagcctgccctcatccctatccctccaggcctttgtttccccacctgtaaaatgggccagtgtagccctcacatgaaatgctacttctaaaggcacctgtgagctacagctcatcgggctctgctctgatggctgtgggggagaagggatgatttttctaacctgcctccacccttcctggtgatatgggaggcagacaccaaggtctggtgtctccagctgcagtggatggccactgattgcttctctctgtccagaacaacgagaaaaagagcgcactgcagttggagcagcaagtaaaggagctgcaggagaagctagacgaggtgaaggagatggtaacctccaccccatccaagaagggctgggaggcgggcaccagcctctggggaggggaggtgccaggccaaaggcagctccagctgggaggcaggtgaccccagcaccctccagtgcagctctatgactgtttcttgcttcctgccctctgacttttagaggtgggtagccctgggctcctcccaggtctggacatcatcatcccagctagagacatggagcccccaatcacaggggaagagacagtggtacaagaggctccttatccaggcacggtggctcgcacctgtaatcccagcactttgggaggctgaggcaggagaatcacttgaggtcaggagtttgagaccagcctggccaacgtggcgaaacctcacccctactaaaattacaacaacaacaacaaaaaattagccaggcatggtggcgcatgcctgtaatcccagctactcaggaggctgaggcacgagaatcgcttgagcccacgtggtggaggctgcagtgagctgagattgcaccactgcactccagcctgggccacagagtgacactgtctcaaaacaaaacaaaaaaggctccttagattcaaactggattctggcctgggttccactggtcaccattcaactactgttcatctctaagtctctgtttctgtgacttcaaaaggaagttagcattttccttgcagaggtgctgaggattgaatgagagaatacctggaaagcattaggcatgtagcacacttagcagatggtggttggctccctctgcttttccaccagtctgtggcctacagtttaaatggtgggaagaaggacatgagatttgaggctggggaaggaggtatggggttctaggcaagggaggaagcctcttaggcctggagcaagggaccagggtcctgggcaggtgacagagccccacggtgccctcgctaccctattaatgggcccagaatctggaagccagccaccatgtgccctcatgcccagggtcttcctgcaggtggagctgaagagccaagagtctcagagtctgcagcagcagcgagactagtacctgggtcacctgcagcagtacatggccacctatcagcagctgacctctgagaaggaggcgctgcacaggcagttactgctgcagacccagttcgtggaccagctgcagcagcaggaagcttggggcaaagcggtggctgagatggccggccaaaagttgcaggagacccaggggagggagttgctgaggacggggccccgagggggatgacctggcaacctccgtgccttctcactctgtttcccgtccccttaggagcacctagaagctgccagccagcggaaccaacagctagagacccagctaagcctcgtggctctccctggagaaggtacaggagaccactcagaggaagaggagagagccccaggaggaaggggggactgttagcagcataggattgaggggttggaagagacctttagaacagctggtcgttatgccaaccgggtgtccgcactaagttcagcatcaatatggtgacctcctgggagcagggggccaccaggttgcctaaggatgaatgaactggaccagatcagaaagggagcaggtcaggactcccgcaccgaccggtagtgggactgtgcctgggcaatatagcaagatcttggttcttaaaaggaaaaataaagaacagcagctcactcccctctggggagaggctggctcagggttacacagtcagggtggggacagaggtaggcccacagtaccttccttgttgggttgtctgaggacccctctggccacctccccacaggagatggaggacaacatctggacagtgaggaggaggaggcgcctcggcccacgccaaacatcccagaggacctggagagccgggaggccacggtgagcctgactttccctgccccgctttgccaccttcctctgtggtccctcccagagcccgttatgctcttggttttcccaccttctgatttctctggcccctcaccccttccgggagccagtggtcagacactttgtcacctgtgaccaacaggtgcactctctgaggccccaagggaaggggttgttctccacctccctgcctcatttgttctgtctatgcccctacaagaatactcacctcttgccttcaagtggcatttttcaactccgctggagccagttcccaggaggagcaggcacggctatgtgggcagcggaaggtgcgaaggctgtgccgcctgcacctggctcatctggtggccttggcctggaaggagccagaggcagaggccccagccccagggaggactggagatgagtttgtgtgtggggagagctaccgggccctgaaggaggccatggtgaagctgaaagggagtgagtcctggcatgggccaagaaaagtgggggcggggcagaacaggtcactcccgaggtgtgaccccattattttggctccagagcagctttatggacctcccgaaggagaaggcggacgggacggagcaggtggagagacgagagcttggattcgtccagccttctggagtgacagacggcatgagtgagcgggaggccagggcacgggcacggggagctgcagggccgtcggagggaccctagtgtctgagctgtgtcctctcacaggagagtccttcaccgtatatgaaagccagggggcagtgccaaacacgcggcaccaggagatggaggatgtcatcaggctggcccagaaggaggaggagatgaaggtagggcgtgcaacatctctgcggggttgggggtgggcatgggcactggtgcaggctccagggtgggagctgagcacccctcccttcaggtgaagctgctggagctgcaagagttggtgttgccccttgtgggcaaccatgaggggcatggcaaattcctcatcgctgcccagaaccctgctgatgagcccactccaggggccccagccccccaggaacttggggctgccggtgagcaggatggtgagtagagctctcaggcggggtgggcaggcaggggcaggggaggctcgcactgtgctcagacccccgcctccctctctccgaagatttttatgaagtgagcctggacaacaacgtggagcctgcaccaggagcggccagggagggttctccccatgacaaccccccggtacagcagatcgtgcagctgtctcctgtcatgcaggacacctaggagcacccaggcttgcccagcaaaccctgcgtgccattcttctaccaggcagccgagaacagggagataaacatcatcatcttctaagagctggtcaagaaatttaaaacaacaacaacaaaaagttacggggttcatctcctacacaattcatttactccatttgaatgctagagccactcacatttatttgtgtttctaatttaccgtttaaatttatttgtaaaaagttaagggagagttggtctttccctgatgttctttctggcatcctttagcatttttatttttaatttgataattgtaggtcattagtatgcatatcgagtttgcccttaggtggtgggaattcaaacacacaaagacccactaatttgcacaaaactattctggctggtttggaacaggctgccatgcttttttaatgttattgcagcatgtatattcattccagaattcagataaaatgtgcttatgttctgctattacgtttgatcgaatcctaaccacagtgagctcttcattagctcaatatgtggtttgccctcaattgagcactgtttattactttgtaatatgccactgtgagtactgacatttagagttgtttaaaggccaagaactggaaacagccttttccctattttctgtgtattggggatgggagtaataacattttggggagctttttaaatctcacagaagaggaaagtggcctgctctggcaggtgtgtgcaggatagagtgtgtttcatttgttctggtgccaagaatgagcgctgtactatggtagttcccttaggatttgtatgtgctctgggctcatgaagatattgcatcatgagctgcagcagttgtaccctttcttgatgacctaaaaagggattatttctgaggaatgaaaggctcccatcattgactgtggatgtggaaaaccttttctagcttagagcatttatatctacaatacattttaaagtcagagttcatgttacctgttttaatcacgagtatatgtcccagtacacaaaagggcactggttggcattcttcttaaggtatttagtgaagatcataagaaatcctttaagagtttaaatgtccctggaagaggcatacaggctctagtcaagaatgaatttgagtgaaggaaagctgtgtgacacctggccttcctctatgttcatggagcttctttgaggctagaagattgattttatcatctagacctctctggctaatacctattcttcagccacattagttactctgacataggaatttacttcttttctttgaatggaaaacactttaaaaataataacaaccattattataaaccaatatatgtgagagtacttagttgaaacaaaaaggagttttagtagacagtattatactacacatgaaaatcaaggcgaagtttatgcaacttaaaatgtttacaagctgcagtgcaatctaatgtttgtgaatgtccaagtattatgagaaaaagtgtctatacaatgacagacttatgtttcctcacaaagttcttcacaaagagtgaaatatgtttttatacctctcagtttcagttagaggcatattttgtgccatatttatgttaatgtgcctatacgtgatgagtgaattatttcagtcatacattgcctaaatcataactttaagatgcttgggaaagaatcaacagctaaaagttcatgaagttctaatgtctgtgttccaaaatacgtcacagtattaggatgcagggagagatgtgtgtgcgctccctggggtgggcatttctagttactagaccatctccatttttagcatttggcatcctcatgatacttttatacatatgacattaataggagagcaataatacgattttacagatggaataacagatgtgcctgcattcagtgaaagagtgcaaatattaagtccttgtgacttcaactgactcttccaaattgtatgaatttatcaatgtattagataaactcagttccagaattataaagaaaaactgttagaccaacgaatgtggctaattaacagtaggacgatttctagcccgagggtttaaaatggacttcaagtcctgttcttgccttttattttctgaacttgccacttttgcattctttgagttcagtttaaagacagtttgagtccaatttagaccctcgggctagaaatcataccactgttaattagccaccttatttggtctaacagtttttctttataattctgaaactgggtttacctaatacattgataaattatttcaaaggtatttttatagttcaaatcacttcacttttaccctgataaatataaatgactaggaatgatcttcagctagcctttagcacctgcaaccaatctgacaataatgtgttcatcaggtacctgtggattaaatcacacaccggcatatttaagctgaatgtcagtctggaaaatgaatgtactatattaactgaaataccactctttgtgtaggtattctgtcatatatttaagaaaaattaaatagcatgtaaatcatataacaataacttaagtctttcttcaaagtgcatgtggtcctttgcaatacctcattcagccaagtatttgttctcttcctcattcagtttaaggcagctttcaatttgcttagaaggcaacattagaagggtagagtttaatcagaaacatagaattttaaagtgtgggttcaactgaataaatttgaatttctgtaggaagtaaagaattaaaaatctatttaaagattgcaatatataatcatttttaaagtatttgtttaacctgatgggttttccagaaatgaaaacaagtcagttctaaaaccaaagctgatatttagaaaatgtgaaaatataaatcagccctatgcataatatagtttctctaaaactttatcttaaagagtcattttaaaagaatataactattcaaaaatgtaactgctatcttaatgttttgaaataagttaaaacactttaaaatatgaatactgtagtttgaaagaaagaaactgggggaaggaaaagtagagaaagaaatgccaattccaatgcaaggctttatttgccaagttttcttagaatgacttttaccagtttatgaattcttgtaaacagaatgtataatagaaatactgaaacactgttgcctaaagtggcattgttgactgctactgtgatgctactgtaatgtaataaattattaaattgttgcaaagtgc

SEQ ID NO: 1062 - DNA, 12968 bp, Homo sapiens
cacagcagccttgtaggtgactggaggtgttcgctgatgtggccccaaccctacctccctccccaccccatgatgttagaagaatctcgacagaataaattggcagcagccaagaaaaaggtaaaaagccaagaaaaaggtcatggccccccaacctagccagagatcccctctgatgacaagaccactcccagagtccataccactcctgaggcacaccgggctgggcccccctaccccggcgcctctggactccccccaccaacgtcttgtcagtcagccccgccccttcagcaagcagcccagcctctgccctcgccaatcaccctgcggtgactttgggcggatgactactggggatacctgctccatattcagccctcacgtcctgccaccccaagcccaacctccctgggttctttgggctcacctctccaaggacctgggtcccccagccccaaccccccagcatcgccagtcatcccggggtgactttgggctggtgactcctggggttccctgagcagactctgctctcccctcctgctgacccaagcccgacctccctgggctctctggactggcatctccaaggacctgggtcccagccccacgtcccccctcccccatcgtggatcggcaactcagccattgcactgatgaggtttcccccacccccaggaggagtggaatgtagtgatgtcacagtcctcctaggaactgtcattactgctgcaagaccggcctttgatcttataacccagtcccctaagcattctcaccccatttctggttcctctggtcacagcacaaatttccagctagaagggaaatggggaccatgggacctaggagcaagaggtttcaggctgccttactcccttcacatagacatcgacagtgtgaaaagcctacacttcccctgtgagctcaaaacgttgacagtatctctgggtggtaatgggagaatgggtttggtttggttttctcccaggcttctactctccagagagactttaacatttttttccgagttctccacctcatattctaattctccacggttctgggaccagactgcccttcagtcagtggtctctgaagtgagatttgctcatcttctgtggaataggtcttgggaaactgaacttgacagcttgaatcttcctcatatcatctcaacttagggtacattgagtgccacaggataaatgtgggagatctttctgaagcatcagtttcccttgattctcttgagagagaaaaaacattaatgtacttaggggtgaccctcacataggtttctaagagtataccagacttctctctgaaatgagacttgggttgtcctctttctgataaattcccagatttaacaaaaaagctgccttctgccatgaggacacattgatataaaagtttgagagatactggtgcacttcttcacactaacaggcatttgaggatgtatgactctaaaccacacagcgtgtagttcatgcctatgtaatgtttacttttctacctctgcgtctggttttggtccccggcagctgctgattcatggcaaaaccccagagcttggagtcagaagactgagtttaagttccattattgcccccccacacttttttttttagccataatatccatccctctcagtcacttaagtgattgtgacaacaccttgtacagttgttggtggcattaaatcagatggtgtataagagtattttgcaaaaactgtaaggagggtgtggctgtaagggctggtagttctcatgagtattactgctcttctttcccacagctaaaagaatatcagcaaaggaagagccctggtattccagcaggagcaaagacaaaaaagaaaaaaactgacagtagccctgagacaaccacttccggtggtggccactcacctggggatgtgagtcttggctggccaggctcctggggacagggggcccaaggggcagtagagggtaattgttgagattgctgggtactggttaagaattctgggtttgaatcctgcttcttcatctgctagcgatctgatttatggcaagttgcttgagctctttgggcctctcttttcacatctgtaaaataggggtagtattgtttgacttccatttgtgaagtttaaatgagattccttattgttgttgttttcatgttaacccctagtacgtggcctgctgtaaacacccaggatacccaggaaatggtcattgctgtttgattttcctgatccccactcgcaaggggaagctgggctaatgagtacagccacttgccatcaggctgtccctctaggagtcactgaagggggcccagggtgtggtgaggagagcccaaggcactaggagcaagagaaggtctaacttgccaccagcttgctgggtgaccacagaaaaatcacttcttctgctgggcctcagtttcctcctctgtaagatgatactggataagatcagtgtctttcaaacttgttttttagctgaagtccccttagttcaagtgaactcttactcaggagtctgtttttttttaatggaggtggaggtctggagctctaccagattcatcgtccatgtcctgggcctgaggagaggggtccagtgagcgtattaagatctgcattggtcagctgactccactctgtgactgcgtcactcgggggacttttccatctattttttcctgcccctggcaaggcagcaggtggccatttggaagaatggcacaggccatggttttaatctcctctgctcttcttcagcgtttccttttcctgaacccacatcttcctcctaccctgactttcttgcttctctctaagccacttctgtctttcaccccctgcccttgtttttcccttgtcacctcctgtagattcaggacattctgaaggtgcgggtgtccaaccttaaccactccaatggggtagtgctcccccattggacaagtggaaggtgaggcagtgccaagacccctctctggcttgctgtctacagctgtgcatggccctgaggcttctctggcttgggggatgcttggcctctgccttgttttatgttgctgccattaaccttcagcctgtttctgtctgcttcttcacctgcttgattgattgggttttttccttccccgcgtcttttattatcttggaaatggtgacgcctaaaagtttaaaagtaatctgggaataacgtacagagcaggcatgtgggatttgggctctttttttttttttttttttttttttttgagacagagtctcactctgtcactcagactggagtggagtggtgcgatctcggctcactacaacctctgcctcccgggttcaagtgattctcttgccttagcctcctgagtagctgggattacaggcacctgccactacgcctggctaatctttgtatttttagtagagatgcagtttcaccatgtcggccaggctgatcttgatctcctgacctcaagtgatccacttgtctcagcctcctgaactgctgggattacatgtgtgagccactgtgcccggctccttgctgtttttatactttctccatatacataactatttcccatgtaagtttttttttaatttctcatttttattactcctgcatcatctgttaccctgaaggatctggaagtaagaggccctgggctgaggtgcagtgactttgcaggccagccctccaacctcctctcacagtgggggctgggtgaccctctgccagctgagacagcccacacacaccccagccctaatgattgttctctctacctctccccacaatcctcttccaactcctcctctctgcatgtgcctcagagccagtaccaagaactagcagtagccctggagtcaagctcagtgacaatcaatcagctcaatgaaaacatagaatcattggtaagtccagtggggtcccctgattccatgctgccaatcctgggctttagtttccccttggggccctgaagaaaggggctgggggcccctggtgccaagggcaaatggggagctggagcacccaggcctcacctggagggaccccagagcaaggagcacgcagcatggctcttctgtcactgccctctttgccgactctctcttctccagacacccctgctccagtccttgccacacacgccctgaggttgtcacctctcagggaagcgctagcctgactggttgtcaggggccctgtatttctgccctgactcagtccctaatttgctttgagtctggacaagccacctgtcctccttgggcttgtgtttctggaggaggtagagcatcaaagttctctgttagctctgagagtctgagatttaaaggcccctagaatggaaacctgagggccaagggctcctgtctgtccttttccatcctatatctgctgtgaagaaccgtagctggcccgtatgtgttcagtaaatgtttgttgaatgaaggcacctttctaaatcacaagctggcagaagggtgggccttcctgagactccctctctagaggtttatgttactgtcctttcaagagaatccagattcaggctttgagttctgtggctgtgggcaaaaaccaacaaagacccaagtcctctgtccttgggagcttgaggagggttgaccagtttgtgttgccattggttctgagaatgttgcctttaaaatccattcctggaccctgcctaccgcttccaggtctggggaatagagttgagggggccactctcagtcacctgaatttgactctccccacagaaacagcagaagaaacaagtggaacatcagctggaagaagtaacgtgatttctttgctcacaacatgactgctgggtttgggggacactcagatgcagaggcgccagtctcatcttgcccactcccagcctggggaagaaggctcacccatcagattccaccccatccccacagggtccctgataacctggtcccatgggtgggcctgtcctggggcattggtggcattctgggggcatgtctcttgctgtgccatctctgcctccctgtgataagagctctgtcttcctcttcctacaggcaaagaaaacaaacaatgaaatacacaaagcacaaatggagcagttagaggtgagtggagggtggggagctttctcctgtcctctggagaatgtttctttccttctctttcagcatttccttggcttttctcccaaacgttcaattccagacaatcaacatcctcacattggaaaaggcagacttgaagaccaccctttaccatactaaacgtgctgcccgacacttcgaaggtgggaatctgggcatcccgtcatccttcaacctggcactttgacaggtctttagggggagtcttttgggccccatctcaacctctctcattacagaagagtccaaggatctggctggccgcctgcaatactccttacagcatattcaagaattggagcgggctctctgtgctgtgtctacacagcagcaggaagaggacagggtgagtccaaccagctgccccatcccctggcagcctggcttcccagatagaggagtgagcctaaaggtcccttctgcaggatggagtgtcctgcccagaaggcagcatggtcatttctcactacttttgtgtatggttgttagaggcagcctggggctaagtcagctgctgtgggtgagttggggggcactgtggggagtgagcactggatgcagagctcagaggccaagtgcctgccctgccctttcctggctgtggccttggccaagtcctaggtggggtattgggtagttgttctgtgaaggtacagaagagcacctttagtatgttaccatttctgtagagagaggaaaggggtgtgtgtgtgtgtgtgtgtgtgtgtgtgtgtactatgataatatacaaaaacatgtctgcaagcattcataaaaaactcaggagagagtaacagggtgcctggagacacctcccttctgtaccttctgagttttggactgtatgaatgtatcatcctttcaaaaagtgaacaaaagattaatttcccccttcctatctgtgtccccacccccagcaagaaaaatgggcttagagaataggatagacctgggtgttcaaatcccagctctgtctaagtgatcttaggcaagcacttaaccttgaacactcgatgtttttcatctacacaatagaggtaatcctagtaaccgtctcatatggtggttgtgaggattaaatgggattgctagcatggaacctggtgaagcactccataacggttcaaacagtggtagtaataacagtaataacaatagcaatattatctgatctctctgggcctctgttagccagctgtaaattctatctctttccctctcccttccaactttactgagttcttttaataaccaggccacgggcttggaaatgccttgacctttactgaccgagttgtatattgagcctagccctagcccttttaaggggcactgcccgagctccccagatcaaaacttctcactcttcaccatccagtcctcgagctgcagagaagcggtcctccagcggcggttacagcagaccataaaggagcgggcgctgctgaacgcacacgtgacacaggtgaggctttgcagagggagggatgtggaaggaagatgaccccaggtggccaggagcaggtgaggaccagtgacagcccttcctaacttctgtgcccatttcttgcaggtgacagagtcactaaaacaagtccagctagagcgagacgaatatgctaaacacataaaaggagagagggcccggtggcaggagaggatgtggaaaatgtcggtggaggtgaggtctgacccttcagcccccactttagataggtcactggatctttctgggcatctgtaaaatgggaatagtacagccagaggtggtcatgggtctgggctttgtggagatggggacagagaatgagatggtagcctgtccagccaccagcccctctctccagggccctttcccctgtgctttgggcaggctcgaacattgaaggaagagaagaagcgtgacatacatcggatacaggagctggagaggagcttgtccgaactcaaaaaccagatgggtaagatggggctggtgtgacctcggagcaggactggcatcagaggtctgtgggggtggcttagaatgccccagggaggtgggtgggtggaagggctttgaggcagagggaaagaggtctgtgccaggagacggcaagttttgtcatctccatgagcctcagggtccccatcagcaaagagggaggagtgcccgttgtcagccacccacagtgctctctatgtgaaagtggcttggaaattggctaccattgggtgcgaggaatgattagcagtgaggccaagtttgggaagcctgagaggagctgtgcatcaagaggaggttttttttttttttttgagggggatgtgggtagaggggttggggaatccagaggcccttattgtctgcttcatttctcagctgagcccccatccctggcacccccagcagtgacctctgtggtggaacagctacaagatgaggccaaacacctgaggcaggaggtggaaggtctggagggaaagctccagtcccaggtggaaaacaatcaggccttgagtctccttagcaaggaacaaaagcagagactccaggagcaggaggagatgctccgagagcaggaggcgcagagagtgcgggagcaggagagactgtgtgaacaaaacgagaggcttcgggagcagcagaagacgctacaggagcagggtgagaggctgcgaaagcaggagcagaggctacgcaaacaggaggagaggctgcgaaaggaggaggagaggctgcaaaagcaggaaaagaggctgtgggaccaggaggagaggctgtggaagaaggaggagaggctacaaaagcaggaggagaggctcgcgctctcccagaaccacaagctcgacaagcagctggccgagccacagtgcagcttcgaggatctggtgggttgccccacctggggagcctgccctcatccctatccctccaggcctttgtttccccacctgtaaaatgggccagtgtagccctcacatgaaatgctacttctaaaggcacctgtgagctacagctcatcgggctctgctctgatggctgtgggggagaagggatgatttttctaacctgcctccacccttcctggtgatatgggaggcagacaccaaggtctggtgtctccagctgcagtggatggccactgattgcttctctctgtccagaacaacgagaaaaagagcgcactgcagttggagcagcaagtaaaggagctgcaggagaagctagacgaggtgaaggagatggtaacctccaccccatccaagaagggctgggaggcgggcaccagcctctggggaggggaggtgccaggccaaaggcagctccagctgggaggcaggtgaccccagcaccctccagtgcagctctatgactgtttcttgcttcctgccctctgacttttagaggtgggtagccctgggctcctcccaggtctggacatcatcatcccagctagagacatggagcccccaatcacaggggaagagacagtggtacaagaggctccttatccaggcacggtggctcgcacctgtaatcccagcactttgggaggctgaggcaggagaatcacttgaggtcaggagtttgagaccagcctggccaacgtggcgaaacctcacccctactaaaattacaacaacaacaacaaaaaattagccaggcatggtggcgcatgcctgtaatcccagctactcaggaggctgaggcacgagaatcgcttgagcccacgtggtggaggctgcagtgagctgagattgcaccactgcactccagcctgggccacagagtgacactgtctcaaaacaaaacaaaaaaggctccttagattcaaactggattctggcctgggttccactggtcaccattcaactactgttcatctctaagtctctgtttctgtgacttcaaaaggaagttagcattttccttgcagaggtgctgaggattgaatgagagaatacctggaaagcattaggcatgtagcacacttagcagatggtggttggctccctctgcttttccaccagtctgtggcctacagtttaaatggtgggaagaaggacatgagatttgaggctggggaaggaggtatggggttctaggcaagggaggaagcctcttaggcctggagcaagggaccagggtcctgggcaggtgacagagccccacggtgccctcgctaccctattaatgggcccagaatctggaagccagccaccatgtgccctcatgcccagggtcttcctgcaggtggagctgaagagccaagagtctcagagtctgcagcagcagcgagactagtacctgggtcacctgcagcagtacatggccacctatcagcagctgacctctgagaaggaggcgctgcacaggcagttactgctgcagacccagttcgtggaccagctgcagcagcaggaagcttggggcaaagcggtggctgagatggccggccaaaagttgcaggagacccaggggagggagttgctgaggacggggccccgagggggatgacctggcaacctccgtgccttctcactctgtttcccgtccccttaggagcacctagaagctgccagccagcggaaccaacagctagagacccagctaagcctcgtggctctccctggagaaggtacaggagaccactcagaggaagaggagagagccccaggaggaaggggggactgttagcagcataggattgaggggttggaagagacctttagaacagctggtcgttatgccaaccgggtgtccgcactaagttcagcatcaatatggtgacctcctgggagcagggggccaccaggttgcctaaggatgaatgaactggaccagatcagaaagggagcaggtcaggactcccgcaccgaccggtagtgggactgtgcctgggcaatatagcaagatcttggttcttaaaaggaaaaataaagaacagcagctcactcccctctggggagaggctggctcagggttacacagtcagggtggggacagaggtaggcccacagtaccttccttgttgggttgtctgaggacccctctggccacctccccacaggagatggaggacaacatctggacagtgaggaggaggaggcgcctcggcccacgccaaacatcccagaggacctggagagccgggaggccacggtgagcctgactttccctgccccactttgccaccttcctctgtggtccctcccagagcccgttatgctcttggttttcccaccttctgatttctctggcccctcaccccttccgggagccagtggtcagacactttgtcacctgtgaccaacaggtgcactctctgaggccccaagggaaggggttgttctccacctccctgcctcatttgttctgtctatgcccctacaagaatactcacctcttgccttcaagtggcatttttcaactccgctggagccagttcccaggaggagcaggcacggctatgtgggcagcggaaggtgtgaaggctgtgctgcctgcacctggctcatctggtggccttggcctggaaggagccagaggcagaggccccagccccagggaggactggagatgagtttgtgtgtggggagagctaccgggccctgaaggaggccatggtgaagctgaaagggagtgagtcctggcatgggccaagaaaagtgggggcggggcagaacaggtcactcccgaggtgtgaccccattattttggctccagagcagctttatggacctcccgaaggagaaggcggacgggacggagcaggtggagagacgagagcttggattcgtccagccttctggagtgacagacggcatgagtgagcgggaggccagggcacgggcatggggagctgcagggccgtcggagggaccctagtgtctgagctgtgtcctctcacaggagagtccttcaccgtatatgaaagccagggggcagtgccaaacacgcggcaccaggagatggaggatgtcatcaggctggcccagaaggaggaggagatgaaggtagggcgtgcaacatctctgcggggttgggggtgggcatgggcactggtgcaggctccagggtgggagctgagcacccctcccttcaggtgaagctgctggagctgcaagagttggtgttgccccttgtgggcaaccatgaggggcatggcaaattcctcatcgctgcccagaaccctgctgatgagcccactccaggggccccagccccccaggaacttggggctgccggtgagcaggatggtgagtagagctctcaggcggggtgggcaggcaggggcaggggaggctcgcactgtgctcagacccccgcctccctctctccgaagttttttatgaagtgagcctggacaacaacgtggagcctgcaccaggagtggccagggagggttctccccataacaaccccactgtacagcagatcgtgcagctgtctcctgtcatgcaggacacctaggagcacccaggcttgcccagcaaaccctgcgtgccattcttctaccaggcagccgagaacagggagataaacatcatcatcttctaagagctggtcaagaaatttaaaacaacaacaacaacaaaaagttacggggttcatctcctacacaattcatttactccatttgaatgctagagccactcacttttatttgtgtttctaatttaccgtttaaatttatttgtaaaaagttaagggagagttggtctttccctgatgttctttctggcatcctttagcatttttatttttaatttgataattgtaggtcattagtatgcatatcgagtttgcccttaggtggtgggaattcaaacacacaaagacccactaatttgcacaaaactattctggctggtttggaacaggctgccatgcttttttaatgttattgcagcatgtatattcattccagaattcagataaaatgtgcttatgttctgctattacgtttgatcgaatcctaaccacagtgagctcttcattagctcaatatgtggtttgccctcaattgagcactgtttattactttgtaatatgccactgtgagtactgacatttagagttgtttaaaggccaagaactggaaacagccttttccctattttctgtgtattggggatgggagtaataacattttggggagctttttaaatctcacagaagaggaaagtggcctgctctggcaggtgtgtgcaggatagagtgtgtttcatttgttctggtgccaagaatgagcgctgcactatggtagttcccttaggatttgtatgtgctctgggctcatgaagatattgcatcatgagctgcagcagttgtaccctttcttgatgacctaaaaagggattatttctgaggaatgaaaggctcccatcattgactgtggatgtggaaaaccttttctagcttagagcatttatatctacaatacattttaaagtcagagttcatgttacctgttttaatcacatgagtatatgtcccagtacacaaaagggcactggttggcattcttcttaaggtatttagtgaagatcataagaaatcctttaagagtttaaatgtccctggaagaggcatacaggctctagtcaagaatgaattcgagtgaaggaaagctgtgtgacacctggccttcctctatgttcatggagcttctttgaggctagaagattgattttatcatctagacctctctggctaatacctattcttcaaccacactagttactctgacataggaatttacttcttttctttgaatggaaaacactttaaaaataataacaa

SEQ ID NO: 1063 - DNA, 10291 bp, Homo sapiens
cgcagacggcgcccagcggcggcgcgaacggcagctaggagggttgctccgggcttggtgctcactgcgacttcccgcgcagggcccggtcggactaggacccgcggcctgagagacgctggaggatgcggacgcggaggccgcctggggtagcggcggcgggagtcctggcgctctgcaggtaggagctcgcccgctcggcgggcgcggaaacttgggccgagtttgcgggcggcgcgtggagaaggggcgggtggcgctgccccagggcgcccctaccggccggcccggggactgagggagccgcgcctgggccgaggggctgcggcttctggctgccgccggccccccgcgaacgggctgcggggcaggggtggcgctgctgctccgactttccccggacttcgaggctcccgggacctggtagcgctctgggtctccggcggagaacaggcgcctaatctggcgagaaggaactcaggccgagccctccggcctcccgcaggaccctgtcacgtggattgctgggggatggcgttgaggaggaggtatggggacaagggggcactggagggctgggcctgggggcgccgggcgctgaggcaccgcggggccctggacgcgccctgctgggatgggacggccctgcggttttctcgccacctcttgactcacccctctggcctcagcccaggctggcaggatcgccctgaggcggaggctgcccggaccctgtcgccgggccgcccctgttccgggacctcccgccggtccgcgggcgtcggtgtggggctgggtgcgcgggcctgcctgcgtgcacacgtatgcccggggcccgagcgaggggagagcgcagttctggaatggcgtgtgtgcagatgtgggccatgcacgtacgtgcaggcacgggtttgcatgcgtggcggcggcctgtgtgtcagcctgctggatgcacgtgcgtctcggcgccgccgggaggggcttggggacacccggaagcccgccaggtcgggtgcggcggcagcctctaagcgaaatcggctgtgggccctaggcacccgagttatgttcagggcgggtaggggaaaggggatagagaccgatcccgttcgctttcccctccactggagactttgggctgccccaggttgggttgtagcgtctggagagcccagagcctcaggtagggaaggtgggagatgggagaacactcggcgaggcccgatccagccctccgggagaatccagatgctggccacaattgggcaggaatcgcgctcttcttcctggtctttgccatcggccatcccgaggcccctagaaggtgaaagtgggaacagagagctgtttcctttcccactgcgtaaggcaggggcggtgctgcggtggtgggctcttctccgggaccctggcctgggtgctggctgagtgacgttggagcttggcagagaggatcaacagagctgcctctcaaggatgatctgagcctgctccctgggcacctgccctttccgagagcttgcttgcctcagtatgggtcagggaaggaggcacctacattttggcaactgtcttgagtggaggagtcgtctcccttgagagagtgtatcctgggctttccacctcctactggcaggagatcaggtcattcccacacccctaagagttctctgttggctccctgaagccgccacccctcccacaaagactcctgagggtcccaggtggtttcctgtctattgactgggtcccagataggggcctcaagaagtctccagagcaaagggtattccatgggctgagacccaggagagagggactcctggggtgggggtggggacccagcagaccccaagaagcatgtgggggaggtgagaccaaagtcagtacttaacccagagtgtcccaagggtggaggtggggaggatccacacttcaaaaccctacagttccttctcacagcattgctgtggagtgagatgggggctttcacccctcgatagcaggtttctatcataggacactgctgttgggactgtcacctgtgtcctaatggcccctctgtgtcttctctaggctggcctgaggtgtggggttctgtccaggagatgaaccagcttgctttctgggtctgccttggtggaagtgggcattggcccccacactagccttgtgttttctaaccccaaaatgtgccggtctaactcagcctgtggctgtcattggctccaaccagaagaggcaaggagagggctggtccttgcttgccagtcactgaaacctgtgacactttgccctaatcatagcaagattgagctaggtggtcctttctaagctactgagagtttccaggaatagggtgctggctgggggaggtagaggtaggtcagtgtggccccagaagacaggcttcagatgagcccctaacgggttactgggtgcctgctgccctgaggggcctcagtccccatccttccttggtcttgtcttagagctttgtcttttttcagcacatagtttttccatcaatacaatgggagtagtggctaagtagcactctggcccctggggcctccctccctggacttttttcttttcttttcttttctttttttttgttttgttttttgttttttgtgtttttttgaggtggagtctcactctgctgcccaggctggaagtgcagtagcacaatcttggctcactgcaacctctgcctcctgagttcacgcaattctcctgcctcagccttcagcgtagctgggattacaggcatgcacaaccatgcctggctaatttttttgtatttttagtagagacagcgtttcaccatgttggtcaggttggtcttgaactcctgacctcaaatgatccgcacacctcggcttcccaaagtgctgggattacaggtgtgagccacagcacctagccacctccctggactttcacacacgcccctgacgctgtcttggccccaccctgccatgtgcctaggaatcgccatctgcagcttgggggctgggggtggatccaggctcctcatgctctgggaccttcctgctggtgctgcagcaccatctgctgggctgccctgactcctgcggagggggaggagtggggcgagaggggtgtggcttgtacagactgatgtccccagttacctctcctaggggactgctctccagagccaagtccagtatctcagcattggctttgggcctagggacctgggctggaggcccgactctgccatttttgacaagatcagcaggtcagaggagtgtcacaagaaatctgtgaatttgtagacaatactcagattccatgttttggctgcagtgggcatcactgtggcatcttggaataggaccctgtggtgggaggcaggaggcctgcttctcgttgtgtctatttcattggtgactttgggatgaatgggtctcctcatctgtatatgagggggtggcggcagggtatgtcaagtgaccctgagacccagtgcccctacaaattctgaaatcccaagaaggaggggatcttgggagttgtatggaggaaaatcgaacagaaggggctcctggagtggggatgggtgggggttctgtgtagaataattcattaaacaaagggttctgcagcttaaaatatacgagttggggtcaggagcagtaggtggttcatgcctgtgatttcagcattttgggaggccaagatgggaggatcacatgagtccaggagttcaagaccagcctgggtaacatagtaagaccctgtttctacataaaatactaaaatgagccgggtgtggtagcaggcacctgtggtcccagcaacctgggagttgggagaatcacttgagcccaggaggttgagactgcggtgagccaagttcatgtcattgcactccagcccgggcaacagagtgagaccctgcctcaaaaaatacatacacgagttggaaacctctgtcacgtggctcatgcactcacagtcttaactgagcatcatttaagcgccaggttcttaggtgtagccgtgagctgatgagagcagcagccctctgttgctttgcctgtagcctgttttcctgacagcccctgcctttctctctctatcccaggtcagaagttgagtagcaggggcctaggagggctcgaagccttcacagcgatggcagagaagcgacccctgagaaccctggggcctgtgatgtatggcaagctgccccgcttagagacagactccgggctcgagcacagcctgccccactctgttggtaaccaggatccctgcacctacaaggggtcctacttctcctgccccatggcaggtactcctaaggccgagtctgagcagttggcgtcctggaccccatacccacccttgtactctaccggtatggcaggacccccacttcaggcagacaacctgctgaccaactgcctgttctaccgctcgccagcagaaggccctgagaagatgcaggactccagccctgttgagctcctgcccttcagtccccaggctcactcctacccaggcccaccactggcagcacccaaacctgtctaccgcaaccctctgtgctatgggctctcaacttgtctgggggaaggagcagtgaagaggccactggatgttgactggactctggcgactgggcccctgttgccctcagctgacccaccctgctctctggccccagctcctagcaagggccagactctggatggcaccttcttgcggggggtgccagctgaggggtccagtaaagactcctcagggagcttctccccatgccagcccttcctggagaaatatcagaccatccacagcacgggcttcctggcctccaggtacacaggtccttaccctaggaactccaagcaagcaatgtctgaggggccctcaagtccttggacccagctggcccagcccctggggccaccctgtcaggacaccgggcccacccactacccaccaccccaccacccaccaccccaccctccacaggccctgccttgccctccagcctgtcgccacccagagaagcagggcagctacagcccagcactcccactgcagcctctggggggccacaaggggaccgggtaccaggctggtgggctgggcagcccctacctgaggcagcaggcagcccaggcaccttacattcccccactggggctggacgcttacccctacccctctgcccctctcccagcaccctctccaggcctcaagctggagccgcctctcactccacggtgcccattggactttgccccccagacactgagttttccttatgcccgggatgacctctctctctatggagcatcccctgggcttggagggacaccaccttcccagaacaatgtgcgggctgtgccacagcctggtgccttccagagggcatgccagcctttgccagcgagccagccctgctcagagcctgtgaggcctgcacaggaagccgaagagaagacctggctgcccagctgcaggaaagagaagctccagccccggctcagtgagcactctgggccgcccatcgtcatccgagacagtccagttccctgtacccccccagcactgcccccctgtgcccgggagtgccagtctcttccacagaaggagggcgcaaggccacccagctctccaccaatgcctgtcattgacaatgtcttcagcctggccccctaccgtgactatctggatgtgccggcacccgaggccacaactgagcctgactctgccacagctgagcctgactcagccccagccaccagtgaaggtcaggacaaaggctgcagggggaccctgcctgcccaggagggcccctcagggagtaaacccctaaggggctcacttaaggaggaggtagccctggatttgagtgtgaggaagcccacagcagaggcctcccctgtcaaggcttcccgttctgtggagcatgccaagcctactgcagccatggatgtgccagatgtgggcaacatggtgtcagatctgccaggcctgaaaaagatagacacagaagcaccaggcttgcctggggtgccagtgaccacagatgccatgccaaggaccaacttccacagctctgtggccttcatgttccgaaagttcaagatcctccgtccggcacctttgcctgcagccgtggtcccgtccacgcccacctcagctcctgctcccacacagcctgcacccacccccacatctgggcccattggactgcggattctcgctcaacagcccttgtctgtgacctgcttcagcctggcactgcccagccctccagccgtagctgtggcctcccctgcccctgctccagctccatcccctgctccggctcgagctcaggctccagcttcagcccgggatccagctccagctccagctccagttgcaggccctgctccagcatctacttcagccccaggggactccctggagcagcattttacaggactacatgcgtccctgtgtgatgctatttctggctccgtcgcccactctcctccagagaagcttcgcgagtggctagagacggctgggccctggggccaggctgcgtggcaggactgccagggtgtgcaggggctgctggccaagctgctgtctcagctgcagcgcttcgatcgcacccaccggtgccccttcccccatgtggtgcgagctggcgccatcttcgtgcccattcacctggtgaaggagcggctcttccctcggctgccacccgcttctgtggaccatgtgctgcaggagcatcgtgtggagctgcggcccaccacgctgtcggaggagcgggcactgcgggagctcgccctgccaggctgcacctcacgcatgctgaagttactggcgctgcgccagctgccggacatttaccccgaccttctcggcctgcagtggcgcgactgtgtacgccgccagctgggtgagcatggggcagccccagtggccaccggagctgtgtgagcaagtgacaggtgtgtgtgctgtgtgagtgcgtcacagctggggctgagtgattccaaggactcctgcccgggtagggggctttaggatgagctctaggtacccccaccccttgaccctccagacaatcagtgagcaccttcatagcctcttttgtaggcttctgaacatgccagctgctctgtccccatggaaactcctcggcctcccctggtgctgcaccttcttggattccctcctcctctgcctgtgccttctccatctttggtgcagtgtttccggcactctggttaggccctgttttctagctgagataatttccctgatctccagcctagcatcccctttgtgagctctagccctaaataacccactgcatgctgggcctcagcccctgggtctctctcccacactgaactcatcccaaatcacactcccgagccttcccctcagctcacttcccacaaccagttcttttccatgtcagtgaagggcaccccctttcacaaagctcctcatgctctagacctggtgagggccacagctgcctttttgaacgtgtagttttgcagtcctccccggcccttacatacacagaagtgtgcgcataagtcgcattgttttgtggtttgcttttcctctactaaatgatgtgcctgctgttctccagcttgttttcttttaatgtcctggaggaccacacaactgccgaagtgttgtgtggcgtgtatgatcacacttcttcagctagggatctggtgatgggaccaagtggattctgttattgcccctcctgcgtcagtacacctggcattgcagcctgaggccccctctagtttttctctccctgctgcccccaattccaccctctcccatttccactgcccagcctcttccctgtagaaactgttcctagttccatccccgtagtggcagccttgccccgggcccttacctggttgggatggggaagggcctgtggcagtgaggtgcagatgagcttaggggctggctgaccagaatccctgatccctgagtacttacaaaattggagcagatgccttaatgggatgcaaaggaaatccagactcaggcgatctgttactgagtgagggtcccacatcactcagggctgggctgcccagctcagtcctctccccatacagttgggctgtctggggcccagagagggtcaggtctgtttctcctgggctgcctgatcagcagtggagtctgggcactccacacagtccgaggtgctctgactggagcttgcaacaatcggggggcctgggaagcaagtgattgagaccaggcttctggcttctggctgaattttgttgcccctgtcctcactccctcccaccttgggggccgtttttctctgtgtgcccctagacagttatccctgccttcctttgttgtgggtgggttcctgtgctcccccagcatggctcttaggacagtccctacctgggctcggcctcgggcttgggcttggtctctggggctggtatggcagaaacatgatggctgtcttatatatggcagggtcctctgttcccatgcctcagttttccatctgagcaatgggtattggaccaggccaatggttcctgacctgctgagcccctttgctctcatccttgtacccaaacagcctctcctgagtggtgccctcatcagatagagttctggtgtcacctggggagaagcacatcttttttgcttggatggtctggccagtgggcatgtgtggggaagagttgtgatgccagcctgacttggggcagagcagaagcactgtttggatggctttggaagccaggaggtgggacctgagggtatggggtctgcaggctgactatgtgttcgttttccaggtgactttgacactgaggctggagctgtgtcctcctcagagcccactgtggccagaggtgagccagagagcctagccctggctcagaagtcaccggcccccaaggtcaggaagccaggcaggaagccaccaacccctggcccggagaaagcagaggcagctgctggggaagagtcctgtggtgcctcccctacccctgctaccagtgccagcccacctggccccacactgaaggcccgcttccgcagtctgctggagaccgcctggctcaatggcctggctctgcccacctggggccacaagtcctcaagaccagaccagccctcaccctgcccacagctgctggacagccagagccatcacctgtagcactggttgccagtgctgtgtgtatagcagtcactctccacccttcccttctgcctgcccagctgccccggggccacgagtggatgctggggctgtggctgctcccctggaggggttccatctctgaccctgtggcccattcagggtgggctgaagagcccctgagcttttaacgtgagggtctttattggataggactactccctatttcttgcctagagaacacacatgggctttggagcccgacagacctgggcttgaatcccggctcgtgttcttgctgcaggacctgggcaagaaacttcacctctgctgagccctcattccccatgtgtaaaatgggacaacgcaacctacctcacagggttgttgtggggatgctgcctgatacataccctgtcaccatttggtctctgcttcctctctgggacagggcctagaattggaggcagagaaccttcctatagaaagtcttcgtgtgtcctaggacttggctatcgtagagtggtaccttaggcagtggatgtgactcacactttcaggagtcaccccccagcatttggggttgggttggccctactccagcctggagctccctgagggagcctgcactccctgctcccaatccccgctactggtgcagggatgcagcctggagctggcgtccttgttctgggcctgctgctgccgccaccccaggaggccccaggcctgtcctgaattgacatcagtgcttccctgaactgcctcccccacccctggcattatcccaggaaacttatgttttctagaagctaagcagctgctgggactcagggactggtgcaggtaggctgagtggcagctcagtcctagaaggtctctgaagatctggactgaggaccctgctgctccccaagccagagcccatcagccaggcctgctgtgagccacctgcctgtggagtgctgagctcaaccaaaggctggcaagctctgggcctcatttaagggattctgatgagccgatgggccctggaggcagcccattaaagcatctggctcgtttttggaa

SEQ ID NO: 1064 - DNA, 7634 bp, Homo sapiens
ccctttagtggctgcagtggcgacgagcggaacggagtgcgggttcccggggagggggcgtgcaggatcgggttgtggggggtgcgctgtagggctaaggagaagatgagctttggggggccctgaggaggaggggagtcaggattaaccgaggacagggtcgcagcgggggcatggggaggacgggcccgagagcgccgctcctccccaaaactaggatttggagcctcacgttctcccgcaaaacgagccctgtgggtgccaggccaggggcggctcccaggtgtggagggggcaaggtacgggcgtctgccgtcgctaagtgcccccttccacttaaggcacaccttcgcctccgattccgaaccgcccggggacagaggcaagtggcaaagcagggagggcggaggtgaggagtcgataccccccaccccagggaccaggcgctgccgcgggccctttccctcccccaggcccggggcaggagctcggggagcccttcctggtgcccgccgtcctcctgcggagccatggggagcggctccagcgcatggcggcagcccgcccgcctcgtcctggcccctgccctgacccgggggcggccgcggggatgtccggtccgtggggcaggcccggttctcgctgcggccaagcggccgattcggccgctcccgccgctcccccgcgccaggccgagcttcgctctttccctcggtggtgagcggccagatccaggcgggtcctaagtgtggggggaggggggcgcagggaggggcggccacgcgatcctaagaccctttcagatggtgggagagcctggagaaagagacagcgtgtgcggagggggtgctccctcagatggggggtcaggaagtctccctcaagtgtctgggacagagggacagcaggggccaaggcggagatgagatccgtgagtgaggggagccgggaagaagtaaggctgcagccgcggccccgcaaggattgggactttcgtctaaacgcggtggaagcccatggaaggaagcggttagcagcaaggcagagtcctgctccctctgcagccccagctcccagcgccctgggctttccaggcacctgtccgggtaggggattgagggccgtggccaggcccgcactttcctgccagccgcagctggccacatgcccatctgaccctccgagttctcctctaaaaatggggctgacagccgctacctcacaaagtccacaccgggctcaacccgctgccttcctccccaacaggactctgccaccctccctcaggatgcctgagggccccgagctgcacctggccagccagtttgtgaatgaggcctgcagggcgctggtgttcggcggctgcgtggagaagtcctctgtcagccgcaaccctgaggtgccctttgagagcagtgcctaccgcatctcagcttcagcccgcggcaaggagctgcgcctgatactgagccctctgcctggggcccagccccaacaggagccactggccctggtcttccgcttcggcatgtccggctcttttcagctggtgccccgcgaggagctgccacgccatgcccacctgcgcttttacacggccccgcctggcccccggctcgccctatgtttcgtggacatccgccggttcggccgctgggaccttgggggaaagtggcagccgggccgcgggccctgtgtcttgcaggagtaccagcagttcaggtagggccagcaccaggtgtgatgaacatagtcgcgggctccacacctgactctcttagtgccttcttggccaacaaggggcgagtccctgccccttctgggcctcagttctctcatctgcagatcaagacagtatacctgtcctgggtcagctccctgagccagtgggcatggaaactcaaaactaattgggggccgggtgtggtggctcaagtctgtaaatcccagcactttgggaagccgaggcgggcagatcacgaggtcaggagttcgagaccagcctggccagtatggtgaaaccctgtctctactgaaaatacaaaaattagccgggcatggtggcacatgcctgtaaccccagctacttgggaggctgaggcaggaaaagcgcttgagccggtgaggccggggttgcagtgagctgagacagcaccattccactccagtctgggcaacagagcacgactctgtctcaaaaaataatgataataataactgatgggggaggagagaggagagccaagaggaggatgggtaggtactgccctgaggacatgtggccagttagtgtcagagaagctggggctcccacccacaatcccacaccacctctcagggctcccaggaggctaagaaggtggaggggctttaatatggtaagtgaggctgagcggaattgtttcaaggggatggggaggggactatctcatgacatggcttccgccttgggctttgtggtctcccacatccggcctgcccagtattctgtgtcctgtggtctcctctgcgccacttccctgcctgcagtagggtgtaacagccccacctgggatgtgatgcaggtcacctcacatggcacagtgttggccacttcctttcctctgaagaggaaacgtgtatgagtctctgcttcatgccaggccttgttctaggggctcggggtacagcagtgaacaagatgaatgtggtccctgctcccacagaactgatgttcacataggataggggaatgagaaatggacccatgccttaggaaaacccaacaggtgaaggaggtagaggatgacttggccgagggtgggggtacattagcaatggccactctagggaggtttgagctgaggcctgactgatgagaaggagccagccagaggaaggcattggaactggcaagagtcacaaatgcagaggcctggagtagggttggcaagttctccctttctgggggatgctgtgcgtccgttgacccttaggagacttggatacctgtgggatgggttggagatgtctctggtgccttagaagaaagttgactcctggccttcccctgtgtgaactccaagcacatccccagggaaacatctgtctttggtcctggattcctcccacctcagccttcctggggagtcacgccacaagttaactctgccagctggctctgaagtttctctcaaaccacgagcatttgggctgttttcttagtcccccagctggggcgtgtggcaattggcttacctcagggatcagggcacctcccaggctacccttgtaccttcaccccagaactctgtcttctgacccactcatcacacccattagtcagtcttgccatgacccttttccgcaaagaaacaagatgcacatcctcttcacggtgaggaggggagacccatgacccttggaggtggggtgggggctgctagggccctcactggtactccacatatctcctgcacagagccagacaatgtccaggatcttgagaagaatggaccctaccaatggcaaacccacatatggtctctaacccaccacaaatgctatacagggagctccagactgcaaacacacttgaggtcctgtggccacactgttctcatgtcctgaggagtctgaggtgataaacacacaacctcatatacaacctcatgttgctttttttttttttttttttgagacagggtctcgctctgttgcctaggctagagtacagtggcgccatcacagctcattgcagccttaacctccagggctcaggtgattctctcacctcaacctcctgattaactggaaccacaggagtgcatcactaagcccctggctacttcttaaatttttggtagagatggggtcttccttgttgcccaggctggtctcctgggctgaagtgatcctcctgcttcagcttcccagaatgctgggattacaggtgtgagccaccacaccagcctcaagttactttagatcagtatttttcacctttcacaatgaatttatttttaattttgtttttattttttgagatggagtctcgctctgtggcccaggctggagtgcaatgctgcgatctcagctcactgcaacctccacctcccaggttccagagattctgctgcttcaggcctcccaagtagctgggattacaggcacccaccatcatgcctggctaattttgaatttttagtagagacagggtttcaccatgttggccaggctggtctcgacctcctgacctcaagtgatctgcccgcctcggcctcccaaagtgctgagattacaggcatgagccactgcacctggccgtcctttcacaatgaatttaaatcccttgatgttcccatttaacagataggaaaacgggggcagggagaagaggaactgtaactcccagtttccttccccttgcacccagaaacaggttctctgagcccctctccccatcccatggagggtggggatgggtcttacgcacccagaccgtgttcctccagggagaatgtgctacgaaacctagcggataaggcctttgaccggcccatctgcgaggccctcctggaccagaggttcttcaatggcattggcaactatctgcgggcagagatcctgtaccggtcagcaagcaggcatgggcatggggactgcggtgggccaggtgtgcccacattccccactgcctagcatggcttgccttgcccccactacaggctgaagatccccccctttgagaaggcccgctcggtcctggaggccctgcagcagcacaggccggtaagcccagagagggatggagcacacgtgctggcacactggtgtccacatgggccggcaaggagatgggtggggtcaggtgtccccagcttagctcaacaacaggggtggggaggggatgaactgcccaaagtctgaccaagctcagagagaaggtcagctgcctttacatggccctgctgacagacaggtcctgcccctgccccttcctcagagcccggagctgaccctgagccagaagataaggaccaagctgcagaatccagacctgctggagctatgtcactcagtgcccaaggaagtggtccagttgggtgaggccaaagatggcagcaacctctgcttcagcaaatgattgtgtaaccctggggcacttgtccctctctggacctgattcaccgatttggaagtttgtagccctagctgatactcaatggactaggcctcctcacttgtcaatagtgtttccaggctgggcgcagtggctcatgcctgtaatcccagcacttcgggaggccgagtggggtggctcacctgaggtcaggagttcgagaccatcctggccaacatggtgaaaccccatctctactaaaaatgcaaaaaattagccaggtgtggtggtgggcacctgtaatctcagctactcgggaggatgaggcaggaaaatcgcttaaacccaggaggtggaggttgcagttgagctgagatcgtgccattgcactccagcctgggcaacaagagcaaaactccatctcaaaaaaaaaaaaaacaaaaaaacagtgtttcctccaagctgcccatgagacaggcaggacaaggattcttttatatatttatacacacacacacacacacacacacacgcacgtttatatatatttttggtagagataggatcttgccatgttgcctggactagcctcaaactgggctcaagtgatcctcccacatctgcctctaagtagctaggactacaggctcacaccaccacaccgggctaattgttaaaaattttttttgtagagacagggtctccctatgttgcccaggctggtattgaactcctggcccctagggattctcccatctaagcttcccaaagtgtcgggattacaggtgtggccactgcacagggccaggacaaggattcttaatcccactccaggatgggaaacccatggccgagtgggaagaaaccagctgaggtcacatcaccagaggagggagagtgtggcccctgactcagtccatcagcttgtgtagctgaggtctgggccaggtctaaccaggctccccactcctcccaacctgagcctgccctctgatctctgcctgttcctctgtcccacagggggcaaaggctacgggtcagagagcggggaggaggactttgctgcctttcgagcctggctgcgctgctatggcatgccaggcatgagctccctgcaggaccggcatggccgtaccatctggttccaggttgggccctactgttcacacaggcagagaccccaggaggctgatgggtggaaacgtggggtcacaataactggggtggtgatgctcagggtctgtctagaccctccaaggaccacactgttcctgagggtcacacccctcccctcccatgcgtcccagggttgcagctagtggaagtagcccaaggcaggtagcccaagtgaaagtagccaagggcagagcagctttgctgatgtggactctaacatgggggatgtcctagaggcttcctaagggagaagctacactgatctggatgggtgtgtgtgagtcctgcctctccaaggaataccgcccctgtgccaacccaggctgattcctgaattatccccatcccattttagggggatcctggaccgttggcacccaaaggtaagctactcctaatgtaataggctaagagagcagaaaggacttcacgcctgcaagggctacagcacccttctccaccctatccccctgcaaccctgggagtcacccctgggcaggataggaccctccaactccaacaccagtgtcctgcagggcgcaagtcccgcaaaaagaaatccaaggccacacagctgagtcctgaggacagagtggaggtatggctgcctgctcccgcctcctcccctgcactctgcagccctggctgcccctcccaggcagctgccttaccctaagagggcggggggagtggtgggccctaaccaacctctgaactgctttctgagcccctcagggacccgtgtctcctccatccaggacgctttgcctccaagcaaggccccttccaggacacgaagggcaaagagagaccttcctaagaggactgcaacccagcggcctgaggggaccagcctccagcaggacccagaagctcccacagtgcccaagaaggggaggaggaaggggcgacaggcagcctctggtgggctttcctcatcactcccagaaactggctctacaggagaggatgggatggtggcctaggagcgcgtgtacaaaggtgggagaaaggctgccatggcagcccctggagtcttagctgaccatcttgcctgttcttcccccaggccactgcagaccccggaaggtcaaggctgacatcccatccttggaaccagaggggacctcagcctcttagcaggaggctctccttgcttgcactcaccctttcttattgtcttgccctgcatctgggggtctgaatttttgggagcaggcaatatctgaaggtgcaaacaggccctacggctgttccctgcacaactctcatggttttaattgtaccccatcttccacatctttaaagctcatgtgaaaaatgctgcatttttaataaactgatacatttgaacttc

SEQ ID NO: 1065 - DNA, 8263 bp, Homo sapiens
tctctttctcgcctcagggcctttgtactggcggttccttccgccggacacgtcgggtttcctcgtttttgcggactggcgctttctgatttcagagactctccgcaacagaaccatctcaagtgggtctacctcctcgcctttttttgttgttgttgttgcttggctgcgcttctgacagggcaggccgtgatgatgtttgtttatgagttaggtctgactgttcgttggtgcttaagatccccaccgggtccctagggcctgtgcgtaccgcgcacctgtgcacgtcctgcgcgcagctgcaggcgactccgctctggctcgtcgctgctgtttcctgctgggggtgccgaccctgtcccacgctagctgggtgacttcccccaaccgcagagacagcggcgacccggggcctcagacctgcccccgcatctcgccggcgccaggcagtgggaagtcaggttcttccgccacctcccagccaggtaactgccccgaagcctgccccaaagcctggaaccccccaagctcggggaccccaccccgaagaatcgcgaccgcttccctgagggactacacctcccagcggctcccagcgcgctcccgggcaccgcccgttctggcgttaaccctttagtggctgcagtggcgacgagcggaacggagtgcgggttcccggggagggggcgtgcaggatcgggttgtggggggtgcgctgtagggctaaggagaagatgagctttggggggccctgaggaggaggggagtcaggattaaccgaggacagggtcgcagcgggggcatggggaggacgggcccgagagcgccgctcctccccaaaactaggatttggagcctcacgttctcccgcaaaacgagccctgtgggtgccaggccaggggcggctcccaggtgtggagggggcaaggtacgggcgtctgccgtcgctaagtgcccccttccacttaaggcacaccttcgcctccgattccgaaccgcccggggacagaggcaagtggcaaagcagggagggcggaggtgaggagtcgataccccccaccccagggaccaggcgctgccgcgggccctttccctcccccaggcccggggcaggagctcggggagcccttcctggtgcccgccgtcctcctgcggagccatggggagcggctccagcgcatggcggcagcccgcccgcctcgtcctggcccctgccctgacccgggggcggccgcggggatgtccggtccgtggggcaggcccggttctcgctgcggccaagcggccgattcggccgctcccgccgctcccccgcgccaggccgagcttcgctctttccctcggtggtgagcggccagatccaggcgggtcctaagtgtggggggaggggggcgcagggaggggcggccacgcgatcctaagaccctttcagatggtgggagagcctggagaaagagacagcgtgtgcggagggggtgctccctcagatggggggtcaggaagtctccctcaagtgtctgggacagagggacagcaggggccaaggcggagatgagatccgtgagtgaggggagccgggaagaagtaaggctgcagccgcggccccgcaaggattgggactttcgtctaaacgcggtggaagcccatggaaggaagcggttagcagcaaggcagagtcctgctccctctgcagccccagctcccagcgccctgggctttccaggcacctgtccgggtaggggattgagggccgtggccaggcccgcactttcctgccagccgcagctggccacatgcccatctgaccctccgagttctcctctaaaaatggggctgacagccgctacctcacaaagtccacaccgggctcaacccgctgccttcctccccaacaggactctgccaccctccctcaggatgcctgagggccccgagctgcacctggccagccagtttgtgaatgaggcctgcagggcgctggtgttcggcggctgcgtggagaagtcctctgtcagccgcaaccctgaggtgccctttgagagcagtgcctaccgcatctcagcttcagcccgcggcaaggagctgcgcctgatactgagccctctgcctggggcccagccccaacaggagccactggccctggtcttccgcttcggcatgtccggctcttttcagctggtgccccgcgaggagctgccacgccatgcccacctgcgcttttacacggccccgcctggcccccggctcgccctatgtttcgtggacatccgccggttcggccgctgggaccttgggggaaagtggcagccgggccgcgggccctgtgtcttgcaggagtaccagcagttcaggtagggccagcaccaggtgtgatgaacatagtcgcgggctccacacctgactctcttagtgccttcttggccaacaaggggcgagtccctgccccttctgggcctcagttctctcatctgcagatcaagacagtatacctgtcctgggtcagctccctgagccagtgggcatggaaactcaaaactaattgggggccgggtgtggtggctcaagtctgtaaatcccagcactttgggaagccgaggcgggcagatcacgaggtcaggagttcgagaccagcctggccagtatggtgaaaccctgtctctactgaaaatacaaaaattagccgggcatggtggcacatgcctgtaaccccagctacttgggaggctgaggcaggaaaagcgcttgagccggtgaggccggggttgcagtgagctgagacagcaccattccactccagtctgggcaacagagcacgactctgtctcaaaaaataatgataataataactgatgggggaggagagaggagagccaagaggaggatgggtaggtactgccctgaggacatgtggccagttagtgtcagagaagctggggctcccacccacaatcccacaccacctctcagggctcccaggaggctaagaaggtggaggggctttaatatggtaagtgaggctgagcggaattgtttcaaggggatggggaggggactatctcatgacatggcttccgccttgggctttgtggtctcccacatccggcctgcccagtattctgtgtcctgtggtctcctctgcgccacttccctgcctgcagtagggtgtaacagccccacctgggatgtgatgcaggtcacctcacatggcacagtgttggccacttcctttcctctgaagaggaaacgtgtatgagtctctgcttcatgccaggccttgttctaggggctcggggtacagcagtgaacaagatgaatgtggtccctgctcccacagaactgatgttcacataggataggggaatgagaaatggacccatgccttaggaaaacccaacaggtgaaggaggtagaggatgacttggccgagggtgggggtacattagcaatggccactctagggaggtttgagctgaggcctgactgatgagaaggagccagccagaggaaggcattggaactggcaagagtcacaaatgcagaggcctggagtagggttggcaagttctccctttctgggggatgctgtgcgtccgttgacccttaggagacttggatacctgtgggatgggttggagatgtctctggtgccttagaagaaagttgactcctggccttcccctgtgtgaactccaagcacatccccagggaaacatctgtctttggtcctggattcctcccacctcagccttcctggggagtcacgccacaagttaactctgccagctggctctgaagtttctctcaaaccacgagcatttgggctgttttcttagtcccccagctggggcgtgtggcaattggcttacctcagggatcagggcacctcccaggctacccttgtaccttcaccccagaactctgtcttctgacccactcatcacacccattagtcagtcttgccatgacccttttccgcaaagaaacaagatgcacatcctcttcacggtgaggaggggagacccatgacccttggaggtggggtgggggctgctagggccctcactggtactccacatatctcctgcacagagccagacaatgtccaggatcttgagaagaatggaccctaccaatggcaaacccacatatggtctctaacccaccacaaatgctatacagggagctccagactgcaaacacacttgaggtcctgtggccacactgttctcatgtcctgaggagtctgaggtgataaacacacaacctcatatacaacctcatgttgctttttttttttttttttttgagacagggtctcgctctgttgcctaggctagagtacagtggcgccatcacagctcattgcagccttaacctccagggctcaggtgattctctcacctcaacctcctgattaactggaaccacaggagtgcatcactaagcccctggctacttcttaaatttttggtagagatggggtcttccttgttgcccaggctggtctcctgggctgaagtgatcctcctgcttcagcttcccagaatgctgggattacaggtgtgagccaccacaccagcctcaagttactttagatcagtatttttcacctttcacaatgaatttatttttaattttgtttttattttttgagatggagtctcgctctgtggcccaggctggagtgcaatgctgcgatctcagctcactgcaacctccacctcccaggttccagagattctgctgcttcaggcctcccaagtagctgggattacaggcacccaccatcatgcctggctaattttgaatttttagtagagacagggtttcaccatgttggccaggctggtctcgacctcctgacctcaagtgatctgcccgcctcggcctcccaaagtgctgagattacaggcatgagccactgcacctggccgtcctttcacaatgaatttaaatcccttgatgttcccatttaacagataggaaaacgggggcagggagaagaggaactgtaactcccagtttccttccccttgcacccagaaacaggttctctgagcccctctccccatcccatggagggtggggatgggtcttacgcacccagaccgtgttcctccagggagaatgtgctacgaaacctagcggataaggcctttgaccggcccatctgcgaggccctcctggaccagaggttcttcaatggcattggcaactatctgcgggcagagatcctgtaccggtcagcaagcaggcatgggcatggggactgcggtgggccaggtgtgcccacattccccactgcctagcatggcttgccttgcccccactacaggctgaagatccccccctttgagaaggcccgctcggtcctggaggccctgcagcagcacaggccggtaagcccagagagggatggagcacacgtgctggcacactggtgtccacatgggccggcaaggagatgggtggggtcaggtgtccccagcttagctcaacaacaggggtggggaggggatgaactgcccaaagtctgaccaagctcagagagaaggtcagctgcctttacatggccctgctgacagacaggtcctgcccctgccccttcctcagagcccggagctgaccctgagccagaagataaggaccaagctgcagaatccagacctgctggagctatgtcactcagtgcccaaggaagtggtccagttgggtgaggccaaagatggcagcaacctctgcttcagcaaatgattgtgtaaccctggggcacttgtccctctctggacctgattcaccgatttggaagtttgtagccctagctgatactcaatggactaggcctcctcacttgtcaatagtgtttccaggctgggcgcagtggctcatgcctgtaatcccagcacttcgggaggccgagtggggtggctcacctgaggtcaggagttcgagaccatcctggccaacatggtgaaaccccatctctactaaaaatgcaaaaaattagccaggtgtggtggtgggcacctgtaatctcagctactcgggaggatgaggcaggaaaatcgcttaaacccaggaggtggaggttgcagttgagctgagatcgtgccattgcactccagcctgggcaacaagagcaaaactccatctcaaaaaaaaaaaaaacaaaaaaacagtgtttcctccaagctgcccatgagacaggcaggacaaggattcttttatatatttatacacacacacacacacacacacacacgcacgtttatatatatttttggtagagataggatcttgccatgttgcctggactagcctcaaactgggctcaagtgatcctcccacatctgcctctaagtagctaggactacaggctcacaccaccacaccgggctaattgttaaaaattttttttgtagagacagggtctccctatgttgcccaggctggtattgaactcctggcccctagggattctcccatctaagcttcccaaagtgtcgggattacaggtgtggccactgcacagggccaggacaaggattcttaatcccactccaggatgggaaacccatggccgagtgggaagaaaccagctgaggtcacatcaccagaggagggagagtgtggcccctgactcagtccatcagcttgtgtagctgaggtctgggccaggtctaaccaggctccccactcctcccaacctgagcctgccctctgatctctgcctgttcctctgtcccacagggggcaaaggctacgggtcagagagcggggaggaggactttgctgcctttcgagcctggctgcgctgctatggcatgccaggcatgagctccctgcaggaccggcatggccgtaccatctggttccaggttgggccctactgttcacacaggcagagaccccaggaggctgatgggtggaaacgtggggtcacaataactggggtggtgatgctcagggtctgtctagaccctccaaggaccacactgttcctgagggtcacacccctcccctcccatgcgtcccagggttgcagctagtggaagtagcccaaggcaggtagcccaagtgaaagtagccaagggcagagcagctttgctgatgtggactctaacatgggggatgtcctagaggcttcctaagggagaagctacactgatctggatgggtgtgtgtgagtcctgcctctccaaggaataccgcccctgtgccaacccaggctgattcctgaattatccccatcccattttagggggatcctggaccgttggcacccaaaggtaagctactcctaatgtaataggctaagagagcagaaaggacttcacgcctgcaagggctacagcacccttctccaccctatccccctgcaaccctgggagtcacccctgggcaggataggaccctccaactccaacaccagtgtcctgcagggcgcaagtcccgcaaaaagaaatccaaggccacacagctgagtcctgaggacagagtggaggtatggctgcctgctcccgcctcctcccctgcactctgcagccctggctgcccctcccaggcagctgccttaccctaagagggcggggggagtggtgggccctaaccaacctctgaactgctttctgagcccctcagggacccgtgtctcctccatccaggacgctttgcctccaagcaaggccccttccaggacacgaagggcaaagagagaccttcctaagaggactgcaacccagcggcctgaggggaccagcctccagcaggacccagaagctcccacagtgcccaagaaggggaggaggaaggggcgacaggcagcctctggtgggctttcctcatcactcccagaaactggctctacaggagaggatgggatggtggcctaggagcgcgtgtacaaaggtgggagaaaggctgccatggcagcccctggagtcttagctgaccatcttgcctgttcttcccccaggccactgcagaccccggaaggtcaaggctgacatcccatccttggaaccagaggggacctcagcctcttagcaggaggctctccttgcttgcactcaccctttcttattgtcttgccctgcatctgggggtctgaatttttgggagcaggcaatatctgaaggtgcaaacaggccctacggctgttccctgcacaactctcatggttttaattgtaccccatcttccacatctttaaagctcatgtgaaaaatgctgcatttttaataaactgatacatttgaacttc

SEQ ID NO: 1066 - DNA, 76 bp, Homo sapiens
gggagagtgtggcccctgactcagtccatcagcttgtgtagctgaggtctgggccaggtctaaccaggctccccac

SEQ ID NO: 1067 - DNA, 4242 bp, Homo sapiens
ctcagctgaccctgcgggaccggaaaaagaaattcccgggccctggcttcttggcgcgatggtgaggcactaggggcgaagcgaggcttgggctgctggagcgggaatgagggggcgccaagtggctccggaaactgggggaggttgtactggcctctccgcaaacacagtgtgtgcgggcgtgagggctgtgagtctggtagggaaaagtccaccactctcccgctcccgagacgggggcgggggtacggggcgggtaagacagagcaggccggccggcttagagtcccggtgcttccctggcggaaggaagggcccctgcctcccggggcaggaactagggcttgtctggagctgggagtcctttcaggtcttccccatccccaagaggacctcccaaggatacccccttccccagccctgccgtggggcttgtacaagaaggtgcttagaatcaggctcactcttccacactgttaggaagcccctccgctctttccagagccagaaagtagtagttttggggttgagacttatccatccatccatccaatccatccatccgtacgttctaagcgcctggtctataccatgaagtgtgctaggcactgggaggacttgagctgccaagggaaggggaaatcggaggcttgaattggagtcatagctaaggctccaggggcagagacctaactgcgccttgtgtgtagtgctaagggggcttcctaaggatgccatcaaacttaaaggcggatggatggcaggagctggctggctgaagtacagtttgtgtaccaggggtagggaggcaagggtgggagacgtgtgtcttcagacagggaacagcatgtgcagagacttcaggttagagagagtatggctccccaggaatggatgcatttcccatagctgggagagtatcatctgcaggttagggaaagatgaggctggacaagtagagaacaaatcttcctggctcttggatcaccacaatcaagataatgaacgtatccactggcctccataatttccttgtgtgaggggctattttaagaagtataatcaagaaaggctgttctggctgggtgcggtggctcatgcctgtaatcctagcactttgggagagtgaagagggtggatcacctgaggtcaggagttcgagaccagcatggccatggcactccagcctgggcaacagagggagactctgtcttatttttttattttttaaaaaaagaagggctggtctgatgtgtcacttaaaggatagcaagccactggccaggcgccgtggctcacgcctgtaatcccagcactttgggaggctgagggggacggatcacttgaggtcaggagttcaagaccagcctggctaacatagtgaaactctgtctctactaaaaatacaaaattagccgagtgtggtggcacatgcctgtaatcccagctacttgggaggctgaggcaggagaatcacttgaacctgggaagcggaggttgcagtgagccgaggtcgcgccattgcactccagcctggggaacaagagtgaaactgtctcaaaaaaaaaaaaaaaaggatagcaagccacacagagagtgcagcaggcatggaggcgggagcaaggctggtgtgccccagcagcagcagggaagctggagtggctggagttgtgtgggtatggggaagaggggagagagttcactcgtctctgtgaggcccaggactttgttttatcccatgctgtacccccagcacttagagtgggagctagcacagagaaggtgcttaattgatgtttgctgagcagatgaatgcctggagtagacctcagagcagggtttggtggcagggtgggtcagggagagagtttactcaacagcctggtgataggggagaacaagaggccagagggtatccatctatgtcggggaccaggggtccctggtgggcagcagtgtgggagacacacggatcctggccacacctcaggcctccctccagcctgattacctgcctccctcccttgcagaggttccggttctgtggtgatctggactgtcccgactgggtcctggcagaaatcagcacgctggccaagatggttgagtgcacagggtctagtctgggtggaggaggggtgttgggggtggggattgtgggtgtagaggatggtgaggtttctctggggctagggcctcagtgctctcagcctgtgctaccatgctttgtgaccttgatcagtggctggcctgctctgagccagtccccaggaaggaggggtgaggtttgccagcctggctgatgtaaggacttcccttccagtcctctgtgaagttgcggctgctctgcagccaggtactaaaggagctgctgggacaggggattgatgtgagtacaagatccagcaccccattgtcccatgaccttatgaccaccactgccctgaaactctgcactaggcccagggagacgggtgagccagcctctcaacctctctgggcacctcccttccttctttccagcctgtctgttccttatcgcaggatccaggctgggggtgaggggctggtgagcaggggcctggcaccccctgaaggtctcctttccccatagtatgagaagatcctgaagctcacggctgacgccaagtttggtgagtatcccgctgagtctataggccccaggcaaccctgggaacttggcctggtgcctggtacagaggggccccccacccctcccagcagcatccttaacttaccttccctagtggaggagcatgagggaaagaaagaccgacagtcccaccttcctgtcctctgccagctcctggtggagcagtagcagtgcctgtggctccaggaggcctgggggctttgagctaaagttaatagggcaacagggaggtggctggacccacagtgacaccccctgccccacccacgggtccctcagagtcaggcgatgtgaaggccacagtggcagtgctgagtttcatcctctccagtgcggccaagcacagtgtcgatggcgaatccttgtccagtgaactgcagcagctggggctgcccaaaggtacgggttgtgggtgggcagctgggcagcctgtgggccaagggctgctagagaaggggacaggccctgtgaccctgaggtgtacctgccctgtctgggccaggagcccaagccaggccccgacatgctacctccagagctactccattctacccccagagcacgcggccagcctgtgccgctgttatgaggagaagcaaagccccttgcagaagcacttgcgggtctgcagcctacgcagtaagtatgaggccagccagggtccgggctcattctagaaggtgcacgcagcacacaaagtgcatggagagtccagggagacgacttaaccacggtcacatggttactagcagccgtagagctgggacctggccctgggtctcctgactccccacaaggtttcttgtcactgaggtctgctgtgggtgatcagaactgattatcgggcacctgccctgttctgagcctgggtcagcaggatgggagcttcttagaggccacatagccttgaatggttgagagctgagccagggtgtcggctgaggtctacttggcttgcctgctttgatcctgagagccacccaccccatctcacagtgaataggttggcaggtgtgggctggcgggtggactacaccctgagctccagcctgctgcaatccgtggaagagcccatggtgcacctgcggctggaggtggcagctgccccagggaccccagcccagcctgttgccatgtccctctcagcagacaagttccaggtcctcctggcaggtgaggctcagctattcctcgacgggtgagaggctctcccagatccgcctgactgcctcccacctgcccacctcttccctctgcagaactgaagcaggcccagaccctgatgagctccctgggctgaggagaagggtgttccaggcctgtgtggagccgccctgcccgtatggagtcacgccctctgaactgctcttcgggaggcagccctggttctaggatgctgaggccctggcccggactctggcctcccagatccccagctgcctcacttctctcttgagaacttggctcagggctcctgaggacctttcccagcattaccttcccttcccttgaaaggcaattgttggctgttttcataagcaggaaaaataaacagaagtataaaggaa

SEQ ID NO: 1068 - DNA, 7634 bp, Homo sapiens; identical to SEQ ID NO: 1064

SEQ ID NO: 1069 - DNA, 112167 bp, Homo sapiens
gggttttgatcatgtcggtatatttatatgtaaatacaaaactgtatcactgtaagatattgaatatgaacattacaattattttctgaatcagactcagtccattgatattaaatacaaaatgaaatgattgtaaaaaataataatatacacattcaaagagcttattacagtataaaattattgaggtctgatcagctgccaacctcatcttctgtcacaggggaaggtttaggagttcctgggattttttgggaatgtggagtgctgaggactcttgatttatccctagcacataaggatgagtgggctgggagcaggcagggacaggttgggtgggtaggggacaaacagtgattgcaggggaccacctcactcagccagggggtgaagctttttattgacacagaacccacccagtttgagggtctagcaggctagcaggcaggaagagatgggcatctcggtagacagggccaagctgcataaaggaaccatccagcaaaagaaaaagggccccagctcatcctcccagggaggtattttcttagtggttttttctttctcatacctgggctccccctccttccttctaagattcgtaccgattgcatttggctctggctgctcagtgagttcatctctaccctccgcctcccatccctgggatagtgaaagcaaagagagagtatggaatcacagtggaggtctgttccccaaattggccaagtaaatgtagaaaaatcatcggataagggaaatccatgctgagctaacccagtgtcaccacaaactaatacattcttggctccaacaggtggcaactggaaggagataagtcattacttaaggaaggggccctgtggcaggaacatggaggagatgtgtgtgtgtcctcttccaccactctgtagcctgacaagaggagacatgatcaccaacccaagctagtccaggataaatagtagggtccaagaagcaaggagtcctgaactgcaacacggagccccaggaacttctggaaaggagtatcgtgtgtatatgtatttatagaatacgatcatattatcacatacaatatatattatatacacacgtacatatggacccatacacataagtgcacacacacacacacacagaatgacagaaaggactggaatacacgccctacttataaacgtgcttggcactcaggacgatctctagaatatgtaacttggtcaagctctctggggagaaaggcaaatgctcatcaaacctccccataaaatcctaggaaagggaaggagtgggagacaggagacctcagaaaaagaatggcgggagaaaggaggagggaggttccttccccacttacctcggggaccctagcaaaaatcaatagccacaatttggttttaataaggcacagtttgatagcagatgctaggaattaagaacacattgctactggccctttctagtggcaatttcaccacatttatctagccaaagggaaaggctgccttgcgtgcacacgtgtgctgggagacacaagaaagaagttgatccatggcttcagcgtaactgatggcaacctataggctcagcggtgtccagggtagtttaaggaaggctggccaacaggtaggaggttcgtaggagagttactgactctccacggccagcaggttttggccagaggataccatgccctccttctctgcgaactccaggatggccttgtagcaaaaatagtactgctcaggggtctggatgctgaaggccctctgggtcctcatgcgtgacaccgtctggaacacattaagggtgccaagctcctccagctgtgccaggcagatgtccagtgagcagaaggtacctgaagaaggaaggaagtgatcacatctggtttacctctcttctcttcctccctctaccaaataacccaggcagaactgaatgaatgacttcacaggcaaagtgcctcatggcagaaggccaggtggccttaggcctgaaaggactcaagaaggaggtcacagggagtgttggaggccagagaaatgagaaggcctcttatttctcaggacatacacttggggtaacaggaagtggaaatgggaaggtgacacaggggaacttcctgcttcaatcccagacagacagactgacagcactcccacacctaatttccagagtccacaagtttttcagaggcctaacaaaaacctattctcaactttctcccaaagggacctttgaaatagaaaggccaacatttcctaccatgtacatgcccttaaggcaaaagctgctaactggctccagaatggagaacacagcacagggtggggagtccctccagggagggctggatgggaaggaagcagcagcccagctgagctctctgggatacctgcagtgacagttctaacaggtgacagagtcagcgttatgatggggtgtataaaacatcaacccctagaggacttggcttgtgaaatatatattctggccatcacttggtccaccaaaaggacattagatgagggatttttcacagcaattcaccaccaagggagcaagtgagttccttctccaatcacagatgtgggctaagagctttgtttttcctcgtccacccctactgcccctgcagacaccaagagctgcattaggtgcgttacctgtcctgccaatgcctgcactgcaatggaccacaatgggtggctcagggcactgccctttggagcgtgctcccatgttgctcacagccagactctgctggtttctgaccactctcaagaagtcaatgagggaagctgctgaggaagggacaccatagtctggccagctcaagaactggaagtgggtcacctggcgtttctgccgttccttagataagaaaagaagtaaacgttaacaaggttatttctgcctgcccctagctacctctggcttttccagattctcaacaccctggttatccctaccaccaaggctcctatccaccactgtcaacttttcccataattgcttctttactacaaacccaaaggaagggttggttaattggaaaaggcagaattcctatactgtaagatccagaattttttttgagacaggatctcactctgttgcccaggttggagtgcagtggcacgatcaaacttactgctgccttgacctcacaggcttgtgccaccatgcccagctaatttgttctatgttttgtagagacaggatctcactgtgttgcctagattatcttgaactcctgggctcaagtgatccttccacctctgcctcccagagtgctgggattataggcctaagccattgcacccagccccagatttctaaaattataagctttactcctatttaatgttcctatcgtgctgcagtaatatggctatattggctgtgagttaaatatcctcatcctgtccctagaaaaacagaagcaactcataacttccctggtatcctacctattccctctggagattttcattacagtaattattctccccctgtttcaacaaggtgagaaaaaagaaacctggatttacctctgtgttgtgaatttctagcgttgttttcttataatgattcatgttctccacgcctagattggtcactgtgaggaagccaaatcggatccgagagtctttttctaaaggccagtactggccacactttctcctgccgccttcctcaaagctgaagacacacagagcaaggtaagccttccatcgttcctctccacagcagtaacctggcttccccaaagacctgatatacccccaggcagcaatatcatctcttgcattgcttctaacttacaccattgattctcagcagaaaggaaaggaaacctcttcattctaaacaaatgtactcacagctaaagtttctgcatgtactcatatagcagacagttactgagcacttactacagcatttggtctttttcctaatacgcaatagtacgtctcacatatgtgggataaatactgggtgaacagagacaaaaacagtatagtagctgggtatagtggtgcatgcctgtaatcccagctacttgggaggtttaggcaggagaatcacctaagaccaggagtttgagaccagcctgggtaacatcatgagactccatctcaaaaaagaaaaagaaaaagaaaaaaaaagagtagagaaaatatgaaaatatgataggtcagagagaactctctgataaactgataaacacacatctactggtatgttagcaggaggtttgtgtaaaagcctgaagtcccagcccaggcaacatggaaaccctatctctactaaaaatacaaaaattagtcaggcatggtggtgggtacctgtagtcccagctacttaggaggctgaggtaggaggattgcttgaatccaggaggttgagactgcagtgagctgagatggcaccactgcactccagcctggatgacaaagtgagactctgtctcaaaaaagaaaaaaaaaaaaaaaaaaggcctaggccaggcgcagtgactcatgcctgtaattccagcactttaggaggccaaggtggcggatcacctgaggtcaggagttcgagactagcctggccaacacggtgaaaccccatctctactaaaaatacaaaaattagccaggcatggtggtgggcacctgtaatcccagctacttgggaggctgaggcagaatagcttcaacctgggaggcggaggttgcagtgagctgagatcgcaccacttaaggttgcagtgagctgagatcgcaccacttaactccagcctgcacaatagagtgagactcttgtctcaaaaaaaaaaggcctaaatctaccttgccaccctccagtggccccaaagtattccaaggtagaacttctcccactacctcctctccaaataagtggtggttataacagtgctaaggaagggaatttaacattcacattcatttttttccttcctcatctgaaataggttattccttaaatttgccagatttgtagaccaaaatttcaaaaatattcctttcattaaaatcttccggccaggcgcggtggctcacgcctgtaatcccagcactttgggaggccgaggcaggcggatcacgaggtcaggagatcgagcccatcctggctaacacggtgaaaccccttctctactaaaaatacaaaaaattagccgggcgaggtggcgggcgcctgaagtcccagctactcgggaggctgaggcaggagaatggcgtgaaccccggtgggggcagagcctgtagtgagctgagattgcgccactgcactccagcctgggcgacagtgagactccgtctcaaaaataaaataaaataaaataaaataaaataaaaataaaataaaatcttcctggccaggcgcagtggcccacgcttgtaatcccagcactttgggaggctgaggcaacagatcacgaggtcaggagttcaagaccagcctgaccaacatggtaaaaccccatctctactaaaaatccaaaaattagctgggcatggtggcacgttcctataatctcagctactcaggagaatcacttgaacccaggaggcaagggttgcggtgaactgagatcgagccattgtactcccacctgggtgacagagcaagacaccatctccaaaaaaaaaaaaaaagatattagccaggcgtggtggcacatgcccgtaatcctagctattcgggaggctgaggcaggagaattgcttgaacctgggagacggaagttacagtgagccaagatcgtgccacactgcactccagcctggtggcagagtgagactccatctcagaagaaaaaaaaaaaaagtagcaacaaatggagagcaaagggaatctggtaattcaggagtcaggaaggcagcacccctctggaaatagggaacagataaaaggagaattgtcccatgtttcccagaacttcctttagtggataaggccaggacctcaaaatagggtataactggcacagggttgccagagccagggattaaagctttaacaagttagatctattcatctccaccatacccgggttgtggattagctaagagatatctcaaaatctttgccctggctttcctaatcctcaatttttttttttttaattgagacagagtctcgctctgtagcccaggctggagtgcaatggcgtgatctcagctcactgcaacctctgcctcctgggttcaagtgattctcctgcctcagcctcccaagtagctgggattacaggcacgcaccacaatgcccggctaattttttgtatttttaatagagaaggcaccatgcccggctaattttttgtatttttaatagagacggggtttcaccaggctggccaggctagtctggaactcctgaccttgtgatccgcctgccttggcctccctaagtgctgggattacaggcgtgagccaccgtgccaggctgaccctcattatttctaaaagctaaacttccctctttaatcacccatgcctagggacagagtggaggtggagacctttggaaaaaagggattaactcaccgggtggtcatgacaatcaccaagactttttgctcccataccatgagccagaaatcacgataggtattctccaaaggacctgaaataaaaggagaagacaagaaacatgactctgggaaacactttttttcttttgtaggcgcttctgttttactccccaatggtaactccaaaccatagatggttagctccctgctcatctttccacatccctgctattcagtatagtccgtggaccaatcacaccagcatcgtatgggagagtgtaagaaacatgaatctgcatgtcaacgagatccccaggtgagtcgtaggtaggtttgggaagcactgctacataccctctcagagtcttaatcatcagaacttcagccatcacatccaggctgacagtgtcaaactgtaagaatctctagctgttttcatctcacctaagcttcagttttataatcacagattgcttactaaaccattaaccttctgtttcccataatctcagatccattatgtctgtaactaagtctcctccttcaaaattagctttatcttggccgggtgcagtggctcatgcctataatcccagcactttgggaggccatggcaggcaggttgcctgagctcaagagtttgagatcagcctggcaacatggtaaaaccccatctctatgaaaaatacaaaaattagccaggtgtggtggcacatgcctgtagtctcaggtacttgggaggctgaggcacaagaattgcttgaccccgggaggtggaggttgcagtgagccaagagcgcaccactgcactccagcctgggcaacagaacgagactctgtctcaaaaaaaaaaaaaattagctttatcttgcaactttcttatctctgttaacaatactagcattcttaaatcattcagtcttaaaaaggtgaagtcaacactgacttacccatttccttcatctcccagaagcagtcagtcaccaaatcctagagattttttacctttgaaatgtttttggtttttattcttttgccctcatcttctccccatcctgttcttcctgctcgatttcactgacacaaagaccacgtcatcttctaagttactgtaacaccctcttagtctacttttttgaataggcctttttcccttccaatctactctgggaaaccccaccagtttaatctttcttaaaaattacttcatcagaacatagacacaccatgctcactttggcctctattctttcgctcaagctgtctccgtcacctccaatgctattcattttctacccattttcaagtgccacctcttccttgaagctttctctgaccaccgcattccttgtgaagcttcttctcttttgcttttgatggcacagctggatctatacaggttgaccatttaatttatatactcttccatccattattttactttgtgggaattaatgatatctcactaaacatggtcctaaggacaaaggattacaggtgtgagccactgcacctggccaaattctcctttgcacagggctgagcactcagggctgagcactcagcaataactttgaagatacttgtgggctaccaactccactttgatcaagacagtaaccggccggcggcagggctcacacctgtaatcccaacactttgggaggccgaggcaggtggatcacttgaggtcaggagtccgagaccagcctggccaacatggtaaaaccccgtctctactaaaaatatgaaaattagctgggcacgatggcaggtgcctgtaatcccagctactcgggagcctgagttaggagaattgtttgaacccaggaggcggaggttgcattaattgcattaaaccaagatcgcaccattgaactccggcctgggcgacagcaagactccatctcaagaaaaaaaaaacgtaacaactcaagataattccttatactttctgggtgtttctttcctctctgctttcaggaaagcagggcagtactaatggttaattttggtctagaagtctgctggttctactacccttattgctaagtcttttagcaagcactaacatgatactggaataccctctctgcagaagtggatgatgtcaaaaacgtgagatcttagaaatacactaaatatccaataagagaggattaattaaattatgacgtatcaggtggggtgcagtggcgcacgcctgtaatcccagcactttgggaggatgaggcaggcagatcacttgagcccagaagtttgagaccaacctgggcaacattgcaaaaccctgtccctacaaaaaatacaaaaactagccaggtgtagtagcacatgcctgtagtcccagctactcaggagactgaggtgagaggatcacctgtgtgtgcctggagaggccaaggctgcattgagccatgatcgtgaaccatgatcataccactctgtcacccagcctaggtgacagagtgagaccctgtctcaaaaataaataaataaataatagcataccataatttatacagtctataaagttgatgttgtaagagctgtattttttgctatggaaaggtattcacagataccattaaatgaaacaagagatagtatagaaagagcacatttggttaaattaaaagtttagttttgttttttttgagaccgagtatcactctgtcgcccaggctggagtgcagtggcgtgatctcagctcactgaaacctctgcctgccgcgttcaagcgattctcctacctcagcctcctgagtagctgggattacaggcatgcaccactacgctcggctactttttgtagttttagtagagagggggtttcatcatgttggccaggctggtttcaaatacctgacctcaagtgatctgcccgccttggcctcccaaagtgctgggattacaggcttgagccaccgtgcccggcctggttaaatattttgtatgcctatatctgcatgtatgcatagataaaggtctaggaggagatgctgtaaaatgttaacattatctctgggtcctagggttatgagggattatttttgttttctaaatgttctacaatggacatgcattaccctagtatacacatcaagaagacagtaaggacaccttttccacatctctgaccctcagcctcatccacatcctactctcctgcaccacagcaactctcatatacttcattttccacattcagaccactggcagaattggagtactgagcagtcagagcatatggtaactcagttaccagactggggctgggcaaacttctcacaggctcaagagagatactaagaagggaaagttgtacttcccagcttagaccctttaacagtaaacttctctcaagaaataaagtcagcagtttatactgacataggtgaaacaatccacagacatggcttgtaaaaacttctgaaccaaacaaacatgggttcaaaccctggttctgccacttactagctgcatggtccaaggtcacgtaaacttttgggtttcagtttgctcatctataaattaataaacctcccttgcagagtctctataataattagatagcatttatgcatctgatatataataggtcttctcaatagatgacatcattaatagaaatataggccaggcgtagtggctgatgcttgtaatcccagcactttgggaggccgaggtaggcagatcacttcaggccgggagttcgagaccagcctaggcaacatggtgaaaccctgtctctaccaaaaatacaaaaattagccaggcatggtggcaggtgcctgtaatcccagctacttgggaggctgaggcaggagactcgcttgagccctggaagtggaaggtgcagtgagccaagatcatgtcactgcactccagcctgggcgacagagcgaaactccatctcaaaacttaattaattaattaattaaaaataaagaagttgcagacattatgatattttattcctaaatacttgagcacttactaggaaaacaaggacctcctcctatagaacattaccattatcaccttaagcatacattaaacatggatacaatgttggctaaaaaaaatctccaattgtctcaatagtttgtcttcaatagatttttttctcccagttgaggatctaatcagatactctttttttttctttttttttttttttgagacagagccttcctctgtcgcccaggctggagtgcaatggcgcagtcgcagtccactgcaacctctgcctcccaggttcaagcaattctcctgcctcagcctcccgaatagttgggactacaggcacccaccaccacacctagctaatttttgtatttttagtagagacggtgtttcaccatattggccaggctggtttggaactcctgaccttgtgatccgcctgcctcggcctcccaaagtgctgggattacaggcatgaaccaccacgcctggccgatcctctttttttttttctttttgagcgcaatctctgctcgctgcaacctccgcctcctgggttcaagcgattctcctgcctcagcctcccaagtagctgggattacaggcatgtgccaccacgcccggctaattttgtatgtttagtagaaacgtggtttctccatgttggtcaggctggtctcgaacttccaacctcagtttatccacctgcctcggcctcccaaagtgctgggattacaggtgtgagccattgtgactggccctttaatttatttatttttgagacaggatcttgctgtgtcagccaggctggagtgcagtggcacgatctcggctcagagcaacctctgcttcctgggctcaagtgatactcccccctcagcctcccaaagtactggagttacaggcgtgagccactgtgcctggccatggttctctttagtctccctttaatctagaacagttctctgcctttttgttttttatggcattaactttggagagtctgagccagttttcttatagtatgtcccacaatctggattgtttcccatgactagattcagattttaaaactggcaatacacaatgcaggtgatattcatttctcaatgcatcatatcaggaggtgtacataatgtccctttgtcctttactggtgatactaagtttgatcacttgattaaggaggtatccaccgtatcttgctctgcagtggtcaaagggccttacgcccatctgatggtctgttgtctttctgtattatgatttcctcctaccatctttgaaagtgacatgatattcttgagatggagaggccaggtcaggaagagtactaggatcataggaacatttatagaaactccacctgaaatcctcctagaggctgggcatggtggctcacgcctgtaatcccaacactttgggaggccgaagcgggcagatcacgaggtcaggagttcgagaccagcctgtccaacatggtgaaacccagtctctactaaaaatacaaaaattagccgggcgtggtggcacacacctgtagtcccagatactcaggaggctgaggcaggagaatcacttgaacccgggaggtggaggttgcagtgagtggaggtcgtaccactgcacaatagcctgggcgacacagcaagcctccatttcaaaggagaaaaaaaaatgagaaatcctcctagagctcagtattccactgtcagacttattagcacatactatctatgtcagaacatttgctggagtgctctgtgatggtataggaaccagcctaggcctattaggacagcaatactcattcctagattggactcaatctctgggaagtccactgctattcttggcctctcactagacaggaagagcatgaagagctcactggctgatgcattctgatgccctacacccttgccaatactaagaaatagccccaaaacttgcaggcagtagtgttatgtgtttaaatctccagtttatctctatgcggtgagtttccaggcacacctggtacagaaaccccaaactacttatttgcttttctcaaccaccacccatctttataaaaggccaggatctagtggccaaaacctccactcaagttaccattcgtttaaaaattatgctatcatttggcacaaggaatcataagtagatggcacaaaatcaacatgggagggacggaccagcttaccttgtgtgccaatgtaagcattcttctgcttgtagccatccatgaaactggcattgatgtaatctgtctaatgataaaaaggagacatcactatagctacacagaatacaccatttgggtcataaaatgatgtactcagtaagtaaaacccaaggtgtgaatattctcttcttgttgagcagaaaatgaggagtgaaatggccagctcaaaccctcacttcaataaatggtgctgggacaagtagatatctacatgcataaaaatcaagctgactccttcctcacactgtaaaactgactcaaaatgtatcacagaccaaatgtaagggattaaaactattaaaactctcagaataaaatataagagtaaatctttgtgaccttgggttaggcaaagctttcacagatatgataccaaaggcgtaagtgacaaaagaaaagagataaattggactatattaaaattaaaaacttatgccaggcgcggtggctcacgcctgtaatcccagcactttgggaggccgaggagggtggatcacgaggtcaggagatcgagaccatcctggctaacacggcgaaaccctgtctctactaaaaatacaaaaaaggtctcttccgtgaggagcgcagaggaggtcgcggcgccggaggccccagaaggctcgaaggcgccgcgggctggggtcggtggcttagggagcccgtccggccatggtggccgcgggtggtggttggcgcggctgcgctgcggcctggggcagtgcggagccgggacagtcgcggcgctgacgcccgcgggccccagctgcagatatgaagcggagccgctgccgcgaccgaccgcagccaccgccgccccacagccgggaggatggagttcagcgggcagcggagctgtctcagtctttgccgccgcgccggcgagcgccgcccgcgaggcagcggctggaggagcggacgggccccgcggggcccgagggcaaggagcagccgcctgccttggcctcccaaagtgccgagattgcagcctctgcccggctgccaccccgtctgggaagtgaggagtgtctctgcctggccgcccatcgtctgggatgtgaggagcccctctgcctggctgcccagtctggaaagtgaggagcgtctccgcccggccgccatcccatctaggaagtgaggagcgcctcttcccagccgccatcacatctaggaagtgaggagcgtctctgcccggccgcccatcgtctgagatgtggggagcgcctctgccccgccgccccatctgggatgtgaggagcgcctctgcccggccgagaccccctctgggaggtgaggagcgtctctgcccggccgccccgtctgagaagtgaggagaccctctgcctggcaaccaccccgtctgagaagtgaggagcctctccgcccggcagccaccccatctgggaagtgaggagcgtctccgccgggcagccaccccgtccgggagggaggtgggggggggtcagcccccggcccggccagccgccccatccgggagggaggtggggggtcagcccccccgcccggccagccgtgccatccgggagggaggtgggggggtcagccccccgcctggccagccgtgccgtccgggaggaggtgggggggtcagccccccacccggccagccgccccgtccggaggtgaggggcgcctctgcccggccgcccctactggaagtgaggagccctcagcccggccagccaccccgtccggagggaggtggggaggtcagcccccgcccgccagccgcccgtccgggagggaggtggggggtcgccccccgcccggccagccgccccgtccgggagggaggtggggggggtcagcccccccgcccagccagccgccctgtccgggaggtgaggggtgcctctgcccggccgcccctactgggaagtgaggagcccctctgcccggccagccgccccgtccgggagggaggtgggggggggtcagcgcccctgcctggccagccgcccctccgggaggtgagggggcgcctctgcccggccgcccctactgggaagtgaggagcccctctgcccggccaccaccccgtctgggaggtgtgcccaacagctcattgagaacgggccaggatgacaatggcggctttgtggaatagaaaggggggaaaggtggggaaaagattgagaaatcggatggttgccgtgtctgtgtagaaagaagtagacatgggagacttttcattttgttctgcactaagaaaaattcctctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctccttaagagtcatcaccaggccgggcgcggtggctcacgcctgtaatcccagcactttgggaggccgaggcgggcggatgacgaggtcaggagatcgagaccatcctggctaacacggtgaaaccccgtctctactaaaaatacaaaagattagccgggcgtggtggcgggcgcctgtagtcccagctactcgggaggctgaggcaggagaatggcgtgaacccgggaggcggagcttgcagtgagccgagatcgtgccactgcactccagcctgggcgacagagcgagactccgtctcaaaaaaaaaaaaaaaaaaaaaaaaaaagagtcatcaccaatccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaataaattaaaaaaaaatacaaaaaaatagctgggcgtggtggcaggcgcctgtagtcccagctacacgggaggctgaggcaggagaatggcataaacccgggagatggagcttgctgtgagctgagatcgtgccactgcactccagcctgagcgacagagcgagactctgtctcaaaaaaaaaaaaaattcattcatcatcagccatcatggaaatgcaaatccataccacgagatactaatttatacccactaggatggctacagatatcaaagatagataatactgttggcaaggatgtggaaaaactgaaaccctcatacatgtgtaaaccctccttatacatggctagtggtaatgtaaaatgctgcagttactttagaaaacagtctggttgttcctgaaaagattaaacagttaccatatgacccagcaattccactccttagcaaaataacataggtgcatacaaaaacttatacataaatatccatagcagcattattcgtaatagccaaaaatggaaacaactcaaatgtccttcaactgataaatgaataaaagtggtatatccatacaatggaatattatttggcagtaaaaagcagtgatgtgatgatacatgctatgacatggatggacctagaaaacattatgctaaatgatagaagccagacacaaaaagctacatagtctaggattctctttgtatgagatccctagaacaggcaaatctatggagataggaaataaatcagagtgggttagagggaaataggtagcgactgccaagggtgtgaggtttctttgggaaatgaaaaaaatgttctaaagttgtttgtggtgatggtggcacaactctgtgaatatactaatagccattgacttatatactttaaataggtaaattgtatggtatgtgaactgttggaggccgaaagaatgagggtcatgatcaactcagtataccactggaggctacatgagcaaaaaggaaactgttctcatgaaagcaggatgttggcaaactgacaaactgcatctgccgcccagaaggaatgctgagggcagtcacgacccaggcacaagtgtttcttgtagttaggcacatctgaagcctgttagcaataatgtgtacctgtgatcaattaagcagctgaccaatcgttacctcctcctccctgctcttggtacccaataaatacaaagggctgtagaagctcagggctgcctttgctcactagaagcagggagttctcttcttccccatgttacccttcctttagaatagttatttttgtcttaagttttcattgctatgtttatcccccttcattcagtctcctaatgacggtctcaagtaataacaatagtaactgccctagtgacatctcaagcagtaattgtggcagtctgccagagtgaactatataactcaatagaaactgttatttacaagaaaagggtccatcaagacttgcaacactgtagcacaggaccaaatgagaggcaaggcaagcaagtaggaacacctggtccatcctgccacacacaaaaggcaaaatatgaatggagaagaaataaagctacatctcatacttaggaccatcaacagacgagccaaacacctggactccattattacctgaattaatgcaaagcaacttccagtcaaattcaaaggcatctcaatgaacagctcctgactacctctcttccagggtattctcccacctcctaatgtcctcagtcttaattacttcaacatcattttttataaatacctactcaaaagatcctttgatccaggctgataaaagagaaacatcaatcagctgcagttttatgttatagtataactagttgggagttgaatggatagaagcagtggaatggataagggaaggtgtgaagggttacagaaggacaaaagaaaagtttcaatagcaaactagggaaaactcataacccactgcattacagagaggtcagactgactctttcctcaacctatcactcgttctcctgtgggtcctatcactgggtgggcagtctgaactgtcagtatcccatagctaacctcctaagatatctccacctcatggtcaaacccatgttacttggatttgtgttcattagccagtcagtctaccaatttatcactctactatttatttagtcaagagtttcctccttagaaactgtttctttgactaaataaatagtggagtgataaactcggagttttccctcccatagcagctagtattgacctcatacgattactgtcctaccctgactcagacaacttcactgagctaatagaccacctgcagcagacccagcatgctaaaagcctcactcacttccaaacaggcttctcaatccagggtgcacccagtcagccaaagcccatcctctactcaacctggcacatgcaaatggtatacccactcgaggaccaaggggagaaggtatggaaaagcacaaaagatttacctagtatatgccagtcagcattagtaagaacataaggaggaactaacttcatgctttgaaaagaattgtcacttctttttttttttttttttttttttttgagacggagtctcgctctgttgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttttagtagagacggggtttcaccttgttagccaggatggtcttgatctcctgacctcatgatccacccgcctcggcctcccaaagtgctgggattacaggcgtgagccaccgcgcccggccgaattgtcacttctttaaagaagacattatttctttataactaagaattaccagctttagcactggtctctgagctgatttttaattcccagggaattaaatttttaatttcagcaacttcggaagaatcactggatattaaaactgaaggccgggcgcagtggctcacgcctgtaatcccagcactttgggaggccaaggcgggcagatcacgaggtcaggagatcaagaccatcctggctaacaaggtgaaaccccatctctactaaaaatacaaaaaattagctgggtgtggtggcgggcgcctgtagtcccagctacctgggaggctgaggcaggagaatggcacgaacccgggaggtggaggttgcagtgagccgagatcgcaccactgcactccagcctgggcgacaaagcgagactccaactcaaaaaaaaaaaaaaaaacaaaactgaaaatgacccagagataaagtatacacttgggggaaaattggaatagcaggaagaacaaacccggaacactatgttgtgagccattgctatagactgatcatttgtgtcccccataacttcaaatgtgtaatcccaaccccagaccctcaatgtaatggtattaggagatggggcctttagacaggtgattaggaccatgaggacagagctctcacaaatgggattagtgcccttataagacagaagagttctgaagtgctccctcaccccttccccttctgccatgtgaggatgcaatgagtagacagtggtctatgaaccaagaaaggggccctcaccagaccccaaatctgccagcacgttgatcttggacttcccagactccacaatagtgagaaataaatttctgttgtttataagccatcctgcatgtggtatttttgttacagcagcccaaacagattaaggcagccatgttcaacagaaactgggactaatagctttaaaattccagaagcaaatcaagtaaacaattcactaaaaaacctgaatcctccaaataacaaggtattgtatacttgaaaattgcggacagcatattttaagtgttttcaccacaaaacaaggtaaatatgtgaagtaatgcatatgtggtgttttttttttttttttttttgagacggagtctttgctctgttgcccaggctggagtgcactggtgcgatctcggcttactgcaagctccgcctcccaggttcatgccattctcctgcctcggcctcccgagtagctgggactacaggcgcccaccaccacacctggctaattttttgtattttttagtagagacggggtttcaccgtgttagccaggatggtctcgatctcctgaccttgtgatctgcccgcctcggcctcccaaagtgctgggattacaggtgtgagccaccgtgcccggcaaagtaatgcatatattaactagcttgacttagtgtctctgcaatccatacatattttaaaatattatattgtataccataaatatatacaatttctatcaattaaaatttaaaaacaactaaatgtcagaaaacagaatggaaaaatagccccataggtggaaattccatgagagtgttaagtccccaaagctaagtaaataatttttttttttttgctttcggcccgcaaagtaaataatgtcaaaaaaactaaaaactaaaatcaaaataaaataaaaaaaaagcctaaatactccatttactataaaaataaagcctccgctaatgtttcagtaaggagagggactacaaatcagacaatgatcttcatattaaccacaggatgattagaagaatctcccagtacactaagattcactcattcacaaatatgtcctgagtgtctgatatgtggcaggcactgttctaggtactggagacagggaagtcaacaaaatggataaatacaggtatctctgactccagagccccaactcaaccactgtactccactccttcagggcatatacgatgatgatctcagcagtactgatgaatttaccctccagccagccagtctcttagctcaaatgctcctgcaggaaaatcttctccaagggtcctggataggactgtgaattcagtttatgtgcttgaaacaacagggacaagagagttggaaaccatgatcctggggtcccaacccacatgtcatatatgcccaaatacaaggcagtaagttttccaaaaattattccccagaaagagaagggatataacaagtccttataatgtgtgtcatgttaaagaggtactatttaaattactttactgtgtgtcatgttaaagaggcactatttaaattactttactttgccggcgcagtggctcatgcctgtaatcccagcactttgggaggctgaggcaggcggatcaccccaggtcaggagttcaagaccagcctgaccaaaatgatgaaaccccgtatctactaaaaatacaaaaattagccgggcatggtggcatgcacctgtaatcccagctactcgggaggctgagaaaggataattgcttgaacccaggaggtggaggttgcagtgagctgagattgcgccattgcactccagcctggacaacaagagcgaaactctgtctcaaaataaataaataaataaaaataaaataactttactttgaacaacctcagtcaatgctgggttttttttttttatgagatcacctaacaaaattgggtttttcggagatatcacctaataaaattggtatatcagaagggaaaaaaaggaagataataataatttagtcattcatctcaaaattctaaggttggatgttgctgtaaacaagttatattaaaaaggaattatggccaggcacaccggctcatgcctgtaatcccagcactttgggaggccaaggtgagaggattgcttgagcccaggaagaacttaggcaacacagtgagaccctaggtctacaaaaataaaattaaaaaaaatcagccatgtgtaatggcgtgtgcctgtagtctcagctacttgggaggcagaggtgggaggatcgcttgagcccaggagttcaagggtgcagtgagctacgatcaagtcactgcactcaagcctgggtgacagagtgagaccctgtctcaattttctgttttttaaggattttacaaaggaataagtgaatgaatcatattataggggatgcataagatgcaggatgaattaaaaaaccaacttgtcctggccgggcctagtggctcatgcctgtaatcccagcactttgggaggccgagacgggcggatcacgaggtcaggagatcgagaccatcctggctaacatggtgaaaccccgtctctactaaaaacacaaaatattagccgggcgtggtggtgggcacctgtagtcccagctactcgggaggctgaggcaggagaatggcgtgaacctgggaggtggagcttgcggtgagccaatattgcgccactgcactccagcctgggggacagagcaagactccgtctcaaaaaaaaaaaaaaaaaaaaaaaatttgtcctaatgttaccctaacagattttcctggtttaggataaaatttccagtcacaatgccacacacttaaaagtaaataaagatgttgtactctggaaaaccttgttagactgactcaaaaattggcctgtaattccagcacttagggaggctgaggcaagaggattgtttgagcacaagagttcaagaccagactaggcaacatagtgagaacttgtctctacaaaagtatttaaaaattagccatgtatgtggcacacacctgtggtctcagctacttgggaggctgaggtacaagaatcacttgagcccaggaggtcaaggttgcagtgagctgtgatcactgtacctagcctgggcaataaagcaagaccttgtcttgagggagaaaaaaaaaagtggctcaaatgtgacaaagacactaaagttaaaggtgtatgtaaagtgtttgaataaaatgttcattaaatatctctgttaatagattacatatgaggcttttaacatgtagatataatcaaattaatatattaaataatatagtcatttgaccatttcatctctatccctagacatttatgtatacataagttgtccacaatttcctcagatacagatggagaaatcagaggtcacttataatcaaagttgctttgtattgatgcatatatactcaccaaaggaattgcactatatgaccatgactttacaactaaggagtaaaatgataaataatttaacatctatgaagcacctacaatacaacagaccttgcactatcagcattcacataaagaatttcatttaatttccactcaatactgtgagatgggcatttgaggacttgcctatggtcacagactagtatgtagcaaaatataaactcaaacctaatctctctggcctcggagtctactttcattctaccgaagtattagtaagcttcactttggaagaagctctatttcccccagtgcacctaaaaagattacatttatctgtctacctgagtatggccacttcgctttgttagcttcactctagtttggtccaggcagggtacatccccataacggtttttctctaggtttcctggagacctgaaggaaacgaaacaaacaagcaagaataaagaaaaagtggggacagtatgtatgtacaaaatctgaccatgctaaaggggtgtcaattactcttaggggtggagacatggaagcttttcaatttctagcccatacagttccatatcatttaacattttttgtggtaagtacatactacttctaaaagtaaacatatctccattcaaaagagagagggagaccaggcatggtggctcacacctgtagtcccagcactttgggaggcaggaggattgcttgaggccaggagttcgtgagcagtctgggaaatgtaatgagagcttatctcttttttttttgagacggagtctcgctctgttgcccaggctggagtgcagtagcgtgatctcgactcactgcaagctctacctcctgggttcacgccattctcctgcttcagcctcctgagtagctgggactacaggctcccgccaccacgcccagctaatttttttgtatttttagtagagacggggtttcaccatgttagccaggatggtctcgatctcctgacctcatgatctgcccgcctcggcctcccaaagtgttgggattacaggcatgagccactgcgccctgcctaatgagaggttatctctagagagaagtcaaaaaattagccgggcatcatggcacacacctgtactcctagctgctcaggagtctaaggtgggaggacggcttcagcccaggaagtcaaggctgcagtgcgctatgacagcgccactgcacaccagcctgggtgacggagagaaaccctgacttaaaaaaaagagaagctgggtgtggtggctcatgcctgtaatcccagcactttgggaggccaaggcgggtggatcacctggggtcaggggttcaagaccagactggccaagatgataaaaccctgcctttactaaaaatacaaaaattagccaggtgtgatggcacacacctgtaatcccagctactcaggaggctgagccaggagaatcgcttgaacctgggaggtggaggatgcagtgagccaacatcacaccactgcactccagcctgagtgacaaagcaagactttatctcaaaaaaaaaaaaaaataattaaatttaaaaacagagagaaggagtggggatgggagtcccaaatggccaaggcagaaattggtactaagaagtggggtgcttctgtaacaaataactaaaaatgtggaagcagctttggacctgggtaatggacagagctgatagaatttggaagtacatgcagaaaaagcctatgttgccataaacaggcataaaaggcaattctactatgggctcagaaaaagaagagctatagagaaagcctcagtcttcttagagattacctaagtgatactgatcagaaaactggtagaaatatgggtggtaaaatccattttgatgaggtctcagacagagatgaggagcacattagtaaaaagagagagagggagagaaggggagagaaatggggtataccaccaaaaaactccagctgcagataaaaatttctactacttatttgtcaaaagatgttcaaaccaaatctcttcaattccaatttcattttctttttgggacagggtctcaaaggtctccagggtcgcccaggctggagtccagtggcacaatcacagctcacttgcagccttaatctccctgggctcagtcccagatgcacaccaccacgcccagctaatttttaaattttttgtagagaaagggttttgccacattgcccaggctggtctcaaactcctgggctcaagcaatcctcccgcctcagcctcccaaagtgctgggattataggtgtgagtcaccgagcctgaccttaaatgccagtttaacatggtaggttgataacacatattgactgcactccattcatccagtagcttcactaaaatgatgaaaaaggagtattcactacaaacccaaaaagtgacagtggagacatcagcacacaaagagtgttcaactcattttgacagagaaaaagcagataggaggattttggctgacgtggccagacacagaagctaggaccaagggaggtacctatagagagacaagatggcacacccttagaactcccttaccatggaaagcaaggtgaggaacagagctaaaaatgggaataaaatgaaaatctgaatgttatgtagtgaaaatccctgacccattctcattgtcctgacctacactcatatccaagtttggatcccctcagcggatccaaaggacaggagaactcttcactggataaagtaaacagcatcaggtgaaagaattctgtcatttggagaatacccaacaaaaagctagttgtctgatcattataatctgaagctcatccatgcaaaacgagcttccatgcagcttgtttttgtttttgttcatcactgtctgcttttgtaaccatgcagcttttaaggaccataaatgtgaactaaaagccaaggatctcaatgtaattaaggaaagcccttacacaaagactttaatacacaattcaaataacacaattcaggcttgtcacggtggctcatgcctgtaatcctaactctttgggagggccaaggtgggaggatcacttgagctcaggagttcaagaccagcctgggcaacatagcaagaccttgtctctactaaaaattaaaaaaattagctgggcatggaggtacaaacctgtagtcccggctattcaggaagctgaggtaggaggatcacctaagcttgggagacagaagctgcagtgagctatgattgcatccctgcactccaccctgggtgacaaagtgagaccctgtctcaaaatcaaacaaaaaataaacaaacaaaaaaacccataattcaaacacatgggggctacagaagtttaaaaaaaaagatagtcaataagagaaaagtaacctctaaaaggctatcattaatatcctcaaagagaaaatagatgatacaattatacataaaacaagaagagagtgcaatgaaaaaggaacagagaagaaaagctcttggaaattaaaaataatatccaaaataggaattttaatagacgagataaaagagaaagttgaggaaatttccagaatacaaaacaaaacaaaaaaagtgatgaaaatatgagaaaaactggccaggcacagtagctcatgcctgttatcccagcactttgggaggctggggtggacggattacttgaggtcagaagtttaagaccagcctggccaacatgttgaaactcgtctctactaaaaatacaaaaatcagcagggcatggtggcacacgctttgtagtcccagctactcgggaggctgaggcatgagaattgcttgaacacgggaaatggaggttgcagtgagctgaaattgcgccactgtactccagcctgggcaacagagcgagactccgtctcattaaaaaaaaaagaaagaaagaaaaagaaaatatgagaaagatgaagaaagttaagagaatcattctgggacacaagtcagcaaactatgccctggccacttgtttttgtaaatgaagttttactggaacacagtcaagcccatttatttctgtactcactaagtatatattgacagtgttgagtcagtaaactatgccctggctacttgtttttgtaaataatgttttattggaacatagtcaagctcatttatttctgtactcactaagtatattttgacagcgttgagtacttgtaacaaagactgtaaacctcacaataccgaaatatttactatcttaccctttaagaaaaagtttatcaatcccatatatatatatatatatatatataaaatctatatatttacatatagagagagagcgcgagcgagaactaacataatacaaggaaagaaatcatttaaaacacagtgtaataagaaaagccctagaactaaataacaaaccttcagattaaaagaatctatcaagtaaccaatgtaataaattttaaaagaggacctacactaaggcacatcattgtgaatctttttttttgcagggggtggacagagtctcgctctgtcccccagactggagtgcagtggcacaatcttggctcactgcaacctccgcctcccaggttcaagggattcttctgcctcagcctcccgagtagctgggattacaggagcctgccaccatacctggctaatttttatatttttagcagagacggggtttcgccatgttggccaggctggtcttgaactcctcacctcaggtgatctgccctcctcagcctcccaaagtgctggggttacaggcttgagccactgtgcccagcctctctcaatccttttaaatgatctattgtttttctttttccttccctgggcattttaaagataatttctttttctgtttaagaaatttagactgggtgcaatggctcactcctgcaatcccagcactttgggaggccaaggagggcagatctcctgaagtcaggagtttgagaccagcctggccaacatggtgaaactccgtttctaccacaaatacaaaaattagccaggcatgatggcacacgcctgtagtcccagctactcaggaggctgaggcaggagaatcacttgaacccagaaggtggaggttgcggtgagctgagattgtgccactgcactccagcctgggtggcagagtgagaccccatcttaaataaataaataaataataaatagattgagaaagaataagatcagacaattcacagacagcatcactagtaattggaaaggcattgccttaaaaattctgagataaagttatttctaacctagagttctatactccagcaaaatagaataaaagaaagaagatggtctacaattaggaaacaagatccaacaaaggaaagagggaaaactgcaagataaaaactgaggaacaagcctagagaataaccaaccacagtttagactagaatgaaagaaaaagttctgaaagtgaggtctcaggaaaaaaaaaatagatgcaattgattatctgatacattcaatcacttggaaactaatgataacactgtaaaataaatctgattgggcatatagaaaaataatgaagggccaagcacggtggctcacacctacaatcccagcactttgggaggccaaggtgggcagatcacttgaggtcaggagttcgaaaccagcctagccaacatagtgaaaccatgtctctactaaaaataacaaaaaacattagctgggcaaggtggcaggtgcctataatcccagctactcaggaggctgagatatgagaatcgcttgaacccagggtgtggaggttgcagtgagccgagatcgcgccactacactccagcctgggcaacatcaaaacaacaaccacaacaacaaaacaaaacaacaacaacaacaataaaaaacaaaagaaaaagaatgaggaacatatacagaaaactaaaggaaatgaaaaaatctggtaattaactccagaagaaacaaaaaattgaattgataagatcattaggccaggtgtagtggctcattcctgtaatcccagtattttgggaggctgaggcaggtggactgcctgagctcaggagtttgggaccagcctgggcaacatggcgaaaccccatctctaccaaaaatacaaaaaattagccagacgtggtgaagcatgcctgtggtcccagctactctggaggctgaggtgagagaattgcttgagtttgggaagcagaggttgcagtgagctgagatagagccactgtactccaacctgggtgagagagtgagagcctgtctcaaaaaaaaaaaaaaaggctggacgtagtggttcacacctgtaatcccagcactttgggaggccgaggcaggtgaatcacttgaggccaggattttgagaccagcctggccaacatggtgaaatcccatctgttctaaaaattaaaaaaaaaaaaaaaattgttaatatatttgatcatttcatagtagcccatgtagctctccagtaaaaataatttacatagtcataataatgtacaatgacgattcaatttaagaatgttacatataattattggaagagtagtcaaaatgaaagtggagacatagtataagagctaaatgagcacctacaataaaagtcactaaaagtattattaacttttttttttttttttgagacagggtctcgctctgtattccaagctggagtccagtggcacaattttggctcactgcagcctcaacgtcccaggctcaagtgagcttcccacctcagcctcccaagtagctgggattacaaacacacgccaccacaccaagctaatttttgtaatttttgtagagacagggtttccacctgtctctacatgttgctcaggctggtcttgaaatcctaggctcaaacgatctacccacctcagcctcccaaagtgctgggattacaggcatgagccactgtgcctggcatattataagcattttaatttagaattagggatgaaataccaggggaaacagctacaagagttgaatacatgattataggtaatggaactgagggtaaaataggaatttgctatttattttgtcattgcttgtcttctttagaactgtttggttttgaaaaaaattatttgcatatattaactgaaagcaaagaaattacaaaggtcacacatataaaataatactctatattgttcatgagtgcttatgcatatataacagtataaacaaaatcaactagaaagaaatatcatattcatactagtagctgcttatgatgagtggggagaactaaggatgcggattagaaggaatttcaactttataataaattctttctctcatataataattaaaaagacagctgggcacagtggctcatgcctaaaatcctagtgctttgggaggctgaggtgggagaatcacttgagcccaggagtttgagaccagcctgggcaacagagcaagactccatctctacaaaaacttcaaaaaaattagcaaggtgtggcaccccatacttcttgtcccagctactaggaaggctaaggcaagaaaatcacttgagcccaggaggttaaggctgccataagctatgacagtgccactgcacctgcactccaacctatgcgacagagcaagaacacatgtctctcttaaaaagaaagaaaaaggccaggtgtgggggctcatgcctgtaattccagcactttaggaggccaaggtgggtggatcacctgacgtgaggagctcgagaccactctgaccaacatggcgaaaccccgtctctatgaaaaatacaaaaaattagctgggcttggtagcgggcacctgtaatcccagctacttgggaggctaaggcaggagaatcgcttgaacccaggaggcggaggttgcagtgagctgaagtcacaccattgcactccagcctgggcaacaagagcaaaactctgtctcaaaaaaaaaaaaaaaaagatgaagcaaatataacaaaatattaacaagagtcagtgttgattctgtggtaggaacatagttgtctgtaaaatcttaaaaaatttcagcccagcgcagtggctcatgcctgtaatcccagcactttgggaggctgaggctggcggatcacctgaggtcaggagttggagaccagcctagtcaatatggtgaaaccccatctttactaaaaatacaaaaaaaaaaattagctgggcgtggtagcaggcacctgtaatcccagctacttgggagactgaggcgggagatcacttgaacccatgaggcggaggttgcagcgagctgagatcacgccactgaactccagcctgggcgacagagcgagaccacatctcagagaaatatatatatatatttctcccttcctatacgaatatgcctagtgaataaaaccaatcctaaaagattacatacagtatgtatgtaatttttttacattttatgtaatgttacttgatataacaacaatttggaaaggacaaaattagagaaatggagaatagattagtggttgcaggggttaggaatggggaggtggtgggaaggaggtatatgtttactatagggcaatgaggctgggcacggtggctcacacctgtaatcccagcactttgggaggccgaggtgagtggatcacctgaggtcaggagtttgagatcagcctggccaacatggtgaaaccctgactgtagtaaaaatacaaaaattcgtcaggcatggtggtgcacgcctgtaatcccagctacttgggaggctgaggcaggagaatcgcttgaacctgggaggcagaggttacagggagctgagattgcaccacagcactccagcttgggtgacagagcaagactctgtcttaaaaaaataagtaaataaaaataaaaatattgatcgcttctcagtcttttggctaagatcaagtgtaaaataaaaataatgaagggcaacgaggggagccttgtggtgacagaactctgtatcttgattatggtgacagatacacaaacctacatgtgtgacaaaactgcacagaactaaatacacaaaaatgaagtaaaactggggaagtctaaatcagattggtggattgtatctatattaacattctggctgtgatattacactatagttttggaagatgttatcatgggataactgtagaaagggtacatgtaatctgtctccattatttcttacaactgcaggtgaatctacaattataagaaaaagtaaaaagagaaaagggaaagaaagtctcttggtccaggggaatcctgggcaagagtgaatatacactgatagccacttcataatccagaattccaagggagacacagtttgttctttgtaagtagctctactgggagttggtgtaagtcagaggcttggagctgatgaggattctaggttctaaatcataaagtggggaatcagtcattcaataggcaagactaggaagtcctctcattagatgagagatctgttctctgattgtcaaatggtagctggtttggatgatggcaacaagacgatctaaacccacttttttttttttttttttttttttgagacagagtcttgctctatcgcccaggctggagtgcggtggcatgatcttggctcacagcaacctccgcctcctgggctcaagtgattctcctgcctcagcctcccaagtagctgggactacaggtgcgtgccaccacacccagctaatttttgtattattagaagagacggggtttcaccatgttggccaggatgttctcaatctcttgacctcgtgatctgccagcctcaacctcccaaagtgctgcgattacaggcgtgagccaccgcgcccagccaaacccacttttttaatggaggaggggagactccatagtagaaatgacatctcaagggcctcacagcagctggtagttgcaaaagcaccgagagcaaggtgaagaatccccaggataagtgtgcatcctcttagatcagcctagcatgcctccctgctccaacatatttccttgattcaagactgcaagggaggctgggcatagtggctcatgcctgtaatcccagcactttgcagggctgaggtgggcagatcacttgaggtcaggagttcgagatcagcctggccaacatggcaaaaccccatctctactaaaaatacacaaattaggccaggcatggtggctcacgcctgtaatcctagcactttgggaagccaaggaggacgaatcacccgaggtcaggagtttgagaccagcctggccaacacagtgaaaccccatctctactaaaaatacaaaattaaccgggtgtggtggcacacgcctgtaatcccagctactcaggaggctgaggcaggagaattgcttgagccgggagatggaggttgcagtgggctgagatcgtggcactgcactctagcctggccgagagtgagactctgtctcaaaataaataaataaataaataaacaaacatacatacacacacacacacacacacacacacatatatatacacacacaaattagttgggtgtggtggcacacacctgtaattccatctacttgggagactaaggcacagaatggcttgaacccacaaggcggaggttgcagtgggccgaaatcataccattgcactccagcctgggtgatggagtgagactgtctcaacaacaacaaaaaagactttaagggaataactgttctgtttgcaaaagagattggatataaacagggagtctggtagttgggtataggtagcacccataattccagcactttggaaggctgaggcaggaggatcacttgagcccaggggttcaagaccagcctgggcaacatagggagactctacaaaaaatttaaaaaattagccaggcatggtggtgcatgtctgtggtctcagctactcaagaggctgaggcaggaggatcaattgagcatcaagagatggaggctgcagtgagccatgatcatgccactatgcgccagtctgggggacagagcaagaccctgtctctaaaaaaaataataataataaaataataaatacaataagtaaaatgaaataaaaattaaataaaaataggggtctggagctggtagggaagaaacagagctgtatgagagaaaagaataatttcccttgttgatatatggtctgtgtcccctttttctcctcttattttcctttgcattcttgatctgattgacttctttctcaagtgcctcttatctcttactttccctatctcattattttccccaactcattattttccctctttgctttgctaaaagactctatccctgcatcttattcagaacacactgactacactggacaggagttacaagagagaagaggtactcacagaatcctagatttctaaaacatttaagctacaaaggtaggtgaatatcagagtccagtagtcacatattatacagaggaaaaccaaagtgctgagaagggaaataacttgtgtcactcacagagggaatttttggttaagttggaatatgaggctgggacccactaggatggcttccctcattttctttcttttttttttttcctcttcttttctttctttctttttttttttttttccttagacaaagtcttactctgtcacttaggctggagctcagtggcgtgatcataactcactgtggtcttgacctcccgggctcaagtgatcctcctgcatagctgggacaacaggagtgtgccaccatgcctggctaattttttcgttttttatttttgtagaggtagggtcttgctatgctgctcaggttagtctcaaactcctgggcacaaatgatcctcctatacctttactcccaaagtgctgggattataggcatgagccactgcccccagccctagtttctgtagttttcaacagtcacagctcactagctggagagaaagagatttctggggcagccaattaaaacatggtaagagaaatgacagcaacatggtaagagaaataatctgaccaggtgcggtggctcacacctgtaatcccaacactttgggaggttgaggcaggaggatcacttgagcctcggagtttgagaccagcctgggcaacatgccaaaaccccatctcttcaaaaaataaaaaatgagctggacatagtggcacatacctgtagtcccagctactcaggaggctgaagtaggaggatcgctttaacctaggaatttgaggaaaagaaaaggataaaagaaaagaaaaggagaagagaagaagaaaagaagagaagagaaaaaagaaaaagaggccaggtgcggtagatcatacctgtaatcccagcacttcgggaggctgaggcaggcagatcacctgaggtcaggagttcaagatcaacctggacaacatcgtgaaaccctgtctctactaaaaatacaaaaattagccaggcatggtggtgcgcgcctataattccagctacttgggagggtgaggcaggaagaatcgcttgaacctgggaggcggaggttgcagtgagccgagatcgtgccattgcactccagcctgggtgacagaacgagactccatctcagaaagaaaaaaaaaagagagggagggaggaaggaaggaattacaggtgtgcgccaccacacccagctaatttgtgtgtgggtgtgtatatatatatgtatgtatgtatatatagttatcaactagttacgagccagagttataaactagcgagatggttttgtgataggatttgagtagaatgaaaatctcaaggggttaaagtcctatgaggcaactgtactctctgactgtggattattttaagtgtaccacatacccctcctcaagaagtaatgttataccataaatgttatggggagaaactgcccaaatgaacagaccagcactcacactgagtactggaatagagagtagcctattttgaacctactttttttaaaaaaaacttgcatttcagaaaaatatccaaaaatatgtccaacagggttatcctgttggtaccaaagaccttcagaaatttcagagcataggatgttagcaagaagcacccaatggtgcccaggctggagtgcagtggcgtgatctcagctcactacaacctccatctcccagccgcctgccttggcctcccaaagtgccgagattgcagcctctgcccggccaccaccccgtctgggaagtgaggagcgtctctgcctggccgcccatcgtctgggacgtgaggagcccctctgcctggctgcccagtctggaaagtgaggagcgtctctgcccggccgccatcccatctaggaagtgaggagcgcctcttcccggcagccatcccatctgggaagtgaggagcatctctgcccggccgcccatcgtctgagatgtggggagcgcctctgccccgctgccccgtctgggatgtgaggagctcctctgcccggtcgcgaccccgtctgggaggtgaggagcgtctctgcccagccgccccgtctgagaagtgaggagaccctccgcccagcatccgccccatctgagaagtgaggagcccctccgcccggcagccgccccgtctgagaagtgaggagtccctctgcccggcagccaccccgtctgggaagtgaggagcgtctccgcccggcagccgccccgtccgggagggaggtgggggggtcagccccccgcccggccagccgctccgtccgggagggaggtgggggggtcagccccccgcccggccagccgccccgtccgggaggtgaggggcgcctctgcccagccgcccctactgggaagtgaggagcccctctgcctggccagccaccccgtccgggagggaggtgggggagtcagcccccaacccggccagccgccccatccgggagggaggtggggggggggtcagccccccgtccgggagggaggtgggggggtcagccccccgcccggccagccgccccgtccgggagggaggtgagggggggtcagccctccgcccggccagccgccccgtccgggagggaggtggggtcagccccccgcccggccagccgccccgtccgggaggtgaggggcgcctctgcccagccgcccctactgggaagtgaggagcccctctgccgggccagccgccccgtccgggagggaggtggggggctcagccccccgcccggccagccgacccgtccgggagggaggtggggggatcagcaccccgcccggacagccgccccgtccgggagggaggtggggaggtcagccccccgcccggacagccgccccgtccgggagggaggtgggggggtcagccccatgtccgggagggaggtcgggggggtcagccccccgcccggccagccgccccgtccgggagggaggtgaggtcagccccctgcccggccagccgccccgtccgggaggtgaggggcgcctctgcccagccgcccctactgggaagtgaggagcccctctgccgggccagccaccccgtccgggagggaggtggggggctcagccccccgcccggccagccgacccgtccgggagggaggtggggggatcagccccccgcccggccagccgcccggtccgggagggaggtggaggggtcagccccacgtccgggagggaggtggggggggtcagccccccgcccagccagccgccccgtccaggaggtgaggggcgcctctgccctgccgcccctactgggaagtgaggagcccctctgcccggccagccgccccgtctgggagggaggtgggggggtcagccccccgcccggccagccgccctgtccgggagggaggtgggggggtcagccccccgcccgggaggtgaggggcgcctctgcccggccgcccctactgggaagtgaggagcccctctgcccggccagccgccccgtccgggagggaggtgggggggtcagccccccgcctggccagccgccccgtccgggagggaggtgggggggtctggccagccaccccgtccgggaggtgaggggcacctctgcccagccacccctactaggaagtgaggagcccctctgcccagccaccacctcgtctgggaggtgtacccaacagctcattgagaacgggccaggatgacaatggcggttttgtggaatagaaaggggggaaaggtggggaaaagattgagaaatcggatggttgccgtgtctgtgtagaaagtagacatgggagacttttcattttgttctgtactaagataaattcttctgccttgggatcctgttgatcggtgaccttacccccaaccctgtgctctctgaaacatgtgctgtgtccactcagggttaaatggattaagggcggtgcaagatgtgctttgttaaacagatgcttgaaggcagcatgctcgttaagaatcatcaccactccctaatctcaagtacccagggacacaaacactgcggaaggccgcagggtcctctgcctaggaaaaccagagacctttgttcacttgtttatctgccaaccttccctccactattgtcctatgaccctgccaaatccccctctgcgagaaacacccaagaatgatcaataaaaaaaataaaaatttaaaaaaaaaagaaaaaaaaaaagaagcaccaaagcagaaagtacctctttctgcatgcgagaaaccatcatttatgtgagagtgatgttccctaacataaggaagggtctctgctaagcaagtgaggggtggaaggagctgttgccagagcctaccagaagcatcctggtaaccagctgctggcccaaactttttctacttacatggaacagtggaaagtgccaacagggttctcacgacgaatgtcttcatattcctcatagattccttgcttttgcctggcattaacatagtccaccaactcttggatggtcatagcatggggacctggaacatgtactgagtcccagtctaaggcaggagggagggagaacaggatgatctcatcgaagggatctgggtggccgttcacctggggtaggaactggaaattccaagtggcgagatcaattttgacgtacccacccaggttttctggaagacactccctgggcagatgctgcgtgacctcagatgtctttaatatttgaatctggaaggttagaaagaaccatgtgagtatgtgggaggagggaaaggcatatagagtgacaaagaataaatgtatttatatcaggtttggaggatgggataagattttcttgaaatacaaggtatacttgtaaaagtagtagactacatttcatctgcctgagatttaagtcctatgaatttgccagataaaagtgtgaactcccagaatgtatataaaattcactcctggaattagggacactgttatacatcttctgaaaggacgatgtagtgaacaaaagctttatattattaacaaggcttcccagcatcgctgcatgctggtactctttttttggccactaagaatgcataggtagtagttatttttgtcaaccccatactcagacaaccaattctaaggcctgttagcttgtattttactcagcttggtataactgttcacaaagataggattctatgaaagcaagacacccagaggcagggtagcccaggaaaaatgtgagataacactttttttttgagacagggtctcactttttcacccagcctggagtgtagtggcgtgatgaaggctcactgcagcctcaacctcctgggctcaagtgatccttccacctcagcccctcaagtagctgggaatacagatgcacacaaccacgcccagctaattttttgtagtaaccataaaacttaattctgctctctgcttggacatagccatgctggaactaattagcttaactggttctccttaggatctctgtggaatggggattctcttcctcctaaaagctcatctcttttgctgtcgcctcttcttggaatgccttcctttcctcctctgcctcttcatggaccagcacagctcacctcttctgtgaagtctttcctgactgcctgaggccatatgctcctctgcgttcctgcagagccaaagtcctcctatgtgtatctctgtgttccctatcaagaccatgagctccttgagggtagactgtctcacttaatttttaattatcaggaaccagtgcttcgactacaaaaagtgcttaatatattttgagtttatacatgcatgtataattcctataattcaagtgcaagaacttgcctatggattcctctcaaagagttaccttagaaaagatctctccagctggcacggtggctcatgcctataatcccagcactttgggaggctgaggcaggtggatcacctgaggtcaggagtttgagaccagcctgtccaacatggtgaaaccccatctctactaaaaaaatacaagaattagctgggcatgttggcaggagcctgtaatcccagctacttgggaggctgaggcaggagaatcacttgaacccgggggacggaggttgcagtgagccaagatcatgccattgcactctagcctcagcgacaacagcaaaactctgtcgcaaaaaaaaaaaaaaaaaaagaaagaaaagatctctcctggctgggcacggtggcttatgcctgtaatcccagcacttttgggaggctgaggtgggtggatcacgaggtcagaagatcaagaccatcctggctaacacagtgaaactccgtctctactaaaaacacaaaaaattagccgggcgtgacagcacacgcctgtagtcccagctactagggaggctgaggcaggagaatggtttgaacctgggaggcggagcttgcagtgagccgagatcgcttcactgcactccagcctgggagacagagcgagactccgtctcaaaaaaggtggctcacgcttgtaatcccagcactttgggaggctgaggtgggcggatcatgaggtcaggagttcgagaccagcctggccaatatggtgaaacaccgtctctactaaaaatacaaaaattagctgggtgtggtagcgtgcgcctgtactcccagctactcaggaggctgaggcagaagaatcgcttgaactcaggaggcggggctgcagtgagccaagatcgtgccactgcactccagcctaggcaacagagtgagacactctcaaaaaaaaaaaaaaaaaaaaaaaaagaaaagctctctcctactctgcgtcattaggtctctaagcagcttccacagaaccaaatgttttcactttcatgtcctgtcttttaattgctgcaatcagtaactgagaccataaatcttttaatcatggaacacgcaggagattataacagaattaaagtttctggttttattgtggcggcggggtctcactgtgttgcctaggctggtctcaaactcctggcctcaagcgatcttcccgccttggcctcggactcccaaagtgttagtattataagcatgagccattacacttggcccagaattaaagtaattttgaacgcttttgaaattgggaagcaacaaggtattctgagaaaaaaaaatgccaggaataaatgtagaaagagacataacgaaaaactttcctccacaaccctggtggtcaagggattgaatgatgtttccagttgaacaaattctaatgccagttcaactaatgcagttatattacaagctgttaaatattaaaggcctatgcagcactaggataaattttggaagtagcagctatccctaagttacctccaggacacgttccttcagtactatcttatgcaaggtgctatagaaagtgagaaccagataaactgtgtttagttttgaacttcaagaagctcgtaggacagtaagagaggcagtctgtattgaactgactaatgcatcaggtagagaatataagtgaatgcactaacagaagcagaacaggctctagaagacacgccaggaggattttttgaaggtagaaaattaattggcaggaattcactgtatctattcacctccagataaaaaagggcaagcttgccttaccctctcccggactttgtccttcaggaggagactgatgatggaatagggcactcggaaccatatgggtgcccccacaatcagcaccttcttcaaacgagctggaaatgctccctgtggagaaaacacatgaggatttaagtgtaatggaacctgtgactcttcaagcccaagtttaggttttctgctcttctccccattcttacccagcagggggagtctacagcctaattcaggtttgatctcagcagctagaggaaaagtggttaaacaaactgaagaaattagaagctgatttacctttaaaaataacaatgttaagttcttgtctaccgtaagctttatggatcaaaaactattctgacttctcatctcaacagatatcctacacataccacacatcagcatacatatatgcctcttaaaaaagttatgttattaaaacttgaaggaaaaatgagatcatgaataaactgaacattaaacatttctcgaccaggtgcggtggctcatgcctataatcccagcattatgggaggccgaggtgggtggatcaccagaggttgggagttcaagaccagcctggccaacatggtaaaacccatcactactaaaaatacaaaattagccaggcacggtggcagacacctgtaatcccaactactcagaaggctgaggtaggagaatcacttgaacccaggaagcagaggctgcagtgagttgagatcaagccattgcactttaccctgggcaacaagagtgaaactctgtctcaaaaaaaataatatggctgggcacagtggctcacgcctgtaatcccagcacttctggaagctgaggcgggcagatcacttgatgtcaggagtttgagaccagcctggccaacatggtgaaaccccatctctactaaaaatacaaagattagccgggcatggtggcatgtgcctgtaatccctgctactcgggaggctaaggcaggagaatcgcttgaacccaggaagtggaggttgcagtaagccaagatcgcaccactgcactccagcctgggcgacaagagcgaaactccatctcaaaattttaacaataataaataaaaatttaaaaattttaaaaatttctctttcataacttttcattcagtctgatgtatgcataatctttttttaatctattcattcatctatgtatttaccaatcaataatctaatgtgcactatggcaaatgagatctaaaaaaaggagatatcctcatccacacaagatataaagatgaaaaaatcattcattcctaatccacagtgcttagtttttttgtttgcttggctgctctgtttttgttttgtattgtttttgagacaggatcttgctgttgcccaggctggagtgcagtggcacaatcgccactcactgagtcctgtacctcccaggctcaaatgatcctcccacctcaggctcccaagtaactgggactgcgccactacacttggctaatttttgtatttttagtagagacagggtttcaccatgttggccggctggtttcgaactcctgatctcaagtgatcctcctaccttggcatcccagagtgctgggattataggcattgagccactgctcctggcgtgaagttcttaattttcaaatggttaaatgtattactgttttcttttctggttagtgtgttgtgtgtcttaaatccttttctattttaatgtcagaaaaagtacttttttttttttttactgctgtaccaccgattccaccaatgtgtattaatttttctaatttggttttttattgtaaaatatacacaacaaaattgaccttttaaaccattttaagtgtacaattattggcgttaagtatgttcacaatgcagccatcaccactattcattttcagaactatttcatcatcacaaacaaaaaccctgtacccattaaataacatctccctattcccttctccccctagtccctagtaaccttggttctactttctgtctctatgaatttgcctattttaggtcctcgtattattggaatcctactatatttgtccttttttgtcttgtttatcctacttagcataatgttttcaaggttaatccatattgtagcatgtctcagaattacattgctttctaaggctgaataatatttcctcataaatataccacatttttcttatctattaatccgttgatggacatttgggttgtttccacttgtacacattggttgtttccacttgtccagatttgaggagctattttccacattgtttccacttgtccacatttgaggagctattttcttttaaaaatttaaacttttgtttttgtcctttttttttgagacaagttctcactctgttgcccaggctggagtacgatggcaccatcatggctcactgtagccttgaccacccaggctcaagtgatcctcctacctcagcctcgcaagtagcatgtgccaccatgcctgtctaattttgtatttttgtagaataaaaatacaaatggtttcatcgtgttgcccaggctggtttcaaactactgggttcaagcaatctgcctgccttggcctcccagtgttgggattccaggtgtgagcctccatgcctggcctgtttttgctatttaagactttaacctatctgaagttgatttttgaacatggtatgagatgtaggaatctgacatttttttctatatgggtagctgttttgttttccacctttacatattaaaaagtcccgtctttccccaacttagactttctatttgtcagttttaacaaagtcacaatatcctggggaataaatatgacataggtaatttaattaaccatgtaaccatcattctgattattcagtttgttttcaggcctaaataatcctgatatgctcattttatcttttccttttaattttttttttgagactcactttaatattttttttttttttagtctcacttggtcacccaagctggagtgtagtggcacgatatctgctcaagggttcaaccaattctcctgcttcagcctcccgagtagctgggattacgggcgtgtgccatcacgcctggctaacttttttgtatttttagcagagatgggttttcaccatgttggccaggctggtctcgaactcctggcctcaagtgatccgcccatcttggcctttcaaagtgctgggattacaggcatgagccactgtacccggcctccttttaaattattttaagaagctgtttctaagactgggattatttggctaaagattatgaatattctttttttttttttaagacagggttttatcaactgggctggaatgcaatcatatgatcatagctcactgcagcctcatatcctgggctcaagtgatcctcctgcctcagcctcctgggtagctgggatgataggcacacaccaccacatgcagctaaattttgtacagtcagggtcttgctacgtggcctagactggtcctgaactcctggccttaggcaattctcccacctcagcctcccaaagggctgagattatagatttaagtcactggagccagcttaaggtattatttttaattatctaaaataaatgtgcagtaaatactctttttatattttcctgattgtttccttagcatataatctcagaaatacaactgatcaaagggtatgtgcatttttaaggatttataatgccagatgccttccaaaaggtgttaacgacttactgaactgacagtatatgagggtgctatacagtcatttatttatttgaaaaacaaacaaatctttattgtctagaaatatatatttttaaaatcccccagaaaagacgctattctctcatttccccatcctcttcctcttccacacctctgagacaaaggacattattatactttagtaaaacttcatccagatgtccagacaataccccaactatgtattcttctgtatttgcaagctacatgttcttatagatacatctgtagatctggttcatctacagataccagttagcctttgtaatccattcgccacttaagtttcactgtcactggcttttctgttaatcccttgaggaaaggtttgggattgaggggtaaatcctttataaccacaggagaatgctgcaggctattcgctgctgaccaagctgccacccatccctggtgactgcagcaggtacccccagacagtcatgtaaatagactaggcccaggtctgcagttctttgctctgaaaaaagagacgtaatagcttctactttttatttatcattttgtggaaataacaggtgttttcctagaatggtttttgatttgctggtaaaaggaccttggacatttaggtcctgaaataaattgttgcatctttgaaggaaaagatgaaagtagtttatcacacttcagtgaagaggcctttggagaagtttgttctagatgctgtatattctccatagaggagtgctggggtttctccaaatcagtagaactaaagggtaactgaagagaacagagtgacatgtcagattgagaatcagtcttttgaggctgggcgtggtggatcacacctgtaatcccaggactttgagaggccaaggtggatggatcacttgaggtcaggagttcgagaccagcctggccaacatggtgaaaccccattgctactaaaaatacaaaaattagccgagtgtggtgatgagcacctgtaatcccagctgcttgggaggctgaggcaggagaatcacttgaacccgggaggcggaggctgcagtgagctgagatcaggccattgcgcttcagcctgggggacagagagagactccatctcaaaacaaacaaacaacaaaaaagaatcagtcttttgaaagtggcaaaaagggctgggcacggtggctcacgtctttaatcctagcactctgggaagccaaggctagtggatcacctgaggtcaggagttagagtctagcctggccaacatggcaaaaccccatctccactaaaaatacaaaaattagctaggtgtggtgacgagcacctgtaatcccaactacttgggaaattaaggcaggagaatcgcttgaacctgggaggcggaggttgcagtgagccgagatagcaccactgcactgcatcctgggcaaaagagtgaaacactctgtctcaaaaaaaaaaaaaaaaagaaagaaaagtggcaaaaagaataggctagaagatactagctacaattcctctttttttttttttcttttggatttctcaggaatgatttcttcctagttagaccgccagtgttgcatggtaaccacacccatgaaaagggccggaatattgaaaaactgcatgaaactaagcgctgtgggtcgggcacagtggttcacgcctgtaatcccagcactttgggaggccaaggtggctggattgcttgagctcaggagcttgagaccagcctaggcaccatggtgaaactccatctctacaaaagatacaaaaatcagttgggtgtggtggcacatgcctgtaattctagctacttgggaggttgaggcatgagaactgcttgaacccaggaggtggaggttgcagtgagccaagatcgtgccactgcactcagccttggcaacagagcaagacctggtcttaaaaaaaaggaacttctgttagtcaaagagcttcataaaaagtgaaaaaacaagctataaattaagagacagtttactgtgcgcacacattatatgtgtgtgtgtatatatgtatcttcatggattagaataatatattaaaaactattaatttctaaatggacaaatcataaatagacatttcacagaagaagaaaaaatatatagctaacgaatatatgaagatatagttaatttcactaataaaagaaacgcaagctataccacaagataccatctcatatccatttgattgggaaaaaaattaagaagtctgacattagtaagtgctggagaggatgtagatcaatggaaatcttcacacatggcaagggggtacgactgctttgaaacacagtttgacattgtcttataaagttaaatcttcacagactttaggacccaacaatctactcctaagtgtataccctagagcatgcattctcaatgggggagatatcacctcaccaaaggggtaaaattagtaggagagcagggtgaggtgagccagaataaaaaaaagaaatcgggccaggtgcagtggctcacgcctgtaatcccagcactttgggaggctgaggcgggcagttcacaaggtgaggagatcgagaccatcttggctaacatggtgaaaccccgtctctacttaaaatacaaaaaaattagccgggcgtggtggtgggcgccgtagtcccaactactctggaggctgaggcaggagaacggcgtgaacctgggaggcggagcttgcagtgagccgagatcgtgccactgcactctagcctgggcgacagtgcgagactccgtctcaaaaaaaaaaaaaaaaaaaagaaatcttacactttttatgtatacagagtacataaagaggccaggcacagtggccaacacctataatcccaacactttgggaggccaaggaggcggtactgcttgagcccaggaattcaagaccagcctgggcaacatagcgagactctgtctctatttaaaaaataaggccaggcgcagtggctcacgcctgtaatcccagcactttgggaggccgaggcgggtggatcaccccaggtcaggagtttgagaccagcctggccaacgtggagaaaccccgtctctaccaaaagtacaaaaattggccgggcggggtggcaggcgcctataatcccagctattcaggaggctgaggcaggagaatcatttgaaccgggaggtggaggttgcagtgagccgacatcgcgccaccgcactccagcctgggcgacaagagcaagactccatctcaaaaaacataaaaataaaataaaataaaacaaaataaaataaaaaataaattttaaagagtacatagagatatgcagtatgtttatggtattaaaatttcattagaagaggaattattaggggaaaaaatatttaaaaaggctccttagtgaggcaacaatgaaaaaaggttgagaaacactcccctagagaccctcttacacatatgcaccagaaaacatgtttaagaatgttcataacagcaccattcataacacaggttgggtattccttatccaaaatgcttgggactagaagtgtttcagattttgaatttttttcagattttagaatatctgcatatacataattagatatcttggggatgggacccaagtctaagcaggaaatttatgtatgtttcttcttttttttttttttttttgagacgaagtctcactgtgtcgcccaggctggagtgcagtggcacgatcttggctcactgcaagctccgcctcccggattcacaccattctcctgcctcagcctcccaagtagctgggactacaggcgcctgccaccaggcccggctaatttttttttttttttgtatttttagtagagacagggtttcaccatgttagccaagatggtcttgatctcctgacctcgtgatccgtccgcctcagcctcccaaagtgctgagattactggtgtaagccaccatgcctggcctaaatttatgtatgtttcatacacaccttatacacataagtatgcctcagattcccaaagtgctgggattacaggcgtgagtcatggcacccagcccatcccacttttatgactcagaatgttcctgtgcttttttttttttttttttttttgagacacagtctcgctctgtcgccaggctggagtgcagtggcacaatcccggctcactgcaacctctgcctcccaggttcgagcgattctcctgcctcagcctcccgagtacctgggactataggcacgcgccaccacacccagctaatttttgtgtttttagtagagacagggtttcaccatgttggccaggatggtcttgatctcttgacctcatgatccacccacctcggcctcccaaagtgctgggattacaggcatgagccatggcgcctggccgttcctgtgcattttttacccgaattcctcccatttcacttttaagatcatttcttgttctaaggaagcagagagtagtcatcatttacagatgacctttacattgaacataatgtctgaagtttgcatctttcctaaatcttttcccaaagaattaaaaaaatatatatatcccaagcattgaaggaaacttgagagggccctccatagccttaccttcagcaggtttaggactttcttgccaagatccagctcaaagttggcataattagaaccacacatgtcatagataaacaccagtccattcctctgagtttcaaagctgtaaatcaaccattgaacaaaaacatttgtaagtaagcagatggatgaggcaggttgaaagcctaatgccaaaacaaaacctgagagtatgagacacatctaggatcaaaacaactgcctgactgcacactggtcttacaaaaagatctcttatctttggtatctgctatgtttattaaggcagatttatccagatgtaccaaatgccaaactcgtaggttgagaatgctctacagcaactaagttatcaaaatctgaactgttttctcccacccctctgaatctacctacccaaatcatataacatattccgtactcaaccccaaagtttcctcttccatgaaagtttccctgataactgtaatcaaacatgctaccaattgttttttcccttaaagccccataaatctttctgtggatttttcttgtggccttaataaactctgtatagccatctgattctctcctaaaggacaagaacttgttgttccactcattacgcccaacaatccctagcacagcccttaaaaataaatggtcactgaattgtaattcagtagactggaagcccatctctaagaaaatatttcagacctgtgaaaaactgtgtagaacaaaactgcctctaagctcattgatagtaaatttgtctcttatgaccccatggaggaagagaacaaacccataaatggcctttggaaagcattcctaaaaagtagattaaggctgacatagtggttcatgactgtagtctcagtactttgggaggctaaggatggtggatagcttaagcccaggaatttgagaccaggctgggcaacatgacaatacctcatcatgtagtgacctatagtctcagctacttgggaggctcaggtgggagggtcacttgagcccaggaggtcgaggctacagggaggtcatgccactgcactccagcctgggagacagcgtgagatcttgtcttaagaaaaagtaagactgggcgcagtggctcacgcctgtaatcctagcactttgggaggccaaggcagctggatcgcttgaacccaggagttcaagaccagtctgggcaacatggcaagaccctgactctatttaaaaaaaaaaaaaaaaagagggaaaagaaagaaaaaaaagtagattaacaggtattaatagtaagccatggctgggtgtggtggctcacacctataatcccagcactttgggaggctgaagcaggtggatcacctgaggtcagcagtttgagaccagcctggccaatatggtgaagccccatttctactaaaaatacaaaattagctgggtatggtggcacatgcctgtaatcccaactacttgggaggctgaggcaggagaattgcctgagcccaagaggcagaggttgcagtgaatcgagattgcaccactgcactccagcctgggcaacagagcgagactccatctcaggggaaaaaaaaaaaaaaaaaagtaagcctattcccagaccaaactgaggaacatttgaagatacagaaagtattcctcagtccaatttcccagatttataaagatttctcaaagatgtactcttccaccaagccagatccgtacttatatgtgatctgcagacccaaatggtcattaggataaattatttgattggactactcacagatgacagcaagagttttcacatctatttagaattgagaaaatgtttggcacaaaactcattcctgaaatcaggagtctcaaagttattgttttttgttttgagacagagtttcactcttgtcacccaggctggagtgcaacggcgggatctcggctcactgcaacctccgccgcccgggttcaagcaattcttctgcctcagcctcccgagtagctaggactacaggtgcccaccaccacacttggctaatgtatttttagtagagacggggtttcgccatgttggccaggctggtctcgaactcctgacctcaggtgatccacccacgtcggcctcccaaagtgctgggattacaggcgtgagccactatgcccagcctcaaagttattttgtatcttactatttttgcaccagcacctcctgggaacctccatatcttcatccctttaacaaattccaaggcagaagcacccgcccatgagctaacatttcaaaaatgtctaattctgaggtacatgaaagtttctccagcagacttagtttcaactggcacctaatgtgttacattagtgttaaatctttactcctttttcttatttatttctttacttattttttaatttttagtagagatggggtttcattatgttgcccaggctggtctcaaactcctgacctcaagtgatctgcccccctcggcctcccaaagtgctgggattacaggtgtgagtcactgcgccctgcccttgactcctttttcacaaccccagagagactatgatccacaaaggtccaagatgctgttaaaatgtgtggcacaggacaggtccagtgactcacacctgtaatctcagcactttgggagactgagatgtgaagactgcttgaggccagaagttcgagaccagcctggtcaacagagtgaaactccgcctctacaaaaaaattttaaaattggacgggtttattagtacgtgcctgtggtcccagctccttgggagacagaggcaggaggatcatttgagcccaggagttgaggctgctgtgagttatgatgatgcaactgcacttcagcccgagcaaaagtgagaccctgtctcttaaataaaaagaaacaaagaaaatgtgtggcacaattattgaataggctatccagatctagatactttctatttctccatgagctcctcaagggtcaaattcaaattatgggctttcccctcatgactccaggttgtggcaggggactaaaacaaaaacaagtcagtgagggggcaaagagaatttaaaaaaaaagaagcttggatgcataatgaatgatccaggttctatattcccagatcaaagtgctcatcctgtgaaggcacataaaacatgaatgcagtaagattttcacactttagggtatagaatagatagatagatagatagatagatagatagatagatagatagatgtgtgtgtgtttatatatgtgtgtatatatatacatatacttttttttttttgagacagagttcgcttttgttgcccaggctgaagtgcaatagtgcgatctctgctcactgcaacctccgcccaagttcaagtgattctcctgcctcagcctctcgagtagctaggattacaggcacccaccaccacgcctggctaattttttgtatttttactagagacggggtttcaccatgttggccaggctggtctcaaactcccgacctcaggagatccacccccttggactcccaaagtgctgggactacacgcgtgagccaccagaatatatatatttttaagacagcattttactctgttgcccatgctgtagtgcagtggcacaatcatggcgcactgtagcctcgacctcccagggctcagatgatcctcccagggctcaggtgatcctcccagggctcaggtgatcctcccagttcagccttccgtgagtgtctgggactacaggcaaataccaccatgcctggctgcctaatttttaaactttttgtagagacgaggccttgctatgttgcccaggctggtctcgaacttctgggctcaagcgatcctctcacctggcctcccaaagtgttgggattacaggcatgagccactgcacccagtttaagatttacaatgggccgggcacggtggctcacgcctgtaatcccaacactttgggaggctgaggtgggtggatcacgagctcaggtgatcgagaccatcctggctaacaaggtgaaaccccatctctactaaaaatacaaaaaaaaaaaaaaaaaacgggcgtggtggcaggcgcctgtagtcccagctactcgggaggctgaggcaggagaatggcacgaacccgggagtcggagcttgcagcgagctgagatagcgccactgcactccagcctgggggacagaccgagactccgtctcaaaggaaaaaaaaaataaaaaaaatatttttttaattcttgagctacatgttacagaaaacaccaagaagtttaaaatacagtccctgacattggttttaaaaaaacggagaagccagatgcaatggcttatgcttgtaatcccagcattttgggaggccgagatgggaggattgcttaagtccaggagttcaagactgcagtgagctacaatcatgctactgcactccagcctgggtgacaaaccaagccctagtctcaaaaaacaaaaaagaaagaaactgaggataggagatccatgaggggctaccaatgaaacaagactgttacagatcactttgaagaagacggatgatggatatgtggatgttcacgataccattctctctcaacctacagagattcggatgttaaaaagaaagtttcctgccctcaagaagcgagtggattcatcatgttgcccagggctggtctcaaactcccgggctcagacaatctgcccatctcagccaaccaaagtgctaggattacaggcatgaatcaatgcgcctggcctcaatatagcacttctaatccggaggaccagccaaagatgtcgagagcagtaagaaactgtaaattacaagcaccagggaaaaaggaatagcagaacaacagcatgggaggacagaaataactctgcccaagagtgaagaaaccaggatcttagaaccagctggactaacatatgatgactgtaaaaaacttcttggggcttgagtttaattgtcaattgaattgtaacaataccaattaccttagcaggaagagagtgatgacctgagctggttctttatgcttatgcacctctttttattaaggatggtttttgcttaactttatacttctgggcttctccctgaatgtttttttgttgttgttgtttgttttgtgtgggcttttttgtggggttttttttgagacaggtcttgctgtgtcacccaggctggaatgcagtggcgtgatcatggctcactacagcttcaccattctgggctcaagtgatcctcccacctcagcaacctcccccacctcccccaagaagctgggactaaaggtgcacgctaccacacccagctaattttttgtattttttatcagagacagggtttcaccatgttgtccaggctggtctcaactcctggcttcaagcaatccacctgcttcagcctcccaaagtgctgggattacaggtgtgagccactgcacccagccctcccctgaatgttgagtctcaaaatcctctgaactaaacggcattattcctgttatgcagacaaagaaactgaggccttagaggttctgatatgagcaaaaagaaccagcacaggtcatctccccctcattcttttccaataagtagttttccatacactgaagattgccgataattgactttctcagcttctgttttcctgacatagagccaaggtggtaaagagaacgcccaccatcttgatagtgcctgcaaacatgccgagttctaaaggacatggattgttttctattcatagcattgcccagggcacatcctaggagaatggcgaaggcactgctgaatttaatcaagtaaaaaactgtcactttcctacctgcatgtagaatacctaaaaaataatctcaatgcttacctatccacagctctgtctagcaagtaaaacagagcctgaagtaccacatgttggactgacttgtggggatgatgcaacctggcagtaaagagggcaatggaggctcctgttgggtcccgaacattctaaagcaaataaaacaagaaacattaaaaaaatcaaatagaaaatcacagcaattactaagacttatatactggataagggtttgatacatgtagaaaacagatgctaacaataattccctgacttcaccaattgctgtccaaagggaagagtgttaatatcatcctttgtctgattctcccaggactccctggaccatatttctgtggtaagaaaaaaaaaacacattctctttgctcttcaactacagacagatcaaaggatggctgtgcactggcttcctagctaacttccctggcagaatggcaaaagaaacaagcagcaggagagaaccagggaacaggaccatgatttccaccctctgccttaaaagtgccattgtatgtttacttgaaaggctgaggtctcaactaagtggagagcttgcgttaaatatggaagcatgggtgtctgacacattgcatatctctcccaaagaccatgactaaccttaatggaccaactgaagaaacttttctaagtctactgtacaactgattttccataattcaattattcaattatcattagtaactctaattactagaaactattagtaattcaattgttactaaaataattttataccaaactgcatggctgtttcacatctgctcctaactgtggagactctctagattcaggataaggtatataggaacaaagtccaaacagggggggatggaggagggatagcattaagagatatacctaatgctaaatgacgagttaatgggtgcagcacaccaacaaggcacatgtatacatatgtaacaaacctgcacgttgtgcacatgtaccctaaaacttaaagtataataataataaaattaaaaaaaaaaaaaaaaaaacaaagtccaaacaggacaccagttaaaaaaggaagtaataaggccctacaagataggtccctaaacactcactaagatggtgaattttccactgaggatctcagaacgaagaggttcctcatgaggtttcagctttacaatgccttccttccttcgagtttcctaaaaaggaagcacagcaaaatgtattaatatgaaaatactgtatatccaggacagcaccatgtaaccaccaaatctcagagataaggtggttatcaatgaatgaatgaattataaatttcataactaaataaattttgtaactaatttcataaccaattctacttcatttagttgaattagaattcaattaaatgggccgggcgcagtggcccacgcctgtaatcccaccactttgagaggccaaggcgggcaggtcacctgaggtcaggagttcgagagcagcctggccaacatggtgaaaccttgtctcggctaaaaatacaaaaattagcctggcatggtggtgcgcgcccataatcccagctactcaggaggctgaggcaggagaatcgcttgaacccagaaggtggaggttgcagtaagccaagacagcaccactgcactccagcctgggtgacaaaatgagactctgtctcaaaaaaaaaaaaaaaaaaaaaaaagaattcagctaaatgaataatgaagtcaactaaatgaattatgaatttctttgtaacctgcctccaagccagtcaagcattttcggaattcctgtccaaagctactttatcagcccctcaggtagggtatttttctctgactcagtaagaaccctaaccctgaagagtaaccagtatgttacattcaggtgcaggatcaaggttcttaaacacgcagcagcactgacatggtaccaggacactaaaatatggacctcaaaaatgtctggatgcctacgttctcacatattttctaggtttaggcctctcctatgtttaaataggagccttctctccacctgatattgtctccaacagcagctaccatgacttcattttcctcaccctgatggccagattctttttttttttttaattgagaccaagtctcacactgttgctgaggctggagtgcagtggcatgatcttggctcactgcaacctccacgtccaagagattctcttgcctcagcctcctgagtagctgggattacaggcacgtgccaccatgcctggctaatttttgtgtttttagtagagacggggttttgccatgttgcccaggctggtctccaactcctgggctgaagcgatccacccgcctcggcctcccaaagtgctgggattacaggcatgagccaccgcgcccagcctcttcagttctcctcttaaatgacaaggttgaccacctacacttcctttttccggagacattctctacctttatataccgataacaaaaaaatattatcttggtttgtcttatttcatcaaccgcttgttttaaacctcttaggctgggcacggtggctcatgcctgtaatcccagtactttgggaggccgaggtgcgtggatcacttgagctcaggagttcgagaccagcctgggcaacatagcaaaaccccgtctctactaaaaatacaaaaaattagccaggtatggtggtgcatgcctgtggtcccagctactcgggaggctaaggtgaggtgggaggatcacttgagctcaggaggcagagatctgcagtgagctgagatcatgccacttcacttcagtctgggagacacagcaagactctgtctcaaaaaaaaaagtgcttccacagaatccagtgctgccttatcataacatttctacaactctttgtttattttctctttcttttttttttttttaaacagtctcactctgttgcccagactggaatgcaatggtgtgatctcggctcactgcaacctccacctccttggttcaagtgattgtccctcctcagcctcccgagtagctgggaatacaggtgccactacacccagctaatttttgtagttttagtagagatgcggttttgccattttgttcaggctggtctcaaactcctgacctcaagtgatccacctgccttggcctcccaaagtgctgagattacaggcatgagccaccgcacccagccctagtctctctttctaaatagtaatctctgcacctggaacacagtaagtataaaataagtatctgttgagtaaatgaatgaatattgaatgagctggtccacaagacagatgtaaccaaacttcagttaagctaatcctagtgcttgttatcccaatttttttttttagggagattttgtatttctttagaaggattctgaccccaaagtaacatgctgtatagtgttttatcaaagacactactaactgagaaagcaaacaagcacaaaaccaaagtctatgccccctcaaaaaacaaaaatcaaaacaaagtaaaatcctgatgccgctacatttgcataaagatactttaagataatggacctagctaatacacagttgctcttcttttccagtgttaaaacttcccttcctgaactgcccactaagctcatcattcatctgaatggcaagtttctaaaagccttagacaacctgaaaaccaagattttcatgtggccagaggccaatgaaaagagctaggattaaaactctaggaagggtgaacccctatcctgccaccaggatgctgtcaggctacttcctccgtctcaatcattagatgtggcatcctggtctacgatcaaaacttaggtacaaaagtagtgccttccagtagctgccttgcccagcttcagctctcacaagggctcctggatatggatccattttttatgaaagtgaggaggaacacttagagaaccaatgtgtgtgtcgagcatgacagggacaacagcaacacttaacccaactgccacaggtctggtctacccctgagccacatactctgtaggagtggaacaattctatggcacggagcacatcaaacttccttgccatgaggaacttgacagccacattccaagacagcggggaaacattgtactgaactgtccacttgttaatctcttcgagaaactgcttggtagcctgtttgacaaagaaagaaagaataattagtaagaagagagcatatttatggagtcaaaaaacaaacaagtgaaaactatcatcccttctccaagcaagtctgaacccagtttgctacagggagcagggaaagacaaacaaaaaggtagaaacaggtctgaaaccagacatagttaaaatttgtataattcaatgaggccagaagccagatctaggttcagaaaacaggacttagtgcaggtatgcatgaaaaaatgaggggggagaagagggatcctaaatgagatgcaaattactagtcccaaagcaaaaaataaaaaaatttaaaaattttgggaggccacactttgggaggtagaggtgggaggatcacttgaggtcaggagttcaagactagcctgaccaacatggtgaaactccatccatctctactaaaaatacaaaactagccggatgtggtggcgcacgcctgtaatgtcagctacttgggaggctgaggtaggagaactgcttaaacccaagaggcagaggttgcagtgagctgagatcatgccattgcactccagcctgggcaacaagagcgaaactgtctcaaaaaaaaaaagaaagaaagaaaaaaaaagaaaacaaaaagaaaagtggccaggccttccgaaggattattgcctaatgcagtgtagtatagcagtctcagctgctgctttggtcccacaagccaaatggacacagcaaaagaatcagaaaatggttttggctttggaatttgaggccagtaaaattattaagaagaacttagccaatcaaaagagcagctattctttgtgctaactgaccccactggacctcttcatgctttatatggcaaccccaaaactggatactagtacccagagtcaataacagcccctctggatagtggttttggaaaggggaggaaaattttcatttttactgtctgacccaggctggcaagatgcctgcttccagaactgtttctatctctcaactaattcatgttcttttatgcactctcatcctatttctccttacattataaccaatttcctttttagacaaactacttttctgtttcttcattttagaatgatttaaattgggatttttttttttctttttttgagacagggtctcactctgtgacccaggctggaatgtagtggcacaatcttggctcactgcagcttcgaccacctgggctcaaacaatcctccagcctcagcctctcgagtagctgggactataggcatggcatatgtcatcacacccagtaatttttttctttgttatttttagtagagacaaggtctcactacatagcccaggattggtctcaaactccggggctcaagcgatcctctcatgatccctctcaaagtgctgggattacaggcatgagccactgccctcagcacattttttttttttttttttttgagacaatatctcactctgtcacccagcagactgcagtgcagtggcacaattactgctcattgcagcctcaaactcctgggctcaagggatcctcctgtccccgccttccgagtagctgtgactacaggtgcacaccaccatgcctggataatttttttgattttttgtagagacgaggactccctttgttggccaggctggtcttgaactccagtgctcaagtgatcattccatctcgcattcccaaagagctgggattgcatctgtgagctaaattggaattttttttttagatagtctcactctgtcacccaggctggagtgcagtggtgcgatcttggctcactgcaacctctgcctccagggttcaagtgattcttctgcctcagcctcccgagtagctgggactacaggggcacaccaccacgcctggctaatttttgtatttttagtagaggcaaggtttcaccatattggccaggctggtctccaactcctgacctcatgatccgtccgcctcggcctcccaaagtgctgggattacaggtgtgagccaccgcacccagccaggaataatttttttgtaggcattctacactactaaaagcttcatgcatggctattctgtcccttccatccagaaacttttctcagctgtttgtctgcaatatgacgaacctgatgagaattctgaattttaaccatacctctattcccaatcaacccacagttatgacttatttattcatatttaataagcacctgttatttgttaagctaatacttgcactgaaaggtataacgaataaaaaaatgaggtttgcttcgaaaggtataaaactagcctaccatgtgaccatggacacggtaattctgtctttgctaatttttcaattgaaaaataaagggaggaccgggcacggtggcccacaactataatcccagcactttgggaagccaaggcgggtggatcatttgaggtcaggagttcgagaccagcctggccaacatggtgaaaccctgtcactattaaaaatacaaaaatcagccaggcatggtggtgcatgtctgtaatcccagctactcaggaggctaaggcaggaaaattgcttgaacccaggatgtggaggttgcagtgagccaagattgtgccattgcactccagcctgggtgacagagcaagactctgtttcaaagaaaaaaaaaatggctgggcgtgttggcttatgcctgtaatcccagcactttgggaggccgagggcagatcacgaggtcaggagctcgagaccagcctggccaatatggtgaaaccccgtctctactaaaaatacaaaaattagctgggcatggtggcatgcgcctgtgctcccggctagtcaggaggctgaggcagaagaatcgcttgaaccaggaggtggggttgtagtgagccaagatcgcaccactgcactccagcctgagcgacagagagagactccatctcaaaaaaaaaaaaaaaaaaagaaaagaaagaaagaaagaaagaaaaagaaagggagggctaggcacggtggctcatgcctgtaatcctagcactccgggaggccaaggcaggaagatcacttgaggccaattcaagatcagcctggccaacgtagtgagatcctgtctctataatagatatatatattacattatatatattacatattatattattatatattatattataatatataatatattattattataataaaatatatattataataataaaaatatatattataatatattatattataatatattataatataatttattatataatattattatattataatatattatatattattatattataatatactataatatatattattatattataatatactataatatatattattatattataatatactataatatatattattatataatatactattatatatattattatattataatatatataatatatattattatataatatatataatatatattattatataatatatataatataatatattattataattattataatataatatataatagaatatattataatatatcataatataatataatatatattataatatattatatattatgatatattatatattacgatatattatatattattatatattatattatatattataatatatatttttattattataatgtatattttatattatatataatatatataagaaaaataaagagaaaaagcataatagcaatgacctacttcggagtcttggcaacaagtcctaccttacaaatacaattcaaattgctacacactatttaaacaactggcaaactaaaatcccaggagagtcagcaatacctcataacagagcatctgattcatcccccaatttctaggaaaggacaaaagtactttataaaccccaggaaagtctaaacggcctgaggctgcacctgagctttagagccttacgattaaggcaacatagcttacaccattggagaaggaaagaaccagcaaaaccaatcaggcaaagtgcatgaaaagagccaagaaataaaggccatgaagaaaagctttcagaagatcattctggcctggaaccagctgaagccacgccagagaaatgagtcccagagaagacaacaggacaaacttagaatgctccttcagaaaatagtttgaattgcctctgtggagtgagtggccagcatcaaaatgaggaaagatggaaggaaaaagaagtgagcacagaaagatcccagaaataaaactctagccagtcagtaaattccccaggagacatggtacctgtttttgttttttgttttttctgctttttttttttcttttgagacagaatctcgctctgtcgcccaggctggagtacagtggcgcaatcttggctcctggcaagctccacctcccgggttcacgccattctcctgcttcaggctcccgccaccacacccggctaatttttttgtatttttaatagagacagggtttcaccatgttagctgggatggtctcgatctcctcacctcgtgatccacctgcctcggcctcccaaagtgctgggattacaggcgtgagccaccacccccggccgagacatggtacctgttttttaattaacctattatcctttaaatacagttctctagtgggcctctctgatgttgcttatagaataaaacaccagaataatagaacatatttttcctgctacttagctgggtatacaatttctaataaaaaataatcaacggataaatcaatgtataagtagaagtggaaaatgtaaatgaccaagaggtgatatgaactcatcacatatccatctgttaagataaattttcattttttggctgggcacagtggctcgcccctgtaaacccagcactttgggaagccaaggtgggcagatcatgaggtcaggggttcgagaccagcctggccaacatagtgaatgaaaccctgtctctactgaaaatacaaacaattaacagggtgtggtggcaggtgcctgtaatcccagctacgtgggaggctgaggcagtagaatcgcttgaacccaggaggcagaggttgcagtgatccaagatcgtgccactgcattccagcccaggagacagtgcgagactctgtctcaaaaaaaaaaaaagataacttttcatttttcataaataaaccatgtcctaataagagaaaggcatgcaggtttcacacacttccttcaaagtacatcttgccttcctttttattaagctcagttcctccaaggtccttaatgttctgtagctcccaagagctgttgccttgagctgacctctgtccccctgctggtcaggatgttattcttggctttaagcacaggaacaattcctcctggtttggcctgaccaggccttgcatgtagagtccagtgtactataaacagtgatgtgatatttacagatacaaatacacatgcgtagcacctgctctgttcagcctcagattcaccctcctgcacacccatccctctggtggaagagatgaacctctaaaaggagtcagaaagaatggcctcatcttcaacaaccttcctttagacagttaatcagatttctccctctgcttacacataggtttaacatgaccactgagtacaaagtaatttgtagctctgctggttaccagaaaaacaagtcccagcaactttaatcagcaacacagtcttcagaagggataattgaaattctcaaaattaaaactcagtttatttcctagtgaaagaaagaatgagccaaaagatgagtcacagcttagaaaatattttaactccaggacaatggtttgaatctatctatgcttatgaaacacaagttgttaacacctggcagctaaggaagagctggagttcaaacagctctggtcttcctttgggataaggtctgaattgatatatggagaaactaacattaccacttacaaccctccttaaccagtttttcaggtaagggtaagatttgttttgttttgcttttttgagacaggttgttgctttgtcaccgaggatggagtggagcaatcatggctcactgcagcctcgacctcctgggctcaattgatcctcctgcctcagcctttccaagtggctgagactacatgcacacgtcaccatgcctggctaatttttgcattttttagtagagatggggtttcaccatgtagcccaggctgatctcgaactcctgggctcaagaaatccacctgcctcagcctcccaaagtgctggaattacaggcatgagccaccgtgcctggcctcaagggtaagatttgttcctgcatagtcaaaaagcatactataattatctacttctcccacaaccatgtttaaataaataaaaacaagtttcttgactatggccatgaagataaagatactagagaacctgctataaaacagctgagaaagctgtcaattaagcagggtacaccctggacacaattcattagtgttgaaataatggtatcagagagaataaaaccaacaacatagcctccatgttacatcaaactcccaagagcagctataattttgagatgagctttgggcaaggaactagccactcaagaggacaagaataatgtgctggcactctcagttccacaggtagtaccttaaatcctatatcccaagacaacctaggagagtgaagagccagacctgtaagaaacctgctcttgaaataaacaaaaaacttctgtctcctgaaatatcagttacctagcaacaaaggagaaagtttagtgtggttttggggattataaagaaccaatccatcttcttattcactactgtgtgttatttgggcaagtcatttaacctctctgagccacaatttcctcaccttgaatgagaaacggatggaagagcacccactaccatacctagcacttggtagtctctgaatggatgaatgttcattctcttttttctttactctggtcatttcacactaaaacttctttcaacaaagatagaatttcttagaatcatatgacctctgttgcttccctttagtctgtatcaatgcaatctctctaatccattttatacaaaaccatacatttaaactagaaatatgtgttcaggctgggagtggtggctcacatctgtaatcccagcactttggaaggccaaggtgggaagactgcttgagcccaggagttagagaccagcctgggcaacatggtgagaccccatctctacaaaaaaatttaaaaattagccatgcatggtggcacatgcctgtggtcccagctactcggggggctgaggtgggaggagtgcttgagcctaggatgccaaggctgcagagggccaagatcataccactgcagtccagcctgggtgactgagtgagactctatctcaaaaaaaaaaaaaaaaggccaggtgcaatggttcacgcctataatcccagcaccttgggaggccgaggcaggtggatcacctgaggtcagaagtttgagaccagcctggccaacagggtgaaacctcgtctctactaagaaaacaaaaattaaccaggtgtgctggcttgcgcctgtaatcccagctactcaggaggctgatgcgggagaatagcttgaacccaggaggcagaggctgcagtaagccaagatcatgtcattgtactccagcctgggtgacaagaaagaaagaaaaacaaaagaaataaacattcaactgaaaacgattttttttttttttgagacagagtctcactctgttgcccaggctggagtgcagtggcgtgatctcggctcactgcaagctccgtctcctgggttcacgccattctcctgcctcagcctcctgagtagctgggactacaggcggccgccaccatgcctggctatttttttgtatttttagtagagacggggtttcactatgttggccaggatggtctcgatcccttgacctcgtgatccacctgcctcggcctcccaaagtgctgggattacaggcctgagccaccgcgcccggcctcaactgaaaacactttttaaaggaccaattattccttattcaaggctctgtggctataaagaaaaagctgaggccagaagtatttagacttcagttcccatctttttgtccctactctcagacttctctggcagctccagagattaacaatgccatcctaggcacaagctccttttaacagcgcaaactatggagaggtctcaatacaataaagaaacaggtgttgattacaggtgttgtgcagaacaaacaccatgaaaaaatgcagtcagtcatcctgcaatgaagacctaaataaggaaagtgattcaagataagatgcaatgtctggcttttaacaaatttgaagatacttctgtatttcaacaaatatgccatttctccattatttcagtgatggatgcattaatgaactaccttcctctcatgacctgtttcccccctctctccttcattgtgattactgcctttttatatctattgatctcttcagcccatattaatctgctaggtgagactctgagcaaagacacactggtttgctataaggcagcaagaggtttgatgaatttccaaactaaaactacgatttttccataagcactttgttaatgtaccaaaaaaggaaacaaatccagtccctttaatatttactggtttatctcaaatattttccacttctcaggaaaacattgccttttcttaaaatgtgattttaaaagagataatgctttcttaaataggctcttactgcatttgggaaaagttttaagtatattttctgattttatcgtattataaaacaatgtaataacaaaaatttgcaaaaagtaaaaggccagtcataatctgtgcacacacacatttaaagaaaaacttaagggaaggggaaaagaaaggattagtcaaacattcacaacaaatatttgctgagggcccattctgtgctaatcagtacagtagttgttgagaagacacaacatagatcgcttcttggcctttcgctaagatcaagtgagaagacacaacatagagacataaagaccctattccaagcagtttacaatcatttaactatggagacagatgtataaatacatctttaccacataatgtaataaattctaggaaggttctatgaacagaatgctatgggattcaaactctctctatggatataaaaaaaatttttttaggagtgccttgaaggatgagtaggaatctgtcaggcagagaaaagtattctagtcagagaacaaaatgtttcaaatcagggtcatgaaagaacagggcttattggggatatcatatagctagtgtgtccaatgtgtatgagggagaatggtgggagatgtgtgaacaggggggctgaaccagactgggaaggcccttgtatgctgtacttcaaattccagacatgatcctataaacataaaagattcaatagagatctttaagcaaagggatgagatgatgagtttggttcccctctcccacctcaaaaaaataactataagcagtggggaagtcagactgaaaggaaaaaaaatctagcaacagggaggtaagttccctgaagacagggatcatatctattttattcacctagttcctagcactgtgcctggcacaaagcacttacttaataaatatctatgatgaatgaatgaattaattattgaagtctcaatattattaacatttagagggcagacagaagatgaagaacaaaggaacttttacaattttcttttagaaatactagtgattgcaggccaggcatggtggctcacacctgtaatcccagcactttgggaggccaaggcaggcggatcacctgaggtcaggaattcgagaccagcctgaccaatatggcaaaactccgtctctactaaaaatacaaaacttagctgggcatggtggtgggcgcctgtaatcccaactactcaggaggctgaggcaagagaattgcttgaatccaggaggctgaggttgcagtgagccgagatcatgccattgcactccagcctgggtgacacagtgagactccgtctcaaaaaaaaaaaaaaaaaaaaactagtgattgctgaaaatcaaataaatggtgatctaaacaaaaacaagaggaatcgtcaaatatcttccctaaaaaaaaaaaaaaaaaaaaaaaaaaaaggccaggctcggtggctcacgcctgtaatcccagcactttgggaggcttaggtgggtggaccatgaggttaagagatcaagaccatcctggccaacacggtgaaacccccacctctattaaaaatgcaaaaaacttagctgggcgtggtggtgcgcacctgtagtcccagctactcgggaggctgaggcaggagaatcacttgaactcaggaggcggaggttgcagtgagccgagatggtgccactgcactccagcagggcaacagagggagactccatctcaaaaaaaaaaaaaaaaaaaaaaaggccaggcgtggtggctcacacctgtaatcccagcactttgggaggccaaggcaggcggatcacctgaggtcaggcgttcaagaccagcctggccaacatagtgaaaccctgtctcttctaaaaatacaaaaattagctgtgtgtggtggtgcctgcctgtaatcccagctactcaggaggctgaggcaggagaatcacttgaacccaggaggcagaggttgcagtgagccaagattgtgccactgtactccagcctgggagagagagcaagactttgtctcgaaacaaaacaaaacaaaacaaaacacacacacacacaaagcttcacagtaaagatagctctcacattacaggcttctccgaggaatgtaaagacttggtttaacatcaggagatctatcaaagcaatttttatgttaacaggaaaggaaaaaaaagtatataaccttctcaacagatgctgaaaatgcactgcgtaaaatccatcacacataggccccgtaatttttttctattaaagatgagaaggccagcaggtacctgctattaccaccactatgtaacattgcactgaaggtcatacctaacagaagccaaaagatgcgtaacaacctgatgcaaaaagacaggaattttaggccaggtgtggtggctccaatctataatcccagcactctgggaggccgaagtgggcagactgcttgatctcaggagttcgtgaccagcctgaggaacatgacaaaaccccgtctctacaaaaaatacaaaaattcgcccagcatgatggcacacgcctacagtcccacaagtgggaggatcacttaagcccgggaggcagaggctgcagtgagctgaaactgtaccactgcatggccccccagcctgggtgacacagccagaccctgtctcaaaaaaaaaaaggaatgttaaagaagagaataaaattcagaaaccacacagtgtatatctaagtatacagtatatgaaacaagtaatatgactattagtaagcaaaaagtattataggaatttagatatgcacataaatatttgtaggatacacaaaaaactggtaataatggtcacctctggggagagaaaatgaactggggctgggtgtaatgcttcacacctgtaaccccaacactttgtgaggctgaggcaggaggatcacttgaatccagtagttccagaccagcctaggcaacaaagcaagacccagtctctataaaaaaaataaaaaagaaagaaagaaagaaagaaagaaaatgaactgggaaacagcattggaagataactataagcaacctttaaaaaatttttttttggccgggcgtggtggctcacgcctgtaatctcaggtgtttcaccattttggccaggatggtcttgatctctcgacctcatgatccgcccgccttggcctcccaaagtgctgggattataggcgtgagccactgtgcccggccagtgatttatctttagtaaacaaattacatttactatcttctctctgaaggaagttggtatttagaagattttttttttttttttgagatggagtctcgcactgccacccaggctggagtgcaatcgcacaatcttggctcactgcaacctctgcctcccaagttcaagtgattctcctgcctcagcctcccaagaagctgggattacaggcgtacctgcctactttttgtgtgtgtttttagtagagacggggtttcactacgttggccagactggtctcgaactcctgacctcatgatccgcccgcctcagcctcccaaagtgctgggattacaggcatgagccaccgcgcccagcctagtagagaagatttaattggaggaccacgaaggtagaaatgttcacccatttgaatatgtgaacttttttattgttgttttttgagatagaatctccctctgtcacccaggctggagtgcagcggtgtgatctcggctcactgcaaccttggcctcccaggttcaagtgattcttctgcctcagcctcctgagtagctgggattacaggcgcgcaccaccacgccaggctaactttgtatttttagtggagacggggtttcaccatgttggccaggctggtctcgaactcctggcctcaagtaatccgcctcaagcaactcccctgacctcccaaagtgctgcgattataggcaagagccgccacgtctggcctgaatgtgtgaacttctaaattatatgtcacgttttatttattaggaagtgtgaagtatagaattccttatggctaagacctataaaggtatcattaaaaaatttaaagacataaaatacccctcagtttctctgcctttttgaaggaaagcatcagaaataaaaaacaaaagtgaaactgacttttacaaaagtttagtccattgagatagagcaaataaataggcacaatgaaagaaaagggaatagagtcaactaagtttgagtgcactgtaaatacttttttaaaaataatgtgtggccgggcatgttggctcacgcctgtaatcctagcactttgggaagacaaggcaggtggatctcaagagttcgagaccagcctggccaacatggcaaaactctgtctctactaaaaatacaaaaattagccagacgtggtggcacatgcctgtaatcccagccattcaggaggctgaagcaggagaatcgcttaaacccaggaggtggaggttgcagtgagctgagatcgcaccagcctgggtgacagagcaagactctgtctctaaaaaaaaaaaaaaaaaaagaaagaaagaaagaaagaaagaaaaatgtgaatcaggtctgattggaagcactacttctgctgccttcctgtttgtacttttcagttgctgcaagaatgatccaggcggctgctaggtgaggtgacacataattccagcattttgggaggctgaggtgggaggattccttgagaccagcatggataacatagtgagatcctgtctctatttaaaacaaaaaaaggatgatccaggtgggacgagatgactcatgcccgtaatccaagcactttgggaagctgaggtgggaggatcgcttgagcccaggagtttgagaccagcctgggcaacacagggaaacctcgtctctaaaaaaaaaattaaaaattagccaggtgtggtggtgcacacctgtagtcccaggtactcaggaggctgaggtaggaggatcacttgagcctaggaggtccaggctgcagtgagctgtgatcacaccactgcacttcagcctgggtaacagtgaaaccctgtctcaaaaaataaaaaaataaaaaataaaaaaaaagagacaggatcttgctcttgcccaggcttgagtgcagtggcatgatcatagctcagtgtaaccttgaagtcctaggctcaaatgattctcctgccccagcctccctagtagctggaactacaggtgtgtgccaccacatctggctacttttttaatttttgtagagatagggtctcaccagccgagactggtgtcgcactcctggcctccagtgatcttcccccattagcctactgaagcgctgggattacaggcatgatccaccacacctgccctcattttattattattattattaattaattaattaattttttgagacagagtctcgctctgtcgcccaggctggagtgcagtggcatgatctcggctcactgcaagctccgcctcccaggttcacaccattctcctgcctcagcctccccagtagctgtaactacaggtgcgcgccaccatgcctggctaattttttgtatttttagtagagacgggatttcaccgtgttagccaggatggtcttgatctcctgacctcctgatccgcctgcctcagcctctcaaagtgctgggattacaggcgtgagccactgcacctggcctttattattttttgtttttgagacggagtcttactctgtcacctaggttggagtgcagtagtgcgatctcagctcactgcaacctccacctcccaggttcaagcagttctcctgcctcagcctcctgagattgagaccatcctggaacatggtgaaaccccgtctctgctaaaaatacaaaaattagctgggagtggtggcgtgcacctgtagtcccagctactcagaggctgaggcagaagaatcgcctgaacctaggaggcagaggttgcagtgagccgagatggtgccactgcactccagcctggtgacagagcaagatgccatctcaaaaataaaataaaataaaataaaataaaatataaatcattaataggtctactcccagcaatctggataaatgtatattgggaactcagaaccaactgcttaaaactacatgtggcacagaatctttcacaatgagtttacaaacattttcttcctttaaaagataacccatattatcaggtctctttattctgatatccacatgttgcaagatagaaagtctttcttgttcatccgttaagggactatgtgcacttcaaactcaaagccctacaaatctcatcagaaagggtaaggccaaataaccatgaagaaaggcctaacacccatctgcctaatgaaaccaaataggatggttctgaaaccatgggactcttccatctaccacatcaagcattatgcaagaacccaagaagaaaaaaagctaactgctattaaaggattaatatcccactgggaacggatcaacaggaaaccagggttgaccaagtgaagtttcccatctgagtccaaagcttcaggcaacactgaggggccagagttaactgaactgttaaacacgaaaagctcctcagtgttaatgacttcctaccagcagaagtgaagggctaaggtttatcagcactccaccagccaagtgtgacagccccagatcaggaatagtttgtctccaatacctgatgagcagaaaatgttctattccttttcaaatgctatttctgtctcctttggctcatggttcctttgtacacataagacagcattagtcacatattaaagaaggcaattcaatcccttcattttttttttggctttttttttttaattatacttttaagttttcgggtacatgtgcacaatgtgcaggtttgttacatatgtatacatgtgccatgttgatgtgctgcacccattaactcgtcatttagcattaggtatatctcctaatgctatccctcccccctccccccaccccacgacagtccccggtgtgtaatgttccccttcctgtgtccatgtgttctcactgttcaattcccacctatgagtgagaacatgcagtgtttcgttttttgtccttgcaatactttgctgagaatgatgttttccagtttcatccatgtccctacaaaggacatgaactcatcattttttatggctgcccttcatttttctagagcaagattttgcccctcccagttcacacagaccaaagagcaaagtcctgcaagaaatcacagtagtagtaaccatgtgtgaagcatttaagatataccagagaaggaaccatactacatcatactcaacactgacaagctaggtattattaaccgcataaagaaatcaaaggctcacagagccgaagcaaactgtccaaggttactcaaccaataaatggcagagctgaggttttgagcactgaatccaagtcttttcaaatccttatagtctttccacttcactaaatgggcatgagacatacaagacacatatcattcatcttattgggtaatatatatgtcatttgtttgttgatctatgcacaaaattactctggaagaataaataagaaactggtagcatcagctgtctcagaggagaactaggtagctgggagacatggtgagaagattaatattttccatattcctttctgtatctttttaagtttaaatcgtatgactatattatccactcaaaaaaataacaataaaacatattagttttatatagcctttaactaaaatatacataacaggaatttttgaacataatatttttgaaactatgccaccaaacaataataagtttgttggtaatcttcatttcagggccaaaaaaatgagttagggagctctacacaggggtaaaggatgacagctgtttcacgaactgctagccttagatggggatgcttcaacgaggagtgtgccactctcactttcctgctggaggcatttgccaatagcatatttactaaacacaagctggcatctctcctctcaggtttaaaaaacacttgccaggccaaagttatcaaagaggatgaagaattcccagagacaacagaggaaataggtaaacaaggaaaacaaggaagtaaacaattctaaattgtcataggagaaaattcatgttaggaggttgagaggcagaatataacacagaagagaaacggaaaaaaacgaaacctgccgagtaaacaagcagctcctggccaggcgtgggggctcacacccataatcccaacactttggaggccaaggcaggaggatcgtttgagcccaggaatttgaaaccagcctggacaacacagggttatccaatctccacaacatatgaaaataaattagccgggtgtggcagtgtactgctgtggtcctagcaggaggctgaagggggaggatcacttgagcctgggagtccaagtctacagtgagctgtgatgatgccactgtgttccagcctgggtgacagagcagaacctgtctcaaaaagcaaaacaacaacaaacaaacaaaacacacacacacaaaaacaagaagctcctcatccaccaacaagagcaacatcatctaggttcccagagggaggtaacagaggtagctggtcacactctccacaagaacctgtagacagcttgccaactgccactcatgccgctaaagagtgagtgaaccacacaaccagaagaaacctgtaaagtctttctgggggaaaaaaaaatttaaagagcttggtaaacatagagagtgggaggggcctttggtaacattttttttttctcttcttccaactgatagcttagactttaggaaagaaaggaggaatgtgaatggctgtgaggaaattgaagttggctttccagatcatgctaaaacattcttacccttcctctactcccaaacctggcttattcctatttctccttcaggtcagcctaaatcctacttcatcctataaatttctactgctttccagccaagcactgaccaaacagtattataaagcatgttattgtctatctgctcccactaaactgtaagcttgggaagatgcaggggccaagggttctgtgccacaactgcatactcaacaccaagcatagtgacaccattctgataagtaaatgtgtcaatggtgatgggctcttggcctgctaaaagagtgtggttcagagagtaggaagaacacatttgaacacttgccaatctgattatgggaacttaaaatttaaaatacaggagagggccgagcatggtggttcacacttgtaatcccaacactatgggaggctgagatgagtagaatgcttgaccccaggagttcaagaccagcctgggcaacatagtgagacccccccatctctagaaaagatttaaaataaagtaaaacaaaacaaaacaaaataaaataaagtaagaggacagcaaaaaattcctaaataaaactgggaaagaacatcaggaaaataacatgagaagaaaagcaatgaaagaggtgactattaaatcacagaagaaactatctggaaattagatatcttaattccctgccaatatcttaacgtcagacatctataataggatatacaaaataaaataatttaaaataaatttatggccaggcgcggtggctcatgcctgtaatcccagcactttgggaggcggaggcaggtggaatcacttgagatcaggagttcgacatcatgacaacagcctggccaacatggcgaaaccccgtctctactaaaaatacaaaaattagctgggtgtggtggcgcacgcctgtagtcccagctacttgggaagctgaggcacgagaattgcttgagccagggatgggaggatgcagtgagccaagatcacatcactgcactccagcctgggtgacagagcaagattctgtctgaaaaaatagattaaagtaaatttatggattttgtaaaataagtaagacatggtctctacccataaaaatctgagtctggcagaactgtgaacacaatacaccaactaatgggcaaatggaattcaaatctttattatttttacttatttatttttgtcttttacaaacaaaagtaagtaattcagatctcaagaggggaagtggaatgacagcacatcccaaaatgatattccctggagaaatccacaaaccacagtagaaaatttctgaatgaggataaaagagagtaatggacatgatacagctactgggagaccccttcaaacttctcaataacagaaaatatagattgttttcttgactcagatcccaaaattgtcagggtgataatggtgtatagaaatagggaacttcagccaggcgcagtgcctcacgcctgtaatcccagtactttgggaggccgaggcgggcagatcacgaggtcaggagttcaagaccagcctggctaacatggtgaaaccccatctctactaaaagcataaaaaataagccaggcatggtggcacatgcctgtactcccagctactcaggaggctgaggcaggagaatcgcttcaacctgggaggcagaagttgcagtgagccgagatcatgccactgcactctagcctgggcgacagagcaagactctgtctcaaaaaaaaaaaagaaatagagaacttcattaaccttgacatttgctggatatcacatttaacttaaaaagggtgggtgggcacagaaagcctgataaattcttgtggacagtttcatcctaaaatgataagagaacgactacactggacattatccagactaaggagaaatactagatgaaaaattgaaagggtttcaagaagaaagtaaccacataatccttaacagtgtgatagccaacaactaagtgttgtcaacaggaggcagttaagaatgcaagttctagacagagcactagtcaccctacattaaagacccagttctgccacagcagaactctcactcaggcaagtcaaaaaccacctgtgccaggccaggcacggtggctcatgcctgtaatcccagcactttgggaggcctgggtgggtggatcacctgaggtcaggagtttgaaaccagctggccaaatggtgaaactttgtctctactaaaaatacaaaaacattaccagatgtggtggtgtgcacctgtagtcctagctactagggaggctgaggcaggagaatcgcttgaacacgggaggcagaggttgcagtgagctgagatagcaccactgcacttcagcttggccgacagagcaagactctgtctcaaaaaaaaaaaaaaaaaaaaaaggccaggcacagtggctcacaccggtaatcccagcactttgggaggccaaggcaggtggatcatgaggtcaagagttcaagaccaccctggccaacatggtgaaaccccgtctctactaaaaatacataaattagccaggcgtggtggcagacaaaacaaaacaaaaaacaaaacaagacaaaaaaaacctctgtgccatacattttctcatccaaaaaaggaaacctgcctatgctgtctcgcatgatcaaataactggctatccttgaaggcattgtgtaaaacttaactacactgcattaagtaacaccagaccttaacaatagctaatatttactggatatagggttctttttttttttttttgagacgaagcctcgctctgtcacccaggctggagtgcagtgactcaatcttggctcactgcaacctcggcctcctgggttcaagcaattctcctgcctcagcctcctgagtagctgggattacaggcatgcgccaccacacccggctaatttttgtatttttagcagagatggggtttcaccatattagccaggctattgtcgaactcctgatctcaagtgatccacttgcctcagcctcccaaagtgctgggattacaggtgtaagccaccatgcctggcccctactgggtacagagttctaatcacaagtcagagactaagatttagatagattatcaaattctctcaatagcccttaaagattgatactattattatccctatattacagttgagaaaacagatttcgaactgttaggtaacttgtccaaagtcccagaacaagaaaagtggtagagcctgaatcagaacacaggttttctgactctagagaatccacattataaccactgtattacagtgctttcaaaatgcagatttaactaaattaaaatatcataatataaacttcttctttttttttttttgagatggaatctcactcttgtcacccaggctagagtgcaatgggacgatctcggctcactgcaacctccacctcccaggttcaagctattctcctgcctcagcctcccaagtagctgggattacaggcgcccaccaccatgcccagctaatttttgcacttttaatagagatagggttttgccatgttggccaggttggtcttgaactcctgatttcgtgatctgctcacctcagcctcccaaagtgctgggattacaggcatgaaccaccacgcccagactaatatcataatatgaacttctaaagagaagacagatggtggtattgcttttttgttttaatttttgtttttgttttttcctttagagacaaggggaaatttttttttttttttttttgagacagagtcttgctctgtcacccaggctggagtgcaggggcgcgatcttggctcactgcaagctctgccaccagggttcacgccattctcctgcctcagcctcccgagtagctgggactacaggcgcccgccaccacgcccggctaattttttgtatttttaatagagacggggtttcaccgtgttagccagaatggtctcgatctcctgaccttgtgatccgcccgcctcagcctcccaaagtactgggattataggcatgagccaccacacccagccaaaaatttcaaaaaaagaaaaatagaaacagggtctccctctgtaaccaaggctggagtgcagtggggcaatcatagtccactgtaatttcaaactcctgggctcaagcaatcctcccatctcagcctcccaaagtgctgggattaacaggtgtgagccaccacacccagccagatgctggtgttttttaaagaaatccttaaaagtgagataatatgaattatgcaattaattataaattattccaatttcatttttttttctttgagacaaggtctcactctgtaactcaggctggattacagtggtgaggacatggctcactgcagtcttgacctcccaggtgcaagtgatcctcctgcctcagcctcctgagtagttgggactacaggggtggaccaccacacttggctaatttctgtattttttgtagagacgaggtttcaccatgttgcccaagctggtctcttaactcctcagttcaagcgatctgcctacctcagcctcccaaaatgctgggattacaggtgtaagccaccacatctggctaatttcaaatttaaaaagggaacaatctgaagagactagcacaatcgaaaagcattcttgagtacagatgttaaaaggccactcacaaacacgtacaaaaaacagaaggcatagttaaaaaaaagagtggtggctctaacctaaaagaaaagtaacagcccataatgaggcaaggcttgttaataaagctaaggataacaagaagggttttgtgagaactgtctagaccttggaaggctggggcggaaggattgcttgagaccacgggttcaaaaccagcctaagcaacatggcaagccctcgtctctactaaaattaaaaaattagccaggtgtggtaaagcatgcctatagtcccagctactcgggaggctgaggtgggaggattgcttaagcatgggaagttaaggctgcagtgagccatgactgcatccctgtactcttgcctgagtgaccgagtaagacccttgtctacccccacccccaccaaaaaaaaaactgtcttgataaactcctttttccgtttctctatcaagtacaatgttcagtttgaagtgggaaaaaataagccctgtaaatagagagaaatgaatttcaaaacagcagagaccctaacaatctgacaatcctgagaactccaaggcagcctgataaacccctgtggtagttttttttttttttttgagacagagtcttgcttcttcacccaggctggagtgcaatggcgctatctcggctcactgcaacctccacctcccggattcaagcgattctcctgccttagcctcccgagtagctgggattacaggcacccgccactacatccagctgatttttgtactttcagtagagacggggtttcaccatgttggccaggctagtctcgaactcctgacctcaggtgatccacctgccttggcctcccaaagtgctgggattacaggcgtgagccaccatgcccaaccagtggggtcaattttaaaggacataaaaaataaaaagattggctgggtgcagtggctcacgcctgtaatcccagcactttgggaggccgaggtggacggatcatttgaggtcaggagttccagaccagcctgtccaacatggtgaaaccccatctttactaaaaacacaaaattagctgggtgtagtggcgcatgcctgtaatcccaactattagggaggcagaggcaggagaatcgcttgaacccgggagaaggttgcagtgagccaagatcgcaccactgcactccaacctgggcaaaaagagtgaaactccatcttggaaaataaataaataataaaaataaaaagtttttttttcttttttgttgagcagggtctcactgtgttggccaggctgctcttgaactaggctcaagcgatcttccttctttggccacccaaagtgttgggattacaggcatgagtcaatgtgcctggccaaaaattaaaagattttaaaggaaaagcctggaaggagagagacaaacagaccaatgtttactgagtgcttatagtgtgctgggccatgaggcaagtactttacatccatgttttattcaacctttccaacaggcccatttgtagatattaagacttttaaaaaaatttttttcagacatgaaatctcactgttgcccaggctgaacttgaattcctgagatcaagggatcctcctgcctcaggctccagtgtagctgggactacaggcatgcaccaaccaccctgccgagggctgttaagacattttaaatatgaggaaatgaaggcccagagaagttaggacttcaccaagtcacattgcttcccatgatacaaccaagattgcaaaaccaagtctgactctaaaacccacgctctttttctttttgaaacggagtctcgctctgtcacccatactggagtgcagtgccacaatctcagctcactgaaacctctgcctcccaggtgggttcaagtgattctcctgcctctgcctcccaaatagctgggactacaggcatgtgccacaaagcccagctaatttttctatttttagtaaagagggggtttcactatgttggacaggctggtcaccccatgcatgctctttccattaatttactctgtatctgtctctggcctagtcccattgatggcaatgagcacattacagaggcgtagcatcccaaacaaggaggcttactagacctcatctgtaatatagacagtccccaatttatgatggtctgacttacaattttttgactttagccaggcatggtggctcatacttgtaatctcagcactttgagaggctgaggtgggcagatcacttgaggtcaggagttttgagaccagcctgaacaacatggtgaaaccccgtctccactaaaaatacaaaaattagctgggcatggtggtgcacgcctgtagtcccagttacttgggaggctgaggcagaagaattgctggaaactgcctgggaggtggaggttacagtgagctgagatttcaccattgcactccagcccgggtgacagagtgagactccatctcaaaaaaaaaaaagaaaaaagaaaaaagaaaaaaaaatttgttttgacttaacaatggtacaaaagtgataagcactgccgggcacggcggctcacgtctgtaattccagcactttgggaggccgaggtgggtggatcacctgaggtcgggagttcgagaccagcctgaccaacatagagaaaccccatctctactaaaaaaaaaaaaagtagaaaattaacggggcatggtggcgcatgcctgtattcccagctactcgggaggctgaggcagtagaatcacttgaacccaggaggcggaggttgcggtgagccaagatcacaccattgtactgtagcctgggcaacaagagggaaactccgtctcaaaaaaacaaaacaaaacaaaacaaaaaaacagtgataagcattcagtagaaactgtactttgaacacccatacaaccattttgtttttcactttcagtattcaataaattacatgagatactcaatgctttattataaaatcacctttatgttaaatgatcttgcttaattctaggctaatgtaagtgctctgagcatgtttgcggctcagatatgagctgaacatcataggataagctatgctcagtaggttaggtgtattaaatgcattttcaacttatgatattttcaacttacgatgggtctattgggacataaccccacagtaagtcaaaaagcacctaggctgtcttcagttctgagtgctgaactttaagagagtcaccggcaaactagatatggtcccataaaagatttagataagggcactgggtcatgctgaccatacagaaggagggcctttagctaagagaacaaatatatggtaaaaatagaacacaaatccaaaagatcaaaactggatggtgcaatgggctagaatggtactaaaaagcaacggcctttagagtcagacagccaagggtttgtattccagattctatcactcactgtttagaatccaggcaagttacttaacttctctgaaccttaatttcgacatttataaaacgggggtaatactacacaaaattgcaagaggggagaaaaggtaatatttgtaaaattcttgggacataagactcaacaaatggtagtgcacattaaatctaacaaaatgaaatttaaggatatgtgcaagtaaatcaattttagaagcaccagatgaaacttaacaggagtacataagaaaagaattaaagatcttagtagacttgaatctgtgaatcaacagcttgctaagactgccaaaaattattgtgaatttggagaccattacagaagcacagtgtccaaaacaaggagtcctatcagacttcattcatgatactgtctttagtcctgagtgctaaactttaagagggtcaccggcaaattagaatcaatccaggacagatgagaaaagttagtagctctgaaaacacagtaacttgcctcttcttcctggctctatattccctccactccatccaaccaaagctacctgacaactgcttctatctctatgccccagtaacacattcatgctcatatatccccccacaacatattcacgtccctcaattttgccccagttccaaagccccaaatggatctgacagagtgacttgttcacttctagtccaaaaatctaggatgaggcatgtgagacttgctgctaatctggccctgacctgcagattatacttgatgctaatctgcaccaaatctaactggcccctgcattcttcctgaggctgagacccaaccctgtaccctgggtaactgaattaatcctgagtctgagtcacatactcaagaaagtaggactcttcctgaatgtctccttgacccacagctccattactcccttaaagggatgaagctggtcagaagtatacaattagacaatgtcagtcatctcagccatttcaaacctgctagaccaatactttctttcttttttttttttttttttgattttttttaagacagaatcttgctctgtcacccaggctggagtattgcagtggcacaatcatgggtcactgcagcctcaaccttacaggctcaaatgatcctcccacctcagcctcccaagtagctgggactacaggagtatgccaccatgcccggctgaaaaaagaaaaaaaaatttttttttttgaaatagaatttcgctcttattgcccaggctggagtgcaatggtgcaatcttggctcaccacaacttctgcctcccgggttcaagcgattcttctgtctcagcctcccaagtagctgggattacaggcatgcaccaccacgcccggctaattttgtatttttagtagagacagggtttctccatgttggtcaggctggtctcaaactcccgacctcaggtgatccgcccgcctcagccttcccaagtgccagaattacaggcgtgagccaccacgcctggcctttaaaatttttttgtagaggcagggtctccccatgttgcccaggctggtctcaaactcctggactcaagtgattttcccacctcagcctcctaaagtgctggaattacatgtttgagccaccatgcccggcctagatcaatactttcaaatccaaaaaggccctcagataaactcaggaacaaacgtatatattctcacaaaatggtacaagttgatcagcttattgtacctaagagactatttgcaaacctacaaagaatgaagtcttaaatagctgcctgtaatctggatgtcctcactgcagtgaggcatcagctccccagcagaacccagacagtaaaatctgttaactcacatgtccagactctcagggcaactaacactggagtaacatgagcttccccctatggaatggtcttgtcaaaactggcaggttttcctggctgaatcagaacagcctgggtcttgtttcattcaatactcccttggaagccaagcatctctctagggaatgccatctgcagtggacatcaggtatctcaatgccctctttgcaaccatgcaaatatcctggttccatttctatatctcaagagactctgctctttcttcagatgagaaaaatcatgataaatgctagtctttgagaagtctgccttgctgttcctcttccagggaacagttcagttctagtccagaaccaaatgattcctggagctttcatccagttcagactgcttctatacctagttccagagccaatttataaattcaagacttcccttcctcaactgtacctgaatgtctaaattcacttctagatgtttccttgatcaacaacagcaccctagatattctctggatcactggttgtcagactttgagtatgcatttagagacgttaaaatacatattactggatcccacctcggagtttctgattcagcaggcctagggcaggacttgaaaatgtgcatttttgttttttatttacttttcattttattattattattattattatttttgagacagtcctcgctctgtcacccaggctggagtgcagtggtgtgatctcagttcactgcaacctccacttcccaggttcaagcaattcttgggcttcagcctcctgagtagctgggattacaggcgtgcaccaccatgcccagataatttatgtattttttgtagagatggggtttcgccatattggccaggctggtctcgaactactggcctcaagtaatccacccacctcggcttcccaaagtagtgggattacagttataagccactgcgcccggccaaaattttgcatttttaacaagctcccaagggatgctgatggtggtggtcagggaaacacactttaagaaccactgctctagccaggtgcagtagcctacacctataatcctagcactttgggaggctgaggcaggatgatcccttgagcccaggaaatggaggtggcagtgagctatgactgcaccacttcattccagcctcgatgacaaacaaagcgagacccccgtctcaaaaaaaaaaaaaaaaaaaaaaagagagagaggcactactctagatcaacaattttttttttctgtcgcccaggctggagtgcagtggcacaacctcggctcagtgcaacctccacctcccacgttcaagcaattctctgcctcagcctcccgagtagctgggattacaggcgcccaccaccacgcttggctaatttttgtatttttagtagagacggggtttcaccatgttggccaggctggtctcgaactcctgacctcgtgatcccccctgcctcggcctcccaaagtgttgggattacaggtgtgagccactgcaccggccttttttttaattattattttattattattattttgagacagggtctcgctctgtcacccaggctggagcgtagtggcacaatctcggctcactgcaacctccgcctcccaggttcaagcaagtctctgcctcagccttctgagtagctgggattacaggcatgtgccaccacacctggctagtttttgtatttttttgtagagacagagttttgccatattgcccaggctggtctcaaactcctgagctcaagtgatccacctgcttcagtctcccaaagtgctgggattcaggtgtgagccaccacacctggccgcattttctttattgtggtaaaatatacctaacaatatttatcatttttactattcctaaatatgcaattcagttgcattaaataaattcacattgctgtgtaactagcacctttctataacccaaaattgttttatcatacccagcaaaaactctgtacccattaaacaataattcccccttcccaactttccacagcctctggtattctactttctgtccctatgaatgtacctattgtaggtacctcaaacaagtggaatcacaacagttgtcctcctgtgtctggcttatttcatgaagccgaatgtttccaaggtccatcatggtatatagcatatatcaagactgccttccttttaaggccgagtaatattccattatatgtatatacaccattttgtttattcttctgttgatggacacttgggttgttccacctttggctattgagaatagtgctgctgatcagacgcagtggctaatgcctgtaatcccagcactttgggaggttgaagtgggcagatcacctgaggtcaggagttcgagaccagcctggccaacatggtgaaaccccgtctctactaaaaatacaaaaattagctgggtgtggtagcgcatgcctttagtcccagctacttgggagtctgaggcaagagaatctcttgaacctgggaggcggaggttgtagagggctgagatcacaccattgcactccagcctggtcgacagaatgggactctgtctcaaaaaaaaaaacacaaaaaaacaaaaaagagaatagtgctgctatgacatgggtgcacaagtatctctttgaggctctgtttcaattcttttatatacttaggagtgaaatttctgggtaatatggtagttctacctttaatctttagagaaactgccaaagtgttttccacagtggctgtaccattttatattcctaacagcaatgccaacacttgtttcccattttgttttgttttacttctaaccatcctggtaggtagggcttagctattattattatcacaagttttgatatgggcttttaccaatacttgtagcactgtaaagatagcatgacaacatgagaggttctgactattttccagcttcaaatggtttagcagttccattcaaaagacaagttttcacgattgcttctaattttcttgaaaaatcacctccaaggctagcatttacctagcttcaggttgactaagaaagaaaatgggctgggcgcggtggcacacacctgtaatcctagcactttgggaggccaaggtgggtggatcaccagaggtcaggagttcaagaccagcctggccaacatgccaaaacctcatctgtactaaaaatacaaaaattgaccaggcgcagtcgctcacacctgtaatcccagcactttggcaggccaaggcaggcggatcacgaggtcgagaaatcaagaccatcctggccaacatggtaaaacactgtctctactaaaaatacaaaaattagctgggcgtggttgcttgcacctgtagtgccagctactcaggagcctgaggcaggagaactgcttgaacccaggaggcggaggctgcagtgagccgagattgcgccactgcactccagcctggcaacagagtgagactccatctcaaaaaaaaaagaaaaaatagaaatacaaaaattagctgggcgtggtggcacacgcctgtaatcccagctactcggaaggctgaggcacgagaactgcttgaacctgggaggcggaggttgcagtgagccaagactgcaccactgcactccagcctgggtgacaagagtgagactctccctctccctctccccctccccctctccccacggtctcccgatccctctcttgccacggtctccctctgacgccgagccgaagctggactgtactgctgccatctctgctcactgcaacctccctgcctgattctcctgcctcagcctgccgagtgcctgcgactgcaggcgcgcgccgccacacctgactggtttttgtatttttttggtggagacggggtttcgctgtgttggccgggctggtctccagctcctaaccgcgagtgatctgccagcctcggcctcccaaggtgccgggattgcagacggagtctcgttcactcagtgctcaatgttgcccaggctggagtgcagtggcgtgatctcggctcgctacaacctccacctcccagccgcctgccttggcctcccaaagtgccgagattgcagcctctgcccggctgccaccccgtctgggaagtgaggagcgtctctgcctggccacccatcgtctgggatgtgaggatcccctctgcccggctgccaggtctgggaagtgaggagcacctcttcccggccgccatcccgtctaggaagtgaggagcgtctctgcccagccgcccatcgtctgagatgtggggagcgcctctgccccgccgccccgtctgggatgtgaggagcgcctctgcccggccgccccgtctaagtgaggagcccctccgcccggcagccgccccgtctaagaagtgaggatcccctctgcccggccaccaccccgtctgggaggtgtacccaacagctcattgagaacgggccatgacgacgatggcggttttgtcgagtagaaaagggggaaatgtggggaaaagatagagaaatcagactgttgctgtgtctgtgtagaaagaagtagacatgggagactccattttgttctgtgctgggaggaattcttctgccttgggatgctgttgatctgtgaccttgcccccagcccgatgctctctgaaacatgtgctgtgtccactcagcgttagatggattaagggcggtgcaagatgtgctttgttgaacagatgcttgagggcagcatgcttgttaagagtcatcaaccactccctaatctcaagtacccagggacacaaacactgcggaaggccgcagggtcctctgcctaggaaaaccagagacctttgttcacttgtttatctgctgaccttccctccactattgtcctatgaccctgccaaatccccctctgcgagaaacacccaagaatggtcaacaaaaaaaaaaaaaaaaagaagaaagaaaatatttggggtggctgaagaaaagaaaaaaatgaatatttttttctttttaaaaactttctcactgggcacgatggctcatgcttgtaatcccggcactttgggaggccaaggtgggcagatcatttgaggtcaggagttcaagaccagcctggccaacatggtgaaaccccatctctactaaaaatacagaaattagctgggcatggtggcatgtgcctgtaatcccagctactcaggaggctgaggcaggagaattgcttgaatctgggaggcggaggttgcagtgagctgagatagtgccactgcactccagcctgggcaacagagcaagactccatctcaaaaaaaaaaaaaaaaatttatctgataacttaattccataataacgttgttttacccataaacaaaatggcacacactggcattcagtttccggaaatgtctaatggtttctctagagcatttagaaattaatctagaaaggttatttttgaaaacaaaagtatgtggaaaatcttgtatattttaatcttgctggctacaccacttctaagtccctaacctagccagaaataccattttttcttcatttttggggttttcaaggcatggaagagctagagcctccttagtgaggcaaatggtcattcccaaataaaactgtttaattgtcctcatatattacatttaagtcttcaggcctttctctcagtaactcttttccttcatgattccaagaaaaaaatcaggaaaatatagaaagtataaaagagcagtaaaaataacttcctggctgggtgcagaggctcacacctgtaatcctagcactctgggaggccaaaagaggaggattgcttgagcccaggagcacgagaccagcctgggcaacacagtgagacacccatctatattttgttgctgttgttgttaattactttaaagccaggcgcggtggctcacacctgtaatcccagcactttgggaggccaaggcaggtggatcacaaggtcaggagttcaagaccagcctgaccaacatggtgaaacgccgtctctactaaaaatacaaaaagtagccaggcatggtggctcgtgcctgtaatcccagctactcaggaggctgagacaggagaatcgcttgaactcaggagtctgaggttgcagtgagctgagatcacaccactgcactccagcctgggtgacagagtgagagtaaaaaaaaaaaattactttaaaaagccaggcatggcggcccatgcctgtaatctcagcactttggaggccgaggcaagtggatcacttgaggtcaggagttcaagaccagcctgaccaacatggtgaaaccttatctatattaaaaatacaaaattagcccggcacggtggcgcatgcctgtaatcccagctacttgggaggctgaggcaggagaatcgcttaaacccaggcgatggaggttgcagtaagctgagatcacaccactgtgctccagcctgggcaacaagaacaaaactccatctcaaaaaaaaaaaattacttaaaaaagaattccgttttttggaaaattttcttcctcaactttcttacatttgacccaagttgaaaaaaaatctagcttaaaaacagaaaaggaaaaaaaaaaatgggcaaaacgaaagtatcatggaaaaacaatttcaaaagctgttgtcccagatattgataggcaagtatatgaaatatactttcccattatactcactgtggtacttgagagattaaactgtatatatataagactgtggctccagctggagtgcagtggcatgaccatggttcattgcaaccttaaactcctgggctcaagtgatcttcccacatcagccaacaacagatatgtgccaccatgcccggctaatttattttttattttattttttattacttttatttgagaaagagtttcgcttttgttgtccaggctggagtgcaatgacacgatctcggctcaccacaatctctgcctcctggattcaagagattctcctgcctcagcctcccaagtagctgggattacaggcatgtgccaccatgccaggctaattttgtatgtttagtgagatggggtttctccatgttggtcaggctggtctcgaactcccaacctcaggtaatccacccacctcagcagcccaaagtgctggcattacaggtgtgagccaccgcacccagctaatttattattattattattacttgtgtagacatggggtcttgctgtgttgcccaggttggtctcaaactcctggcctcagatgatcctctcgccttggcttcccacagtactgggattacaggcatgacccactgcgcctggccaagatggattttcataaaggcaaagagcagaccttctattctgagagctacagccagaggcttatatgaactccccaacttcattaacctcattaaatcatataatttctgtcatacgtaaatgtacattaaacagtgacatcttggaacaataaataactgggaacaatgtagccacacctctacagggaaacttgtgagtggctgaaaccaggaatgttgaacccacaaatgtccagggagagctatctctggggtgtgtgtgtcatacacgaacatacatggttaaaggcagaggaagtgcactggagacagcagttaaccagaagagtgagtctcagcgcttctactgaaagcctctgaatatcatccctatatcttaaagacaatcatcctaggccgggcgcggtggctcacgcctgtaatcccaacgctttgggaggccgaggcgggtggatcacgaggtcaggagatcgagaccatcctggctaacacggtgaaaccccatctctactaaaaaatacaaaaaattagccgggtgtggtggcgggcgcccgtagtcccagctactcgggaggctgaggcaggagaatggcgtgaactgcactccagcctggatgacagagcgagactcgtttcaaaaaaaaaaaaaaaaaaaaaaaaagacaatcatcctaagcaaaacaatacctgcttcgtaggctatgtgaagaataaacaatttcaaaaaagtttcactcattctttagcaaacatattttagtttgttttctgtttttctttccatcttttattttaggttcagggggtacatgtgcaggtttattacataggtaaattgtgtgtcacagggtttggtgtacagattattttgttacccaggtaataagcatagtacacaatagacagctttttgatcctcgccctcctcccactctccacactcaagtaggcccaggtgtctattgttcccttctttgtgttcatgtgtacttaatgtttagattccacttataagtgataatgtatggcattttttttctcttttctttttgagatggagtctcactctgctgcccagtctagagtgcagtggtgtaatctcggctcactgcaacctctgcctcccgggttcaagcaattctcctgcctcagcctcccaagtagctgggattacaggcacctgccaccatgcccagctaactttggtatttttagtagagaaagggttttgcatcttagccaggttagtctcaaactcttgacctcaagggatccatctgcctcagcctcccaaagtgctgggattacaggcgtgagcccacacccctggctggtatttggttttctgttcttgcattagtttgcttagcataatggtctccaactctatccttgctgagaaagatatgatcttttttatggctcggtagtattccatggttggtgtatatgtaccacattttctttatgcagtcaactgctgatgggcactaaggttgattctatgtgtcagcaaacatattttgaaccctccaaaatatactaagaattcagaagttcgagtccctgtcctcattgcacgtaacaagtcctcctccttgacaggtactctatagtttaataactgccttcaaagaactagaaagcaattcctcaaggatagagagctccaaccttgctatacaaggacctggcacataccaacagataattcaaatatagtttgaatgaacaaactatatttctgcttatgatctaaaaaaaatcctcagttgacattaacacgataaagaattgataaaaaataacactgtgtggtgattatcaggggaacagagacacttcagggcaacactcagaaacatttggaggtatacatgtactgaaacatcacaatatgtataattattatgtacattatgtctttttttttttttaatagagataaggtctcactttgtcacccaggctggagtgcagcagcaaaatcatagctttgtaaactttgtaacctcaaattcctgggctcaatcgatcctcctgcctcagcctcccaaagtgttggaattacaggcttaagctaccatgcctggccaaaaacaataattttaaaaaagagaaacacttgaaggggaaaaataaaaatgacaccacattggccaggtgcggtggctcacgcctgtaatcccagcacttctggaggctgaggcgggtagatcaggaggtcagaagattgagaccatcctggctaacacagtgaaaccccgtctctactaaaaatacaaaaaaaattagccaggcgtggtagcgggcgcctgtagtcccagctactcgggaggctgaggcaggagaatggcgtgaacccgggaggcggagcttgcagtgagccagaatcgcgccactgactccagcctggccgacagagtgagactacgtctcaaaaaaaaaaaaaaaaatatgacaccacattatcatgccatggcaaagctcagtagtgttctctcatgtaaaatccctccatctggagtgcagtggctcatgcctgtattctaacactttgggagggcaaggtaggaggatcccttgaggcaaggaatttgagaacagcctgggcaacacaacaagaccctctctctattaaaaataaatacataaaaataaattttggctgggcacggtggctcacgactgtaatcccggcactttgggagcctgaggcgggcagatcacgaggtcaggagttcgagaccagcctgaccaacatggtgaaaccccgtctctactaaaaatacaaaaattagctggcgtggtggcacgtgcctgtaatcccagctactcaggagactaaggcaggagaactgcttgaacccgggaggcagaggttgcagtgagccgagattctaccactgcactccagcctgggcgacagaaaaagactccgtctcaaaaaatatataataataataataataataataataataataataataattttttaaaagctaaataaaatccctccacctctgaaaacccctgcaaagggtgtggaaatggctcattttacccctatgatggttatgctataaaacaattggttttagactagagcttttcagtatgagaagtcaattgctgaaatcagtatttggtgacacatattttcataaacactaaatgtgttgagcaaagacctatctttaactttaaagtgaaaacttcaaactgttcctaactacaaaatttttcagagataaaccatggtttctcaactctggcactactgacattttgaccagataattctctgctgtagggagctgtcctatgcattagaggatgtttagcagcattcctgacctctatccactagatgccagtaccacctcccacagtcatgacaactaaagaaatttctagatattgacaaatgttctggggggaggatcatactgatagggaaccagagataaacaatggaatgataattttcttcataaaggctgtttaaataagatatggaagataatacaaactatcattctttgcactcatttgcgaatcatttttaggtcatcagatgaccttttaatattttatctgaaaagcagcagcagaagcagaccaccaccaccagtgcacctaaaggtaatgtgtaacctagaaagaagaaatgaaccaatgaaccaatggatgatgcaaaaagtcttaacagtaaaaaatgagctaaggtagcctcagtactctgctatgtatattactcatgcatggtaactgttagaattcttaggctatcttgaaatcttttatttcaatgctacaaagtcagactcttcatttttcttcctattcttatctgaaaaagaaaagtttcctgtatcacagagatcaagaatacttaccactatttattgagcattttgtaaatacaagggattttacttaattaagcagatctccaaaaaacttaaggaaataagacaaaacagattcaggaacgttaaataaaacaccgagagccacaaaggaagctgagggattcctgagatctaccaaagggtcatcaccatcacatcccaaaaggcctaggttttacttataaatcttctagtttataaaaaggccagatttgcaataatattaaaaactgagatctcagcatttaatagcataatcttaaacgtgtaaagaacacatagtacttttcagaaagtgttatttttcattataaaagaaacgtaagtggcgggacacagtggctcatgcctgtaatcctagcactttgggaggccgaggtgggcagatgacctgaggtcaggagtttgagaccagcttggccaaaatggcaaaaccccatctctactaaaaatttaaaaattagctgggcatggtggcaggcacctgtagtcccagctacttgggaggctgagacagaattgcttgaagccaggaggcggaggttgcagtgagctgagatcgcaccactgcactccagcctgggcgacagagtctcactctgtctcaaaaaaaaaaaaagaaagaaacatatgggctgggcacagtggttcatgcctataatcttagcattttgggaggctgaagcggaaggatagcttgagctcaggaatttcagaccagcctgggcaacatagtgaggtcctatctctattaatgagaaaaaaaaattagctggatgtgatgacacgggcctgtggtcccagctactcaggaggctgaagtgggagcatcgcttgagcctgggaggtcaaggctgcagtcagccataactgtgccaccacattccagcctcggcaacagaaacatatgatcattgtagatcatctaaatagcccattttttttctttttttttttttttcagatgcaatctcactctgtcgcccaggctggagtgcagtggcgtgatctcggctcactgcaacctccacctctcatgttcaagtgattctcctgcctcaacctctggagtagctgcaattacaggcgtacaccaccatgcctggctaatttctttgtatttttagtagagacggggttttgccatgttggccaggctggtcttgaactcctgacctcaggtgatccgactgccttggcctcccaaagtgctgggattacaggcgtgagtcaccgcgcccagccttaaatagcccattttttaaaagattggttgtaataatgatgtatataatgaatatcatcatattatcataatgacgtgtatctgtaataatgattcacatcaaaacaaatgcaaaggtaaagattagctaggtgttcaagcaatgaacaagtaactaatggatgaacatccccaaacacttcagtcctaaagtcacagatgacttttttagaacctgcccagaaattactgtagaaataaattctggcttcagaataattcaataaacttacctgtgctacctacactgaaaaaagtgacaagtactgtgccggtatgttgtggatggatttggtatttcagaggaaactggtacatactacagaaacggcctttcccaaaggaaaaatgaaatgctgccaggcgcggtggctcacgcctgtaatcccagcactttgggaggccgaggtgggtggatcacaaggtcaggagatcaataccgtcctgactaacacggtgaaaccctgtctctattaaaaatacaaaaaattagccgggcgtggtggcaggcgcctgtagtcccagctactcaggagactgaggcaagagaatggcattaacccgggaggtggagcttgcagtgagccgagattgtgccactgcactccagcctgggcgacacagcgagactccgtctcaaaaaaaaaaaaaaagaaaacaaaaactgaaatgcttatctcagaagcataaattaaagagaaaaatcatctctaatctactgtttcggtcttaccattttatagtttggacctaagagatcagcaatccttaataaataaggtttcccatgagttctggagcttctctgcctcctgttcgcaccctccatgtccatgtttaacaacctaatgccagccaggtgcagtggctcatggctgtaatcccagcactttgggaggccgaggctggaggatcacttgagcctaggagtttaagaccagcctgggcaacagaacgagaccctgtctctacaacaaataaaaaataaaaaatctaactgggcatggtggtgtggtggtgcacgcttttagtcccagcttcttgggaggctgaggtaggaggattccttgggccagggaggtcaaggcttcagcaagccatgatcatgccactgcactccagtctgggtgacagagtgagaccttgtctcaaaaaaaaaaaaaaaaacaaaacaaaaaaaaaacaacctaatgctggatggacacagtggctcatgtctgtaatcctagcactttgggaggccgaggctggaagactgcttgaacacaagagttcgggaccagcctaggcaagaaagcaatacccccatctctttagaaaaaaaaaaaaatgtgccaggcatggtggtacatgcttgtagttccagccactatagaggctgaggaaggaggaccacttgggaccaggagtttcaggctgcagcgagctaggatcaagccactgcacttcagcctgggcaacagaacaagaccctgtctcttactaaaaaaattttaaaaagtgaaccaaacgcttaagaagctaactcggttaggttcctaaggggccttttcaaaatcagatataaaagggctgatgccaggccctccagcactgagaagtgtaggctaaactaccttttctaggaacatcttcccttattctagaagaataggaatagaaaacagtggttattttagtggtcaggaagagcaaccaagatctcgcatggaggtgtgcttagggggaaaatgttaaaataattgattaggaaaaagaaagtacgagaattgtctgatataccaaggcaggatggtagacagaagcagtgaaatggctgatattacactagaggttgtatctgaacaaataatcagggttaggttctatgacttctaatcttggcactgcaatggaccagccacactgccgtaaaatggggcttaatatttagaaaataaagtttaagtactccaaaattactatgtcttttccaagacaataaaggcataaaagtcagaaaatgaaactaaaatatactcacaatgagtcttaacttttacctctttaaaacagtttagctcctggccaggcatggtggctcacgcctgtaatcccagcactttgagaggccgaggcgggctgatcacctgaggtcaggagttcaagagcagcctggccaataagctgaaaccccatctctacaaaaaatacaaaaattagctgggcgtggtggcgggcacctgtaatcccagctacttgggaggctgaggctggaaaatcgcttgaacccaggaggcggaggttgcagtgagcggagatagtgacaagagtgaaactccatctcaaaaaaaaaaaaaaaaaaacagttcagctcctttctaaaggagggtcttttcaattcattcataagtactaggttgggttccttagagaaaacctccaggccacttaatattcacaaaactaaagtccaagacccttgtgctcagaattttttttttgagatggattctcgctttgtcaccaggctggagggcagtggcgcgatctcagctcacagcaacccctgcctcccggttcaagcaattctcctgcctcagcctcccgagtagctgggactacaggtgagcgccaccactcccagctaatttttgtatctttactagagacgggatttcatcatgttggccaggatggtcttgatctcttgaccttgtgatccacccgcctcggcctcccaaagtgctgggattacaggcatgagccacaccacacccaaccagaaatttttaatacagcaaaattctcacatccaaatgaggttttacctaattgttacttacagtatcataaactatcagcaataatgaaaataataagagttcttcacctttccttccttctttgtctctgtagaagacctcaatttaacatcataaatcatttggtccttgacgtatggtaacttccagggagacagatgacatttagcacaggacatgtaagactgtgggaaaagggaagttcttggccgcaagaaatgggacaaaacccttgcctttgggaaaaatgccaaagatctctgaagtccacgctaaagcagttaaatttttagctttaaaagattccattacaaaaatccaaaccagactgggcacagtggctcatgcctgtaatcccaacactttgggaggccgaggcaggaggattgcttgagcttaggagttcgtgaccagcctgggcaacatggtaaaacccccctctacaaaaaatataacaaattagtcatgtgtggtagcatgcctgtagtcccaggaacccgggaggcgaggtggaaggatcacttgatcctgggaggctgggaggtcgaggctgcaatgagttatgatcatgccactgcattccagcctgggtgacagagtaagatcctgtctccaaaaaaaaaagcaaaaaccacaccatacaattagaataggcttttaaaaactacactataaaaatgcaagataataattttctggaattcataagaacctgtactaggtgatggtccccagggtggatatgaatattttttccccttgtaattggcttaagctaacatggttctaaaatttttcgctattcaaaaacgatgaggacgggcacggtagctcatgcctgtaatcccagcactctgggagaccaaggcaggttgatcacctgaggtcaggagtttgagaccagcctggccaacatggcgaaaccccgtctctactaaaaatacaaaaattagccaggtatggtggcgggcacctgtaatcccagctactagggaggctgaggcaggagaattgcttgaacccgggaggcggcggttgcagtgagccgagatcatgccactgcactctagtctaggtgacagaacaagactgtctcaaaaagaaaaaaacaaaaaacaatgatgaatatcataataatggctaacttttctgactacttattatataagcattgggctaagtgctctacatgcatctccttattaatcctcacaacattgtaaggtctaaataacataaactttaagaattttcaaaaaaagaaaaaacataaaattaaaataaaaaaagaaacaaaaataataataattttcaggctgggcgtggtggctcacgcctgtactcccagcattttgggaggccaaggtgggtagactgcttgagccctggagttcaagaccagcctgggcaacatagtgacaccttatctctattatttaaaaaatgaaataaaataaattggtggtggctcacgcttgtaatcccagcactttgggaggcagaggcaggtggatcacgaggtcaggatatagagaccatcatggccaacatggtgaaaccccatctctactaaaatataaaaattggccaggcatggtggtgcatgccagcagtcccagctgcttgggaggctgaggtaggagaatcgcttgaacacaggaggtggaggttgtgccattgtgctccagcctggtgacagagcaagactccgtctcaaaaaactaaataaaaaataaaaataaaactattaacagaaacataagtactttcgaaaactactctattatcctatcaatcatcactgggatatccatgcaaaaccaaaataccctgaacagctataattatacagaattttaatctagtgagagttctagttaagagtcttggcagggtgagatggctcacacctgtaatcccagcactttgggctgctgaggcacgtggattacctaaggtcaagagttcaagaccagcatgggcaacatggtgaaatcccatctctactaaaaatacaaaaataagccaggcgtggtggcaggtgcctgtaatcccagctactcgggaggccaaggcatgagaatcgcttgaacccaggaggcaaaggttgcagtgagctgagatcgtgccactgcccacagcctgggcaacaaagcaagactccgtctcaaaacacaataacataatgacaatgaagattaatacttatatgtagaaattgtccttcacactgccaaactgccagcccattaagaaaggcttttacggccaggcatggtggctcatgcctgtaatccgagcacttggggaggccaaggcaggctgatcacttgagatcaggagttggagaccagactagccaacatggtgaaaccccatctctactaaaaagaaaatacaaaaattagtcgggtgtgatggtgcatgcctgtagtcccagctactcgagaggctgagacaggagaatcgcttgaacccagaaggcggaggttgcagtgggctgagactgcgctccagcctgggcgacagagcgagactctgtctcaaaaaaaaagaaaaaaagaaagaaagaaaaagaaaggctttcacaagccttcttgtgcaaaagaacaagaagatataaagaaaataaaattttattgtagttgtgaccacaccttgaaatggagagttgacaactctgttttaaggaacaaatttttttcctatagtaatttcatcataatttcttgcacagagtatacagtatgtttcctctggcaatacacagctgagtaaaggttttctgtatcttttcatctgtacttttcaaactatattttaagaagcattaacaaaaccaaacacatatatcaataccaaaacccacaaaattagctattttatacccacttaggcacctaagtaaattggctaatggcttcatgggaagtaatgtagtgtaaaagaggaaacactggcagtgaaggcagaaaacctagacctgggtggaaatcatggctacatcacttgttaactatgtgaccttgggcaatttccttctctcagtctgagttttcttatttgcaaagtgagggtagtaattccaatcttgggagggacgattaattgcatgtgaaatgcccaccacagagcctgactgaaagcaggagtttagaaaagatactgttacgattgttattcatataagctccttaaaagcaaaaacatcatatttgtcctcgtagcccaattgtaggctttataattattgaggagctgaaaaacaagaaacaccaaagttacaaatgaggatttgtatccgttcaacacatgcctagacagaaaatgagactaagtaatcatgactttcaaaaactatatcaatgcatacacagcatataaatcaaagtatatattgccatttgatggggaaaaaaatcaaaatatgtaatgtgcttatttttaagccactctgaaagaagatgatgctgcctgtatacaaatcaagagtacaactactcttcattcattctgcaagtatttccgtaagtgccagtcattatgtcagtcattatgctaggcaatgtgcatatgatggggagcaaaagcgaaaataatcccaaccctcatagagcttgcttgcagtcatgtaatcacacaaataagtgttaacttgtgataagtgatgtgaatgacaggtaaatggtgctctgagaacctattaggttagaatctaatctaactgaaatcaaggaaggccttccaaggaggtgaaacctgagagctgaaggatgaagaggaggttaacaaaggggggtgtttccagatggaggaaagcagctcctgcaaagaccctgtaagcaggaggaaacaaggaaagaaggcaggactataaggccagtgtgcatggagcagagacaagtgtgagaactagctagggcctaggctgctcaagggcctagatatatagcctacattcaaaagttgcaatttgatctcaagagcaatgacaaggcctgtaatcctaaggctttgggaggctgaggcaggaggacggcttgaacccaggaggttgaggctgtaatgagccgtgattacaccactggactccagcctgggtgacaaagtgagatcctgtctccacaaaaaaaaaaaaaaaaggcaaccagaagccactaaagagttttatgaatgcttctttgcggggcaggcaggctgaggggaagatgaaatcagattttcaacaggactctggcttctggattctggaatatggatggaccaggtgggaaacaaaagtcctgtcaggataggatagtagcttcgaatagggtgatggcagtgatggtggaaggaagccaatgaattcaagagatattcaggaaaatctaacactgtattgtacacaagggcagagggacagcagtgtccaagacttctgggtttctgattcatatgactgtacagaaggagataccactcaggaggtattctgcttcagaaatatttttaaggagccaggcgcggtggctcacgcctgtaatcccagcactttgggaggctgaggtgggtgaattgcctgaggtcaggagttcgagaccagcctagctaatgtagtgaaaccccatctctactaaaaatacaaaaacttagctgggtgtggtggcgggcgcctgtaatcccagctactagggtggctgaagcaagagaattgctcgaacccgggaggcagaggttgcaatgagccaagatcacgccattgcattccagcctgggcaacaagagcaaaactctgtctcaaaaaaaaaaaaaaaaaaagaaagaaagaaaagaaatatctttttttttttttttttttgagacagaggagacggagtctcgctctgtcggcgggatctcggctcactgcaagctccgcctcccgggttcacgccattctcctgcctcagcctcccgagtagctgggactacaggcgcccgccacgacgcccggctaattttttgtatttttagtagaggcggggtttcactgtgttagccaggatggtctcgatctcctgacctcatgatccgcccgcctctgcctcccaaagtgctgggattacaggcgtgagccaccgcgcccggccgaaaagaaatatctttaaggctgttcacacaggccaaaaagggcctaactgcactacacttttgcatgaaaatgtgtaaaccgaatttgatcccctactttaaataaggctctaaaagattttttgctatttacagaaatcaaactgactctcaaaagtacaaggattttcctacactgaagaaatttcaaagattctgccacaagcttctaaatcaactccaaataaatgttaaattggtttgagcaatagggcagcattacggagtgaatgtgtcagttcccatgaggaccactttgataaggctaacacttatgtactgctgtttaattttaatattttaaataaatcttaagagtacccttggctgggcgcggtggttcacgcctgtaatcccagcactttgggaggccaaggcgggtggatcatgaggtcaggagatcgagaccatcctggctaacatggggaaaccccgtctctactaaaaatatgaaaaattagccaggcgtggtggcgggcgcctgtagtcccagctactcgggaggctgagacagaagaatggcatgaacccaggaggtggagcttgcagtgagccgagattgcgccactgcactccagcctgggcaacagagcaagactccatctcaaaaaaaaaaaaaaaaaaaaaaagagtactcttggctgggcacagcggcccaggcctgtaatcccagcattttgggaggccaaggcgggtggatcacgaggtcaagaaatcgagaccatcctccaacatggtgaaaccccgtctctagtaaaaatacaaaacttagctgggcatggtggcacgcacgcctgaagtcacagctacttgggaggctgaggcaggagaatcgcttgaatcagggaggcagagtttgcagtgagccgagatcacaacgctacacttcagcctggcaacagagcaagactcagttaaaaaacaaaagggtacttctggctgtgtgcagtggctcacacctgtgatcccaacactttgggaggccaaggcgggtggatcacctgaggccaggagtatgatgagactagcctggccaacacggtgaaaccccatctctactaaaaatacaaaaattagctgggcatggtgggtacctgtaatcccagatactcaggaggctgaggcaggagaatcgcttgaacccggcagatggaggttgcagtgagccgagatcacgccattgtactccagtctgggcaacaaaacccaaactccggccaggcgcagtaactcacgactgtaatcccagcacttttggaggacgaggcgggcagatcatgaggtcaggagttcaagaccagcctggccaacatggtgaaaccccgcgtctactaaaaatacaaaaattagctgggcatggtggcaggcgcctgtaatcccagctgctcgggaggctgaggcaggagaatcgtttgaaccctggaggcagaggttgcagtgagccaagatcaggccactgcactccagcctagatgacagggcgaggctctgtctcaaaaaaacaaacaaacaaacaaaaaatcaaaactccatctcaaaaaaaaagagagtactcttatgtgatattaaactaaaatatggtaacattaggcattaccataattagaactatactgcttttgtttcaatattttgaaatgcttgtaaaaaaataatattttgtagaaaaaagagataagattttaaaaacacacacacacacaatctcttgactttaataaacattttgccgtttccatcctagtccttgttaatgcccatcacattcaattcagggtaaaagataaggtttttactagttaaacacatctgtatatatgtgtatgcactatgtacaaagtaaagccaataccatgtcaatactatcaatactttaatatttacttttcctggttttagttttcaaatttgcaacggatgctatttgcatagaatactgatggctttaagtcttaaaaacagaaatctgactgacccaaggaaaaggatgaaagaaagagattttgtccctttaaaatcagccaacacatcctatcttagtactgaagtacttcccaattctggcagaatgggctccttggccacctgcttgcactagggtctgactagcattttattaacatccaactgcagttaccaggacattcattaccactgcttgtacaaagcagaattctttttaaatttttttcccatacagatttcatcaccaggtgtcaaaagacaaaaccgtggcctgaggccaaatagaaaaatgtcatctccacaaataaggagaaaagacaaggactttaaaaaatcaggtcaacaagcccattagccaataatagtttgtaaaactggactgtcttcacactagaggctgtgctagcaaatgtggtccttggaaacaagagctgtagagcttgaaatgggttgccagcatggtttgcctttttcttttttcatgtttatttttattttttttatttataacatggaatcagactatgactataatcgagcatagctatggcggggtatgggcagtgccaaggaagagacagcgaaaagcccgtagggttcccagtctaagctagcagaccttcccatcttcctcaggagtggtccctgtctccgcagctggaatgtgcgggagggaaagttacaagggcccccaaaatgagacagcaaaccacttccttctgaaaactaaaggtcataggcttttaaggaacaatagagctcaatgtaagcttcagaaagatggagacagtcagatgagacgagggtagggaagcgcgggtgaggagatgcgccccgtctgggatagctgaataggggggtcaaggccagggactttaggaacacgagaagggctggatcttccataacctgcccaagtgggcctgagaaacctaagaggctcctctgaaaatctagggcatctatgcatccaatactctcagccctctcctcgggaagggagataatccccacaggaagcaccccccaaactggggcttttcctgcccttcaaaagccacaaaccctcacggaaaacatttacaagggagtggaagggccgggggcaagcagcggttctgcaaatctcgggaagaaggcccctggatccaaggaactttgcccctggaatagggggtggggtgcggagggcaccgtctgaggctggtaagcctcggcgaaagaagcggcgggaacgggagtagggtcccgtgggtcccccgacgagggggtggcggcctggggcgcggtcgccggtgagggaggcccgcgagccgggcacgggagcggggggctgcggccccgtggctgcaaagagccggcactcgggaggcagaggccggcgtaggcctcgggggcccggacacacccaacgcggcggcctcgggcccgcttacctgctcctcctccggggtcagctccggcgccatgtcgggccggggcgcggtcgcgggctccatccccccgccaccgccgccgggcggacaaaactcgctcgcgagcgcgggagcccggcgcgctcggcctccgcttccgcgtccccgcgcctcagcagcccggggccggctcgcgcatagtgtggccggcagggcccggcgcctgcagcggccgcaaacgccgcttctgcttccttaagaaaaatctctccgaactgccgctctcttccgggaggaaatccttttttatattattcgctccgttcctcacactcccccttatctcctggggaagaaaaagtgcaggcgaagagctaacagccactcgggatttaaaaggaaataggaaatcaggaacttttagagccgggagcgaagggtcggcggaaatttcccgaaggccgccgaccccctcggcgccccgcttcctcggccgcgctcccgctcctccacagcgccacagagctcggggccgcccagccgggccgtcctcgcggacgctggccctgcgacctgcgcggctgcctcagcc

SEQ ID NO: 1070 - DNA, 102 bp, Homo sapiens
gagcaggcccctttacacccctgattcccccacccaagcccagcatctcctcatcctccagctggggctgcagggtttggggccagggggctgggcctgatc

SEQ ID NO: 1071 - DNA, 3710 bp, Homo sapiens
tccaagctctgccgtgacgtcatctccagctccagcctgctggggcctgtgctgactgtgccccagacagccttagctgctcaagctggagaactgtcttccttcccagcttcctccgtgtctggggtgggggatgggggggtctcaggcagggatactctagccccttgactgctgtttagaccctgctgtagctgctgctgctccctgcccagccccagccatgaaactgcccaaggggaccaggagctctgtgtactttgcacagcacccagaaaaggagccattgccctcaaggcaggaggtcaagcagacccctgtcatcatggccaagatcaaaggtgagagccatccccaccctgggcttgggccccctcccctctctccaggactccttccagcctgcctcctgcaaagccccttccaacttccttgaagccttacagaagacctgagcctccaagctgaccctcacaggcagtgttggctgctgggattgtccaagtgggtgggggaggaggggagcatgggacttgcagtgaggcccgctttggaaaaagactaggagcctttgtcctagctttagctttcctcacttcccttcaattttactctcaagggacagcagacgctaattcttactatgttggtaatgactgactagtgctctaagtgggagtagtttagtgcagggattgaaggtttgggttctactggatgatggtcttagaatcttcacactactagtttgtgatatgtgggtagatatttctaagcctcaatattctgtaaaatgggaaaaacaagagcatttaccttacagcattgttcagaggcttaacggaaataatccacgtcggatgcctagtggagaacctggagcagaataagttctcaattaactgtaactattagcttcttattatgcattgtctgtccaagggaaactgcattttatctggaaatactgccttcccccaaacgaagcagctggatggatgctgggctcgtggcagtgcgatagcagcaagaacaaatacccccaatgttcccatggtgcgctgtactggggcttcccctgcctctgacctggtgggcccaggctgagggctgtcctgtccatccttacaggtccggggcccgccaagtacctccggccatcctgcacgggctacatagatcatgacatctccatgttcaaggcaccagcttataccctgcatagccggcactcagagaagcgtgagcgttgccaccccagtcatccggctggggttggagctgttgttggaggttgaggggagagacatggagccattctctgtagccactgggaatctgagacactcaaggggccccctgggtccagaggaagccagcggggattgagggtggggcaactccatgggcatcccctagccgcctctcccaagggagcctataggggatcctggccctgtccagctggcacagcagagtctcctttttctggcctttggctggggcccttcagctccggtcgccatgctctgctagggtcacttgccattgtggccaggcaggaacagctaggaggccagtggggaagtggtggcccccagagctcctcaggtggcctagaacccactggaagggcagaagcagaggccacagatgacctatgctgctgggcagggtgtggtggcgtgcacccgggggtctgagatctggggtgcctgtcaggcctttccctggggagaatacccacctcagcaaggtaagcccctggcctggctgggcctttgctgaatgcccacagcagccacagggctattactccccgttggccccaacccctgattgggtgggtggctgcccaagctgctgggcagctgttattttactgttcctctgagcaagttcttgaaaataccaggtcatgtgttaaaagtcccattttacagatgaggaaatcaagggtccccaaacacccaggagccacagaatctgaagtgggagggagatcttgcctggaggcaggccaggtgctcagtggggcagcctttggggctgaccaggccctctccttggttgccctgcagggatggtgtgccacagcagccctgggccttgctatctcttggatcccaaaataactcggtttggaatgtccagctgcccgcaggtccccatggaggagcgcatctccaacctgcgtaagatggggttatggacagatgttgggggttgggaggttggggggtggggtgcacccttaggacctgggcaggggcaaagggtcaagacttcctccttggaaatgtctggatgccggtatctccctgcaagacaccgacattgcaatgctgacatcaccatgtcttgaagtcaatgttatgacatgcagcatgtcaccaggtgacgttatgatgacatggagctcctgttgtggatgcaatattgtcatgcgaacgagctcacagactgtagtgatctcagaatgtttctgtgtcgctgtcagagggacaatgtctggatgctgacactgtagcaactgggggtaatccaaggggaatgttatgatgacattatggttttttacatgatgaccactgtgttgccatcctgatgtcaggatggcctaagtgaccatcttatttatttattatttatttatttagatcgagtctcgctctgttgcccaggctggagtgcagtggcgtgatctcggctcactgcaacctccacctcctgggttggagtgattctcctgcctcagccttctgaatagctgggattacaggtgcacgccaccacgcccagctaatttttgtatttttagtagagatggggtttcaccatgttggtcaggctggtctcgaactcctgatcttgtgatctgcctgccttagcctcccaaagtgctgggattgcaggtgtgagccaccgcgtccggcctaagtgaccatttggatgtccctgccctgctgctgaggtggtcagcctgaggtcacagtggataaccaggaccatcagttggctagcagagaatgaggtctgttccctgctctgagagccctcccttcccgccactccctttcaggcctgaaccccaccctcgcatcctgccagtactactttgagaagatccacccaccgggggaacgcagggctccccagtacacgtttggctaccggcgcccatacagagtgatggacctcaacccggctcccaaccagtaccagatgccactcttgctggggcccaacacccctgtcagccgagctgctccctgctacagtctggcctccagggacaagaactggttctacaaggaggatgtggcaggaggccctggacctaccacgtacgcccgacctgagccatccatctatcagaaccgcagccctacttacagcatggccaagcgcttcgcctaccctctggacctcacgccacggcctggccccggctcccacgaggtccagcaggtcactgtgcacaagccccacatccctgctttcaccatgggcatcaagcactcactccacctgtgcccactggtcatcgacattcgtgactgaggcccctcttggggcactcactgcccctcatccccagaaattatttttctacaccaaattgagcaatttgaccaagatttctagtagcagagccggtacctgctgagtgtccggcacacagaagacattagagatacattttcatg

SEQ ID NO: 1072 - DNA, 12409 bp, Homo sapiens
tagagatacattttcatgtatttgttttttccttttctgttcacagttgcttcctgtgggtcctgctctgggtgaggggctggggacactggaaggaatgatacagtccctgtccttgaagagttccattctggttcaccaggtggggaagccatgtgtctgtcctccaaggagccccaggcagagactcgggagagctgcattccagtcctaactgccattacaggctgtgtggccttgtgcagctcctgcccctctctgggctcaggattgccctttagacagtgcacagggtaggcttggaagaggtctaggttctcccaagttccagaactgtgggactgtgctgacagtgtgcagtccccgagacaggggcagggcaggtcggggtgcaggcagaggagcggagtccctctggttgggagttgggagaggagtttcctcggggagggacctaagaggacaagaggagactgctggggagggcgaaggtggaggtcaaggtgagagcaaagcatgcaggtgcagtgacagggaactggggaggcacagagcagcaggggcctggggtgcagggggcgaggctgctacccggggccacattgtgggcagccgggaggggcctcgggctttgccctgaaggtgtgagggccggaagatgctttgggagaagctcggacaggatgggcagagtgggaggcagctcccagctgggcagactgcagggaaggtcagcttgtcacatgctgtttttggggtcactcactatgtccccaacctcaacagcttagcctggcagtgcctgtcagaggagcagccgtgaattagccaggagggggcagcgctgtctcaatcttcaagcccaggcctgtgcctacccaccctggctggcacccgctctggctttgctgctgctgggcggacaggcgccagctcctgttggtcttgaggaggtgagggtctctggggctggcatttgtccttcctctgttcttggcatccagagccccaattcacctctactcctggacacaggaacctggcagtcccaggccagtgtgaggcatggaggggatgcggctgaggtcagcaaagaggctgggtgggagggtgggagccatggagggagtgggagggaggaggggggtgagaaagcccccagacctaatggctcaggcagaggcagactgttccgcagagcagagggtgacaggaagagagcaccgcctcagaaccagtgtctaatggttcatccttataaacctgaacaatatccaggttttaatttaaagtgaaaattgaggctgggtgcagtggcccaagcctgaaatcccagcattttgggagagcaaggcaagcagatcatttgaggtcaagagttcaagaccagcctggacaacatggcgagaccccgtgtctacaaaataaaatacaaagattagccaggcatggtagctggcgcctatagacccagctactcaggtggctgaggtggggggatcgcttgagcccaggaggtcaaggctgcagtgagctgtgattgtgccactgcactccagcttgggcgatacagcaagaccctgtctaaaaaaaagaaagaaaagaaaagaaaattgaattgaagccctaactttggtcagaaaggaacagagcatataatattctttggaatatttttaaaagcacacatacaactaaatatttagaaaagagcctgtggtaaaccccactagggatgtccttgattctgggccctgaggtctcctctccatcccacccgcccccaggccctgggctttgcatctgcccatcctctcaacaaggatggcctgggctggctcttgggaggctgtgggagctcggggacccgtctgtcttgtggcagattagaaagatgtcattttgccaacagtgccatttatcatggcagctgcaaaaattagtgatgcttggtgtgtaagtgttgggtgggggtgggagctggcaggtgacagcagccaatgctccccagtgttaccaggtcagggaactgcaggccaacctctgaataggggctttctgatttaacacttagcccaggtgaaggccctctgttggaaagatgaggaagctggcgctcggagcctggaaataacttcggccacgtgataatttttttttgtgacaggatcttgctccgttgcccaggctggagtgcagtggcacaatcttggttcactgcagtagctgggactacaggcacatgccaccaaacctggttaatttttaaatctttttgtagagacgtggtcttgttatgttgcctaggctggtctcgaactcatggcctcaagtgatcctcctgcttgggcctcccaaagtgggattacaggtttgagccaccatgcctagcccacatgacaaattaatggtccatctctaaataaaggtctaggttctgtgtgtgaccaggaccagggctcatctagggtgaagtgctttacttctattaggagtaagtattatttttgcctttatggctcagtctaggacagaccttcagcctggccccagctgccaccagacagaggcaggattgggagctggccctggagctaggactcactcttggggtaggtttatggtcccaagagaaggggagaaggaggatggagggttcagaaggaatattgggggggggtgaagatgttcagatgagaggtggccccgcaatcaaagggatgccgactccagggaagatgaatggggcctcccttgtgcctcggcctgcaaaatgacagggtcatttagcttgggattgacctttggatgaagcagtcccatcacttgacattgcctttcctgtggtagtgcccccagagaggtgacttgcagaaggtcaggcacggcctcccaggtctggccgactgctgcgtggccccttctgaacaactcagggggttctcgcttgaccttgcaggaagccctggtttgatccttgtaggacttgaatctgtatcttcaggtcactagactccggagcctggcacttgatcacacacaaagcccccatccgtgcattcattcattcaacaaacatttgctaagctcctgccctgtgccaggctctggctgggtccgggggtacgaagacttggtcttcacctggagccctggcctccaggaggtctgaggctgtgtccgtgagagggtgggaattcaccctctcccaccacgagcagatgttggagggtggatgaggctcggtgcctggcaggagacccacctgaggttcctctcttctctctagggggcaagacaggcctggctccatgttgggttacctcagccagggcttggtggtgacatcacagtcccacgagcctcttggacactggctggggtgggggctggtctgttgttccactgttgctggagggaaccccaaggccaatcaccactcaggttcccaggacctggggggatggtggccctgggccaggagcagaagaggggccctgcctgcagggacacatggacacaccatctggaggcacacaggtaggggctgtgcacacacacgtcccttaccgcacacacgtggggcaagacacacacacaaatgcacagacccacaccttactctacacacacacacctggtaccaccactgccttcaaacaccctgccccatccctctctcccaggcatctcatctcatgcacagatacgtgcccacccaggctcactggcgcccctcactgccctggagtagtaaatccacaaaccatgagatgtcccgacatgcagagagaggtgggatgggtgatgggagggaggtcaggagagtccctgcattcccccaggagaggggaccgctggctgctctcagcccgccagcctgggacctggcctctgggcgctgtgcacgtggtcgtgagagggcacccccatgaagacaagccaggtccccactcctgctcccagcactcacagacacccactctcggggctgctcaggtacgggaggactaaacaggagctcctgccacccggctcctttcggggtgtggtggggggctggtgggaggacacatccccctgagtccgtggccctgctcactggtggagagttgcccgccctcccgttccttctgctccctcttcctctccacgcccacatcctcccagctggcctttctctcccccagatcctctcccatgaccaggtttcctctctctctctctctctctctctcgctccctgtgtccctgtgacctacttatgctctagaataatgatcgacattttcaattacccccaaagtaacagccgttcttggggcctggcggaggacggctgcatgggcgtgggcacgggcgctggtttgagtgtggggcctgcgggtggtgggggtggggacgcccatggtcccactgtcctttgtttgctttttctcatccggagccttcaatttttcctggaagattggaagcacgtttcccttcaggggaggaagggagataaaacagagaaataaaaactgtcatcattctcttgtaaacagcgtagagccaagtgggggctcggcaggagagagcgacatgagggagaggccaggacagagaaagggggccgagagggatggggtggggaggtgagcaggagccccccctcaaggccgggtgggtgggtgtcctgcaggaaagactgatgggaggggaatgaggcgaggtgaggctgatccagggctggggccaggttggggggttgcggtttgaggagacacagtgtctgctgagtgccaggcaggccctgggaggcaggcgctattctccgaatcccaccctgcgccaggctctgggggtgctgaggtgagtgacagacatgtctttgcactcttggggcataaactctattggaaacaaagcggtggcttcatgtgttcagcacttatatcaattgaggctcagagagggtgggtgacctgcccgatgacacacagctggaggtgaggagaccaggatcccagccaggtccgtgtgaccgcagtctcctttcacaccacctccgctgtgggcacacttggctcttgcgtgaccttgagcaagtcctcacctcttggccatcagtttccccatctgaaaagcagccagcatgctggctctctgcagggctgaggggagcatcagatgtctggatgtgaaggacgctcagctctggctctctggcgagttggcggggggacggaggagcaaagaccaccggatgctgggagagggactggccggcagggaaaggaggccggaccgcagatttactccctgctgctgcccagtggcaataattgggtactgcagagggtgggtctggaggaccttcttcagcttgcaacaaggccagagcagaaaggtgcctctagggagtgttgtctagtcctcccggccccattttgctgatgcccagagaaaggagggactcctcctcaggtcatccagggcagaagcttgggctaggctttcagggtagggtgcttccctccatccctgtggcaatcaagaagcccccagtcagcttcagagcaagagaaacagagttctacatcctctgcttgatgccaccacctccagggagacttccagggtctcctccagtaggaagtggcctcactcctgccctgcagtcccacactcaaactctccttgctcctcctgccccacccaaccatgactgtcctcctgcccgcagcaaatcaggcagcggggccccttgagacacgagagatggtggagaaccattgttaccactcagggagcatgtgccaggggcccactctgtcctgcggctctacctgcatcctctcacttgaacctcgtaagaaccttggtaagttggggttattttgatccccatttttcaggtgagggaacgggcacagagagtttatgacctttacacacagagtggtggggcatggactcaaacccaggtctgtctgttctctggagaggcacctgcatttggaggtgaaaactacccctgtggccatatgacagtccactgtgaccggacactgaaatgaccagtccagggggcttgtgggctggggtctcagcttcaccactgtgctgctgggtgactttgggcaaggcccattcctctctggaccctggtttctcatctgtgtactgtgtatgtgcatgcatgcatgtgtgtgtatatatgcgtgcgtgcgtgcgtgtgtgtgttctgggctacctcagagatccattctggctttgagtgtggtatatcccatcttgggctggtcccaaggcttgggccctgggatggaaaggttttaaaggtcatggggagggggtgcagatggcagtgtgggaggcagagctctggctaagagctgggccccttgggtgcacctcctgcttgcgtgtcactgtgtagggctggggatcaaggggaggcatggactgtgagggcacgagggatccggctctgggacaggtatggggttggccctagggcctggatgtgtctccctccactgcctgccacagagggagtttgtcttacaggaaacagcctcatccatcagcggcaatggggggctgacagtggccactccccaccagccctggctggaggcagactcataaatcccatgccaggctgggctgtaaattcctgtgattcacatctggcctcttggaggacagagacatttggggctgtggggctggctgttctctcttggacaggacaggtgggtacccgggagaagcctcttcactggcccagcagtctcagatggcccccctgaggagatgcgatgctgagcccctggatgcctcaggcccagcccgagccatctctgcccacgcccaggccacctctgcctgggccattcctgtgctctggcccgaatcaccctggaggtcacgtgtgtggacacactctgtggcctcagagatctcatggggcctgtggccctgtgggtggaggattactcaggtgctggggcaagagactgaaggcacaaactgtttcaatataataaagaaaataattagaataagaatagtcataatacaaattagatatagagatgatcatagacaattaccaatcattactataaacattattaatcattagcttttaattactaatataacctaggaataacctgcgggtatagggtcaggtgctgaagggacattgtgagaagtgatgtagaaggcaagaggtgagccctgtcatgcccgcataaggtccgcttgagggctccttggtcaagtggtaacgccagtgtctgggaaggcacccgttacttagcagaccgcgaaagggagtctccctttccttggaggagtcagggaacactctgctccaccagcttcttgtgggaggctggatagtatccaggcctgcccgcagtcatccggaggcctaaacccctccctgtggtgctgtgcttcaatggtcacgctccttgtccactttcatgttcctcctgtactcctggttcctctttgaagtttgtagtagacagtggtagaaggaatagtgaaagtcttaaagtctttgatctttcttataagtgcatagaagaaaacgctgacgtatgctgccttctctctccctgcttcggctacctaagagggaagggccccctgttctgtgatcacgtgacttgcttcaccttgtcaatcacttagaagattcaccctccttaccctgcccccttgtcttgcatgcaataaatatcagcgggcgcagctgtttggggccactaccggtctccgcgtcttgatggtagtggtcccctgggcccagctgttttccctttatctctttgtcttgtgtctttatttattacaatctctcgtctccgcacacggggagaacacccactaagtcccgtagggctggaccctacatggcctggagggttggctccaagaaccccacagtgaggtctcctgccaatccgcatggcattctgtcttggggctgtgaggacacggtgggagatcacggcccagtctgtgcatctctcattccagggaggccggggccccgaatccactgtcccttagacaggaaggggatagggacactcagaccagggctgcagccatttgtcgcctttcatcaggacttttgccacactcagatgccactggaactctacttagcgttttttaaaaatcagcttacttttaaaatttaagtgtgtgttttagcctcgtctttagccatatttgtgaaatcagggtctgatgtactagtcaaataccatgcacatacacgctcagacacatacatatacacatatatgtgaaaatatacacatgaaatatatccatgaaagtaaacaaagttaaaatagcaaatgctcagctccatgtaccatctaaccctgctttaggtttagagtggctctagtctccccccattatgggtgattcctcactggtgaaacaaagcaggttcagatggctcacagagctgagcatttaccagccattctagccttcctccattttacagacaaggaaaccaaggtccagagaggtgtagggcctgcctgaggtcacacagcgctgggattagtggccagcctgcctgactcccagctgagtgatccttttacggaagcacactccctgtctgtggtgtgcagggccccttcctccagaagcatatgtggactcacagagccctttaggagactgtgccctaacatgcctccttccccgccacctcgcagtgcccagcaccctcactggccggcacgtgcagcacagatctgggtgtgcagccactcagcacactgatccacacacgtgggcagagtcacaacacagaagctcgcctgcacacagaggcatttgcaccagctccctgcacacttgtgcctggtgtgttcagaggaccacctgtgctgctcatggagacagggcttgctcgctaatgtccagctgtcatttctctacctcaggtcagagagtctgacccacctaagagccttccatggctccctacggcctgcagcattgagccccaaaagtcaaactcttcggactttgaaggttttccaccctatgcctcaccctccccacagagctcttcctcattccgtctctgttccctgctttggccagtggctgtcctggatgcggcccacactacacctctgcccacactgcagctctgtacccagataccctccagttcctcgccacataattctatctcagtcatgccccggactgcgttgaagccaggctgccttgaagctctcctagactgctcttttccccaaggaagggtcatgatttgccaaatgtttcgcatgtgttagcaagactggagtcggagcaggcatcaaaccttacatcccatatgtcacacctcaccacagacctggatgccaaataccctgaagagtctgaactcacattggcagttagcaaagtgctcctacagccacatctgcagttaacacagcatccctatggccactgtctctcttgatccccacggccactctgggagaaaggcagagagtcatcatttgatagaaaggatgctgaggctctgggagggaaagggacttgcctaaagccccagggtgaagcagcgtctctggactcccagtccagtgctcttgcccagtgctatgctgcttgcctctacccatctccgtgggtcatcagcgcatcatagggcaagccccaatccctgcctcattttggtttatgggcgctggacccacagccctaccctacagtcatttggagacaaaaacagatgctattgttcttccttagagaacgtggccagtggatccggcacactgggaatcagagtgaatgtccttgaaagaggccatgggtcaacaaggccaagccagaggatgcagaacgcttttccttagaaatctttgggagtgaagcaggcttcagactctcccatccctgcccctgcagccacccctaccacattggtttggacccagtaggttggggcgggggcgggggcgggggcggggtgggggtggaggaaaaatcagattgcccatgccccccaggctccttccccagctgcttctgtcctagcccaggcctggtgccattcttccactcacactcgtgtgcaaacccacacacacatcacacaccttgatgctcacagtcacagcctggcctctgctcctgtgggccagtggccagacaccccctgggatggctcaaaggagtcaggacttggaagtggggacatcagggtagctgaaggaaatccacacacccagaacatctcggggttcagactctctgacctgaggtaggctccccaggggctgggagaggggtttgacggaatggaggatggaggacagcgggaagaagaaacgaggaggaatgcaacgtgtggggcggccgccaagagtgaaaatagagggaagcgccatgcaagtgctggaaagaagggggcaggtgggacgagccccacagccccctccacaaaaagaccacttccgggactcagtgctcctttgggggcaggctccgccagctctccgccactcagggctccggtcccacggtcggagtgcccgggacggagacggccagttctggcggccaggtccgacgctctagaatccagccccatttccctcccggccacgcccgtccggcggcctctcctgtcatattcagcccctactcacctggggaccccgggaggggcgcgagggcacctgcagggggagggcctaaggggtcaggggaagcccccggtgtggagggtacgacgggcgcttcccccagggtggacgcagcaggcagaggcccaggagcagggctccgcaacccgggccgggctgggggcacggcggggagtcggcactgcgtcgtggggctggacttgggcgacctgcgggcgaaagggagccaggaacagaaagaggagcgatgagcggccccgcccaccctaaggccccgccccagcccagtgccagccactcccatgcatgcaagccccttcctgaaggcccgaggcggtcaccggagcttaagccccgccgccagcggcgccaacctcccagatccaccccgccccgcagcccgcgctccacggcaagccccgccctctctaagctccgcctctcgcttcaagtaggcgccaccccgggatgggggcgcgccctgcctggtccggcacttcttccgcggcccaggctggggggctttggggccgtgggggccgaccctggtacctgcgtccgaccgggacgctctgcacctgcagccaggagtcatccacaggaccccgtgggtgtgctgacgatggtcgtcttgatgtcaccgatgatgctgggcgcctccctcagcacgtggtgcatgcgccgcatctcgttgcgcccctgtgcctgctctgccgactcccccatcagcgtgttctgttccccacgcgagtacaagttggccagcagctccgagaagatgaactccttggtctgagagcgggcaaagagggaaggagactgggacctgattgatgcttgtgctgccctggccgccatagctgccccgccgggccctgttgggactgtgcgctggacttggagccgcgagtatggcttttcagacgcggcttctacaccgcttagactcgaagatccgcctccccaccgcccttttctcactcagatgaggacactgaggtccagaggaaaagtcacctgtccaaggtcacagttctgggaggggactgaggacctatcatgccaccaggacacctgtctactcagtttttaatttttggagataggatctcgctttgtcgccaggctggagtacagtgggcgagatcactgctcactgaagcctcaacctcctgggctcaaagtgatcctccaacgtcagcctgtggagcagctaggactacatgtacttgccaccaccaagcccagctattttttaaaatttttgtgttgagatgaggtctcattatgttgcccaggctggtcttgaactcctgggctcaagccgtcctcctaccttggcctcccaaagtgctgggattacaagcatgaaccactataatcccacattatatttctattggacaactctggtctggactgtgcctcccttcctgaggctggtcccataaggctggtctgcatctcccctaggccaacatggccacctgggtcccctctacccccatgaggcgacgcatgcacgttgttgatcatgaggtggatgatggtcttgggcatgaggtcctgcatgttcttgttgacaatggccatgtacgagtccaccaggttctgaatggtctccacttgccactccagctgtggtccatggagagcatgaagctgtcggagccattcccctcagtcttgctggc

SEQ ID NO: 1073 - DNA, 27123 bp, Homo sapiens
cgaacgcaagtcccgcttcgctctcgggggcggactcagcggcggaagtggcgctgccggaagatcttcttccgctctgaggcgctactgaggccgcggagccggactgcggttggggcgggaagagccggggccgtggctgacatggagcaggtgggtcccggagcggtcgctgggagcgggtggcgtgcgagggccgtcttccgccggtcgaacccgcttcgccgcccgctgtccgtgctgggttccgtccgacccttcccacacccgctgcgtctcaggttccgcccccttcctctgtctggcctcgcgccgccccgcgcgggttggggtctccagcaatgactcttggcgaccccgcctatcctggggagcccggggaggacgttcgggatctccttccaaagcctccgtcttaactgaggggagaggagagggtgaggtgtctgggtgttatgagcaggggcaggtatggggaggggtcggaatctggggtgagaggaaaacatctacgcattccggtagctctgcgtctcagtgtcatcccgtgtctccccaacttcctttcgaaacggccgtgaataacttcctaattggtattaaaagggccctttgaagtcttgagttcttagaggtgcatagtaccattgacactcatttctaatgacacgttccctcaccccgcatttttgggttagtcaatgtctcctggttttcttcgtaccgctctgacagtcggtcaaagtcccgcttcacgttttcctctgtcgcccaacccctcgctctgtacactgaatctcagtggtcttattttcccccacggcttcagctttacaccaactaaatacccagatccacatcttcagcgcagcccttccctggagctccacgcttgcccatccagcggccattgggacagctctgcttcacatggagctcactgggtccaaacttgaactggtcttttccttgcagattaattcttcctctaccccaacccagccggaagtctggtaatttccttacactttctcctctctttcaagtcccacatcttaaaagtgacctagtactgccaacttcctgaacatccttcaaacctgggccagctccatctcttctgttaccacgctgttgatgtattgtcaattcccaacagtccagccctggcagcttgcaacccagtctccaaactgtaactcttgtgatccttttagaacacaagtcttacggtgccagttccttgctgataacctttttctggctttctattgcctatgtgctgaacccctagcacaatttacacagctctctgtgatctgacctagcagtctcctgtgtgcaccctaaggtccaataatacggcactgcagcatgcgccatgcctacccttgctgttcgtatcttcatgactttgcacacaccagcccccgctgcttggaaacctcctccttctcttgtctgctgggctaccttctacatgtttttcagcgcaggcagcgctgcctccgcctaacccccaaggttaattgcccttctgtgtcctgtagcaccctgtccataatagcatagtagctgagaatacagactcctggatcagactgcctgggttctgacctgtttggtaaccttgatgaagtcagtgcctcaatttcctcacttgtaaaatggaggtaggaatgtctctacttcatagagttgtgaggattgaatggaatattgtatgtttaggtcttaaaccagtgctaggcacaagaatgctcaataaattaaagtgagttgcctgggtgcagtggctcatgcattaatcctagtactttgggaggcaaggcaggatgatcgcttgaggccaggggtttgcaactagcttgggcaacatagtgagaccccatcgctacaaaaatttaaaaaactagctgagcatggtggtacgtgtgggaggatcctttgagcccaggaatttgaagttacaacgagatatggttgtgccactgcactctagtgtgagggacagagtgagatcctgtttctaaaataaataaataaaaagttattactattatgtaaggacaacatagttcaccagttatgatttttaatttcataagttgcctgaggatggttgaagtggcttactagtcattggatagagcctggctctttgccaataaataaaatgctggagtggaggacactgggggcagggtctggatttattgagtgaagattcaagagtgaaaaaggctcagacctggtctgctcaggaaaaccagtctggaagtgtgtgtgtgttacatggcaagcattaaatctagagaaatgtatagatctgggaactagagggagaaaaagaccaggggcggcttctgaggagctgacagttaatggggcctataaagcgatgggaggattttatcagagggaggcagaggctggagtgggctcagagatcagaaagctgggtcctctgaacagagctccagtagatggtggctgggtgggggaacaggggagacggagctgaggaagacagaggcagcgtcctttgctgacgctggcaattcctttcctgtattggccatgaggaagcatcccttgacttgggagccagcagggaccatgcctgggggcaactatgctccggaggcctagtacctggtgtttgggaccaggccccctgggtagggccattgtgcatgcctttgggctgggccttctttggagctcttttgcctccctgtaatgcccaccctccttgcctccagctgatagatgctgactcttcaaggccagggtcagatggcccctcctccctgtggcttttctgacttcactcattccagcctgggtcagatgatcccttctctgggagcccacggtcctttgttcattcctccctgaaagcgctgatcacagcatggtattatttatctgccagtcttcctcaccagacccagagtccctgatggaccagaacagggtcctgtggccccaggacttgcactgtgtccagcatactgtaggcccttggaacccgcatgttgcattaagttgagctctcacacagctagacttgttaagggagagcggtgcgggggagataaaaaatccggcacatctggcagcttgtgcctgttccactgaatgcgagagcctgttggctccactttacagatgaggaagctgaggttcaggggaggtaaggtcaagatcactcagcagggatttaaagagctgtctcctgactccaggtctgcatgtctcccagaaactgccttggggtcccagcctccaagggggcaggtgccacatcagtgggacaaaagaaaagtgtccctttttctggctgaggagaggctaatcctggctttgtccaggcagggttggtgcctggaggatcctgtgctgaaaccggctcccttccatccccccaacccccccaccccttgtcccttgccctatgggggccttttcttgagagggctgagatctctcctggaagatgactagccgtttccagactaaccttgggaacttgacctcactggtttacatagcagcacgaagagggcaggtggggcctgattcactggccctgagtgggtcaggggtcatggaatcacagaactgggggcatccctgatgattcacagggcctggcacaagggggaagggagggcaagtagatctcagtgtgttagggtcttcctgtacactgcacccgcagagcctccccggctggggggagaagtgtgtggtggtgagtcttgtttctatttggcttaactcttccccttccgcttcctcagaaggaaaggagaaacagagccaggctttggctttgggtcttatttgtcactgtagctgtgtcctcctctccctacactcccacttctccaggggatttcccaaaccctctgtggagggctatagtagggccagtcagccaaccatcccgaggctgatggcatgggccagtaaccctgaatgtgccatcctagccaggcgcagtggtgcacacctgtaggctcaactacttgggaacctactcccaagtttttgactccaggattgatgtccaaccccaaacccacaccctttctcctgttccagggtggacattacggatccacagactagctaacttactagacatgtaccgtggccaggcactgtggctgtgacttggacctcaagggcttaggacagatggccttgaaacatctagctgtgataagggaaatgctgacccagagttacttgggaggctgaggcaggattgcttgagcccaggagtttgagaccacagtgtcctatgatcgcgcctgtgaacagccactgcactccagtctggcaacatagtgagacctgtctcttaaaaaaaaaaaaagtgtcattctgggtcagccccctgaagccagggtctacccttccattctgcagtactgctgggactctcagtttgggcaaagtgctatgctggacctgcctggccagggtcctgcctctaacactgtccccatgggtaatagtagtaatagctgctattaattaagcacagacactgtgcatgtgttgtttctaatcccttcaagctctgtgaagtaggtactatattctccccattttacagaaaaggagactgaagttcagagaaacccagtgatttggtcaagggcacacaatctaataaggaatggccttaggtttttgcctccaggactggtgtccaaccccaaacccacacccttttccctgttccagggtggacattatggatccacaggctaacttactagacatgtatcatggccaggcactgtgactgtgacttggacctcaagggcttgggacagatggcctcgagacatctagctgtgataagggaagtgctgacccagagttctgaaaggtcaggggagtctggagggtgaggagaagctctgccccggaggtgacatttgaactagtctctgaagcgccagagttctccccaaaggaaggaggtcattcaagaatgaggaaacagggcgcccaggcgatgggctgtggtgtgtcctgggagcagccaatgatcagcagagtagaggcagcgagtgttgacccccatagcaaaaaatgagtgctggggtctggagtcctccctcctccttaaccctcctctgttatcaaagactcaaggttaactcaccttacgtcttctccctacaagtcaggctcagggaggggagcagataccctgcttgaggacccccaggaaaccagttcctctttccttcttgtggagggagtgcctgggctctgggcagggaagacccccacagagggtggagtccagctccaggagaggcagcctgggcagggaggggctgctctcccggctgggcgtgagtgtccatgtgcacttgtgcatgtgctgctgtagggaagggtgtaaatggccgttcagtgcatttcctggaaacccactctgagcctggtacagttctggcactgggcatgcagcagggagcaaagcacaggaagtccttactttcatggagttcgcatgccagtgggagacgatgggcagtaaacacagaccagtgaatgtatcatatgtcaggggtgacaagtgctgtgaagaaaaatacagcagggtaagggatggagggtgggggctaaatagaggttcaggaatggtctctacaaagggacatttgcatagggacctcattggaatgagagagcaagtcatgcaaagacctggggaggagctcccgacagagcagcaggtgcaagggccctggggtaggagcatgcttgatgtgtccgtggacagcgagggaccagtgtggctggagtagagggctcaaggggaagaggaaaggggaagaggaggacttgtaggctagggtggggacttacgcctttattctggggaagccattggaggttggggcactggggagatgtgatctggcttttaacaggatccctgtggctgctgtgttgagaacaggctgaaggggtgaagacaagaaagagtggcaggtagaggtgatagcctggacagggtgacatagtggtaggtgagcagtgggcagatactggccagattttgcaggaagagacaacaggatttgctcatggtttggatgtggaagggaggtgtgaccagatgaatgctaagcccaaagagggcctcttgacacactgtcccccagctagcaaggactcttgcaggcagcagcatttgtacttagaaggtcccagcctgtcatgggggaaggtcatgttcctctggggtcggctccgctctgcctcttcctggctaggggactgtgggcagctctccttcccatgagtcatcactacagcttctgggaaggggtgtgatgcattaaggagatggtgtctgcatggtgccaccgcaggccatggccagctggatctgtgtcttctgcaccagcccatctggatgcagtgcaacctgtctggtctgctatcctgcgttcccctaactggcaccctcctgggccagccagcagcaggacatagaccaaggccaacctcctccacacccagggcctctgccttctaccctctgtggagtctccattaacttggcattgacagggctgcttgactcaaaacaaccccagccctgccctgaagccatctcgccagtcagtcagagctcaagactctctctttctctggagaagagcaggaaagtaatcccagctaaccctcatgcagccaccactctgtgtcagaatctcttctaggccattgcattgaataagtcatttaatccatataaacctgcaaggagtaggtgatattgttaaccccattttataggcgaggaaactgaggcatggtgaggttaagtgaccagcaaggtggaaatctgaggtttgacccatctcctggtgtggagtccagttctctcagcttcactgatccttcctgatttgtgctgagttagggaccccttgggaagcccccatgggcagggggtgctggtgctagcatttcctgtggattatgggagggggatgtgtggaggacctgtgtctactgttcctctagcctctgggggatttggagaacccactctgcccagagatgtaagtcatctttggatatagatgagacttgttccccctccccctgaatcccagggcacagctctatggaataagctctagctggaacttgtaaagtttggcccagccctccctgggaggctaggaggtggggaagagccaggagactcgaagtggtggtggtagttaatgtctatgtggttagacgttaaccagttactctgtggtgccaggcactgtcctaggcacgctatagttatcattgtctcctttggtgcccccagacagcccagggtcaagacaggtagcctcagtttacagatgcagcagtggaggcttgcacaatgagtaggtggctttgttcaaatcacagacctaggccaggtataaaagcctaagtgtggtgtaattccagcactttgggaggccaaggcggggagattgcttgagtccaggagtttgacaccagcctgggcaacatagtgagaccctgtctctacaaaaaaaaaaaaaaaagaagaagaaaagaaaagaaaaattagcctggcatggtggcatctgcctgtagtcccagctactcaggaggctgaggcaggaagatcacttgagccagggaatgtttgaggctgcaatgagctgtaatcacaccactgcactccagcatgggcgacagagtctcaaaaaaaaaaaaaaaaatcgcagacttgccttggctaggaaacgcctactgagagctgccgtcggtcagctgggctttggagccgcctccctgaagaaaggtgtctggagcttctggcctggggtatgacgaagggctagcaaggaaccctgtctgtggctctgcagcctgagatttgtggaaattgaaaattggaggtgggtgagtgggaggcggcttagccatcctgctgtcctcctcttctgtctgcgggaaggggcagccgatgctgttccctgggtgggagcttgcaattgcagaggggccggtctcaagaggaaggagtagagatcagcccctgcactcccctaagagcctctgccaggagccaggacagtcctctacttcctgcccctcccccaacctggaattcacctctgcctgcagctggataacctggcctttctatagatgaaggaaccaggctagagggttagggagcttgctctgagccacacagcaggtgaattgtagagttcagatttgaacccacgccttttggggtgatttttattacatgtcactatagtgtatttaacctccctcgctcacaatttccctcttacttgaaaggtttttgttttgttttgtttttttgagacagagtctcactgtgtcacccgggcgggggtgcaatggtgtgatctcggctcactgcaacctccgcttcccgggttcaaatgattctcctgcctcatactcccaagtagctgcgattacaggcacacgccaccatgcctggctaatttttttgtatgtttagtagagacgaggtttcagcatgttggccaggctggcctcaaactcctgacctcaagggatcctcccacctcagcctcccaaagggctgagccactgctcctagccccatcttacccgaaaagtcttgccagctacttaatctatctcaaccaccactgaccaagcggttaccatactccctcctgacacctacctcaacacccatccctgtgacatagggattcttgccttttttttttttttttttttttttttttgagatggagtctcactctgtcacccagactggaatgcagtggcgggatcttggctcactgcaaccttcgcccctcaggttcaatcaatcctcccacctcagcctcccaagtagttgggactacaggtgcacaccaccacacccggctattttttgtaattttagtagagacagggttttgccatgttggccaggctggtctcaaactcctgacctcaggtgatcacctgcctcagcctcccaaagtgctgagattataggtgtgagccaccgtgtctggcttcttgccttttcttgtcatggtaaaatatacataacataaaacttaccattttaaccttttgtttgttgttttttgttttgagacagggtttctctctgtcacccaggcttgagtgcagtggcacagtctcagcccactgcaacctccacctccccggctcaagtgatccttcctcctcaggctcctgagtagctgggactgcaggtgtgtgttaccacgcctggcaaatttttgtattttttgtagagacggggctttgttgtgttgcccagactgttcttgaactcctgagctcaagcagtccttcctccttggcctcccaaagtgctgggattacaggcctgagctaccacacccagcctattgttgcctgttttaatgcagctgaggaaactgagtctcagaagggttatgctttgccccagagcacacagctaggaaggggacagtctgagatttgaaccatgaccttagagtccattcctttttccatgataccagccacctcctgtttgtcctgagtccaggacaccacccaaaaccctattacaagtggggctggtactattgtatcctagggtgaggaagagaaggcctggaaagcggtgtgggggcgtgtgcccaccccttccctttgcctcatgaataatccgctgttccctggcacctgacttcccccctccccacccgcttccccctctaacccaggatggtaaaacctccacttttgcccggcgtggtggctcacgcctataatcccagcactttgggaggccgaggtgggcggatcacaaggtcaagagatcgagaccatcctggccaacatggtgaaaccccatctctactaaaaatacataaataggcaggcgtggtggcgggcacctgtagtcccctctacttgggaggctgaggcaggagaatcgcttgcacctgggaggcggaggttgcagtgagccgagatcgtgccactgcactccagcctggtgacagagcgagactctgtctcaaaaaagttaaaaaaaaaaaaaccctccactttcccccctacctcccactctcactccctccccaagcagttcagcttctgcagacactcgactgtcaagtctgcagccatcccaggcagactctttcacaccacacgtgctgttcccctcctgacacttctgaaggtgcttgggagaggccagtcacagcaaccagtgggctcttttggcagtgggtggggtgctgctcccagggggctgggctgtctctgaattgtccattcctgcctccccctcatcaggagggtgggtgtggtgggtggaggcctgcgctagctgtgatgcctccagggctaggcagcctacagtcagccagagaatgagcactttggggactgcacagggcagttccacgccacggtgggttttcatcacttagactggcaggtggtctgatggagctcaaaggcctttcaaagtcatctgagtgagccccattttcaaaccctagccaacgaggcctcactcagggtgatgctggagtttgaggaaaggctgacaggtgggattcagtagctgcttttacccatagcagtctggtttttatctgttttatatattgaggttccaagtaaggtattactcttttaaatgtttctcttgctttgcaaaggaggtggtttgtagctgggtgtggtggctcatgcctgtaatcccagtactttgggaggctgaagtgggaggatcgcttaagcccaggagttcaagaccagcctgggcaacatagaccttgtctctacaaaaaatttaaaaattagctgagcatggccggccgcggtggctcacacctgtaatcccagcactttgggaggctgaggcgggcggatcacgagatcaggagattgagaccatcctagctaatacggtgaaaccccatctccactaaaaatacaaaaaattagccaggcgtggtggtgggcgcctgtagtcccagctactcgggaggctgaggcaggagagaatcgcttgaacccaggaggcggagcttgcagtgagcctagatcgcgccactgcactccagcctgggcgacagagtgagactccgtctcaaaaaattaataaaaaataaaaaaataaaaattagctgagcataatggcatgtgcctgtggtcccagttactcgggaggctgaggcaggaggatcacttgagcccaggaggtcaaagctacagtgagccatgttcacgcctctggactccagcctggatgacagagtgagatcctctctttaaaaaaaggcagagggagatgattgaaaaaaaccactgactttcccccagataaacagaggcttggtgagaaggacttgcccagagttaggcggaattactggttgcccggagactggggtacaggttccttaactctgggccagtgctctgcctactgtacaggctgtcatttggactttgagctgctttcggtgggagggtgatatcaaaccccctttctttgactcttggccaactgtccccgcccctgccttcgagcccccatgcttggctcccacactccctggcatatttcaactctcccgggctcccgcaacacctctgctctagccccatctgcgtctctcgcttcgacagggacgtctgggcatgtgagtgtcagtgtggttgccactccaagtgcgtctcacacccaagctgctgccatccaagtcctgtccccaaggagagagaaagtcagagggaaagacagacagacacagaagtagactggagtaggcgagcgacagcacctggaagtgaggcaaggaccaaggagggagggagggaggagagaggcagatagagaagagagagagaaatgtggagaaagtgggagagactgatgggagtggagagaaagactcataaatgggagatagattgagaggaagacccagatggggaaaaataaagacagacatggatgacgatatgttctgtgggctgtggggaaacaggcattcttgtacattgctagtgggagtgcaaactgcaaagggaacttggcaatacctcacaaaaccacatatgcaatttgacccagcaataccacttctaggaatctgtcttgaagatgtatttccaacaacgggaatatatatatgcgctcaaggttattcactgcagcatttctggaattacaaatctaagtgctcattcatgggagactgaataaactatggtttgtctataaaatggagtaccaagcatctctatcaaagaacgagaaagacaatgtaaaactgacatggagtgctcaccaggatatactatttagtgaaaaaataacaagcaagagcccatctgtagtaagctactgtccatgtaagaaagaaaggatataagaaatataaggctgagcgtggtagctcacgcctgtaatcccagcactttgggaggccaaggcaggcagatcacctgaggttgggaattcaagaccagcctggccaatatggtgaaacctcatctctactaaaaatacaaagttagctggacatggtggcacgtgcctgtaatccaggctacttgggaggctgaggcaggagaatcgcttgaacctgggaggtggaggttgcagtgagctgggatcgcgccactgcactccagcctgggccacagagtgagactccgtctcaaaaaaaaaaaaaaaaaaaagatatacaaagaaagcatattcctttatacaaaagaaatataaaaaggataaagcagacactaaagctgtaagttactgctcacacgtgtaatcccagcactttgggagaccaagaagggaggattgcttgagcccaggacttcaagaacaccccatctcttaaaaaaaaagataggttactgttaggggttgaatcgtgtcccccgcaaaaaggatacgttgaagtcctaaccacctttacctcagaatgtgatcttatttggaactggggtcattgcagatgtgatcagtcaaggtgaggtcatcttggaggagggtgggcccattatgactggtgtccgtatcaggagatggcagtgtgaagacggacacatgggaagagcaccatgtgacagcgaagaccggtcggcgtttgtggctacaagctgagtcacgccagattgctcgcacaccgtcaggagccaggaagaggcaaggaaggggtcagagggagcacggccctcccaatacctttctcagacttccagcctcctgaactgtgagatgataaatgtccatgatttcaaacaaacaaacccaaaatggcagacatgggagagggagagggagacagctaaaaagataattacaaaggaaataggccaggtgcagtgactcacgcctgtaatcccaacactgggggaagccaaaacaggaggatccttgagccagggagtttgagaccagcttgggtaacatagtgagaccctcgtctctaaaaaaaataaaataaaatgaattagcctggtgtggtggcgggcgcctgtggtctcagctacttgggaggctgaggcaggaggatcgcttgagcttagaagttgaaggctgcagtgagccatgatcgtgccactgcactccagcctggttgacagagcaagaccctgcctctaaaaaaacaaacaaaaccccacacagatggaaagttactttgtgaaacagatacaaaagatgaggagagatggagagagtgaggaagggagacaggtctggctgcaaacaaaagggctgtcagaggcagggaaatgtcacctgccctggagctgcggcctgtcaccatgagggatgcactgagcatgcagtctggcacagatctggctgatagatgttggggatcccattgccagcggcctgtcacatcccctccccatcgcctgtttccagagctgagcccagcttttccgtagcactgtggagatgaacctgtcatggggctcagagtgtggtgttgggagtagccttggcctggtgcctctgcctcacctgccctccgactctgctgcaaacagtcagttcctgtttgtgggggcttgcacaggggcagagggatggacgagctggcttgctcagaacctcctgccagccacaaactgagctgcgcttgttttggacgtggtagactgaggggcccaggaaggtagtccacatagtgaaagtgtggcaggacacctcaggaggggagagtggttagatcttgcctcccaagatcagggacaaacatctagagcttcccttcctctagaccccaaactactccctggtgctgggatgtggggagactcagggagcctcttggtcaagtcccagaagctcaggcccccaccaagctggtgagtttttgcctccccgcttcagctcctctgactttcttttttttttgagacggagtctcgctctgtcacccaggctggagtgcagtggtgtgatctcggctcactgcaagcttcacctcctgggttcacgccattcttctgcctcagcctctcgaatagctgggactacaggcaccggtcaccacgcctggctaattttttattttgtatttttagtagagacgggtttcactgtgttagccagaatggtctcgatctcctgaccttgtgatccacccacctcccgcctcccagagtgctgggattacaggtgtgagccaccgcgcccggcttcctctctgactttcagtgggacctttccttctcacccaagggacggggcctcttagagcccagcacatgggtggggcagagactgtaggcctgggggctacatggcagggagggagtgccagagttccttttgtctttagggttcctgagagcccgatgctggcacaggatggtaagggattgggtaaatccattcacctctctgggccttggttgtcgtatctgtaaaagaagaggaaccgtccctgccctgagtggacgtgaacgtgggtgtggatctgtgggcatggggtggggggcggtagagcactgggctggcctccagagtggctgcttcctactctctttagggtttgccctgttcctgtctgttatgtagcatggagctgagggccaggagacctactgagcattcatttattcaacaatcaattacaaagcacctattgcatgccaggcattgtgctgggcaccagggagacagcagtgaccatgtcagataaagcccgtgaggccatggagtttacagtctagtgagagaagggtaaacagtgaaataaaacaataaagatcgtttcagatagtgacccacttcactgaagaaaggaaggcagcttactatcatgttatgctgtgatttggagcaggagggtgggaggctttctgaggagaggacttttgagctgcctgttgaagggtctgtgggagaacattccaggcatggggagagccagatcgaaggtcccaaggcaggacagggcagctgtattgagggatgtaaaaaaggccagagtggcggtggcagcaagacagagagaagggctgggcagaggccacctgcaggcctggactgagagggcctggtgaggagactgttagcctgagaagggtgggaaaccgtgggagggcattgcaacgcattctctaggccggctatgtgaagagcaggagggtgagagaggcagcctggaggcccacccgtgagaagcagattgccatggtccaggcagagatggtggtggttggacctaggcagggcaaggggtggtggagctgagagggaccaagatgcctgctctccatagctccaagcacacagacactgctctaggaaggccctcccagttgccatggattagggggtgggaggggaagactggctgctgggagggaatgtggctttgtgcttggaaaacaaagaacagagcttggggccctcttctcctgggggtggtggcaggcccagaggctgttgacaggaccagaggctggagctcagggctaggcctggtaggagcaggctacagccccagggatccaggagggggtaggtgcccatgcagagggaccccagagccctccaggggtgaaccctgtggctgctgggcttggggcagggagcaccaggaaggaggacagataattagcggaatgctcaaccctgcagcctgggagccaggctggtggaggacatttgggcaacagtgccctgggccctgggcttgggacccagtgtagagacaaatgcgtttgggagccagtggtggccctggtggctgtgtgggagggacaggaggagtttgacaggactctgcctctgcctcgcccccagccctgctgctgaggccgcgccctccccgccctgaggtgggggcccaccaggatgagcaagctgcccagggagctgacccgagacttggagcgcagcctgcctgccgtggcctccctgggctcctcactgtcccacagccagagcctctcctcgcacctccttccgccgcctgagaagcgaagggccatctctgatgtccgccgcaccttctgtctcttcgtcaccttcgacctgctcttcatctccctgctctggatcatcgaactgaatgtgagtgggggcgaggtgggggcacaggccatgttgcaggccacccgggcctcagtttgtccatctgccacatgggagggctgcctctcccctggggttggttagctgggtaaaatgaagactgggaggaacaacaggggttctcatattctgaatgaaggaatgtggaggggttcggaggggttgtgtcatttggccaaggtccctctgcacccaagtgtgtgaaggcaacggccttgaacctaccctccagctgagttcatgctcttggcctctgccccatactgccccctagtggaggctcccgagagaggaggagggggagacccagctctggcagagctgttgaaacctttgtcttctttctgcctgccactgccctctggctccagttggttcattcattcgtttgttcgatcattcattcattcattcattcattcattcagcaaacattttttgagtctctgctgtgtcccaaccactgtgctaaaaccagacgctagccaggtgtggtggtgcacacctgttgtcccagccgtttgggagtctgaggtgggaggattgcttgagtctagaagtctgaggctgcagtgacccatgattgcaccactgcattccagcctgagtgacagagtgagaccctgactcaaataaataagtaaataaaagcagagggcacagtgggaagcaaaacaggaaaaactcccagttcccagtggctctaatgagatgctgccgggcagcctggagaccagagctgccccacccccaccccacgcagtgcttggcccaccctcaggaacacagtctagttggcagtggcctgatctggtctccaggcagggccaagcccacataagcaggagccctggaagcagggcaccccaggctcagttctgtcccagctcctcctcggctttggcccgatgacctcagcaagggactcagccccttgagtcctcccctcgttttccttctgcagcatgggctccccatcagacttccggatggcaagggcccttcctccaggtctcatgcttatgtgacaagaaaacaatgtcttgttaatagaggtgatgagctcagagaaggggccagctccgggcaaagagattaagtttgattctgggcatgttgagctggagggagagacagggctctgagggtgactgtcgattgtgcaccagagatgagctggcaccttcagtgagctggagccatggccatggatggccctaggggccatcttacccatgaaaaagctgtggcccagcaggctcaggaccttctgcagagcttctaaggtcttaggcagacttccttttcaaggtcccatccaacatcaaagcaaacactaaaacttacctgcatccttcattgaatacttgtttccttacccaaaaagagctgaaaagattttgataattttactttcgttttgttttgttttgagacagggtcttgctctattggccaggctagagtgcagtgatgtgatcatagctcactgtagcctccaactcctagattcaagggttcctcccacctcagcctccccagtagctgggaccacaggtgcatgaccacatttggctattttttttttttttggtagagatggagtctcactatgttgcccaggctggtctcaaactcctgggctcaagtgatcctcccatctcggcctctcacagtgctgggattagaggcatgagccactgtgcctggcctctgtaattgtgcttttgaagttatttggctgtgttggctgcgattgctctgcagtcctcatgcgtacctgggaattcttgcaaagtgagaagatctaacttactaattgttttcagatgtcatgaaacatttcagaatcctgcactgaacaattagtagagtccacatgatgtttcccttggcagacatttaattaaaattgtattgattttcagtcttgtagttttacttttgtatttgggagcatatatttttagttcgctgacagactgtgtctgtgttgcccagtggttacaaggactcagtagggtcgtgctgagcagggggtttggagccagagagtggcaaagcaggggctgagacttggctctcccgagtcctgatcggtcagcaccggtgggtgcccaggctggaaagaggaaggaggacagagctctgaggcctagtgactgagggtggaaggggctgcagagcccagggcagagtctgaggagcaagaggagtgctgggtggtgtgggttgggtgggatggggtgggtgggtggcaggcctgggggcctcaccggcagccagaggagaggtggcatcagatttcatggagctggggtgggcttgaggaagaggcacatggtggggctgtgtgctcagtgggggagcatctgtatctttaacaagcccccccagatttggctgccctgctggagagcggaagccccagtctaggcggttgtgaggggtcttcctctccagggctcctgggctccatcgcccagagtccctgtgtcctcccttctccagggtggctggtgccccacctgaaggagcctaggcccgtcacccccgtcattccaaggagtcaggtcgcagtctggcctggtgtccatccagttccctcaaacctctggacattggagtcagggccaaggcctcaggggtcctggtgaaaatgtctggtgggctggggtagggacaggggcaaggacacatccactccgtctccacttcaccctctcaagcagcgtgatggattttgcccattaagcataaacctaatcaattgatttgccacctgaggctccgtctgacaccactgcccacccccaccccccatcagcccagatggattatggctgggaagatggagcaccgcagtgctgggagggagatgggattctgtcagaggtgggctttcggcgcccttctgctggccctgtatagggcgcattgcctcccctgcacagccccgaagcctccaagcctgccccttcctgggcagggtgctggaagctagccctgcccatcggggcggcctggatccttagaggactggtattggtgcctgaggtctctggccgtgggctgagatcccttggtgcttccagggccccctgggtggtggcttagcatcaacagcctcccctccaggttcctccatcccctacctcttgccccttccgggaggtgaggggcagccccaggcccttgcttctacctgcagagctcttcctgtctccctctcacagaccaacacaggcatccgtaagaacttggagcaggagatcatccagtacaactttaaaacttccttcttcgacatctttgtgagtggccttggctgatcctggggaccccggaggcagagagggagcagggaaatgacttctgctgggttctcttttggcagcatatatccagtctgatcagagactcggctcccatccttcgggagccatcagtcattaaaacctttgctccacaaggctgggcgcagtggctcacgcctgtaatcctagcaccttgggaggctgaggtgggtggatcacttgaggttaggagttcgaaaccagcttggccatcatggtgaaaccccgcctctactaaaaatacaaaaaattagctgagcatggtggttcgcacccataatcccagctacttgggaggctgaggcaggagaatcacttgaacctgggaggcggaggttgcagtgagctgagaccgtgccaccgcactccagcctgggcgacagagcgagactctgtctcaaaaaaaaaaaaaaacctttcctccacaaagcccccttcagagagccccaggtgggagagggaagataagacccctgtgcaaggttacatccaaattgtcccagagacatgctgactcagtcgttgtcccctgaggtgtgcatgcccataggaagggaacgtgggggcaggaccagaggggaggtcagcctgcagcagggtggggggcagtagcttcctgtgactgccttgctcccgtcccccaccaggtcctggccttcttccgcttctctggactgctcctaggctatgccgtgctgcggctccggcactggtgggtgattgcggtaagatgccactttcctggcagcttctgggccctggcagggctggtggaagggatgggatggaggaggactcacttcccagcctctgccttccccttcctccctccctcccctgggcaggtcacgacgctggtgtccagtgcattcctcattgtcaaggtcatcctctctgaggtcagtggctcagggtctggccagtctggtgggcatcagacctgagtggtatgcttctagagaggagcatttctctaatttggggtgtctgtccctgttgtccgggttagggggagagggaatcctgtcctttggtatctataaggaatcatccttcacccgcttccctgacttagccccttgcagctctaggaatcagaaggttctttctccagcctaaccccagtttatcctgctgcagacttgagagggttcccaagcagctgctaccaggaatggggtgtatgccagtttggctggctagagttggtagccacagaagggggctctgggtttggggtgacccctgccatggagctcagccccctcccttcacagctgctcagcaaaggggcatttggctacctgctccccatcgtctcttttgtcctcgcctggttggagacctggttccttgacttcaaagtcctaccccaggaagctgaagaggagcgatgtgagtgcttgcgggtaggggggtgcagcgagggttacccacagccccaagagaggggagttgcgggcatgagagtcagtctgaagcatctcgccacctctgagcagcctccagtagcctgagggggagcttgggtgggggtaccccaggctgctagggtgtaactgtcctcggtccgggaccgagtctgctcctccagggtatcttgccgcccaggttgctgttgcccgtggacccctgctgttctccggtgctctgtccgagggacagttctattcacccccagaatcctttgcaggtgagggctggtgtgtgggggaactgctttcagggaggggccttgtgaggaatggggtaggctgggtctgttctttctattccttctatcaggctccctggggaaagccagcaaccctctcccacacacttttatcccccacatccttgcactcacatacccgaaccccactacctccccacactctctccccaccccttgccattgtcatctgtgcctgttttctgcagggtctgacaatgaatcagatgaagaagttgctgggaagaaaagtttctctgctcaggtatttgcctgcctacccctaacccctgcccttggaatgggtgcctggaggagggcgggtgcaggggtcagccggggtgggcaggggtttcccagtagaggctgaacctcgggcaatgcccatccgagtgtctcccccaccaccagtccggcccccctggtctgcctcatgcctgggcacacaggtggagcagccacaagcctgcagggcccagggagaccagcccagatcccacatgtggctgggccaggcccctctgggaagcatgtggtatgtctagagagagaacaggccacgaacatggtggactgcaggccccaggctgacccctccctgcctcctgcttccgtccaggagcgggagtacatccgccaggggaaggaggccacggcagtggtggaccagatcttggcccaggaagagaactggaagtttgagaagaataatgtaagaagccctctcccacctgaccttcccatgcgtgttaggagtttctgttctcttttctgaggcctgaggaagaaacccaaagattacatgggttggagccatattcctgccccaagagagggagctgggccctcgggtcggcaggaggctgggctggattggacgtttcccccgtgccccttggccccccttccccgcaccccccatgtttacttccctgctgttctgcccccttggctccaggctttgaaggggaagccaggcttctgctctgcatccgttgtttcgtttcatgatcaaaacaacattatctacaaagatcgtagagagcttggaaaacagagagcaacatgccccagtccctctctctggccagttcttgtggcagccccattggcctggagacatggttttttgtggttgcagctgcagctgtccccccgtcttttaactcgacatcaaaagcctctctcctgccagtgccataggtttgttagagctactgttttgtaacagctgctcaggtgtccccaaactcctggagttttccaccctgagctgttaaaaacctgccctgcctgtcacccatttctgtgccaccagcccaccccctgcctccactctcctccctgccaccttctgtccctgccataggaatatggggacaccgtgtacaccattgaagttccctttcacggcaagacgtttatcctgaaggtgagtgaggggagcgggtgtcctggagccccagacagcacaggaggctccaggaaggtgccgaggggccctctggtgggtgccccccaccaagagggaagggttggtctgcccgagcccatctggcaccacccagccctctgccgccctgtcccagaccttcctgccctgtcctgcggagctcgtgtaccaggaggtgatcctgcagcccgagaggatggtgctgtggaacaagacagtgactgcctgccaggtgagcccagtctggctgcctcttaaggcacagatgggggcacagccacgcctcagtgggatcactgaagcactcagcgcctcagctgccccatctgtacagtgggtgtgatggtaacagtgcctgctcgggagggtcgggaggagggcaggaggagtgctcatcaggcgctgcccagggcctgcctgtggcaatagcagttagtaaaggggcctggggtgttcccatccctggggttttcctggggcgacctgttccaaaagtctccgttgacggccctcagatcctgcagcgagtggaagacaacaccctcatctcctatgacgtgtctgcaggggctgcgggcggcgtggtctccccaaggtgagtccatgccgggccccctcctttcagccaggtcttctgcactttggccttgggtcattgtcccctgaactaaccctccctcccgcagggacttcgtgaatgtccggcgcattgagcggcgcagggaccgatacttgtcatcagggatcgccacctcacacagtgccaagcccccgacgcacaaatatgtccggtgagcctcactttgcctggggtcacccctgccagcccctcccctgggagcattgagcagtgcagggtacagcatgtacagctgggcacttcccctgctgaggctgcgttcctgttccctgtcccgctgggctctgctcctcctggctactaatcctgctaatcttgctgctctgtctgtggagatggggggtggtggacagctggaaccaagccaccaaggctggacgggatgtgcggcggtggctggctggggtagaccatggatggggacccgtgcagggaaggggcctgagagccatgtgctcactctgggctgattgacctgagcaggaggctctatgctctgggtttcatcttcctgcctaaggagactcgggtcccctttcgtcctcctcaccctgtcctcactccgtcatctttctctggagtggctcaggagttcccccaaagataaagggattatggccttcccgcatctgtgcctgggcttctggagtcttcccttttgtccagtcaggctgtggtgctgcgggtggccccctcccatagaccccactcttccccatcccctcctgggttccagcaggagcactgttctttgaataggatgccaggctctgctttgggcactggacagacttgctgggtgcagggaagctcacttcctctctggatgccaacttccttatctgcagaatgggcttaggtgtgctcagtggagctgagggagaatgaaatggtgatgggatgtgaaccgtgcctcccaggcttagccttctcctgagcaggtgtcccctcctgaaggggaaggggtaagaagcgccagcccagcctactctgccatagcagggctgacctagaatctctggacagagtgtatgagggctgggaaggtggtgagctctctgtccctgggggtgtgcaagcaccaacaggccgttgtaggaggattcaagcatcacagagtgggtgggggtggagggccgattctgcagcccatgggacacctgtgctaagccttgttcagatagggtagctctgcctttctgcttccagcccagtcccagctgggccaagaatggagtgtgagtggtaggggctgcgggggggtgtcagggcctcactctgttccaaagtccccccaatgatgcctctttccataggggagagaatggccctgggggcttcatcgtgctcaagtcggccagtaacccccgtgtttgcacctttgtctggattcttaatacagatctcaaggtggggtgctggggggctgccaggtgggttctgtggagtggaggggaccctgctgctgacttggttgctgcatgactttgggggctctctgccatgcctgggcctcccctttgtcagccacctttcttacttgaaaatttgggtcagggtccagatggtctcttagccctgggttgctgtagggcatgtgcccccccttcttacctctgagtcctgaggccctgaggaagggtggctggtggccagcccggccccaccctggtctgtttgtgttgctggtgccaagagccaggcccagcatgttcttcctgccaggggtgagtgggagagggcgacccaggctggattccagagctgcacctgcattctggcccagagcccccctgctggtgccagctgcaaggggagaccctgctgagggcaggccatcaagtgtgacttctgcctgccttcccccagggccgcctgccccggtacctcatccaccagagcctcgcggccaccatgtttgaatttgcctttcacctgcgacagcgcatcagcgagctgggggcccgggcgtgactgtgccccctcccaccctgcgggccagggtcctgtcgccaccacttccagagccagaaagggtgccagttgggctcgcactgcccacatgggacctggccccaggctgtcaccctccaccgagccacgcagtgcctggagttgactgactgagcaggctgtggggtggagcactggactccggggccccactggctggaggaagtggggtctggcctgttgatgtttacatggcgccctgcctcctggaggaccagattgctctgccccaccttgccagggcagggtctgggctgggcacctgacttggctggggaggaccagggccctgggcagggcagggcagcctgtcacccgtgtgaagatgaaggggctcttcatctgcctgcgctctcgtcggtttttttaggattattgaaagagtctgggacccttgttggggagtgggtggcaggtgggggtgggctgctggccatgaatctctgcctctcccaggctgtccccctcctcccagggcctcctgggggacctttgtattaagccaattaaaaacatgaatttaaaaaaaaaaaaaaattccagcccctcccactgccttgcctcttgagggaagagaaaggcaggcagcagcttggatgaagagggaagacccctcacacagcctctcctgggctcacaggagggcggagcccggggagccagttcctgaaacatgccccccattccccccccgcccaccccccactccccgctttcctgaccagttcaactgagcagatgactggtcagaaaaaaatgccccgccccctgccaggcttcagcggggcaagtttaaagtctctagtccaggaatggaggtgggggtatgggcacctggcagtgcccacagcaagccttgactgtgtggcctggagatggggcctgagcttcagggtcactgaggcacctctgggatccaggccacctggagccccggacctcccagactccactcacccattccctctccccgcacggcactcacaccaggggcggcctggagcccggatcgcagggcggggccaggccactgcctgccttcctcctccctcccggctggcctgcccccttgcctgcctgcatgcaggcttccagcagagccagcttcttcagagccaggtggatcctgtttcggtcctgcctaggtgtgtgaccctgggcgaatctacctctctcagcttctgcttcccactttatgaaaatgggactgatgtcacagggttgttatgagattaaaagatatgaagaaccggg

SEQ ID NO: 1074 - DNA, 27123 bp, Homo sapiens; identical to SEQ ID NO: 1073

SEQ ID NO: 1075 - DNA, 27123 bp, Homo sapiens; identical to SEQ ID NO: 1073

SEQ ID NO: 1076 - DNA, 4413 bp, Homo sapiens
atgcaagttaaattacatttattatataaagagatcctataacttgatacgaaaaacaaagcaactccaacagataacagaagggcaaaaggacaggaacatctgatcaaagaaacacagctaccgatagcacacaaatattcaacctcattaataatcaaaggattaggatgcacttcttgcttattcaataaagttaataatttctaatttttctacttttcaaatgtactcaaatgtgctatttttagtaataaaaaactgagtaattaaaaaaacatagaaagtatgaaaatttctgccaatgcagaaatcataaacagcattaaaatgaatcaacacttgtatgggcagtaaggttcagacccctagaagccaattcattttgccttggttcctgagttttattatgggattgtcaataaggagaaagttgttcctgatttacatgctgacaatcttccaggtatagggggttgtgtgtgtgtattacacacacacacaatgtatatataaattttttttcttcaggtagacaattattccaggaaagtacctcttcagaatcactcattacagagaattcctgtaactccatttgctgataaaagtcccattaaaaattaccatgtggttctcaaccaatagggatacctttggcattgaagaggctgagggttgattttagtactgcttgtaagaccatagtgttccagaggctctgtagctggcttctttgggaatctgaagttggtcctgtctttgagacatggccaaaagcacatttttcctcacttgatgcagaagaaaatgttatctcctgcttgctcagatcatagcctcgaggcagatcacacagctcaggatgcacatggactggaacagcaccagggcaagcaccccaaatcacaaaataatcatgttaggatgactaagttgggaggctgaacttaaaaccctatagctttgttcagaatatttttttctttgcttttttcattaagttttactgaccaaaaaggtggaaaaaagaacctaaattttctgcacaaaagcagttctctgaaacctgaactttaccaatctgtgtaaaagtactctacagaaaatacacaagcagaaaacagtaatgtaagcttcatctgaagtaacggtttagtcacatgacaaatttggttgtcgatttagtatgctgtagcccttatctatctaaattcagtatgactacatagacatttattctctggtactgaatttccatttgaatagaaacggctgctttgtggaagaaagaaacttcaatttaaaaacaatttcagcatcgttgaagtgccaatcagttttcaaattatgtgtgtgtatacatatgtatgtatgtgtgcatgcatgtatgtttgtattatgtgtattttttcctcctctctccctctcttgctcgctctagagagagataccaaatactggcttggtgctatactgttttttcctagttaatatttttattatttctgtctacgtaagaaacttcaaatattctgaatgcaaccacacaatcgagtaagttgacagacatgacaaaaactacgaaaagagggaggtaactagtattaatacttggcaacctttcgttatttttagtttagagcggcctccctctgacattttggagtcaaagatgaaaactcaactttgaagcataatggacataattacacatttaccacagtcatctacaattttatataacatcacaaaaagacatctaaacatttttctacgtctttttttcatttgttaaaacagctatgttaaatacattttcagaatgcatttgttagccacttgataaacatactaaaagccatacaagacgaataacatcagttacctttatatctaataactgtaccaatcactgtaagaagatacaactgaaggggaagtattagatcacccatgacgtactgcaaaggtgttacaccttagacctaagaatgatctgaaggtgctgaaagaggtgattctctagaaggtgacccagggttttcttcaggtggaaaaactgtgagtgtacaggctcgaatgccaccaagtgactctggaagatcaaaaactttatgccactcatctttttctgggtcatatttctggacaatttctaccatacaacgattattccaagaatatccaccaacaacatagattttattttcaaagacggcaactccaacatcactttggcctcttaacatggcggcaattggggtccactggtcaagggttggtgaatagtattcacagcttagaacatcatcataatcacttgttcctctgaagtgattgccaccaatgacatagagcttatctccaactgtacacatgcaatgcagacctctgactgtagtcattggagccttttgcatccatttatctgtatctgggtcaaaacacatgagctcattttggaaagtgtcatgggtaattcctcctgaaatatacattaagcctccatatactgttccagcatgaccatagtggggttcactcatttttgcaacatagctccactcattcattcttgggttgtaacattctactgtggccagttcaccagctgcactgcgcccaccaactgcatacaaatgtcctttgagggcactcaagtgaaagaatgtgcgcttttcatttaatgatgcaacctgcatccatttattataccgaggatcaaatctgaaaactgtatcaacagcagtttttccttttgtatcataattactctgaccaccaactacataaagaaagtttccaatgacagcaataccatgctggtaacggggagcatccattggggctaaagatctccattcttgtgccctttcatcatacatccgtaattctttactgacaaccagctgctgcctcaaaactcctcctaatgtaaccaagtgagtggagtcagatcgaatggcagttctatctgactgcatcactggctgcatatatggcatcatttggtaattgctagcttccaaaagcaaattcacgcaggtattgtctgttctcatgaaatctactgtctgcacgtaattgatgagatcctgtggtgtcatcagtggaaatcgaatattcttcattaactttgcagcataatccatccgagggtcttccaaccttagccagcgacaggctgccttaaagagttcaagttcggtacagtgcttaagactattactggaaagcacaaatgcaagtcgttcaaaagggagttttagaaactccccagtactcaataaagcaggaaagttcttcaggatgaaattattaacatatttatccacttctataagattgtaggtgttagcaattcgtccaacctcaacacagttatccaaagagactcctgatataagaaatactttacagaaatccaaaacgggtaatatttgtaaaaagctagcagcttcaagtgtgtcctgaagattgtccatattaagagaaagttttgcagtataaataaaatcaatgattttcttcagaccaaccttgttcaccccatgaagcttaatgcacatcaaatcttgttctttcattccacctgtgaacatggctttgaaataatcactagcagacgccatcatagctctgtgaacagggaagatttcatctccatcacctggtaccagggtcacatcacaaagcaatccttctattctaagctgatcaaagccttgcaataccaccgaactgtgagtattgctggtaaaaaagcgtgtggttcctgccttacaaggctgcaaatgggcagagacgcccatttcgccgttaccaagggacactttcatgtgaaagctttcctcttgcacagagatgcaagccggataaagaagttataaccggaatgttttacaggtaacgaggtgtccagaaagaacagaaagctcgtttccttatcaagggaaggcagtcactgcggcacccctcgggccacgccagtcagtcatccactgaaaatcaccctgtagcaggaccacaaagggctgtggacctcaaatctgattattagacagatgattcatcacctgaaggcggttaaatgacctggttcacctcgtccggcctgcgctgccgctccttcagcagttccgcttcgggcaaggaagaggcgccgccacgtactgtggctccacggcccgctcggcggcgggtccggacacctcagcgaacggcccgctgcgccctccgctgtacctagagtgtcgcagcggccaccggcctgtctttgagcaagggccgggaacacaggcctgggcctgggcttgggcctagaataccggcctagccccaacaccgagccgctccttccggaaaagcctagtcccaggataccacggggtgggagcggccttagcggct

SEQ ID NO: 1077 - DNA, 864 bp, Homo sapiens
ccaaggttcagagtcacccatctcagcaagcccagaagtatctgcaatatctacgatggcctcgccctttgctttactgatggtcctggtggtgctcagctgcaagtcaagctgctctctgggctgtgatctccctgagacccacagcctggataacaggaggaccttgatgctcctggcacaaatgagcagaatctctccttcctcctgtctgatggacagacatgactttggatttccccaggaggagtttgatggcaaccagttccagaaggctccagccatctctgtcctccatgagctgatccagcagatcttcaacctctttaccacaaaagattcatctgctgcttgggatgaggacctcctagacaaattctgcaccgaactctaccagcagctgaatgacttggaagcctgtgtgatgcaggaggagagggtgggagaaactcccctgatgaatgcggactccatcttggctgtgaagaaatacttccgaagaatcactctctatctgacagagaagaaatacagcccttgtgcctgggaggttgtcagagcagaaatcatgagatccctctctttatcaacaaacttgcaagaaagattaaggaggaaggaataacatctggtccaacatgaaaacaattcttattgactcatacaccaggtcacgctttcatgaattctgtcatttcaaagactctcacccctgctataactatgaccatgctgataaactgatttatctatttaaatatttatttaactattcataagatttaaattatttttgttcatataacgtcatgtgcacctttacactgtggttagtgtaataaaacatgttccttatatttactc

SEQ ID NO: 1078 - DNA, 855374 bp, Homo sapiens
cagttggcgcgggccgcgggcgaggcggggccgcgcgcggggtcccctcctcctcccggtcaggtcccctcaggagcgccgggcgcagtctgcgcctcccgctccccgcctccggccgggtccgggacgccgcggctgtggggtcggcccgctaaggacaaggtcgggagactgggtggcgatgcccgagtgcgactggaggcagccgagcggaggcgacggcggttgggatctgtccctcctgaccggggagcgggactcggacgggcgccggtgaggaggaggagaagcggcggcggagaggttttctgcggccggaattcccttcaacagcatccctgtcggcgcccgcgagcgcagtctcgccgggcaggggcgccggggaagatggagactgggggccgggcccgcactggtaccccgcagccagcggccccgggggtgtggagggctcggccggcgggcggcggcggcgggggcgcctcctcctggctgctggacgggaacagctggctgctgtgctatggcttcctctacctggcgctctacgcgcaggtgtcccagtccaagccgtgcgagaggaccggctcctgcttctcgggccgctgtgtcaactccacctgcctctgcgacccgggctgggtgggggaccagtgccagcactgccagggcaggttcaagtaagtgccttcgccggaccccgaacctccagccctgcctcgctcccgtcgcggccttccccgcccccctcgcggcctcccccgcccccgtcgctgcctctgatcccccggccgtgagtgaacctcagcgcgcggcgggagcgggcgagagtggggcccgcgccgcgccccctccagccccggggcgccccgggagagctcgggcccgcgcggagccctgaccaacggggagctaggcatttctcgagcgttccagatgtccgcagcgacttctgatccgctgctcagcacgaacattttcacaatcagttatgatgcccagcaccattttcttgggataatatttaaaaatcagaaattgtccaagttacttatgaaatacatgcgcattgtgaaaaattcacaaaagtgtaaaggttcagttatgatctatgagtgcctctctctttccccatcctcttctctctagaggtgaccccttctaacatttatttagtcatcatagtgatgttaataagtagagtttatgatggacttgctaagtgccaaacactcttctaagcgctttatgtcaattttctcatttattccctacaacaactctgtgagttgctagaattattatgctggatttacggagagaaatcgaggcgatacattgaagtaacttggccaggattacacagtagtaagggccgagttatgattccaaatcagctggcacattctggagccagtacacactccagaatgtgtacttttaacgaatttgctgtgttgtatttgctaggacaatcttgaattgagaaatacaaaggtgactttaggttagatagaaggacgtttttatgtggtgaggataatggatttttttctgatcggttaattcactgtcagcttttgtgcgggaacatcgctttggcttgtttgaagctcaaggagcctaagaagtttgcttgctaaggtgaaggtactttcttcgtactggttggtgtttattacattcttgcctgatataaaaagcaatgggtcacagtgtaggggagtagcaaaagtcacttaatattggggcaggcttctaacaacatgcaggtaacagtcattaagaaagtcagcttcttagtcttctagatacttaatatgaagtttgctggctggtttgtggctcttgaatattgtagattactgatattgttaggctgatagccaaaatctaggtgaaatttctcttgggctctaaggcaaaggtaagactggttcaccttattaatgtattctaggacaatttcctggaattttaaacacagcatactttcctttttttttttttaaaaaaaaacttactattactgattaaaataaatgtcccttaaaactcaatgtaaaaatgtatatttttaaaatggcactttaaaattttaggtagagtctatgatttaaattaactagtaggttttggaagtgaaatcttaaagtgaagttttatgaaacttatgcaataggttgaaatttttctagggtttatactttaaaggtagtatagtaatgtagttttaaaaatactttttaaaaaaattaggagagatgctgattaaaagtttaaaaagtgtttcaagatgaggaaagagatcttaatgaattctgcttgttagttgtttttttttgcttgtgttcttaaacgtttgctatgacagtagaattcagcgtctttacctagcaagagagaattttgaacatgtaaactggtagtcagcagtgaaaaagcctcatccattttttacattttttttacataaatagggagagtgcctgatttatatgtagggatattggcttttgtgtgggtgggtttgctccgtttgtctaaagaggacaaaatttgctgcagtcctgagaagcttcattttaaagtagcggaacttgttaatcagctggatcagcagcctgtgacctcactagcagatgttgtcccagttaaaaagatcacagatcaagttaaaactagcttaaataacattgagaggtggtgttcataaacaaaatacattagtgagtagaagaagaatagatatttgatgtagatattgttaaataacaataaatcctgagctaatcactgagtattcatcttttccttggaagctattatttcctaggactcattgtactctattgggtaaatgcttttgcatttctctgtggaatacaagctattaattagagtaaatataactggtgtaacgatctgtgtttttattatgtatactcttggggataaagaacacattggtatttaatgttaaagagaaggattatgtatagtagaaaagaattcttcttggtaaagtacatgcaaataaacctatgaaaggtttatttgaagatagtagcttgttttacctggcatttgaagtaataacacagtgggaaaggctttaactagaaaatctcacttcactaactatcttgaaaatctttttctaaactgaaggatagcaaccttacaaacagacattaaaaatgattgatcaatcttggtaagcaggtgtcaaaattaattggttggctccatggtaacttagctttttttctactatagggatttcgccagggaataaaaatgttcttcaaatgtttcttgaggatagaagattgatagttgggggaagaaatgcagaagcaaatatagtatcaaaagtggtacttcagttctcttagcattgattccagtcttctgttttcatttgaaaagaataaagcactcagaataacaagccattccttccttacacaggtaaaacaaaaggaacattgatttttcacccaaagctagactaaaggacttgggattgagaataggaaaatatatttgaaatataataatcaaagatacagactctaattcaagttgtatttatttgaatagttcagtgtaatgttaagcaagaaaatattctgctataatctatttgaatgacgttctcttttagaagggagcccttgagaattaattttgtagagtagagatttatataaatttatataaatataaagagtattgctctttatattagtcaaatataaaggggtatatttttacccctcttaggttagtcaaatttggatacttcatttcacgcatttaaaatggaagtatgctgggtgccgtggctcaggcctgtaatcccagcactttgggaggccgaggtggaaggatcccttgagcccagaagtttgagaccagtctgggcaagatagtgagacctcatctctacaaaaaatattttaaaagtagctgggcatggtggcacacacctgtggtcacagctacaagagagagtgaggcggaagaattccttgagctcaggaggttgaggctgcagtgagctgtaatcacgccactgcgctccagcttgggtatcagagcgagactcttcttaaaaatttatatatacatatatgaagcattctatttgtagtgacagcaaaatgaagatgtaatgatataatgtcaggaattaggttgttattatagacaaaaacgggcagaataaagtgtgtaaactcttcccctaagctgttaaaaatatatgcatattgcctggcttggtgtctcacgcctgtaatcccaactctttgggagaccgaggcgggcggatcatgaggtcaggagatcgagaccatcctagctaacacagtgaaaccccgtctctactaaaaatacaaaaattagctgggtgtgatggcacgcacctgtagtcccagttactcaggaggctgaggcaggagaatcacttgaacccaggaggcggaggttgcagtgagcataggtcgcgcaactgcactccagcctgggcaacagagcgagactccgtctcaaaacaaaacaaaaataaacaacaacaacaaaaaacaaatatatatatatgcatatgtaaatacatatatatttggaatcctttttacttgtaaggaaactgacagtaattataaacttaaactgaatgttccctgtccctaagacttctttatttcaaagttttattttaatggataatttatatccatggattatttttacattattaaagtgtataatcacacagtaggaatttaaaataatttaaattgagtgtttcttagattctaaattgataaggtaagttacttgtagaagcatagtagcatggttttcaagaacacgtgtctgcatgatttggcccctttagctgattagactcaggcctcctttcctctgccctgactggccttttgaagttccttgaaagtgtcacattccttttggccttagtgcattttatacacgtaactgtgaactctttcctctctggtctttgcttgggtgattactgatcatccttctaatcttagcttaaatactagtttcttttttttttttttttttttttttttttgagaccgagtctggctctgtcacccaggctggagtgcagtggcgcaatctcggctcactgcaagctccgcttcctgggttcacgccattctcctgcctcagcctcccgagtagctgggactacaggcgcccgccactacgcccggctaattttttgtttagtagagacggggtatcaccgtgttagccaggatggtctcgatctcctgacctcgtgatccacccgcctcggcctcctaaagtgctgggattacaggcgtgagccactgcgcctggccacttaaatactagtttctaaaggaggcttgtctgactcttcacactaggttaccccttatatactgccctaatagcactatttttccttcttagtattgtcaaaaatgaggtgtttaattataattttgatagttatttaaacaaaatttttaagagattgaggtataattgtcaaacagcacaatttaaaatgtacaatttatttaaattatacaatttgataagttttgtcatatgtatttgcatctgaaactgtcaccacaatcaaaatcatgaaaataccaatcacgctagaaagtttccatgtgtttcctttgtaaaccctcccttttctagttgccaattcctgtcccagggcaactattgatctgctttctctcactatagatttgttggtattttctagaactttttgtaaatagaatcatacattatatacttcttttttgtctggcttctttcacacagcgtgtttattttgagattcattcatggtgtgttagtagtttattctactgccgaatagtgttccagtgtctggatacaccataatttgtttatccattcaactgctgatggacatttggattgtttcaaatttttggctgttccttataaagctgctacgaagtttcatgtggaaggctttttatctttgtatggtcatatgctttcctttctcttggggaaataacctgagaatggctggatcatatgggtagatatatgtgtaactgttaaagaaaccgacaaactgttttccaaagtagttgtatcatttatgttcccaccagcagtgagtcagtgttctatctagttaatttcacatccataccaatacttggtatggttagtcttttaaatttttgtgattctaataagtgaatggtatattattgggttttagtttgcatttcccgaattactaatgatattgagtatcttctcatgtgcttacttgccatccgtatatcttctgtaataggcatttattcaaaccttttgcatgttaaaaaaattttcttactgatttttgtgagttctttacattttctggattactagcttcttatgaggtatatcatttgcatatattttctaccagtctgcggcttgtctatgaaaacaatgcaaagagaatgaaatctcttgacagtatttttcaaagaatctaagttttaaattgattaattccagtttatcatttttttcttttatacttttcatgttgtgcctaagaaaagtttgcctaggctgggtactgtggctcatgtgtgtaatcccagcgctttgggagcctgagacaggaggatcacttgagtctaggaatttgagtgcagcctgggaaacaaggcaagacactgcctatacaaaaacatttgaaaaattagctggtcgtggcggtgtgcgcatttagcccatctacttggaaggctgagatgggaggatcactttaacacaggaattggaggctgcagtgagctgagctgtgattgtgtcactgtactccatcctgggcaacacagcaagaccatgtctttaaaaaataaaaaataaaaaaaaaaagaaaactgcctaaaccaagttgatgaagattttcttcattttttttctctagaagttttgtaattttagattttacatttatatttatggtccattttaagttaatttctatatatggggagaggtatggatctaaattcagttttttggcatataggtatttgttttagcactatttgttgagaagagtattctttctctgttaaagtagctttgcacctttgttgaaaccattcatatatttgtgtttctatttctggactctgctttgtttcttgatctctttgtctatttgtatgtcagtacaacaatgtcttgattattgtttctttgtaagtcttgaattctgggagtgtttttcagttttgttcttttccaattattttggctactctgagtcctttgtatttccatatgaattttagaatcagcttgtcagtttctataaaaagcctactaggattttgtttgtaattatgttgagtctatagatcaattttggggaaaatgaataccttgtcagttttgagtttcctacatggtatatctgtttatttatttagttgtttaatctgtcagcagtgtttttaaatttctagtcaatagatcttgcacctcttttgtcagatttttccctaagtagttaatatttttggatgctattgtaaatggcattttttaaactttcacttttgattgttgctattatactgaaacacaactgatttgtgtatgtttgattttttatcttgcaatcttgccaaacttacttattacttgtggtagatttttgcagattccttatggctttctacttagatgattatattgtttacagacaaagatatatttacttctttctttacaatctagatgcctttttttttcttgccttatttcactggccagaacctctattacagtaatgaatagaggtgatgagagtggtcaatcttacttaagatttagggggagatatttgatctttaaccatgaagtatgatgttatctgtaagttttttttttagatgccttttatcacactgagaaagttcccttctattcctagtttgccaagagtttttaccagtgatggaaactggattgtattaaatgcattttctgtgcccattgagataatcatatgattttttcaagtttgttaacatggtgaattatgtacataatttttgaatgttaaaccaaccttacattcctaagataaacttcctctgacacaatatgctttcctttttattttaggttggatttggtttgttaaagttttatttagaatttttgtatctgtgttcatgagagatattagtctgcacttttcttataatatatgactagttttggtgacaagataatgctggcctcatataatgagcaccatgggactctcctgatcatttgctgaaagagtttttagggaattggcattatttcttcattagtgtttggtggaattcaccatcgacaccctctaggcctgaagttttctttaactccaaattcaacttttattaatatacattcaacttatttaatatacagaaggctatatgactagaatcctttaaaatttattggccagaatattgtctatcttggttaagtatttttttgggcgtgtgaaaataatgtgtattcttctattgatgggtggagtgttgtatacatttcagttaggtcaacttggttgatagtcttgttcaagtcttctacaaccattctgattttctgtctgtttttaccacttattgagagaagggtatcttcagttataattttgtatttacctgtttgtccctgcagtcttatctgtttatccttcatgtattttgaaactatgttattaggtgcataaaattttggattatgtcctcctgataaactgagcctttatcgttatccaatgaccatttgttgaaaagactatccttttttcattaatgtctttgtacctttattgaaagttaattggacgtctttatgtatatttattttttgactcttttctgttccattgatccatatctctatccttttgcaaattcctcactttattaatgtatgtatgtactttattaatgtatgtatatgtgtatatatatatatacatacatatatttgagatggagtctcactctgttgcccaggctggagtgcagtggcatggtatcagctcactgaaatctctgctcgtcaggttcaagcggttctcctgcctcagcctcttgagcagctgggattacaagcatgtgccacctcacctggctaatttttgtatttttggtagagatgaggttttgccatgttggccaggctggtggtctctaactcctgacctcaggtgatccacccacctcggcctcccaaaatgctaggattagtatatttttacagtaaatcttgaagttagataatgagattcccccaactttatttttatttttgaaaatttacttggttcattttgtttttcatatacattttagaactgtttgtcaattaaaaaagtcttgctgggatttttattgagattgtgttgacttagtaaatcattttgaggagaattgatatgtaaataatattgaattatctcgttcttcattgcagtatgtttttttcatctatttgggttttcattgattttttacaacagttttttgtagttatcagatacagattctgtgtatatatttttagtgttttttttttttttttgagatggagtcatgctctgtcactcaggctggagtgcaatggcatgatctcggctcaatgcaacccctgcttcctgggttcacgcgattctcgtgcctcagcctcctgagtagctgggattacgggcgcccatcatcacgcctggctgattttttgtattttttgtagagatggggtttcgccatgttggctaggctggtctcgaacttctgacctcaggcaatccgcctgcctcagcctcccaaagtgctgggattacagatgtgagccactgcgcctggtcatattttttgattttataccaaaatattttatgttctttaaggctattgtagttggtagtatttcttttaatttcaatttccagtttgtagactttaaaaaaataatcagggaaatctttctttggtgatatttcctcgcccatatctctttattttttatttttgtggttacgttataggtgtatatatttatgggataaatgagatattttgatacaggtatacaatgcctaataaccacatcagggtaaatagggtattcattacctcaagcatttatcctttctttgtgttataaacaattcatactaattatactttctacccattaaccatccccatttcccccactccaatacctttcccagcctcaggtaaccatcattctactctatctccatgaattcaactattttaatttttagctcccagaaataactgagaaaatgcaatgtttgtctttctgtgcctggcttatttcatgtaatgtaatgatgtccagttccatccatgttgttgtgaatgacaggatatcattcttttttatggctgaatagtactcccttgtgtatatgtaccacagtttatttatccattcatttcttgatggacattttggttgcttccaaattttggctgttgtgaatagagctgcagaaaacattgaagtacagctgtctcttcaatatactgatttcctttcttttaggtaaatacctagcagtgggattgctgaatcatatggtagctctatttttaattttttgaggaacctgcaaactgttctgcatagtagttacactaatttaccttcccaccaacaatgtaagagggttcccttttctctatatccttgccagcatttgtttctgtctgccttttggatatgagctatttaactggagtgagataatatcacattgtagttttgattttcatttctctgatgatcagtgatgttgagcatctttttatttaccttttgacattggtatgtcttcttttgagaaatgtctattcagatcttttgcatatttttgaattggattattagattttttttcttacagcattgtttgagcttattatataatctggttattaatcccttgtcagaatgatagtttgcaaatattttcttccattctgtggatcgtctcttcatgttgttgattgtttcctttgctgtgcagaaactttttaactcgatatgatcccatttatccatttttgctttggttgcctgtacttgtggggtattactcaagaaatctttgcctagtctccaggtgtcctggagagttttcccaatgttgtagtagtttcatagtttgaggtcttagatttctaagtctttaatccattttcatttgattgttgtatatggtgagagataggggtccagcttcattattcttcatatggatatccagtattcccagcacaatttattgaggagactgttacttccccagtgtatgtgcttgacacctttgtcaaaaatgagttcactgtaagtatggatttattctgggttccctattctgtaattgctctatgtgtcctttttttttctcttttttttaatgccagtaccatgctgctttggttactatagctctgtggtataatttaaagtcaggtaatatgatgcttccagtattgctctttttgcttagaatggctttggctattctgggtctttttggctctgcatacattttatgattttttttctatttttgtgaaaaatgtcattggcattttgatagggattgccttgaatctgtagattgttttggatagtatggacattttaacaatattgattcttccaatccatgagcatgaaatatctttccattttttttggtgtcttcttcaatttctttcatttttcccctgcctagaggtttgtggaactttgaacttcagcgagatgatttaaggtatctggcagaagaaatttctaagcagcaaagcattcaagatgtgacttgggtgctgttaaaggcattccattctcaaagggaaacagagcataaaaatttgggaaatgtacagcctgacaatgatagaaaagaaaatcccattttctgaggagaaatttaagccagctgcagaaatttgcatgagtaacgagaagccaaatgttaatttccaagacaatggggaaaatgtccccaggccacgtcagagatcttcggggcagcccctctcatcacaggcctggaggcataggaggaaaaaatggttttgtgggccaggcccagggttcctgtgctgtatgcagcctagggacttggtgtcccttgtcccagctgctctagctatgactaaaaggggccaaggtgcagctcaggctgtggcttcagagggtgcaagctccaagccttggcagcttccatgtggtgttgagcctgcgggtgcacaggagtcaagaatcgaggtttgggaacctctgtctgcatttcagaagatttatggaaacgcctggatgtccaggcagaagtttgctgcaggggtgggactctcatggagaacctttgtatgtcagtgtggaagggaaaagtggggttggagcccccacacagagtccctactggaacattgcctagtggagctgtgagaagagggccactgtcctgcagaccccagaacagtagatgctcctacaccttgcaccatgtgcctggaaaagccgcagatgttcaacgacagcccatgaaagcagccaggatgaggctgtactctgcaaagccacagggtcggagctgcccaagaccatgggaacccacctcttgcatcagcatgacctagatgtgagacctggagtcaaaggagatcattttggagctttaaaatttgactaccctgttggatttcggacttgcataggccctgtaacccctttgttttggccaatttctcccatttggaatggctgtatttatccaatacctatacccccattgtatctaggaagtaactagcttgcttttgattttacaggctcataaatggaaaaaacttgccttgtctcagatgagaccttgggggtgctgaaatgagttaagactttgggggactgttgggaaagcatcatttgttttgaaatgtgaggacatgagatttggaggggccaggggcagaatgatatggtttggctgtgttcccattcaagcctcagtttgaattgtatctcctagaattttttgatgtgttatgtaaaggaattacccagcgggaggtaattgaatcatgggggccagtctttcccgtgctattctcgtgatagtgagtaagtctcaacaatatctgctgggtttatcaggtgtttctgcttttgcttcttcctcatttttctcttgccactgccatgtaagaagtgcctttcacctcccaccatgattctgaggcctccccagccatgtggaactgtaagtctggttaaatctccttttcttcccagttttgggtgtgtctttatcagcagtgtgaaaatggactaatacacttggtaatttataatgaatagagatatattggctcatgattctggaggctgggaagtctaagatcaagaggctgacatcttgtaagggctttcttgctgcatcatcctgtggcagagggtaaatagagggtcaagggataggcaaaagcattcaaatctcatccttttataaggaacccattcccctgataatgaactcactcctgaggtaacagcgttaatgccctcatggtttaatcacctcccattatgccccacctctcaacactaatccagagccttcactcagtccagcaccaactcaaaagtccaaagtctagggtctcttctaaatcagatgtaggtgagactcaaggcacaattcatcctggggcaaattcccttccagctgtgagcctgtgaaatcaaaacaagttgtttacttccaaagtgcaatggtgagacaggtataggatctacattcccgttccaaaagaaaaaaaggggtaacaggccccaaataagtccagaacccaacagaacaaacaatgttaaatctgaaagctagagaataatcttttttgactttatgtttcgccttctgagcatacttggatgaggattgggctcccaagacctcaggcagcccagcccttaggctttgctgggctgagcctacatagcagctctcatgggttggaggctcatgcctgccgctcttatagtctgaggctgcacatgggtgactctatagttctgaggtctcagaggcagccctgctcccatggccctattaggcattgctctagcaagtactttatgatgagtctgctgctgtagcatcctttcagatctacattgaggtagccgcatctccacaacttgtgcagtctgtgcacctgcagaattggcaccacatggatggataccaccaaggtttatttcctatacttttcagagctgcagccagagacacaccctggtttgcttgaacagtgactggggaggctaagggaagctgtgccagaatgcagggagcagatacttgaggcagcacagggcagtgaatgctgaggtcccatagatgcctttctggaaactgtgatctcaggatcctagatgggaggggcagcccaggagacctctgaaatgccttcaagatctctttctatcttgatgaatagcacgtgacttccttttatccatgctaatccccttatgcaagggttccttggccacacccttgcatgctttgcttttttgttctttacatatacaaactgtgacttttccaaatcattactttctgcttcccttttcataatatgttttgtttttaaatcattctaccttctcgcatctttactatatgcagttaaaagtagccacgcagctctttcaatattttgcttagaaatttcttccaccagatatcctagtgaagtggctacattgtctggggtatataccctggggttcatcatcatgcaccaggaaaatttagggcatggacacacacaaggggtttaggagtagaggtttaataggtagaagataagagaaggagaaacagcctcctttataaagggaggggtctctgatcggaaaggactggctggtggcaaatgtgccgagttttatagtccagtttgaggaggcagtgtctgatttctgtaggggtcacagattggttagatcaggtatgaagtttacatagtgcatggggaaggctggttgccccaccataatcttcttatgaaaatggatttcccagttgatcagcatcatcttgtctgctccttacaatacacatggctggcagagaagagaggatggagccaccattttgaaaatgtctagtccttagttcctgtcagcattcacccatgcaagctctcagcttgcaggctgctccttgttagaaaatgatttggggctgcttttcattgaaaaggaaagccttaccaagcactcccatgcccttgttctctgactaagtaattcctttctaactcccattatactagcttattgctcttaaattctgccttccatgaagcactcagatatgggcacaattcagccaagttatttgctgcttcatgtcaaggatggctattactccagtttgcagtatctctttcctcctttctgtctgagatctcctcagagttccctttactctccacatttctgccaatattctgatcataagcactaatgtaatctctacaaagttttaggctttccctgcagttctcttctgagccctcatcagaatcatccttaatgttcttttcataccaatacaagttttttctagccttttttttttcccaaactctcccagcctctacttattgctgagtttcaaagtggcttccctattttcagatatttgataaagcagtgttctatgcttcaataccagttttttgtgttattcagttttgtgctgctataacagaatacttgagacctagtgatttataatgaataaaaatttattggcttatgattctgttgggaaggccaagattgaggggccagaatttggcaagagctttcttgttgcatcattgcatgacagaagagcaaagagagggtgaagagagaaagagaggagggcaaaagggggtgaaatcatccttttataaggaactcattcctgcaataacagcattaatccattcatgagggctatgctctcatggcctaatcatctctcattaggttccacatccccacactgttgtatcggggattaagttttcaacacttttttggagggacacattcaaaccatagcagagactctgcttcatgtcaaggatggctgttattccagtttgcaatatctctttcctcctttctgtctgagatctcctcagaattgcctcacaattaaatattctgttttaggaggcaatcaacttgttttggttcagcacacatgacctagctcacttttcaaaaaacagagctttactgagttacaatttgcacctcaccatattcaccttttaaagatgtacagttcacttatgtttagcatatttagagagtggtacaaccatcaccattacctaattttaggctgaagagccaaattgtataaacaaattggtatctgtgacttgttaaaaaataatttctagggtatcttatatagtcagtataaaatcaaactaatctgtactttagatgtataaaaatgaatttttataatgatgttttatcataacatcattatatcagtattttaccatcctgagttatcaaagcatattataatttccaaaaatatagaaataaactgaggtaggcaaaactttaagatggcccttttgacttttatccctggtattactgtcatgattatgttatgtcatttgtcaagagggagattatttgggttttcttactctaatcacatgagccctttaaaagcagagtatttcccctgggtgctagcagaagaggaagctaaagactcaaagcataaactggatttgacatgctaatgcttgtttgaagatggagggagccatgcctgaaagtactagagaaagtggcctcttggtgctgagagcgagcaacccctggtcagcaactggcaagaaagttgggacctcattcatataactggaatgaactgaattctaccaacagtgaataagcctggaagtggatgcttttctggagcctctggataacagcctagctcaactaatacccatctgagtctatagggacttctgtcctatagaactgtgagataataaatggatgttcttttaaatttctatgtttatggtaatttgttaccagcagtaaaaacaaatttaggggcatatttagcaatacatcgttgaaaaaagttattctggctgaatttcaatgatactgagttaaccagaaaattaaattaattctttaaacatgatggtcaattgagttttattatctttaacagtaataatacaaggtgattgtcatttattaatttaagctttttataacaccttgtgtacctgtctttgatttctttggtctgccatgaatggttagaattaatgctcaaaatgtttgccataaggttactaattgctgtctggatccacgaaaggaagatgctctggcattttagatatctgatttatttgaccctatttgatgcacagtatacttccagtctaccatttgagccaaaaagtgaataggagaactattttacagatagcataaagttatgaaatgatcagtagatgtgatgaagtttagccaaaaggggaagagattgatcttatcattagatagtagattaatttgaaaataatgattaccatgtgcaagagaagtattccctgattaaaaaatgtttgagttgtatagttatctcagtagctgaagggaatgttgaggaaaaaatgtattaatgagctaaaatcttatttggaaatatccttgttagaattatagagctcagaatcagctgatgttgtagtccatttgtattgctacgaaggaatacttgacgctggataatgtgtaaggaaaagagatttgtttggctcatgattctgcaggatgtacaagaagcatggcaccagcatctgcttgtattgcggggctcaggctgcgtctactcatggcagaaggcaaatgggagctggtatctgcagatttcatatggcaggagaggaagcaaggggtgggagcggccaggccctttttcataaccaactctctcaggaactaatagagtgagaactcactctttactgtgaggatggccccaagccattcatgagggatctgcctccatgacccaaactcttctcagtaggcctcacctctgacattagggatcaaatttcagtgtaaggtttggaggagtcatatattcaaaccatagcagttgagaattaggcctcaaagtcagatagataatggttaaaatatcaactatatcaatactgaattggagaacatctttttcttgtgtggccataatgggctaatatttcacctcaaaattaaattacccactcatttatgggccaagttaggcaactgctgatctgtattgcaaggtaggacaacagtagtggaagatagtagtcagaatgcatttcctgtgcctaaaatagtctgacagtgaatgatctgataaagaagttaggaaaacagttccatttacaatagcatcaaaaaacaaaacaaaaaaaacccaaaaaaaaaacttacgataagtttaaccaaagaggtaaaagatctatatgtagaaaactagaaaacattaatgaaagaaattgaaggtgacacaagtaaatggaaagatactttgtgtattcatgaagtgaaagagtattgttaaaatgtctatattacccaaagtaatccacagattctatgcaatcctatcaaaatagaattagaaaaaaatcctataatttgtttgaaaccacaaaagaccacaaatagctaaagcactgttgagcaaaaagaacaaagctagaggcattacactagctgactggtctttgaaaagttaatggaaaatgcatattatgaaaaaactgcgtggatttcaaattttttttgcaccaaaacaaactcataccaaattgttataacaagtctgaatgggatcaagtttgaggcactaaggaggataagacattggtttgaaaagggcccctatcagagtaacataaattctgctaaaattgaagcaagagcaaacatcaaatttatggtgaagcttgggtggaagaaggtgaaattattgatgctttatgaaaagtttaggaggacaatgccccaaagtaatcagcagtttataaatgggtaactcattttaagaagggatgatatgatgttgaagatgaagcctgcagcaggagactattcacatcaatttgtgaggaaaaaatcatcttgttcattctctaattgaagaggactgatgtttgacagcagaagcaatagccaacaccatagacatctcaattaattcaacttactcaattctgaatgcaaattaaagttcagtaaactttccaatctatgggtgccaaaaccactcggaccagattaactagagataagagcagaggttttagtggaaattataaacaagtgggatcaagatcttgaagtatttcttggaagaattgtaacaggtgaagcatgactttaccactacaattctgaagacaaagcacaatcaaagcaatggctaccaggaggtagaaggggttcaatcaaagcaaaagtggactggtcaagagcgaaggtcatggcagcagttttttgggatgctaaaggcattttccttgttgactttctggatggccaaaatataacatctgcttattatgagagtgttttgagagttagccaaaactttagcagaaaaacacctgggaaagcttcaccagagagtccttcttcaccatgacaatgcttctgttcatttctttcatcaaacaagggcaattttgtgagagtttctatggaaaatcattaggcatccaccttatagtactgatttggctccttttgagttttgtttgtttgtttgtttcctaattgatatggtttggctgtgtccccacccaaatcttatcttgaattaccacgtgttgtgggagggatctggtgggagataattgaatcatggggccaagtctttcccatgctgttctcatgatagtgaataagtcttatgagatctgatggttttataaagaggaggtcccctgcacaagctctctctgcctgctgccatccatgtaagacatgacttgctcctccttgccttccaccatgattgtgcatgctccccagccacgtggaactgtaagtccattaaacctctttcttttgtaaattgcccagtctcaggtatgtctttatcagcagcatgaaaatggatgctaatacactaatcttaaaatgttttctaagggcacctatttttcttcagttgataatgtaaacaagactgcattgacatggttaaattcctaggaccttcagctctttagggatgtactaaatgactggtatcattgcttacaaaagcttcttgactttgatggaacttatgttgaaaaataaagtttatattttttatttttatctgtttttttttccatgaacttttagtcatctcatagttattaaaacagcgtgatacctgcataaaaacagacaaattgacccatggaacaggatagagagcccagaaataaattcacctgtctgctgtccactgattttcaacagaggctcgaggaatacacattggagaaaggacagtcttgtcaataagtgattctaaaaaactaggtatccagatatagaagaatgaaattaaacccttatctgatcccttatagaagaatcaactcaaaatggattaaagatttaaatggaagatctgaaactaaaacaactagaaggaaacataggagaaaagctatgactttggtctgagcaatgacttcttgcatgattccaaaagcacagacagcaaaagcaaaaatagacaaatggtattgaatcaagaagcttctatacatcaaaggaaataacagagtgaagagacaacctacacattgagagaaaatatttgcaaatcatacatcagataagggactcatacccaagacataaaatgaactcaaatcattcaataacaagaaaacaaataacccctatttaaacatgggcaaataatctgaatagacatttttcaaaagaaaacatacaaaaggtcaaaacatatatgaaaacatgctcaacattactaatcatcagggaaatgcagatgaaaaccacaatgggatgtcatctcatacctcttaaaatagctcttataaaaaagatgaaagataacgtgttggtgagtatatggcaaaaagggaagtttttgtacactattgggggaaagtaaattagtacagccattttgaaaaaaaatatggaggttcatcaaaaaactgaaaatagaatcaccatatgatccagcagtctgagtatatatccaaaggaattggaatcagtatgttggagagatgtttgcattcacatgttcattgcagcattgttcataatagccaatattgggaaacaacctaagtgcccaccaacggatcaatggattaaaaaaagaggtatatatacataatgaaatagtattcagcctataaagggacaaaatcctgtcatttgtgacaacatagatgaaactagaggccattaggttatgcaaaataagctaggcttagaaagacaaatatcacctgatctcacttacatgtggaatctaaaaatttgaatcaattgaagtagagagtagaatgggggttaccagaagctgtgggtggtggtcagttgggcagggaaaagaaaaatattggtcaaagggtgcaaagtttcaattaggaagaataagtgttctattatttcgttggcgttctattgtacaatgaagtgactaatgttactaattgtgcattgtgtatttcatatactacattgctaatagagtggattttaaatatttttgctgcaaaaaatatgtatgtggggtgatgggtatgttaattagcctgatctgctcagtctgcaatgtatacatgtattgaagcatcacattttaccccatgaatatatacaattattatttgtcaataaagatgaaatgaaaataaaaaggaattaataagctgataaatagtattttaactagaaaatctgtttttaaaaaagatttctatgtgaaaaaggcttacaaaggccaccctgcataaagactatccctgagtggatctgactattccttgtaggctggttatgccaggactaaacctatattctgtgataaacaggatttattgtttcagagatttcgtaaattaaaactatcacactttcttatttttataatgtgttaagttatatatccatagtcaaattatatatccatagtcaggatagacaacaacatcccactagatttaattttagtattgtctaatatttgtgctggttttcctgcatttattagtggccaaccttgtgttataaacagcccagcatgcttttaattaaggactctactttcagctagaatgagatattgacaaggcatatggatatgtggcaggcatctagacaagtgattggcaaactttttctggaaagggccagatagtagatattttaggctttgttggccagatggtctctgttgccagtactcaactctgtcctcgtagtgtgttagcaatcttagataatacttaaacaaactagtgtagttgtgttccaataaaagttcatttacacaaacaggctagtagtttatgtagtactgatctagatgaataagtcagtatggttctcagttcaagaagaggaatgatagaaagtttaaaaaaaagttgtttgaaacttggaatatgtattagaaataatattagaaatagtagttatgtaagagcctattttactttctttagggagttgaactatgtgctacctaatttctggagagcactacacaattggaatgtaagggtattaggagtaagaagtaaaaaaaaataaatggaaaactaggtgtttatggttagagtatggtcctggagtgcaagacttctgaattttagaagaacagttctagactgtaaagaggtccaaagtatgtaatgggaatgctttgcccaagtggcatgcaggtaaaggttcttggagtttaagaagagatcatgaaactgaagaaggagaattgttctttctttattatagaagtagcaggagatttctcccctttacgcatgtcttttggtggtgagaaggaattttccatttcttttaccttgattggtgacatcctcccatgcttccagtggactggtattggcaaggaggaaacctttttgtagtaagtggaggaaaaggtgggctcttggtaagatctttagtgctaaggataaggaattcagggattgtggtgagtagtttccttttaagtttgggaaattgtactactgaagttgaataggacgggacagggtgtgtagttttcaggtactcctattgtttagcttaggtagggaggcataacagttccttcacatcacttataagagggagataaggattactatggtagctcctacaatatatgtttctttggaggaagggggatatatatttttaatttttgtgggtacagagtaggtgtatatgtttatggggtatgtgggatattttgatacagtcatgcaatgcataatcacatcatggaagatagggtatttatctcaagcatgtatcctttgtgttacaaacaatccaattatactctcagttattttaaaatggacaattaaattattattgactatagtcaccctgttgtgctttcaaatactagtctcattcattcattcattctatttttttgtaccccttaaccatccctacctcctcctcactttaccactacccttcccagcctctggtaaccatcttcctactctctatctccatgggttcaattgttttgctttttagatcccacaaatcagtgagaacatataatgtttatctttctgtgcctggcttatttcacgaaacataatgacatccagttacatccgttttgttgcaaatgactgaatcacattatttttatggctgaatagtaattcattgtgtttatgtaccacatttctttatctgttcatctgttgatggacacgtaggttgcttccaaatcttggctattgtgaacagagctacaacaaacatgggagtgcagatatttcaatatattgatttcctttcttttgggtatatacccaacagtgggattgctgaatcgtatggtagctaaatttttacttttacgaggaacctccaaagtgttctccatagtggttgtactaatttacattcccacaaacagtataagagggttcccttttctccatatccttgccagcatttcttactacctgtcttttggatataagccattttaactggggtaagatgatatctcattttagttttgcttttcatttctgtgatgatcagtgatgttgagcaccttttcatgtacgtatttgaaatttgtatgtcttcttttgagaaatgtctgttcaaacctttagcccatttttaaaattggattgttggctttttttcctgttgagttgtttgagcactgtatatattctggttattaatcctttgtcagatggatagttcgtaaatattttctcccattctgtgggttgtctcttcatgttgctgtttcctttgctgtgcagaagttttttaacttgatgtgatcccatttgtccatttttgctttggttgtctgtgcttgtgggttattcctcaagaaatctttgcccagtccaatatcctggagagtttccccaatgttttcttgtagtagtttcatatgcttaactacctgttattatgctagacattttatttgaaaattattgatagaaataatttaaggcccaggataatgttatctttctttagagagtaccatgtatcttctgttaggagacttggcatattggcagttctggcagcaccataagccgattttaagacttgggagttttctgctgctcagatgactcatagctaacctacagttgaggtaaaggctggttaacttctggtacaccactattttaatagcaagtcattatgtcccaagtcaaagtgccctgttgtttctttgaacccctatgttttgtgggttattgcttccaacttttgtcctcctctccccttgaggctactaaatgcactctcaaccttttggcagtctcttctaaataagcaaatctctcagaacaaaagcatctctgaatgcctgcctcctcttaaagaatttgcaacttctggatcttggctttgtacattttatcattttgttacttgtaagattttaaaattgtcctttaactttttaagttgtcttcagtggagagtttttctgaattactgcacttagtattaatattattggaagtgaaaaatcagggcaagttatttaacttgttacttaaaatgtgcttcagacttctcatctgtaatatggagttattaattatttactatcttataggttttttgagatttttaaatgaggcaacacattgtgtttatagtggtacctgacatgtagaaaatgcttaagttattattacatttatttgagaatataggaatttgttgctcttcaaagattttccaagcatgaattagccactttattacaaaagtaatttgcagggattatgaaagatttgcaaatgacattaacattgactgacatttctgtcaaccctgatttaggtaaattaaagtttttcccccctaatgtatttaaggctctatactataaggaaaatttaattttatctaaaagtagataatggccctgatatgtatatgtgtgtgtgtgtatgtttatgtgaatatgtaaaaactgattagctgtgatgtgtgtgtgtttgcatatataagtatagtatataaatgttaaatgggaagacattttaattctttaaaatatggtctcttgataaaataattgggctggaagtaaaaaaaacaaaatgaagcagaattgagatttttgttttaaagatttttaatttctgaaaatagagtttttccaaatatctttttcttttttatgcataaaatagaagatacaattttttttatttgtcctgttttaaaaattgagttcttggactagatgtaaagtagacaggagaaaatgataataaaaaatatatttatagcagaactctttcaagtttggtgacacctattttagcaataccagtacatgaagaaaaaatatagcttacatgctaactccccaaagtggaacatacgtatactttttctctattccatagatttgtatttgatcttccttctgcctcaacctaatttttgtgcagatgaagtttaacttactctattttgcatcaacattgaatccttcagtactatgttcagtctttcagtgtcttttttcgcttcgtaaattgaaatggtcatgatatattaagatttaaagaaatccaaaataagtatcttttgagatgcagagaaaaatacagcactttgaaattttcctaagttgtaaataaatcctcctttttgaaaattgttatgtcccgttcctttggcttaatgacttttaaattttcttatcctgctatatgtcttaaagttattttaaggtaattattttcattattttattttctcttccaggttaacagaaccttctggatatttaacagatggcccaattaactataaatataaaactaaatgtacttggctcattgaaggctagtaagtatacagtctgagtcaaattaatgtattttattcttaaatgataaaggtgatcatattaatgtcagagcattagagtataattactttatcatttagtttgtttattattagataatatttacaacttctagacatcacatttaatgtaaattacactacctcttcacttgtgacagtagtttaatttttatatatattttgtttttgagttatgttattgtggtattaaattgagtaggcatttttttggtttattttgaacatcttgttatgaaatttgaagacttagaaattataaaagtatttcttgctgagctatgctattcatataatttagcattttagttcaaagggtatttttaaaagaacattttgtagaagagagagttaattattcatttagaggtattttcagtaagtagggcttgaaacaatctatctatttaaatgtattgtgaatggagcataaaagaattgatatgaattatttttgaactgttttgtaatttctaaagagtatatttggaaaattttgtatttaaatttttctaacttaaaagctgttcattctctgctgtgcacctgtagttacattttgtttatttgttaacattatatcacattgagaattttgattaaaatttaaatagttttttagtgcctccaacttaagggttctgtaaaaataagaatagtggcttcttgagtgttgatttttaaaaatcaactttatttaagtaccatttgtatacaacaaaatgcacccatttttaagtgtacagttccataaggtttcagtgatgtatacagtctatgtaacctctgccttcaatcaagagaaagattttttttttttgagacagagcctcattctgttacccaggctggagtgcggtggtgcgatctcggctcactgcagcctctgcctcctgagttcaagcaattctcctgcctcagcctcctgagtagctgggactagaggtgcatgccgccatgcgcagctaatttttgtattttcagtagaaatgggttttaccatgttggccaggatggtcttgatctcctgacctcgtgatctgcctgctttggcctcccaaagtgccgggattacaggcgagagccactgcacctggctgaacattttttattgactacatttttagaaaacaatgatacatacatatgtcctgttaatagattttgaaagttacattttatttgtacaaattagatatgatggcttatcaatctttcaccctgataaggatttatagcaaaattatctataaacagatttctaataaaataccctatctaaagtttcttcactctgtgctttgtatattatataataaatattatgtatttattcactctgtgctttgtatattttaatttgaaaaatatttcatattcattttcagtccaaatgcagtgttaagattaagattcaatcattttgctacagaatgtagctgggatcatatgtatgtttatgatggagattcaatatatgcacctttaatagctgtacttaggtgagtaattatatttaatcagttgcagaaaagtgactgtgtaattgcttctttaaatatatattgatatgtactgcaaaataaatttagtaaagatattgatagttacatttcacagatgattataatactttgttatgtgctgtaactgtcaatttaggtaataattatgtaaatattgatataacataaataagtactatattggaaatatagatttctttctaaatattttttattctcattgtatttagtttattctttcaaagtgccttgaatatgttttcagaactatctggatatattagcgtgagttctagctgacaaataaatagacaagttttgttttttaatagttgtttttttattttagtgaaatggtaaaattttaaattctgcataaaagggttaagttatgctttgtgcaatgattaataaagatggagtttctaccaattgtcaaaatgtgagagttttatttgtttcaaaatattttattgttagtcgtaaggtagattattaattttaaaattatagcattgtatcaatttaaaaatcttttcttgtgtatgtttagattattataaaaagtttcgtgaataggagaaaatctattagacacagaaaaaattatgaacatgtatagattttatatataatttaacatgattgttgataagttactcattatattatttacttttgctatttatacaatatctgttatatgttctgtcattgctggaaatttaagtatggataaaagcttattggtcccttcaaaatattttctttccaatttttctttttattattcatgtggcaaatattctatttcattctattctaatacattttattttgttctattttatcaggaatgtgaattattattttggacaaaaatgtaacgacttgtatttccttaggagcttaggtacttattctatgatattgctattgcttacatttttgagtcatttgaacattagaaaaaggatagccataagcagcccttcatctaaggacaatagagagaaaatagagtggagccttgcaaataattaggttgtaagataatttattgtaacaattaaatttgatcctcagttcatacatttatttttagcaatttaaacatcactttgctatctttactctatttttatgataccgttgactgaccatcatttagatgtgtgcctgttcatttgtttatctagtaattctaattactttgtattaatactcatccattagcattcttaccaacattttcttgttattaaaggaagataattagcaggtgagatttagtatatggctgtgaagatggaattagtgatttctcattagcaagtgttcttgttagccctcctaagggaaatggaaaactcatgtttattgatattgaatatccacttgatgttaagcactaggctaggcagtttaaatgtcatctaatcctcacaaagatctcgttgggggagtactaagtactattatccccattttacagttgagaaaattgacattcagagaagttatttgcttctaatagatggtagagctaggattaggacttgaatctcaatctcctgatttaaaagcatatgctgtttgtacttcatcttgctaagaattcagaatctaatatgtttgaattacttcaattgtataaatatttattactcaacatttaattacagagactgtgtcacaggcttagagtacatagtaaggaagaaggcataggctatcgcagtggctttagacaccaactacctgcagttgggctagaacagatttcctaggttaagagcacagtcctctacaacaagggtctcctctccaccccagatccccgtaccagtccatggcctgttagcaacagggctacacagtaggaagtgagtggcgggcaagtgagcaaagcttcatctttatttacagctgctccccactgcttgcattactgcctgagctccaccttctgtcagatcagcagcggcattagattgtcataggagtacagaccctactgtgaactgtgcatgtgagggatctaggttgctcattccttatgaggttctaatgcctgatggtctgtcactgtctcccatcagccccagatgggaccatctagttgcaggaaatcaagttcagggcttccactgattctacattatggcgggttgtataattatttgattacatattacaatgtaataataatagaaataaagtgcataataaatgtaatatgcttgaatcatcccaaaatcatcctcccccggtctgtggaaattttgtcttccatgaaactggtctctggttccaaaaaggttggggattgctgctctataacactgctgtcatttcagacactagctgcaagcttggtgctccccacctactctgaccatctggctacatatttaggggttcctactctgtcctaaaagtttgataattcactagaattatcatagaactcaggaaagttctacacttatgactatagttttatcatgaaggatagaaatcagagccagccaaataaagggatgcatagagtgaggtctgggaggatcataaatgcaaagcttctgggtcctcagaatgtgttacccacccagcacatcaacatgtatcaccaacagggaagctcatctgagcttcaggtgtccagagttttattgaagtttcattatgtagccatgagtgattgaatcattggccatgaggctgaactcaaatctccagcccctcccatccccttctctctcgggaagttaggctaataccatatggccccaacattttaatcacatggttagtgtttctggagtggccatcccctattctgaattatatctttagcttaaattaattaggggcccaccatgagtcacctcattggcataaattttcagggctcaccatgaataggaagacactcccatcactcaggaaatttcaagaatttagaggttatgtcccaagaactggggacaaaagccagccaaattctttagtatgcagtagtcatgcattagtgggggtatgtaaacagatttttcacacagcctagttagtgttacaatcaggttatgaaggagttctatataatttcaaaataaataactaatccttcatgttgactttcatcgtgagtaaaagtatgaagtatgggggtcagataggacattctagagagagaaaagcatatatacaaaggtatagacacattaaagagcattatattttagggcaatagttgaaagttttgagtaacttgattgtaggaactgtgaaggatacgtaggagtcacattaccccaaaacagcaatcagtgacatttacttagtgctcattttgtgccaatgtacaggagttctttatatgcattagtttatttaatcctcaaaataacctttaggtaggtattaatattgtaattttacaaatgcagaattgagacacagagattttctgtgagtggcccgaaggttgcctagctggtaagtcagaatatgaatcaaggttatgtaattataggtcctaatcccttaatcactgtaatattgcttgcttgtacaccacactaaagaagttgggcttttattctgtaggcaagagtttttagaatgtggagaatgcattggaatggagaagtgttatttttttttttttttactgtgtgctggacaattgtgtgttggacgttgttgtttggaaaatcatatatagtaataatttgaggcctagaaagattatattcttgcagagactacctggggacactcgcaatccatattcaactcaatccaaactcagatactgaggtgattcatagctcagctgcagtgcagtcctttggagggcctaactttaggtagtttgctttcacttccaaccattggagtcccagttcaacgtgaaggccttgtgtttcactttttctttccttcattctgtaaaatccctgaaattaccaccgagttttttttagcccttcaaatcttacctccagccttgaaatcagcaaatgccaatagggtaaatgacctcaatgcctgggcaggccttcaagctgatttttttgtttttatataatttgtcattttactagatttcagttggtccgaatttcctggtgtattatacagtaagtggaaactctcttttatttattgtttttaaaatacttgtaaacaaaaaaccaaacagatctattcttttttgtttgtttgtttttttgagacggagtctcgctctgtcaccaggctggagtgcagtggtgtgatctcggctcactgcaacctccacctcccaggttcaagcgattctcctgcctcagcctcccgagtagctgagactacaggcatgcaccaccgtgcccacctgatttttttgtatttttagtagaaatggggtttcactgtgttggccaggatgttcctgatctcttgacctcgttatccgcctgcctccaccttccaaagtactgggattacaggcatgagccactgcgcctggcccagacctattctttttatctttttcagagagcgctcagagactagctgtatctattataaagacctatttttagtaatactcacctttatataattttattacaatgaacaatatgtatgtataacttaagactggtgtcatagggtttgtattgttttgagagtctcattttaaaatcatttgttgcttcacaaacataacctagtagatgtaataataattactaaagcgttaaatcaagagttgattactttttaacttgtttgcatttgagaatgtattttctaaatcaattatttgactataatatttcatttatgtgtcaaatatgatttgaatgggggaattcagttcttagtggtacctaaacataattttaactgtttaaaggaattgaccgtgtcgagttatataatttgtttgttagcagcttcttttctttcaccaattgcatgttttcatagatttagagaggttagaacatataactaaatgaagataggtaattttcctcatgaacaagtatccttaaaaagaagtacaagttaccagtttaaaactattttgtacatttatatctcccccaccccaagtttttgtttgtgtgcttatgggcttatgtgagcaatattctgtcttggaatagttatatattaatgcaatttgcatagatatgcaaaattagaaaaacattaaagtctatatagttttaaattttttgaagtaaatattttaaatcacctagataaatgtattggaaatgtacagctataactagaatgtaattgtaattgcttaactgatgtagagtgtcttccagcttcatcggatttttaaaccaatcagaatgagtaaaggtacagggttttattagagtagcaaggtgactttaagtgaagttttatacgaattaagtggaagactaccctgtagtattatgacaggatggatagcaggacaaaaaggagaaatgagacattgccttacaaatagtgataagaaaaaaaatggggtacagtggcatgagagtagattttagtgtattggcagcagtagtagaactaatttagtgagaaatggatagggacttcttttagatgtattctccttttagttgcccattctgacgtacaagcattactgatcctggtaagaatatttctgagtaaattttatgtgcttaacagtcttatgtatatctatacatacaatattcagttttgttctcttttagtggtttgatagtccctgaaataaggggcaatgaaactgtgcctgaagttgttactacatctggctatgcactgttacatttttttagtgatgctgcgtataatctaactggtttcaacattttctattcgtaagtattttttaaaaattccttcttttaatgattcttgtaatttaatgtaaaagaggttttttttgtttatttttattaatgtcttgtataccagaagcaggctaccgtgttaaatttcaaattagtaggcaggatcccttcttaagtgacataaaatcttaataatatgccacaaaacgtgatctaaacctataagtttggttgaaaattaattatgaaattgacaattgttttttggcaagtgattaagtaaacaagtactagtgtagctttactggtagcaacagatgtggtgagactgcagggagttgtgaactgcctttcagtgctctaaggtatatcacttgtaatttgaagaggattatgggagctaagtttttgtagtccctattgcagagactgtactgaaagctatgcatacattatgtcatttaattaccttcaattctgtcaagtgggtatatttcccattgacacatgaggaaattgtggcttaagagttaagtggctataccactatctcctctaaaataagaaaagtaatattcattgagaatctattatatgcctgatactttatatacatttttatatctagaagactgagggtgaagtaatgagagatgctttcacaggaatggctagagaggaagtctatatattatttttttcttttcttcagaatgtagaaattggtaaccagagaatttttcaccagaaatattataaatatccttgaatcagcaatttattatggaatttatttatcctacaacgtatccaagtatgtatgcaagggagaacaaatatatagtagaatataatcacatggtggctcacgcctgtaatcccagcactttgggaggccgaggcgggcagatcacgaggtcaggagatcaagaccatcttggctaacacggtgaaaccctgtctctactaaaaatacaaaaaaattagccaggcatggtggcgggcgcctgtagtcccagctactcgggaggctgaggcaggagaatggtgtgaacctgggaggcggagctttcagtgagccgagatcgcaccactgcattccagcctgggcgacagagcgagactgtgtctcaaaaaaaaaaaaaaaagagtcttaaagctaaatatgataaacataccttttcttcaataacagtgtatgggtgatagcatgctcttttatattatacaaccaagttatatcttgacttctcatatagttttgaattttcatgaatttaatttttttctgtaaaatatacaatcaaaacattgagtacttaagtctttacaaaacattttgcctggaaccgtacagatcctgcagatgttgagcatgtagtcgttagacatttggagtcttggtatcaaagtaaatctgttgaataaaataagaccaactgcaaataaatactaacaatttcataagagtaagagggtacagagtaaagaattaaaactacattgtgaaattctgttacatttataagcacataggacacagtataaaaattataaagtttatgatgtatcaaccaaaattctttttcaattaccttgaatctgaatatatatgaattatattttacagaatcaattcttgtcctaacaattgctctggtcatgggaagtgtacaactagtgtctctgttccaagtcaagtatattgtgaatgtgataaatactggaagggtgaagcttgtgatattccttactgtaaagccaattgcggcagtccagatcacggttactgtgacctgactggagaaaaattatgtgtctgcaatgatagttggcaaggtaagcatgtgtggtgtgatggcttttgaaacattgattcatatatgtaatagattaatacaaattccacacgtttgtttcgttatagtttgcacacccaagccttatatatttacttttatttttagaatgttcagattaataatcaacttcttaataatttttttgtcacaaatagaattaattggcaaagattttgtctccatactactttgaagatcaaatgaagttatatatgaaactgaattgttaggtgtgtgataattatggtcttctgtaatttgttgttgaatctccccaaatttggtgacttcactgaatttaatgtggtgcattcaaatttgatttataagggtaatataaatagtatactacaaaaataaatgttcaaagggactgcagtatatgaaacttatttcttaggaaaggctgacatcttgtggctattttaaaaagaactagactatttttaaaagtattttagctgcctattgcagaagtcagatacctaggaaagaatttctaagtaatttttataaatatctatcatcaaagattaagtttagactacagtgaagaatgttggcttatttatctgtatataaaataataaatattgtcattatgaaattaagagatatgcttatacatatacctacccacctagagcttactttttgctagttacatttacctatgaagagcttcctttgtgccaacatattaatcctgttgaaatagggaaatttgactcaataattacataacctgaagtacttgattatgtattattataacacagtgtaataaatagtagcaatagttcccaagttaaaaaccaaagagaacatactcttcatgaagttgtattcattattcctgagatgaccttttcaaaaaagtgttgttgggtatgttgagtacttacttagaggaattattttaggctttgtgtaaattatgcctgtcttaagctcatgttagctcattaaaaaatattaggtatgtcaactgcacaaaagatctatgatttcttattaaatcgaatttggttaccaattgcaattatgtcagatgcaaatttctaaatgttttgtaattacagggacatgtattttaagtgactcttttaatcatttatgacttttcttccccccaaaagtgccttgagatgtaattttattttcatttctgtcgtgaaactaaaataactgtcttttctatagagacagtggtgtatccatattatatttgatttaaggcctgagaaatagaaatatagctcatatacacagtatttttcaaactggtcttcaattgctattagtctccacctcatttcagcagtcttaaaagcaaatgaggaatacatttgtataacattctctgtgaacaactctgccccttttctgttttttacttactttcattagtccttctttgaaatgctttattttgtgtaagtcttgtaatatagatctgattcaaagtattaagaatttttttctggcctttgttttttggccttttcatatcctattattctcatctgtaatgtcccaaatcataagaattcctgaatctaatatgtctataagcaaatggaaatgaggaagcaaatactgggtatgttcacttttaaagcaaagttatattatcagtagtctaagaactacttgtctgtgtgtgtgtatgtgtgtgtgtatgcatatatacacatatatttataactacatatatattttatatggagaatagtgtgaaagtgctttgtaaattataaaacgcagaaataagacaattttataccattttcttaataattaaggaaatgatttctgaattgatatgtttgaaggaggccttgtaaatgagataatatggtgttttcaagacaaattatgtgcagactggttactttgtgcctcaaactgatcctgattctgtatttaaggaagcatagctccaaagaaggtaggattgtgagcaaactcatttaggggaaaatgatgtttttatttcagatatatatagaatgggaaggaatcagtgaggtaagaagaggagatagatttgcttctaggacaaatggggaatgatcaaagaatgagagacatgtgaaaatgcggactgccgaggcaatctttatgaggttcaaaatctggtagttttatacaaggtgttatttggaactggattatttaggttagagtaacagattgttgttacctccattatattttatcctttgttgttgcttgactacttattctgtttggctgtatgcctaatgtatattttttaaaaatgagtgttaccctctagaaacttgggttttattaagataacacagaggaaaaacctagctttatattaagtcctttttttatttttatttttatttttttattatactttaagttctagggcacatgtgcacaacgtgcaggtttgttacatatgtatacatgtgccatgttggggtgctgcacccattaacacgtcacttacattaggtgtatctcctaattctatccctcccccctccccacaccccacaacaggccccagtgtgggatgttccccttcctgtgtccaagtgttctcattgttcaattcccacctataagtgagaacacgcggtgtttggtttttttgtccttgcgatagtttgctgagaatgatggtttccagcgtcatccatgtccctacaaaggacatgaactcatcattttttatggctgtatagtattccatggtgtatttgtgccacattttcttaatccagtctatcattgatggacatttgggttggttccaagtctttgctattgtgaatagtgccgcaataaacatatgtgtgcatgtgtctttatagcagcatgatttataatcctttgggtatatacccagtaatgggatggctgggtcaaatggtatttctagttctagatccttgaggaattgccacactgtcttccacaatggttgaactagtttacagtcccaccaacagtgtaaaagtgttcctatttctccacattctctccagcacctgttgtttcctgagtttttaatgatcgccattctaactggtgtgagatggtatctcattgtggttttgatttgcatttctctgatggccagtgatgatgagcattttttcatgtgtcttttggctgcataaatgtcttcttttgagaagtgtctgttcatatccctcacccactttttgatggggttgtttgattttttcctgtaaatttgttggagttctttgtagattctggatattagccctttgtcagatgagtagattgcaaaaattttctcccattctgtaggttgcgttttcactctgatggtagtttcttttgctgtgcagaagttctttagtttaattagatcccatttgccaattttggcttttgttgccattgcttttggtgttttagacatgaagtccttgcccatgcctatgtcctgaatggtattgcctaggttttcttctagggtttttatggttttcagtccaacatttaagtctttaatttatcttgaattattttttgtataagatgtaaggaagagatccagtttcagccttctacatatggctagccagttttcccagaaccatttattaaatagggaatcctttccccatttcttgtttttgtcaggtttgtcaaagatcaggtggttgtagatgtgtggtattatttctgagggctctgttctgttccattggtctatatctctgttttgataccagtaccatgctgttttggttactatagccttgtaatatagtttgaagtcgggtagcaaatggaaaacaaaaaaagcctgaggttgcaatcctagtctctgataaaacagactttaaaccaacaaacatcaaaagagataaagaaggccattacttaatggtaaagggatcaattgaacaagaagagctgactatcctaaatatatatgcacccaatacaggagcacccagattcataaagcaagtccttagaggcccacaaagagacttagactcccacacaataataatgggagactttaacaccccactgtcaatattagacagatcaatagacagaaggttaacagcgatatccaggaattgaactcagctctgcaccaagcggacctaatagacatctacagaactctccaccccaattcgacagaagatacattcttctcagcaccacattgcacttattccaaaattgaccacatagttggaagtaaagcactcctcagcaaatgtgaaagaacagaagttataacaagctgtctctcagaccacagtgcaatcaaactagaactcaggattaagaaactcactcaaaactgctcaactacatggaaactgaacaacttgctcctgaatgactactgggtacataacgaaatgaaggcagaaataaagatgttcttgaaaccaatgagaacaaagacacacaatctctgggacacattcaaagcattgtgtagagggaaatttatagcactaaatgcccacaacagaaagcaggaaagatctaaaattgacaccctaacatcacaattaaaagaactagagaagcaagagcaaaaacattcaaaagctagcagaagacaagaaataactaagatcagagcagaactgaaggagatagagacacaaaacccttcaaaaaatcaatgaatccaggagctggttttttgaaaagatcaacaaaattgatagaccattagcaagactaataaagaagaaaagagagaagaatcaaatagatgcaataaaaaatgataaaggggatatcaccacagatcccacagagatacaaacaaccatcagagaatactataaacacctctatgcaaatgaactagaaaatctagaagaaatggataatttctcgacacacacaccctcccaagactaaccaggaagaagttgaatctctgaatagaccaaaaacaggctctgaaattgaggcaataattaatagcttaccaagcaaaaaatgtccaggaccagacggattcacaggtgaattataccagaggtacaaggaggagctggtaccattccttctgaaactatttcaatcaatagaaaaagagggaatcctccctaactcattttatgaggccagcatcatcctgataccaaagcctggcagagacacaacaaaaaaagagaattttagaccaatatctctgatgaacatcaatgcaaaaatcctcaataaaatcctggcaaaccgaatccagcaacacatcaaaaagcttatccaccatgatcaagtgggcttcatccctgagatgcaaggctagttcaacatatgcaaatcaataagcgtaatccagcatataaacagaaccaaagacaaaaaccacatgattatctcaatagatgcagaaaaggcctttgacaaaattcaacagcccttcatgctaaaaactctcaataaattcggtattgatgggatgtatctcaaaatcataagaggtatttatgacaaacccacagccaatatcataccgaatgggcaaaaactggaagccttccctttgaaaacgggcacaagacagggatgccctctctcaccagtcctattcaacatagtgttggaagttctggccagggcaatcaggcaggagaaagaaatagaaggtattcaattaggaaaagaggaagtcaaattgtccctgtttgcagatgacatgattgtatatttagaaaaccccatcatctcagcccaaaatctccttaagctgataagcaacttcagcaaagtctcaggatacaaaatcatgtgcaaaaatcacaagcattcttatacaccaataacattcaaacagagagccaaatcatgagtgaactcccattcacaactgcttcaaagagaataaaatacctaggaatccaacttacaagggacgtgaaggacctcttcaaggaggactacaaaccactgctcaacgaaataaaagaggatacaaacaaatggaagaacattccatactcatggataggaggaatcaatattgtgaaaatggccatactgcccaaggtaatttatagatcagtgccatccccatgaagctaccaatgagtttcttcacagaattggaaaaaactactttaaagttcatatggaaccaaaaagagcctgcattgccaagtcaatcctaagccaaaagaacaaagctggaggcatcacgctccctgacttcaaagtatgttaagtcttgagttccttcctaacatttctcttttgcttaacctacctggtcttgtgtgtcatttttttttctttggtttttctttttcttggagataggatctcactctgtggctcaggctagagtgcagtggcatgatcgcagctctttgcagcgttgaccttccatgttgaaatgatcctcccaactcagcctccggagtagctggcaccacaggttgcacaccaccattcccagctaattaaattgttttttttttttagagatgagatctttctatgttgctcagactggtctcaaactcctgggctccagtgatcctcccaccttggcctttagagtagctgggactactcgagggcacacaagtttgttgtataatatttaattttgtcataaagtatagttgtcaaagataatgatatatacatattaaatatatgactaaaagtatagggacctgtgtagactcatctgcttctatgacagtaaaataaaaaaaatagacttcatagtttgaggttcacaggaaaattgagcagaaggtacagagaattcccatttacctcctgccccaatgcatacacagcttctctcattatcagtatctcccaccagagtgtatattcattacagttcatgagctcacactgacaaatcattatcaaccaaagtcatagtttacattagcattcactgtcagtgttggacattctgtgggtttggacaaatgtatcattacatgtatccaccattatagtatcaacagaatagtttttttaacctaaaaatcccctatgctctgcctattcattctttcctctccctacccctgccaaccactgatctttttactgtctccacaattttgccttttcccaaatatcatatggttgtaatcatacagtatgtagctttttatgattggcctttttgacttgacaagatatgtttaagtttcctccatgtctttttatggcttgatagctaattccttttcagcactgaataatattccattatatggatgtaccacagtttgtttatccattcacctactgaaggacatcttggttgcttctgtaaaatttgtttaaattttagtaagtcacctgagggaaaaaggcaactttgaaaagaactgatctcttaaaatggcttccaaacattgggatagaagagcaatttttataacacatgaaaagcaagatataagaaattgaattcatgttcatgtgtaaagaacacaatagaacagtaattttcaaagtactctgttttatataacttttaaaaaatctgaggaggctgaggcaggagaatcacttgaacccaggaggtggaggttgtgagccaagatcgcaccattgcactccagcctgggcaacaagaatgaaaatccatctcaaaaaaaaatctgaatgatgggaggtctttggttgaaagcaacagaaacaatctggcttacttgagcagaaaagtcagttattggaaagtatgcagagacagagactgctgtctcctagcattcattatagaattctcattgtaatagaattctcatttagctcagcacatggccttccatctacataccaaatttctcatgctgccttgcagctagtatggctatgttactgtattagtctgttttatgctgttgataaagacatacccaagactgggcaatttacaaaagaaagagatttaatggacttacaattccacatggctgggggggcctcacaatcatggcacaaggtggaaggcatgtctcacatggcagcagacaagataagagagcttgtacagggaagctccccctttttaaaaccatcagatcttgtgagtcttatttgctatcatgagaatagcaagggaaagacctgcccccatgattcagttacctcctactgggtcccgcccaaaacacatgggaattcaagatgagatttgggtggggacacagccaaaccatatcattctgccactggcccctcccaaatctcatgtcctcacatttcaaaaccaatgatgccttcccaacagtcccccgaagtcataactcatttcagcattaactctaaagtcctaagtctcatctgagacaaggcaagtcccttctgcctgtgagcctgtaaaatcaaaagcaagttagttacttcctagataacaatcagggtacagccattgggtaaatacagccattccaaatgggagaaattggcaaagcaaaggggccacaggcctcatgcaagtctgaaatccagcagtgcagtcaaaccttaaagctccaaaatgatctcctttgactccaggtctcacatccgggtcacgctgatgcaagaggtgggctcccatggtcttgggcagctctgctcctgtggctttgcagggtttagtcccacctcccacttgctttcaggggctggcattgagtgtctgtggcttttccaggcacatggtgcaagctgttggtggatctaccattactggggtcttgaggacagtggccctcttctcacagctccactaggtggtgccccagtagggactctgtgtgggggtccaaccctacgtttcccttctgcactgccctagcagaggttctccatgagggctctgcccctgcagcagacttctgcctgggcatccaggcattttcatacatcctccgaaatctaggtgaaggttcccaaacctcaatttttgacttgcatgtacctgaaggctcaacaccacatggaagctgccaaggcctggggcttccaccctctgaagcaacatccagaactgtaccttggccctttttagccatggctggagtggctggaatacagggtaccaagtccctaggctgtacagagcaggggggccctgggcctgagccatgaagtcatcttttcctcataggcctctgggcctgtgatgggaggcgatgctgtgaagaccactgacgtgccctggagacattttccccattgtcttggtgattaacattcagctcctcattacttatgcaaatttatgcagccagctttctccttataaaatgggattttcttttctatggcattgtcaggctgcacattttccaaacttttatgctgtgtgtcccttttaaaactgaatgcctttaacagaatccaagtcatatcttgaatgctttgctgcttagaaatttcttccaccagataccctaaatcatctttctcaagttcaaagctccacaaatctctagggcaggggcaaaatgccacgaatctctttgctaaaacaaaacaagagtcacctttgttccatttcccaacaagttcctcctcatctccatctgagaccacctcagcctggatttcattgtccatatgattatcagcatttttgtcaaagtcattcgacaagtctctagggagtccacactttcccacatttttctatcttcttctgagcctttcaaagcgtttcaacctctgcctgttacgcagttccaaagtcacttctacattttcgggtatcttttcagccgcgctccactctactggtaccaatttactgtattagtctgttttcacactgctgataaagacatacctgagaccaggcaatttacaaaacaaagagatttaatggacttacagttccacatggttgtggaggcctcacaatcatggtggaaggtggaaggcatgtctcacatggcggcagacaacagaagaaagattgtgcaggtaaactcccctttttacaaccatcagatcttgtgagacttacttgctatcacgagaagagcacaggaaagacctacccccatgtttcagttacctcctactgggtcccttccataacgtgggaattcaagatgagatttgggtgaggacacaaccaaaccatatcagttactaagtttagattggtaggatgtgagtagaaaatctgtatgcaaatattagatcattcagatattttcctatggctgataaatggcaacaactataataagtagcactggcccattcatctctagaatgttcattagagagaaataagcttttcccttcttttagcaacttattttgcttcactcaacctgttctctgaataatacaaaaggatattgagtagctcacaagagaaatgagaagactggataaactattgttggaaagaggccagatacaaataaaggctagcctacagcaaagatgaagccaatggaaagtttgagtaggatattcctgtcattgccacaggatcctgggttactaccactggcaccctttcagtaggtactgcatgctacaggaatggagagaaagaattgtaaattgcctttacatctttgcatcacttattaagactgagtcctgcttaatagtatctgcttggctaaacctaggtcttgtccataccgtggctgcctagagatatgaaatagggaatttaacttttctgttatatgtagtgaaagaggttctctttctggacaaaatccacacaataaaggattctcccaaacacaggaaaggggattcaaatgattgagattcccaaacaaataaaaaattcaaataatatatttttagctatagattgttaccataattaacaaggaatgggctaatttgttctctcatgtctactcagagaaactttgtaatgtggactagatgtaggggtagacaggttaagagacaaaccagcaagcttcagcatacaattttttcttaatgtattacaacagattttttttcctattctacagagaacagtgaaaaacaggtcaccatcatttatatgtaagagagttgcttaactgttatcaaattgttcctgttccttttctattccagaatgtcctgctcaatcctattgctcgattcttttaaatgtcttcaggacatttttatgtttttagtattcctttttaattcaattcagctacagttctcatataaggattgaagttggctgttttaaactcttaaattattgattgaaatacagtatctggaaatgtaaatcatgtaatttaatagttttgttgcgtagtgcctctgatctttatttaaagtcacactttattgtaacttactccagtttctcagatgctctttgtccttcactatctcaagacctttcttaattccaaagttcttcctagaaaacccttaccccattcatattctaagtccaggtcagatccccctgtaatatgctgtcataagaccctatcttttaaatttatatcatttatccctgtttataattatgtgcttgtatgattctttgattatctttcccagtggaatataaactccaagaagttaagaatgattatgttttgatcatctttgggtttccagaacctaatatagtgcatggcatgtactagccacttgcatttgttgttgttattgaatgaatgaattagaaatgtattagtttactagtatagtgatatgtagacattcaactagagatgttttataaggttattactctaataaactatgttatttacttcctgtataattacttctgaacattgagataagcaattgaatttgaacattttttaaaatgttattttatcaagcattggttcttggaatcttggtcttattttgtttcaatcctttggttttagattttaacatttgccattgggtggcagtattgactaccagaaaactcacttaaactctggcattcaagttgtagaaacttggtagttttgtttgacttagaaaaatgtaaaaactttcaactcaaactcatgaatattttatctgaagtattttatctgggttagtcatataacatataaggacatatttagttattttaggatagtatacacatgagattataggttgccttgtagaaattcataaagtagcttacattttcctttagaaatataataataatgaacacggtcaatctatttcttctcttttaactttgaggagggagaagtgacaggtaatgcgtttaattccgttaaattcttcccacttagcaaaaacagcagatctgacttttttgtgagagctaataaaattaaatttttactcttaacctactaagaaagttgactgtttgaaaataaaagcagcattaaaatgtatatatgacagccctttttcatgaattcatttatttatctttttcatttattaatgtaacagtttctttttttgagcttctattaagtgctagagactgctctaggtccttgggatacatcatggaacaaagaagacaaagatccttgtggaacttacattcaagctaggagagacagaccctaaataataaatatacattatatagtatgttagaaggtgataagtacaatggaaaattaaagtagaacagagaaagaggaatagaaagatctgggggttacatttaaaatatgatgatatgcttaggttttatggagaagttgacatgtgagaaaagactttaagcaagcaagagagttcaaccatatagatatctaggggaagaacattctaggcagagacctgtcagttcaaagaccctaaggcaagagcaagccaggtgtacataaggaccagtaaaaaggccattgtggctggaattgaattactgatggggagattagtcagatatgaacttagaagttacacaacaagggagatggttggggatgtggaattaaggggttgctggaggggatggagattcctgaaggatggagctatatcagctaaatattcttagctttgtagaccatagtgaggattttgactcttaccctaagtgaaatgagggagccattgaaggattttgagcagaagattagtattatgtggcttagttttataaagctcctattggtttccacctgagaatagactgtagtagcagtataccagttcagaggctactgctataatctaggtgagagatgatgatgatggtagcttggacaggttggtagctatggaggtggtgacaatggcttgaatactgaatgtgattttaatgcaggattaataggatttgctgatggtctagatgtggggggtgagggaaagaagagtcaaagatgactaaggtttttggtttgagcaaatggaaagacagagttgtcatcaactaatatgaggaagattttaggaagaatatttggttatggtatgccaagttagagatatctttgagatattcaaaaggagatagtgaggaggcagttggatatatgggtctggaaattgatggagagagatctgtactgtagatataaatttggaggtgttcgcttaaatattaaattggaaaccattgatgaaattggatgagattaccaggaaagttagcatagagagagagaatcgaaccaaagactgaactgtgggtcccaacaaaattcagagtatcctgtgctaggcatataaattcctttcttagataagcttgccttatgttgaactatttataaccacttattttgttgcctctgactttataagattttgttgcctctgactgcataggacaatgtaaaatgaacaaatcctgctctcaatatagctaattctacgtttgtcattttcagctgatcagaaccaaggtcttaaatctttcttgggattttttttttttatagtgtgtattgccctgtccatactcttaacatggtttatcaattttcttcaaagcataatatcttagctcaggctgctataacaaaataccacagattaggtcgcttaaacaataggcatttattcctcacagttctggagaccagaagtccaataccagggtgctatcatggtgagggccaccttcctggccctctcactctgccacataaagaacgaacaagatgactgcctttttgttctatccttatatgacagagagaaggagaggaggagagagcgagagcaagagagagccagagagagagagagggagagagaacgcacgtgagagtgcgaacttgtgagagctggagagagtgagcaagctctctggtctctccttgtaaggcactgatctcaccatgaggaccctaccctgataaccttatctaaatctaattacctgtccagagccccacctactaatactatcacgttgggagttagggtttcaacatataaattttgaagggacacaggcattcagtcaataatatgagaattttttttgtttcttttttttttttttttgagacagagtctttcactgccgcctgggctggagtgcagtgggctatcttggctcactgcaacctccgcctcccagtttcaagtgattctcctgcctcagcctcccaagtagctggattacaggtgcccaccaccacgcccagctaagtttttgtatttttttttttgagacggagtctcatgctgtcgcccaggctggagtgcagtggcgcgatctcggctcactgcaagttccgcctcctgggtttacgctattctcctgcctcagcctccggagtagctgggactgcaggcgcctgccaccatgcccgtctaattttttgtattttttagtagagacggggtttcatggggtctcaccgtgttagccaggatggtctcgacctcctgacctcgtgatccgccttcctcagcctcccaaagtgctgggattacaggcgtgagccactgtgcccggccaattttttgtatttttactagagacggggtttcactacgttggccaggctggtctcaaaactcctgacctcgtggtctgcccgccttagccgcccaaaatgctgggattacagacgtgagccaccgtgcctgggccatgaaaattcttagcatgaatatttcttaatgttatttcaatttatggaggaactattctctattcacaattaaagttatcttgggaaagtcaattaactatctggttataaatttcattatttatacaaagagattatttgcccttgtctgagtcttgggatgataacttgatcaaagtgaattgaaatagtgtcttgctgtttatgcttgactggctgataatacagtagcagtttcctttttagtaagtagacattttgtaatagtttgatttagtaaaatcttctgtttgcaatgaggttcagtacattttattaataaaaaaattgaatttgtgattaatatttatatattaggcaactatttacatattctgtgagcattatacatgcaccagtctaataaaatgggcagtttaacttttgtacctagaagaaattttgacatacatgctttcattattttataatttattattttagatgtttttgaaatatgattttgacagttacgattattcaaaaatctggtctttaaaatttttgaagttagtcttttctaagcatacatattttgataataccaggagttttcaaaatgtgtggtgcaagggttatataaggagatgggttggggtaggatggaagataagtgactcttccttttctgcctcaaccatagtgtcatcactttgcaatattttacatattgagattccttgtaaaactttgttttaagccttctgcagcccaaaaagagtaaattggaaaccattgatctttaaacaagagggcaatttgtttccatgccacaatagcatcattgaccgaaactgtaagagccaagtattcttggaacagatctagtataatgattaccactcacacaattcattgtcttataaaattaacagattgtcagaatagttgtggatatttaaaatagacaaaagttaatacctggcctttggagattgattttatgggtctagaacatgtgtagaatactttggatactgtaacaaaatcaaatttttaaaatggtgttagaagagagaacacttgcattgaaatcttgttttgacttttattggagaacttcagattcagtacatactaaatcataagactatatctggaatgattacaacaagctacatttacccctcttgctctaaaaatctttattcccaccatatcttccacttcttattaacaatccagtttcttctgggaaattgccttttgctaacgtagcatagtcttgctgggatgaaaaaatccaggtacctgtctattctaagcttgatttttctccttgaaaaactctctgaatttctacatattttttcaatacagtcccattttcccttaagctagccaaattaatttctgtgactcacatgtaagaaaacaaactgaagtaccaccttagagatactgttagggtgtgttttttttttctggttattagacttctttaaaatacccaaaattatatcagcaacctgcatttgatagaattcagagttagcaatatttatttaatgtgttcagttgaaaactgcaaaaagaaaataaatatagttggctctttaaacatgtaccacttcaacattaaaatgaatgcttttttcgtagtagtatagatgaaatataaattaagggtatgagccaaaattacatcaaaaagtctaaaatcctggagtaagattattttttgcttactttcccttttacttattttttattgatacataatatttacatatttatggggtatatgtgagtatttgttatccgcatagaatgtgtaatgatgaagtcagggtatttggggtattcttcactttgagtatttatcatttctgtgttgggagcatttcaagtgctcttttctaactacttagaaatatacaatatgttgttgccaactatagttaccctacactgccattgaatattataatttgtatcttctaactatatgtttgtatccattagccaatgtctgtcctcccccactacccacaccctgtccagcctctggtatccatcattctattctatacctccatgagatcaactcttttaactcccacgtgtgagtgagaacttaggatatttgtctttttgtggctagcttatttcatttaacataatgacctccagttccatccatgttgctacaaatgacatgatttcattcttttttttttttttgtggctgactagcgttccattatgtatatacactatattttcattatccttttgtctgttgagggacacttaggttgattccgtatctttgctactgtaaatagtgctgcagtaaatatgcaggtgcaggtatctctctgttacagtgattttgtctcctttggataaatacccagtagtgggattactggatcatatgatagttctattttaagttttttgaggagtttccatactgtttaccatagtggctgtactaatttacatccctaccaacactgtattaagagttcccttttctgtgtatccttgccagcatctgttatttttagtctttttaataataaccattttaactaagatgatatctcattgtggtttttgattggcaaattccctggtgattggtgatgttaaactatttttcatgtacctgttggccatttgtaagtcttcttttgagaaatgacttcatgatctttgctcacttttaaataggattatttgtttactgttcagttgtttgagttccttgtatatcctggattttaggtccctgtcagtaacatagttttcaaatattttctcccatcctgcaggttgtcttttcactttgtggattgtttcctttgctgtgcagaagctttttagttgaatatagtctcatttgtctatttttatttttgttgcctgtgcttttgaggtcttagccaaaaaatctttgcctaggtcaatgtctcaaagcattttgcctatgttttcttctagtagtttgatagttttgggtcttagggtttaagtctttaatccattttgagtttatttttgtatatggtgagagataaggggtgtagtttcattcttccacatgtgaatatccagtattcccagcacaatttattgaagagactgtgctttctccaatgtatgttcttggtgtctttgaaatcagtgagtataaatatgtaggtttattctttcactattatgtttcattgatctatatgtctggttttgtaccagtaccatgctgttttggttactatagccttgtaatatattttgaagtccagtggtgtgataccttcagccttattctttttgcttaggatttctttggctattggcctcttttttggttccatatgaattttagaattgttttttctaattttgtgaaaaatgactatggtagtttgcattgactctgtagattgctttgggtagtatggtcattttaacaatattaattctcccaatccatgtacatgggatgtctttccatttgtttgtgtcctcttcaatttctttcttctgtgttttgtagttttcctatagagattgtccacatgcttggttaaatatatttctaggtattttattttttttgtagctattgtattgccttcttgatttctgtctcagctagttcattatttgtgtatagaaatgctgcagatttttgtatattggttttgtaacctgcaactttactgaattcatttattacatttaagagttttttggtggaggctataggttttctagatataagattatatcatcagcaaagagtggcaatttgacttcctctttccagtttggatgcattttctttctttctcttgcctaatttctctggctaggacttgaagtagtatattgattaggtggtgaaagtggacatctttgtcttcctccagttcttagagaaaaagcttttggtttttctccatttggtattgaagtggcatcatttggggaaatagccaaggtttgttgtctcgcactaaggaaatcgaagacgtggacacacaatgagtgggtttaagagcagaaagtttaataggcaaagtaaagaagagaaaagctcccctgtgcagagagagtggtgttctgaatggatctccctctttgaggccagatgcgttttttttttttttttttttctttctaagaatctgactctgtcgcccaggctggaatgcagtgatgcgatcttggctcactgcaacatcctcctcccaggttcaagtgattctcctgtctcagcctcctgagtagctgggactacaggtgtgcgccaccacacccaggtaatttttgtatttttagtagagatgaggtttcgccatgtttcacctcctgacctcaggtgatccacctgccttgggctcccaaagtgctgggattagaggtgtcagccactgtgcctggctgtggttggttttatagaggggcttttggaggcggtgtctgatttacatagggcccagaggatttgttggaccaggtgtaccatttgcatagtgcactaagaggctggccatcccaccctaatcttttattacgcagatggggtcttttcctggccagtgtagacgcctgcacacatggcaacaaaagggaagggaaaatctccatgttgaatatacctggcttccaggtatcccttttctgttggcacagcttccagcattccagcttgcttatctatgcttgcagcttgatttttcaggctgctttttgttagaaaagaaatgattttggggctgtttttttttaaaaggaaattccactgagaactcttttacccttactaactgcctgaataatttctttttaactcctgtaacagtatgatattaactgtgggtttgtcgtatatgtccttttttatatcttggtatgttcctttcatgcttagtttgttgagagtttttatcgtgaagggatgttgaactttatcaaatgctttttctgcatctcttgagatgataatatggtttttgttcttcatgttgctgatatgatagatcacatttattgatttgcatatattgagccatccttgcatccctgggataaatctcacttgatcatggtttattatttttttaatatgctgctggatttggtattttttgagtatctttgcatctgtattcatcagggatgttggcctgtagttttcctttttttgttactttaatatttgggtttggtgttaggttaatcctggccttgtaaaatgaattagggacaattgtctccttttcctttttttttttttttttggactagcttgaggagaattggcattaattcttctttgaaagtttggtggactttggccgtgaagccgtcctgtcctggactttcctttgttgggagactttttattactactttgatcttttcagtttttaatggtctgtttaggttgtctaaatattttttcttgattcaatcttagtaggatgtatgtgtctaggaatttgtggattttctctatgttttccagtttgttagtgtatagttatttataataatctttgataatcttttgtatttctgtggtatcagttgtaacgtgtccttttacatttctgattttgttgatttgggttttctaatttttttttgttgttgttgcttaatctagcaagtggtttattggtagaccacatcttttcatgttgatcctttgtattttttttttccacctctatttcatttagttctgcttttatctttattatttatcttcttctagtaattttgagtttggtttattcttacttttctaattctttgaggtgcatcattagttcattttaaacctttctgcttttttgacgtgggtacttattgctgtaaacttccttcttagcattgcttttgctgtatccaatagcttttagtatgttatgttttgattttcatttgtttcaaaaagtttttttattttctctttaatttattctttaatcctttgatcatttaggaacatgtttttaaatttgcatgtatttgtacagtttccaaagttcctcttttcattgatttctagttttatttcattgtggtttcacaaggcatgattttgatttttaaattttttttgaagtttttttattattatactttaagttctaggacacatgtgtacaacttgcaggtttgttatatatgtatacatgtgccatgttggtgtgctgcacccattaactcatcatttacattaggtatatctcctaatgctatccctccctgctccccccaccccacgacaggccttggtgtgatgtttcccttcctgtgtccaagtgttctcattgttcaattcccacctatgagtgagaacacgcagtgtttggttttctgtccttgcgatagtttgctgagaatgatggtttccagcttcatccatgtccctacaaaggacatgaactcatcattttttattgctgcatagtatgctatggtgtatatgtgccacattttcttaatccagtctatcattgatggacatttgggttggtcccaagtctttgctattgtgaatagtgccgcaataaacatacgtgtgcatgtgtctttatagcagcatgatttataatcctttaggtatatacccagtaatggaatggctgggtcaaatggtatttctagttctagatccttgagggatcgccacactgtcttccacaatggttgaactagtttacagtcccaccaacagtgtaaaagcattcctatttctccacattctctccagcacctgttgtttcctgactttttaatgatcgccattctaactggtgtgagatggtatctcattgtggttttgatttgcatttctctgatggccagtgatgatgagcattttttcatgtgtctgttgactgcctaaatgtcttcttttgagaagtgtctgttcatatccttcgcccactttttgatggggttgtttttttcttgtaaatttgttggagttctttgtagattctggatattagccctttgccagatgagtacattgcaaaaactttctcccattctgtaggttgcctgttcactttgatggtagtttcttttgctgtgcagaagctgtttagttagatcccatttgtcaattttggcttttgttgccattgcttttggtgttttagacatgaagtccttgcccatgcctgtgtcctgaatggtattgcctaggttttcttctagggtttttatagttttaggtccaacatttaagtctttaattcatcttgaattaatttttgtataaggtgtaaggaagggatccagtttcagccttctacatatggctagccagttttcccagaaccatttattaaatagggaatcctttccccattaattgtttttgtcaggtttgtcaaagatcagatggctgtagatgtgtgatattatttctgagggctctgctctgttccattgatctatatctctgttttggtacctgtaccatgctgttttggttactgtagccttgtagtatagttggaagtcaggtagcatgatgcctccagctttgttcttttggcttaggattgtcttggcaatgtgggctcttttttggttccatatgaactttaaagtagtttttttccaattctgtgaagaaagtcattggtagcttgatggggatggcattgaatctataaattacctttggcagtatggccattttcacgatgttgattctccctgtccacgagcatggaatgttcttccatttgtttgtgtcctcttttatttcattgagcagtggtttgtagttctccttgaagaggtccttcacatcccttgtaagttggattcctaggtattttattccctttgaagcagttgtgaatgggagttcactcatgatttggctctgtgtttgtctattattggtgtataagaatgcttgtgatttttgcacatgattttgtatcctgagactttgctgaagttgcttatcagcttaaggagattttgggctgagatgatggggttttctaaatatacaatcatgtcatctgcaaacagggacaatttgacttcctcttttcctaattgaataccctctatttctttctcctgcctgattgccctggccagaacttccaacactatgttgaataagagtggtgagagagggcatccctgtcttgtgcccgttttcaaagggaatgcttccagtttttgcccattcaatatcatattggctgtgggtttgtcataaatacttcttattattttgagatacatcccatcaataccgaatttattgagattttttttagcatgaagggctgttgaattttgtcaaaggccttttctgcatctattgagataatcatgtggtttttgtctttggttctgtttatatgctggattacgcttattgatttgcatatgttgaactagccttgcatctcagggatgaagcccacttgatcatggtggataagctttttgatgtgttgctggattcggtttgccaggattttattgaggatttttgcattgatattcatcagagatattggtctaaaattctctttttttgttgtgtctctgccaggctttggtatcaggatgatgctggcctcataaaatgagttagggaggattccctctttttctattggttggaatagtttcagaaggaatggtaccagctcctccttatacctctggtagaattcggctgtgaatgtgtctggtcctggacattttttggttggtaagctattaattattgcctcaatttcagagcctggtctattcagggattcaacttcttcctggtttagtcttgggagggtgtatgtgtccaggaatttatccatttcttctagattttctagtttatttgcgtagagatgtttatagtattttctgatggtagtttgtatttctttgggatcggtggtgatatcccctttatcattttttattgcatctatttgattcttctctcttttcttcttcattagacttgctagcggtctatcaattttgttgattttttcaaaaatccagctcctgctcctggattcattgatttttttgaagggttttttgtgtctctatctccttcagttctgctctgatcttagttatttcttgtcttctgctagcttttgaatgtgtttgctcttgcttctctagttcttttaattgtgatgttagggtgtcaattttagatcttttctgctttctgttgtgggcatttagtgctataaatttccctctacacaatgctttgaatgtgtcccagagattgtgtgtctttgttctcattggtttcaagaacatctttatttctgccttcatttcgttatgtacccagtagtcattcaggagcaagttgttcagtttccatgtagttgagcagttttgagtgagtttcctaatcctgagttctagtttgattgcactgtggtctgagagacagcttgttataacttctgttctttcacatttgctgaggagtgctttacttccaactatgtggtcaattttggaataagtgcgatgtggtgctgagaagaatgtatcttctgtcgaattggggtggagagttctgtagatgtctattaggtccgcttggtgcagagctgagttcaattcctggatatcgttgttaaccttctgtctcattgatctgtctaatattgacagtggggtgttaaagtctcccattattattgtgtgggagtctaagtctctttgtaagtctctaaggacatgctttatgaatctgggtgttcctgtattgggtgcatataaatttaggatagttagctcttcttgttgaattgatccctttaccattatgtaatggtaaaggataccattcttcgaagaagaaaggtagcttctttgtctcttttgatctttgttggtttaaagtctgttttatcagagaaaaagaattgcaacccctgcccttttttgttttccttgagttttcttttgtgtcctaacatatagtctatcctggagaacattttatgtgctgatgagaagatgtgtattttgtagctgttgattgaaatgttctgtaaatgtctgctaggtccatttggtctaatgtgcagtttaaatccaatgtttctttttctgtctggatgatctgtctaatgctgagagtagggtgttgaagtccccaactgttattttattggatcaaataacactggtgccaagaaacggtgccagggagcccaagacaggcactcttagactgccactgtcacccctacggcccaaagattggcccagggccaatttctccctttaaatgtattaatttcttcctttaaatgtaataatgtttgctttatatgtctaggtgctccagtgatggctacatatttgtttagaattgttatatccttttgctgaattgatccctctatcattataaaatgaccttctttgtctctctttattgtttttgacttaacatctgttttatctaattagagttactcttgctcttttctagtttctgttttaatggattttttttctatccctttattttcagcctctatatgtctttacaggtggtatgagtttcctgcagttggatcatgtttttctttttttttctttttaaaaaatccattcagtcagtctgtgttttttaagtggaaggtttaatttgtttacaatcaaggtttctattgatatatggggacttaattatacttaatttttttgtgtataaaatgagaaggttgtcttaataataacaaagttactattatgaagcatttattatagtattaaatattaagcattttacttagaatctcattttatatttagaaaaatcttatattctaggtggaagctccacaattaaactgaagcttagagaaattaggtaagtttgcccaaggtttcacagctagtaagtaggaaagctagatttgactgcatagctcatgctgttactcctttacagcttaaggtgcttttcattcatccatccattgattgattgattccataagtgtatactgaggctaatcattagtaattgttggctatgttaagtacttttcattgtattttattatgatgggaagtcactgaaggattattagtaggggaatgataggagtagaattatgtttttaatcattctggttgcattctggatagttgaatgttataggaaagggataagtatggaaataagaagaccaggttttagactattgcagtagtccagttgagagtgggtggtggcttggactgaaatggtagttgtagagacagggatcagtggttggggtatcgtggggtgctagaatttaaaaattcttataattagtaagatacagaccagacaccaatcaaaatggatggtggccattggactagagtaagatcttgatgtgccgtgttgtgccaggcattacccctctagttatctattgtagggaggtttgaattatctcaagtgaggagtcaggggaacagggacagcaagactgataacgtgcgatgctgaggtacatctacttaccaacagtcattgaaacttttatactttaacatgtggaaagactgtaatccctgcatacctaattaatattcagtttgtttgtgggttggttgtatggggtgctggagaaagaggcaacttaagaatggcaccaaagtttttgccctgagcaactggatgaatggaagtgccgtttactcagctggcaaacactgctgaaggaattggtttgggaggaaacgatcaaggttttagttttatacatgtgaagtttgagatgaccctctatagatatccaagtggaaatgtaaagtagtagtttgaattcatgagagattgtggggctggacatatacatttgggatatatcagagcacaattctactctgtatgattatgtagtagctttttcccttaaaaaatctctcagcagcccgacactaatgcttaaagttacagtgttagaaattcatttatactctttggttttttaaaactgtgcataacctgcggagaagattctttttgaaattgcactataaggtgaatttgtttattacaccctttaaaaaacagctgagatatactaccttgagaaattgtcatactgattgagaaaagtaatgcagagagagttatggggatatattgcatgagatactaaagtatgaagtggtagaataatttttatggatatatttttataaaaaaggagtcttgcacatatagtatgttcttattcataagtgggggctaaaaaagttgatgtcatggaggtagagtagaatgatggttaccagaggctgggaaaggtttcggggagagagggatgacgagaggttggataatgtatacaaaaatatagtcagacagaggtaatatgttctagtacaataacatagtagggtgactatagttaataatttattatatatttcatagctagaatatttggaatgtttacaacacaaatgtgttcgaggcaacagatatcctaattaccttgttttggtcattacacattgtatacatgtatcaaaatattacatgtagaccataaatgtgtataattgttcagtatcagaaaaaaaattttaaaaagtggactcttgcttagatgtccttaagtgtagatattagtattagctgtttaatgggtggggaagtctttttgtcgttgtttgtgttttaaattaatattcagttaattagtatacattttaagtcattttggttatagaatacagaaagcttcaaattaagacatctaatttttttcttaaatctttgaattatatttataaatcttgtcattctatttataaatggattaatttagagtaaaataaagacaacatatagattgggctacagacctataacatcctggaactgcattccctgcattcttgcctccttgcctgttcctctatcttcagatccgggactgcagcatcttgctttgatagtcacattgcttccttctgcagtcaaatctccctctcttataaggacacctgtaattatatttagagccaatttagataattcacgataatctctcccaaatttcaaaatccttaatttaatacatctgtaaagttccttttgccatataaggtaaaatccaaagcttctggtggttaagacctggatacctttgagggctattattcagtccactggaaacttgttctgcagtattttgctttaatgcagatttgataaatatattggtgatttaaaaatgtacccaattttcaagatttttttcatgccagtgttctctatcaaactcttttccaagtaatacccacatattacttggctgctttcaactctgtgcctttgggtggtggcctgtttttaatgttttatttagaaataattttaaagttttagaaaagttatacaagaataagaatagtacaaagactatctgaatgtccgtttcccagattcacctattaacattttactctattttctttggtataactgacttacatgttaaaataaatctatatttccttttatgaaaatagatacaacatttataccaatagatgcattatatataatttctatatgatttcatgtcttttcagttaaattagaggttggcaaacttttctgtaaaaggccaggtagtaaatactttttctttgcaagttacatggctctgttgcaaccactcagctctgctaaagcagccatagacaatacttaactgaatgaacatggctgtgttttaataaaactattaaatgatttctaagttactgtaattaaattaaaaaagaggttcctttaatatctctgattactaaggaatagttcacagtcttttctcactcagaaataatagttttctatagctgatttaaaatattatcattatcaaagagataatctgagatacttcctagtttgtacctgaaaaatacagagccatacaatgtaagcattgaaaaaaatcttgaagatgaatcaattaatacctgggtgagtgaacacatgaagacatgaaaactgtatgggtcaatatttcttaaatcagactctgcttgggagttttaaaattttgttattaaatgacaatctaaaactttttgatataagcaaattgaagattaactgcctgatctcataattgagtaatgccactgtattgtaatgccagcagttgtgttgacaatttaaagttgggattaagtagtatccctttaattactgtaggctaaaaacaatacaactaaagtgtactaatacttttgtgacaagtgaagggtaaatgattatatgccatagtatatgaatttaaaagatttgtaaaaagtaggttgaagaaaaatggtgggagaattatgttgtcaaaataatgtaggtgtgctaaaattatgtaaaaaaggcattatgagaattaatatcatttttaacttgggacccattattttaaacaaaacaatattatcatattcagtaaatattagttttataaatttacttatatataatttataaatgtatgtttgttttatgcttataaaagaaatttaaacataggagtttatgtctagtatttgagaattttttagtttcattaaaattaaaatactttgtgagccctaaagtttgatgaaaatatattccctttaggagaattccttctattatgtttgagaaacactgatggggaaaccaagacttatgagtaacatcatgaatatggaaaggaaaaggctgtgttttcaactttatagtatttgaaattattctgcactaatttaataatttttattttatgatgcataatttttttttctttttgaggactccactgaagcaaactttggttgtccttaataatgctaaaaaaaatgtaatcttttttatgtttgtttaatagttaataatttttaaactttaatttttaaatgcttttacttccactattttaaaaaaataaatatttattataacccttggtggtagattattatatccatttgtgtagatggaggcttgatgatgaaagaggtaaacatacttccctgacagaactgatatttgagtacattgttttctattttaatactcttgtagcatactaaaataaatctgacattttatattatttaaataattctttaaaattgtgaaatttatttgaacatccaagtccgattgtgagtatatgacttttttcgcctctaagcattacattttctgtgagtattattcttgtaagttatatttcagataatttatgtatatatttgttaatatgataaacattgaattcttaaattctcttaatccatatgttgtatttctataatctgagggctttgtttaatctagtgtgttgtttcattttttttttaataggtcctgattgttctttgaatgttccctctactgagtcttactggattctgccaaacgttaaacccttcagtccttctgtaggtcgggcttcacataaagcagttttacacgggaaatttatgtgggtgattggtggatatacttttaactacagttcttttcaaatggtcctaaagtaagtatttattttcagattcttgctgttttttaagctggatttttatccaaaatgtcttttttttttaattgttgtccgagagtaaaagtggttatttttgtggtagtgtctatttgctagtgagactgatttgtgaatacatgaactcagtatgtccatagctgtcattgcacatagaagtatgcttcatgtagaaatgttattacttctctagagtacttttaataaattctgagtaagaaaatattaacttcaaatacaggcaggccttgcctataatggataaaatgaatcaaatgaatcatgccacctttttttttaatgaagtataatctcatatataaaaatcctctcaatttgttctgtaaattttagtgtacctgaactttactttgtatgtgctttacaaactttcattgggagaacagttctagtattatgagagagatgattgatttactgttggctcaatagagattgttctctgcatgattggataaggggaatcatatggatggcagctttatctgatttctttttcagctaatgattgtattttatgaactgtttagtaacaatacaaaaggaaatagggagaatcatttgatttttaatgttgcttccaggggtagtgttcatattatgtaataactggtacagcttgggcatcaaacaatcagaacttgccctggacagtatggcataatggtgtatacacaatagaattgccagatttagcagataaatatacaggatacccagttaaacttgaatttcagataaaaaacaagtacatttttagtataagaaggcccttttgctgtatatatatatattttttacaaattttgcatgggtcattctttaacaaaaaattgtttgttgtttatctgaattcaaatttaactgggtatcttgtattttatctgccaaccctaaccactgaatatattaaccctcataattaggaagatttcagaaattctgtaagaggagattgctttaaaactatgattgaatgcgactgaaattaaattagaaaatcgaataaattctggagagaaggagggagttttatgtaagtatttaagtggcaaattagaattttttaacatgaagaataaaatacagaaggaagaattgaaagagagttggtgggattaaaatgaattgttaagataaaaacctggagaaataatgatatttaaatgtgaaaattaaaaggaaattaactatgtttaaagaaaatgagaagtctatgaaagtagagtcgaactttgaattaaattgtgatatttccaaagtcgagtttgtaagacaaagagcaacattgtcaacaaggaagtttgtaaattttaagttcatgttctttgcaagatgagtagcatatcaaaaattaaatgatgaatattatttgctattcttttaaatttgcatattttccattggaaccagataaactatttaagccaacttttttttgtctgaaatctgagtattttggttacagtgtttatataaacaaatgagggattagagtagaataattgtgttgctgttttcacaggttagagaatacttttcatcattctgaatgtagttcaattgtaggtaaggataacagctttcagaagtgataggataagtcataacttgatttaatcatcttctatagtggaatttaattggggtggaaatgttacattttaagacaaattattcactaaatataaaagctctgtgttagtgtctattaaattagaaagacttttacagaatatatatacattaacattaatgaaaattaacatgtattcatgaggatagcaaacttttgaaaacactacgtgcttgtttcttgggatatatcattggatataacaaatgcccgtgtctttgtaaagttagggaggaaaggctggcaatgacaaaaaaaaaaacactattaccaaagtaaattatagacatgaacatatatacatatagagacagatgggatggatggatggatagatatagatagatagtaggagtaggtaaatcaggagtgccaaagaagagggagttgcaattataaatgtaatagttaaggtaggcttcataacaaaggtgagaactgagcaaaaacttgaaggagatcagaggattgcagttatttgtaggcgcagaaaagagccagatcaaagacttaagataggaactccttgaggtgtttgaggagcaacaaccaggcccatgcaatttgcatggaatatatgagagggatacattaaattagagtgataacagaggagagagacagatcatgtaggatgttgtagatcttttgggagtcatgggagggttttgagcatgtgttgatccatattttaaaagtgttaccatggcggtttattgatgatatactggggattaggaggaagattagaaacgggatttgagttaagatgaaattatcaagggaatgcattctagatagagaaaaggaccgggaactgagcctgaggcaccatatcactaagaggttgtggggaacaggggaagccatcaaaggagactgaaaaagaatgactggtgagataggaaaacctggagtacagtatcttcaaaggcaagaaaaggcattatgtgaggattaaggagtaattaataatgtcaaatgctgacgattatccaggtcaaggaaaatgaagactgaaaactggtcatggatttagcatgaggaaattgaccataacaaaagcagttttagtggaggggaggggttaaaagcgtgtctagagttagtttaagagagaatggaaagtggggtggggatgggggtaataaagaaatgggggagtagcttaagggacagtgtggtcaaggggtttttcttttattattaatggtttataacaccatgtttgtgtgctgatggcaaagatctagtaagacaaaatatggtgatgtaggaaagagatctcgtgtgcaaggaagaagaatcacttgttattcttcggcttatcaaactgcagaataggggctcagggcctggaaactaagaattttttcttagcgtttttagtttttgctttttttcttttatttgattattttattttttcttttatttcttttattttttcttttattttcttgttttattttatttgcttttttcttttatttctttttatctgtcacccaggctggagtgcagtggcgtgatcatggctcactgcagccttgagcttctgggcccaggcgatccttccacctcagcctcctgagtagctgggattataggcatgcaccactatgcctggctaatttttaaatttttttgtagaggcggggtctccctatattgccctggctagtctcttaactccagtgctcaagtgatcctcccacctcggcttctcaaagtgctgggatttcaggtgtgagctaccgtgcctggcctggattttgtacttttaatgggctgtaaaaaaatgaagaatatgtgagaccattgtggcccacaaagcctaaaatatttactgtctggccctttacagaaatagtttgtacagccctaatttatgataacttggaaagcagtgtgttggctgcagatactggtagatgggtggactagtggtgtgaatctgtggaagttatgttctgattatgtttcctcgtttgtatcatacacatttatcttacaattccaaggtaggaaataagttaaacaatgctgcaatcaaatttggtaacccttacctttcttgtgaaggggcacttgggcacttcctttcctttcctaattcattggaggaagaaagagaagttgggaagataacaattgatagcaagcttcttaaaacaggctcctgtttcttggctggatgcttccttttgtatattttagcaaatggaggaaatttgagcatagagtataagcatttgggatttataatttgggacttcagttttcatatgtattacaccagtagaaaaaaatacgaattttcttttcatgttacataatccaacagtgacttatttttatagaagcttctctactgccaaattcattttatacagtcttaaaaaattatcagtaaacaagctatatttgtgcataggaaataaatgcttattggttaatttatataatgctaagataagtgtgtgggtatgtaaagtagcacagtcattatggtaaacagtgcggaggttcctcaaactgaaaatagaattactatatgatccagcaaacccactgctagatatgtagccaaaagaaagtaaatcagtatatcaaagcgatatctgcactctcagatttattgcagcactatttacaatagccataatatggactcaacatgtgtccatcaactgataaattgataaagaaaatgtggtatatatacacaatggagtattgtttagtccccctaaaatgaaatcatgtcatttgcagcaatatggatggaacaggaagtcattataagtgaaataaaccaggcacagagagacaaatattgcatgtcttcactcaaatgtcagagctataaaagttgatttcatataggtggagagtagaatggtggctaccacagcatgagaagagaagcagggagaaggggacaaagagaagttggttaatgagtgccaaaaagcaattagatagaaggaataagttgtagtatttgatagtaaagtagggaaattatagttaacaatttattgtatatttcaaaatagctagaagagaagaaatgttatgctcccaacacaaagaagagataagtgtttgaggtaatagatattctaattaccttgatttgatcattacacattctatacatatatcaaaataccatgtgtataccatatatgtacaacttaaatatcaataaaaaacttataagtatcaggccaactaaaaaaaaggaataaaaataaatacctaaaacaaaatggagagaattttcatctgtttccaagaaggaaacctggcttaaaaaaaaattaaaaaatacagtcaaatcactattgtttagcttaatcaattgatggaaattattaaaggcaattggacaattaattccagtaataaatatcctaatcaagttaatgtatattatacattcaggagactgaatcctaatttagtgtaggtatatcttgaatgagtctttattagaaatttctaatatggcacatgaaattatgagtttattagttgtaactctttttgaatttaatgaatacttggacacaagtgaataaaaagcacgtgaaaattaaaaaaacaaaaatgaatcttagcttatgaagttattttcttttcttgcttttagttacaatttagaaagcagtatatggaatgtaggaactccatcaaggggacctctccagagatatggacactctcttgctttatatcaggtatggctcctgctttttaaattttaatcagattttgtttttgatagtttaccacaggctaaaaaatactaaatctcagatttatttcaaatatttaatgagaacaatagattatatggatcatgataacttgagataccacatactcttatgcttttagtaaaagaatagattttagaacaatcccccacatgacatgtaaagaaatgaagattgagtttttgtctatttatgcctagtcaatcacttaaaaaaattatggcgaaatacatgtaacataaaatttaccattttaactatttttaagtatagagttcagtggcattaagtacattgacattgctgtgtaaccatggctaccattatcttcagaacatttttcatcgggcaaaactgaagcaataacttctcattcccctcttcccttatcctcttgaaaccaccaatctacttttctgtctctgtgaatttaactgctctaggtacctcatgtaaatgggattgtacattatttgtccttttatgactgatttgtgtcccttagcacactatcttcaaggatcatccatgttgtatcatgtgtcagaatgtccttccttttgaagctgagtaaatattccattatatgtatataccacattttgtttatccatccatctgttgatggacacttagatagcttccatcttttggccattgtgaataatgtttctatgaacatgtgtgtacaactatctgagtctctgttttcatttttttttggtgtatacccagaagtggaattgctaaatcgtatggtaattctatgtttaattttttttttttttagcactgccatagtgttttccactatggctgcaccattttacatttccaccagcagtgcacaagggttccagtttgtccacagccttgtcaacacttgttattttctgtttttgtttttttgataattgacctaatgagtatctcactgtgattttgatttgcatttctctaatgattaatgatgttaaatatcttttcaagtgcttattggctatttgtatatcctctttggagaaatgtctattcaggtctttagccagttttgaattgggttgttttgtttggttgttgagttggaggagctctttatatattatggtattaacaccttatcagaatatgatttccagatattttccccctttatgggctgtcttttcactttgttgagagtgtcctttgatgcacagaatttttaattttagtttaatttaattttaattttaatttattttttcttttgttacttatgcttttgtgtcatatgcaagaaatcattgctagatccaatgtcatgaagcttttcctctatattttctcataagagttttaaagttttagttcttaggtttaagtttttgttgcattttgagttaattgtgtctgatgtaagggtccattttcattcctttgcacgtggatagccagtttccccaacatcgtttgttaaaaaagaaactgtctttttcccattaaatggtcttggcaccctagctgaaagtcctttgaccatgtatatgagggtttttttttctggactctctattttattctattgatctatatgtctgtctttatgctagtaccgtactatttagattactgtagctttttaataagttttgaagttaagaagtgtgatacttcctactttgtttttatttctcaagattgttttggctattcagggtcccttgaaagtctatatgaattttaggattaagtcttctatttctgcaaaaatgttggggttttgacagggattgtattgacattagttatttttatgtatttgtgggattcataaatttagcatgattaaaatgacaggacacttgtttggttttcattttgaatcaacaaaatttcatgtattttgtggcctttggctaggctgtctaaatatgaatttatatgttttctgtgctgttgttaaaaaaaattggaaagcatgggagcagtataaagaacaaactaccacctgtttatccatgcatttgtgtgttttaaaagtaaaataaaagtatttctatgtatgaaaacatatacctacattttttgccttgttttattttttctttatttccctttttgtaacagccttactgagatataattgatataccatacatttcactcatttaaagtgtacaattcagtggtttttagtatattcagagttgtgcaaccatctattgcagatttatgtaagattacagagttgtgtaatcacttttagaatactttcattacttcacaaagaaactttgtatcctttcggtatcaccccacacttcctcgtcttccctagccttaagcagtcacaaagctactttctttctctatatattggtccatgctggacatttcatataaatgaagtcatatactatgtatgttatgactaccatatttcacttagcataatttcaaggtttatccatgttgtagaatgtatcagtacttcttcattcctttttatggctaaataatattacattttatggaaatataccgtgttgtttattcatcggttgaggacatttgagttgtttccaccttttggctattatgaataatgctactaacaacattgctgtttaagattttgtctggacatatgttttcatttcttttgggtatatacataggggtggacttactgggtcaaattcactttttgaagaactgacagaatgttttccaaagttgctgcatcattttacattcccaccagccatgtatgagggtttctatttctatacatccttgccaacacttattagtatctgcctttttgattattgccatcctagtgggttgaagtattatctcattgtggttttgatttgtatttccctgttaactaatgatgttgagcatctttttgtgtgcttttggccatttgtatattgtctttggagaaatgtctattcaagtcctttgcttattttaaaattaagttgtccttttattattgagttgtaagaattcttcatatgttctagatacaagccattatcaggtaaataatttgcaaatattttcacccatttcgtgtgctgttttcactttcttgatgttatctttttaaacacaaaaaattggactttatcttgataaagtccaatttaactttttttccttttattgcttgtgatttggtgtcatatttaataattcattgccaaatctcaggtcataaagacttaacccaattttttttttcttttaagagttttatagttttgattcttgcatttagttctttgacctattttgagttaagttttgtatatagtatgcagtaagggtgcaagttctttttttttttttttgcatgtgactatccagttctcctagcaccatttgttcacaagacattttcttttgtctttgaatggtcttggtactcttgtcaaaaatcaattggccatagatgtgtgggtttatttctggactctcagttctattccattgatttatcccagtatcactctgttttgattacttttttttttttttttttgagacagagtcttgctctgtcacccaggctggagtgcagtagtgtaatcttggctcactgcaacctccacttcctgggttcaagcgattgtcctgcctcagcctcctgagtagctgggattacaggcgcctgccaccatgcccagctaatttttttatagttttagtagagatggggtttcaccatgttggccaggctggttttgaactcctgacctcaagtgatccactcgcctcggactttcaaagtgctgggattacagtcatgagccaccatgcccaacctatcttgattacttttgctttgcagtaagtttttgagaagtgggagtactccagttttgttcttttacaagattgttctgatgttctgcatcccttgcaatttcatatgaattttggaatcaatttgtcagtttctacaaagaagccagctgagattttgatagggatcatgttgaatctgtagatcaatttggagagtattatcctcttaatcaatttggagagtattatcttaacaatgttaagtcttcagacccataaacatgggatgtcttttcatttatttatatcttttaaaaatttatttaaacaatgttttgtaattttcagagtataaggtttggacttcctttattaaatttattcataagtattttattcttttagatgcttttgtcaatgtaattattttcccaatttcatttttggggtgttcattacaagtgtatggaaatacaatttactttttgtacattgatcttatgttctgtaatattgctgattcatttattagctctaagtgctttttaaaaaaatttttaggactttctatataccagattgcatcatctgcaaatagaaatattttacttcttctttccaatctggatgtctttatttagtttttgctctagctggaacatccactacaatgttgaatataagtggcaaaagcaggcatgcttatcttgttcctgaccttagggaaatgtatctagtctttcactgttaggtataatgttagctgtgagtttccttaaatatcttttgtcaggttggaaaaatttttttctatttctagtttgttgaaataatgataatttacatcatttatgtaccatttatttccatcatatgcatttgaaataatttgtataatttaaaagttctacaaggatttaccaaaggtgaactgaaggcatgtggtgtctgtctatagccattagaaatggtaacagaggtgtactctacatgatgcacaaatgtgatatgtctttttggtgaagagcacgtgatgaaaacagtaaataactgagaatagcacaaagctactagggactcagatgattcaaatattgaagactatgagtaatattaatcaacaacttagtttgttatcttcagttatatgggaggagtacattattctttgttataggactacctcacccttaaattgtaagttctttattagcttattgcattttccattcttaaagcagtagtttagtgttctcttactgtatgacaattaaaagtatacttaattgactacataatgtgatagttaaaaaatatatttaaagtagctttttgaaagctttgctgtttccccccctttttgtatataaaagcattagttgtcattattcatgtgttctcattactttttacaaatgagaacaatgccttatgcatgttgtgaacaattactaaaattttatgtaaatttaacctttatttttaattaatatgtgttaagatataacattattttatctattaatatatgtattttaatttacaggaaaacatctttatgtatggaggcagaattgaaacaaatgatggcaatgtcacagatgaattatgggtttttaacatacatagtcagtcatggagtacaaaaactcctactgttcttggacatggtcagcagtatgctgtggagggacattcagcacatattatggagttggatagtagagatgttgtcatgatcataatatttggatattctgcaatatatggttatacaagcagcatacaggaataccatatctgtgagttacttaaaaattgtaatttctttattgattgggaatgtttttctctaataaaatcttcatatgaatttagtcaaaatggtgagttatttgagattgaaattataagctgataattaataatttttaatataagcttttttgattatgttagattttgtcctttaatatttaagcttacctttttaaccaaatgaggggaaatattacttaatagtctcattttctaagatttgtgaattttttaaaaaaatatgtgaaattccagtaggtggtgctatttctttggattttatttatgaacgaagtactgaaactatcccagtctctttactatgcattgcatggtttcaggattttttattttttagcattctatttctaatcttactgctatatctttatgtatgtattacttctttaaagtcagcttctcaaggatagtctgctggcttctataagagattattatctgttatgtgaaggtgaaggtgtctagggcaatctacatgtgagtttttgtactatacctttactccattttgtttttctggtacttcatttttttgaattatttataacatttttaaaacagtggtaaccttctttattgtttttagtttgtttacaaatatatgccctatggtggttattcagattcaagaaaataattcttttctggctctggccagtatgatgaactcaaattcttggctcttttgtgtatggacaactatatatacaactatttagagtccttgtgcagtcttaatgagaaaactcatttgcagaccaccattagcaagagagtacttgtatgctcagaggaagactccccttcgaaatactccactgtttcccttgcagtcctttcaagtgatggctgtttttgtttacatattctcagtacagctgggtcaaaagtgggttacatatcccctttacttcttattgccatttccactctattctcaattcctcctcctttaaattgcctggctttgactcttacatcatcagaatatatcacctattacttcaccttcctgcactcatcctttgctctcagatggctgtgttttatttcttgaggaatttagcttctggcttactgtcactgtgtccagaatacataaggcaaatatttttatgttgtaaatatgcacttaagtacttctcctacctggcctgtcaatttcttgatctaccaaagattttgttttccatcctccttgagccactctctccattgttacgttctagaccttgttattccagtacaatgagtccataatttccatatgaaatatcttacttttcaagtcccactgatctctccagcttactgtttctaatgcccacactctgacaattctttgaccttaccagagcctttagtctgttgagactatcagtttttccactatctctcactctttttttgtccatatttctaaccctacctttttaatccatacttctagccctacccatacttctaaacgtacctagctttaaatttcataattactgttctcaagttgtttttttttttttatgatatccggtacttactcagctgtaagtttataattactcatgtcaagttggcccttaatgacatctggaacttctgccagtgtagcttggtctcgctcccagctctcctggatgactatttcataccttttcctctctcctcaagtttcaaacacttccttctctatcatcactcgcaattgatgaccttagttcttattttactgagaaaacagaagtaatcaggagagaatggctattgatgagaacacgttggagggtgatggttaataagcaatgctacattgaataagcttgcttacatacattattgtcataacaaactcatgacaacgttgaggcagatgtgtggctgagttattccaacttttgaaatgggcccaggagtttttaagcaagagttaacagatgttctatgtagaagggcagttttcttttctgattttgttattaatttttggttttattatagtgctcaggaaatgttggtcttatttctactttttaaatttattgaaattttctttgtgcctcagttttcacaaatatttgataggcacttgagaagaagataaatccaataatatcaaggtatggagtttgatattatttatttataaaatcgactttattgattatattgtttaggccttctgtactgacttagtattttttgttcttgatttatcttgctgtgaaagtggaagtaaaattttaaagtgttagtgtatttttcatatttctccttatatattctggaatttatgttttatagaagttgctattacaaatattaataattgttatgtgcttattgtaaattgtattacttactattataaagtggtttgtttaatgttttcttgacctgaattctacctcatctgtcgttaatattgcccttgttttgtttttttggtcagtcttttcctagtatacctttgctcatccctttattgttattattgtttagtgttttagaatcactttaaaaaaatgtatttcttgcatacgagagagttgaattttgctttgtgattcctgttttttttttgtaaattttctgtacatgtcttgtattttcaaaagtcattcttgcttttttgttgatttgtttttaattatagctcttctcacgtttagggccctccttccccttaactttattttatttttttgtggggatgggtgtggtaagttttgagatctgcttccattagtttcctctatgctacttgtttctcattgccctttcagcatttttgtggctgcttctgtttagctgttttggtttcacttgatttttgtacgttcatacctaatctagactttatgaggaattttttttttaccctcataatttctctggaaatgtaattttcttttcctttcacttcatctactttccccatgttttccttttgttttctatttcttttccagggagaatgggggagattcagaactaaactgttaccacatttgtccttgaaacacaggttttgacttttgaaattttaaaatgagtacttaacttagtctaaagttaagcaatactcttattctttgatcaacctccaatttataggatactgttttccactgttttagttatttttgttttgtttcaaacacaatgataattatatcattttataatataaataaattaaaaataaacagtaagtatatcatttatttacaggggtcagcaaaaggcatctataaatgaccagatagtaaatatcttaggctttgttggtcatacagtctctgtcacaactaattaactctgccttgtagcctgaaagttgccatagacaatagataaacaaatgggcatggttgtgttcaataaaaatttatttacaaaaacaggtggtgggctagatttagcctttgggccttactttgcctacacttgctcttaagagaaagagtatgcttctagggccctagtaaccctgatccaacttaaattaaaatttggcatatagtttttttttggacattatatatagggaaaattcatgccccaaagtagcctgatatctagtaaatggcccaaagttcccagggggaatagttgtttcgtatatgtggaaccaaggctgaaatagatgctatctatctgcctccacggagcatatttttaaaaactcactttttcattgaggatgtacactttcaatgatcttgactttacatagatactctctaatcttatacctacatgggtccaccttcaatgttggccattaaaatggaatctctaggccacctgattagtatatgtcatccttactgaatatagtttataattcacagttggcagaatatatttcgtgtgcttcatcgtttcctttattgaacgtttgtcccactcagccatcagacataatggtggttatgctttccaaggatggctaggaaagtactatgggtttattctgatcaactattagtgataaatattgatataggttgttagctgatatattaatctcctggtaggtttttgtttgatttgggataatctgattacagaatgccaattttgttttagataatctaaacatatttttatattgagtttcttttggcttattctacaaccaaaatactatgtctaaataaatttatctgcagggtatttttggcttgatttttgtcttactaactgcattacttgtcaggcatacttaagaatgtagtgtaagatgaaaatgggaagaatacatgattgatgagttttataagaataatagataaaccatgggcagtttcacattctgtgaattattgaagtacaaagcaaaacccaacaaattttttataaaattatttcttaatagaaaaattaatatcttactttacttattcctaaggcattttgaatttgctgcttacatgttgaaagtatgtggtgtcataaaataatctatagtactttcaaagaaaagagtacaaaatgatgggtaaatgtagtttaaagatgctgtcagaataattaaattcaccacactgtcttccacagtggttgaactagtttacattcccaccaacagtgtaaaagtgttcctgtttctccacatcctctccagcacctgttgtttcctgactttttaatgatcgccattctaactggtgtgagatggtatctcattgtggttttgatttgcatttctctgatggccagtgatgatgagcatttcttcatgtgtttgttggctgcataaatgtcttcttttgagaagtgtctgttcatatccttcacccactttttgatggggttgtttttttcttgtaaatttgtttgagttctttgtagattctggatattagccctttgccagatgagtagattgcaaaaattttcttccattctgtaggttgcctttcactctgatggtagtttcttttgctgtgcagaagctctttagtttaattagatcccatttgtcaattttggcttttgttgccattggtttagtgttttagacatgaagtccttgcccatgcctatgtcctgtgaattgttttggctgcatgttgtaaataaactttatggaagaaagaacagaaagaggatagttaggaagttgttaacggtaatctgggccaaaaatgatgatgagaattagtcgatctgttggattttttaaaaaagtagagccaatagtatttgctgagggtttagatgtagagtgtgagataaaagagaggaaccaagggtgattccaaaattttgggcctgagcagctggaaagatgaaattgccatcaaccgacatgtagtagattgtgaagcaggtttggggcaaaggtgttttaacgatgaggagttcagtttggacatgttatacgtgagatagccactagatgtcaaagagaaaatgtcaagcagacagttggatatatatgttgctataggtactcttttttttaaaaaatttatattctttttctaagaagttttagagcaggaattctgcagtatacctccttatgtgtacactttctagtaaagtgccatattcttactggagtcctagagagaaagatctgggctgaaggtgtaaatttgggagttcttgggagttcttaaagccaagagactagatcagatcactaatgaagtgggtgtagataaaaaggagaataaaaggattgagctatagggtccccgaataataagaggtaggggagaaaaggaagataagcaaggaagagtacggtgaagtgtaagccaagtgcagaaagaatattaagtgggaaagtaatcaacggagccacattctgctgatgcctcaagtacaatcattactaaggattgatcattgaatttagcactgtgcagtcattggtgatcttgataggaacagtttctgtgtagtgatggggtgaaagtctcacaatattggatttaatagggaatgagagaagtagaagtggaaatgatgggtggaaccagctctttcaaggaaatgtgtttgaaaaggaaagcacaaagtgagcagaaactggcaagaaacttaggatcctttttagcttggatttttacagaagcagacaatgagacaggatttcagtgaaataattctatttgggaaagtgtaggtaacactgttaggggagttgatacaaggacgagaaggcagccatttaaaggtccaggctttaattgacacataatctctgaaattttctttaactattaaccctgtcagttgtcagttgatgtgtcccatggactatgtctccaaaacctacccattcttagtagagaacctatccatttttgctagagatggggtttcgccatgcctgtctcgcactcctgacctcaagagatctgcctgttttgacgtcccaaagttctgggattacaaagtactgtgtcatccagtgtggcttgattaatatgaaaatgtttatagagataagacaacagaatacttaagaaaatagctagtgtgaagcatacacaaataaatcaggaagggagctgtgttttttttttttttttggttttgtttttttgttttttttgtttttttttttgtttttttttttttgagacagtctgactctgttgcaggggctggaatgcagtggcacgatctcagctcactgaagcctctgccacctgggttcaagtgatcctcccacctcagcctcccaagtggttgggattataggcatgcaccaccacacccagctactttttgtatttttagtagagatggggtttcgccatgcctgtcttgaactcctgagctcgagtgatctgccttcttcgacctcccaaagtgctgggactacagacatgagccaccgtgcctggccaaggacgggaaattttttgtgagaacatcctagagtacaacttctaaaagtgatgtcgggttatcaagtgcttaggtgtgacagtgacaacaagacttatattcaaaattgttggaaaaatccagaaaatgtttaatgaagaaatcagcttgcagtaaaggttccacatgcttttgtttgtcacagagtggaagtggccttcataattgtataatgatgaaaagacttcttaatccacagctttatttactgcatttttcattttctggaagtagttttattttcctctaagctcctgtgtccttttgtttttaaatgaatatgacacatgctacaatttgaatatgtcccctccaaaattcatgttgaaacctaatccccattgcggtagtattaagaggtggggctttttggtgtgtgattaagtcaggatggctctgctgtcatgagtggattagtgccttacaaaaagtgctggagggagctagctgggtcctttttgccttccatccttccaccatgtgaggacacagcattcttcccctctggaggacatagcaaacaaggcaccatctggaagcagagcgtagctctcagcagacaccaaagctgccagcaccttgattttgaaattcctagtttccagaactgttagaaataaatttccattgtttattaattacatatatgctgttttttataggtactctttttttttctaaaaaaatttatattctttttctaagaagttttagaggaggaattctgcaacatatctcctgtgtgtatactttctagtaaaggggcatatattaaatgcttgataaatatttgtggatgaataaatacgattttcatcacactttccttaaaagtgtgaatctgtttcttgactttgtttttagtatattaaccaaattatttaaattgtgtactatacgtaattattattctccttctagtggtgactcataacatgctgtgcttgatgtcctctatttgtctctccacatctaccttttatttttttccatcctgtttccatgccctctggcttccaggtaggctgagccagtggtggtagatctgatggtgggagatgagtggggttgtggtattttattccaccaactttctccctgctggataaccttgggttagttgtgttgctttattgaaggctgaactgtcaggtgtcctcatatagctattttctaggaattctggaaacactccctcctcttgcttttttaaggccaaggggtggtaaagtcttcctgttgtggtaggtctcaggatattgccctggtcatacctttataaatagcctttattagatactttataattgttttgatcatattatttatttcctgtcagcaccctggctgatatagtagctactattggctttttagagattcaaatataacttttgaccaaaatgatccttcatatgttcttattctggaagttgagaggaagaagtgtcttgtgggaggatttcacactttattagtggataaaaatgttggcagaagtataaacatttcagaatagcatggaattaggtccttcagtccatttctatgcttatttttgaatttttaaattttaatgtcacatggtcatctttaatgttgcattttctcttaatgtgaaagattaatatatttatcatctttcaagagtagctgttccagttttttaataagcagaacccttatttatgtatttcttcttatttattcaagaaaacctttttgttggatattcttttaaatttctttttgaattatgctaactcagactcaacttttttttggttattatgctatcaacgtagaagtaatcattgtcttactagcaaaatacctccaaagtgtatttgatgggaggatatttatttttttaaaagcccatttgctgtattcctttaagttttctctttaaaatcatgttaatttaaaaaaattgttgatttttttcaacttctccattattctgaaatccagaaattcttattgtatatttgtttttaaaaatagctttatcacatatacatgtgcatgtcatctggtttgcttatttttgacctttataaaaaggttgtatttatgccattttctcaggctttctttgattttgtttatcacgattattaccaagattcatccatgtcattatatattgctgcagttaacttctttatatttctgtattttatttgttgtataactctaccacaatttatttacctatttccctgcttttgagcttttggatttggtatctagtaaaatttacccacagtagccattttgagacatatcctgataaactattgcattttaagagataaagaaaaaaatccttaggattttccagcagaaagatgaaatatcttacaagggcaagagattagactagtatcagatttttcaaaagcaacctacagatcaaggcaaccatggaacaaaattttcaagacacttcagaaagtatagaccaagggttttatgtcttgccaaattgtacctcaagtgtcaaggctatcaaaaataattttgaacatagaaaaactaagttaatactgtatgtgtgtgcccttacctgagaaatttatatactagggtagaggtttgcagatgttttttggtaagggttcagatagtaaatagtttaggctttgtatcctactaaattctgttgactctgttgtcactactcagttcttccattgaaactgtatacaaacagtataaattgcataaaagggtgaatgtggctatgtccaataaaacctgatttacaaaaacaattggtggagttaatgggctgtaattttccaatccctgtcctggagaatgagcttcacctaatgaacagataaatgggaacacttcaggtaaaagattgatggaaaacatttcccatacttaattttagagctaagactaaaataaaggtaggaatatgtgtagacaactaaatgtgcaaatgttacatgttttgtccaagtagaaataatgcagttaaaaatgggagaagggagaggaaaggggaaatcagagataagaacattgacagctgcatatgtaatagataggaatcaaaagatgccatttaacacttgatattccatcaaggtctattggacccaattttaatttttagtttgttttctgagcaggcctaactatttgcgaagactattattttatacattttattctttcttagaagtctttcaaagaacaaagagaacatttacttgttaaaaaaaatcagaataaaatattctgtctgtgattaccagatgggtctgttgcattcttttaaaaatgaaagatacactgtggaatttaaatgttgttattttctgtgttctaaagcattttgctatttatcattttaggaactaattcattacttatcaattatttccaactatgctaaaaattaacaataaaacagaagttttttagaaagatgatgccacagtgaaaaaaactgtcatcctttagttgtattattgcggtgcccgaagtattttattacctttaaagaaggcatacaagaagacaaagtaccatcattgtagtccgcttttagtttttgttgaacacagttgagaatttaaaatttttcattttctgcccatactagtaaaaagttgaaagatctttcgcagtaattagacaaataagaagatgaatgcaaagagacagataagaatgcaaagagacagatggtaaccctgtaaactctggtgagtttacactaaatctcagactatggatcttcaggaaatgatatcctaaatgaattttttcaaactcttagattcagtgagtgaacaatacatttttattttttattatgtttatatgccccaacactttaaaacaaagaggtttgctatatttaaattctttttggaatttgcaaaaggtagtttttgactgacacttttttcttgtgtaaattacttatgatgtgataaagcaactaaaaggaactattgaatcatgataaatgctgattactattgttctaggtatactgaggattaaaactgacagaacagataataaaattaggtaagaaagatgagaattaagggcactatgaaagatacatacacaaaggaaaacactaacaaagatataaacgttcttacctaccaaaagaaataaaagcaaagaaatatcaaataggaaaaaactcagaaatatgcattataatacatacacacagtaattatgacataaaattctgtgacagagttgagattcaccataatatcagtacatgggaatgggattaacttgtttattaaaagaaaacatttcaacttgctgcataaaacaaaacccaaatctatgcttgatttaggagacatttacaacatattgatgcagaaacgatgaaaataaaggaacagagaaagatttcataggtgaatgattacagtaagacagggaatatcaaaacattatacaagaataccttataattactaaaacccacaattcaccacaatgatatgatatatattagaagaatattatctatacaccagacaacccagcaaccacctatagaaaacagaaaccacaggcagtgaagagaaacagtgtcacttcagtacaaaacaggtcagtcattattgtcaatacacgataggataaaaaataagaaaatatctaaaaaaatctaaacaacataactaataaagttgaagttaaggatgtatagcgaacaatacagcccgattatagagaatgttgtcttctcaaatgcacatggaaaacccacaaaaattgactgaatatatatataaaaaattagtagtttcccaagaatggaagcattgaaaataaacacctgaatattaaataaaatctttctattgggtgaatggggaaatacaaggaaaaattacagaatttctgaaaaatagtgacagtaaaagcaacacatataaagatttatgggatacatttagagcagttatcagaagtatatttataacattaaacaactctattaatatgaatgaaaataaatgcaccacattcccaattcaaaaagctagaaaaagaatagctaaaccaacaagtaaagatttttgcataactttttatataactaggaggagaataaaaataaaagctgaaattaatgatgtaagaacagaaaaacagattaatttttttgaaaaaaacagagaagccagcagctcatttaatcaagaaacaagagagcaagcacaaatacacaaaacaagaaatgacaagggagaaataatattgataggatattaaaatagtagactatcttgtacaacaatgcaattaaatttgaaaatgttgaagaaatgaattatttcatagaaagtagcaatttttcaaattgaacccagtaaatataaaaaatttgtataaagcactttccttagaaaaagtggagaaagcaccaggcctagatgataccagagagtaaatttagcaaaatcttaatagctggatagtctcaatgctatgtaggttgttttagagaatgataaaggaaggaaacttccaaatttgttttataagggaagtataacattgccacttaaacccactacacagaaatggaaaatttacatatgtatatgattaaaaatgaaataaaacctttccccgttaaatatcaacacaaaattctaaataaaatgaacactccaacacattcttttcttaatgtgtgttgagttttattaatatattttataataagcatccttggatgcctgggtatacatcccatttaataataaaatacacattaatagataattaagtataattaagtgggatatatagccaagcatctaaggatgactattatgaaatatattaataaaactcactatattagtaggtcaaaggagaaaaatgatattattttcattggtattaaaaaaatcacatttctaataacgcttgagaaaatgggaatggatggctactgtatgaacataataaatatgtttcaatcccaaagccagcatcttatacttaataagggaaataagcatttctattcacttcaagaacaaaacaagcgtgcacactatctccagtgcaagattatatatatatatacacacacataaacacacacacaactatgtatataactatatatacacaactatgtataactatatatatatatacacacaactatataactatgaagtagtaatatatatacatgtactactttttgtgtaagggaagtaaaatatagttacacatgctaatttgagcaaaaatgaacacaggaaagataaaccagaaaacaagtatgttggttatttacaaggggtggtagagaatggtatggtaaagatatgacatgaaagtatatttacctgtgtttactcttttaaaaaaatagtcttgacttagaaacattgatttttagaatcatattaatcatttacatattgaacaattaaataaaaaaggaaaggaagaaaaaaatcataaaacaatgtaagctgaaacaaatgaacccaactatgtttcaaatgaataggataatcattctgaaacgggatgaaaagaactaatgcaagtgatttttgaacacagtatttgactatgtgctctcagtcgaggtttagatgcgaagaaggactgcaaacaaatctttgaggtttgttttttgaaggtttaggtgaagcaattctgaaattattttagatatatgtttagactaaaaaataagtaaatatatttttttgggaaccaaagttcttcatgtggaagacgagaactgcagctatgaaatggggaagtcaaggaagaatcctggcctggatggattgcaattggaggtatcagtatgagtttatggttacttagataaatagatacatggatatgtagatacataaataaataagttaatacatagatgtagattcttctgaaagggcccagaagctaagacaccccagtagtagtgagcacactgagcactcgtattcccagatctggtttgtaatatttcctatggaaagaaagcagggctccttggaggagctgattctatgactgtgacaaggaaagtaaagataagccaagtacatcttgttatatcaaattaaggaagcactcaagaaaacgatgggtcatgtcaaaagaacacaggaatcaccttctaggggatcccattggtaaaacatgggacaatttgagcattaaaataatttaagaaagaaatacattaaaaactattgaaaaaataggaatgcataagcttacactgagagtagacagacaggtacaaatacagaagaagggaagcctctacataggatgcagactgtcatagctggagttgaaaaatcattttgcaaaagtcatagtaaaagttgggatgggaaagaatcatcaatggatgttaaatctgtgggggtgggtatgaaatttttttatgagatatgcacggcatttaagtctcccctacagattgctgataaggtgcgggagaaaaatcgtaactacatagtagagaaacctgtcaataacttgtctgagtgatcaaaattaacatcacaaactaaggggaattggacactgtgtgcctttgtatataatacctacagaaagagacattacgtgtggtagagttctgcaaaccagttctgtaaaagttgaaatagtaaatattttgggctttgtggactatacagtctctgtctcatctattcagttttgccaattctgccattatagggtgaaagcaagccatagataagtaactgagtgaacagaatgaagagacattttatggaaagggggaaaatattcacaaattatacatctgataagagattaatatccaaaatgtataaacaacaacttaaaacaacccgattaaaaaatgggcaaaggatctaagtagacatttctcaaagaagacatacaaatgataagaaacactggcgaggatgtggagaaaagggagccctcatacattattggtgggaatgtaaattagtacaaccatgatggagaacagttcggaggttcctcaaaaaaactaaaaatagagttaccaaatgacccagcaatcacattgctagatacatacccaaaagaaagaagatcattatagcgaagagatatctacactcccatgtttgttgcagtactattcatcatagccaagatttggaagcaatctaagtgtccatcaacaggaatggataaagaaaaaatggtccatatatacaatggagtaccattcagccataaaaaagaatgcaaccctgtcatttgcaccattgatggaactggaaatcattaagtgaaataagccaggcacagaaagaaaactgcatgttctcacttatttgtgggagctaaaaataaaaacaaactcatggagatagaaaaatgatggttactagaggctgggaagggtcgttggtggggatgtgaggatgattaatgggtgcagaaagtatatatacaatgagtaaaatcctctatttgacagcacaacagtgactatagtgaacaacagtttattttacattttaaaataatacagtagaattggattatttgtgtcaaagaaatgaatagatgtttgatgtgattattatgcattgtgtgcttgtttcaaaatatctcatgtaacccataaatatatacatctatgtgaccacaaaaattaaaaataaaaaaatttataaagcaaaacataaaaatggccaacagatgtatgaaaacatgctcaatattactagtcatcagggaaatgcaaattaaaactacaatgatctatgatctctcccctcacacctgttagaatggctgtaaaaaagacaaaagataacaagtattggtgaggatgtggaaaagagggagtacttgtacactgtttctgggaatatttttttttttttttaacaaaaatgagcagcagagtaggtatgaccccacaggacatagcttacccacccctaccttacagtattgtgactagaaatgcctaacctgaagctaatcatgaagcaatatcagacaaacttcaaataaagaatatgccatctaaaaagagggatggatagctttattcttcaaaaatatccatgttatgggagacagagaaaggttgaaaaattgttccagattaaaggaagcttacaagacatgacagctggttgttgaccactggtgcacaacatggtgacaacaaatgcatgagaactggtgatcccagactggattctatgctggatgaaaaattaaaaaatgctatgaaggacattatgtactcagttcacaaaatttaaatgtatagatacattaaagtattgtacaaatgttaaatttcttaaagttgataattgcaatatggttatgtataatagaaagagggtgcttggttttttttttttttttttttcttttttctttttttttttgagatggagtctccctctgtagcccaggctggagtgatctcggctcactgcaacctccacttcccgggttcaagtgattctcctgcctcagcctcctgagtagctgggactacaggtgcgcgccagcatgcctggttaattttttaatttttagtagagatggggtttcaccatgttaaccaggatggtcttgatctcctgatctcatgatccacccacctcggtctcccaaagtgctgggattataggcgtgagccaccgcacccagctggttcttaagaaatacacaccaaagtattaaggacagtaagaatgatgtatacaactgggagagagggagggggagggggagggggagagggagaaagggggagggagaaagggagaggaagggagagagagagggagaaagaattaatgataaacgggaaaaatattgacaattagggaatctgaatgacaggtatatgtgtatggggagttctttggctattgcacttttgaaattatttgcaaataaatgtgaaaatagaagaagtagataaatgttttttcatatttggttatgtggaatatatgtttaactgaagattttaagaattcccttgaacttgctgtggcagtaaaggaaatgtcagtttgtccttttttgttatacttagaattacggcttttagggaatctacaaatctcagaggggaattatgtggatggttttactaacttggaccataaagctcttctgggttagtcctgtgggaaatttatttcactttagtttagcaatacctcataaactttctaagaatctcaatgtgagtctcaaggtgagtataatattaatgttttgctttagtatttttcatgctttaagaattttggaggtgtagttgggaagccataattaatgtcatttaatgttaacttttttccttttgatctaaaaatcattagattttttcagaaaggtatttttttaatataaatttattgatactatgagtttctcctctgctcttaatatcacatgtttttaaaaattctgtggtgaattttaagtgtaaattggacattgatttttagcacactggtgtctgaaaatagatccataaaacagatgtattaagtggtgggaattagggatttttaataggagaaatctccagtttagaaacaattcaatcataggaatcacagaaagcaaaattttattatgtgttgcaattaggcttggcatttgtggtagagtttcatttgtgcagacctttttaggaataattaagtaaaatgaaacagtatcaatataatgagtaaaatacagttatgccatgcacaatatttcaattaatcacagactgaatatatgatggaggtctcataagattattctggaactgaaaaattcctatccctggagatgatgtagctgtcaaaatgtcatagtgcaatgcattgctcatgtgtttgtggtgatgctggtgtaaacaaacctacttcactgccagtcgtacagaagtatggcacatacaattatatatagtacataatatttgatgctgataataaacaactatgttagtgatttatgtgtttactatactttttattattttagaatatactttttctacttacaagaaaaaaaaactgtaaaatagccttaggcaggaggtattccagaagaaggcattattatcataggagatgagagctccatgcatatgaatgcccctgaagaccttccagtgggacaagatgtggaggtggaagacagtgatactgatgatcctgactttgtgtaggcctaggctaatgtgtgtgtttgtgtttttgtttttagcaaaaaattttaaaaaataaaaagtgaaaaaataggaaaaagcttatataataaggatttaaggaaaaaatttttatagctgtaaaatatgtttgtgttttaggctgttattacagaaggatcaaaaagttaaaaaattaaaaagtttataagtaaaaatttatagtgggctaaggttaatttattattgaaggaagaaaaatattttaaaaaatttagtgttgactaagtatacagtgcttataaattctacagtagtatacagtaatgtcctaggccttcacattcactcaccacttacccactgactcatccagagcaacttccagtcctgcaagcttcattcatggtaagtgtcctatacaggtataccattttttattttttacaccacacttttaccataccttttctatatgtttagatacacaaataccgttgtgttctaattacctacagtattcagtacaacaacatgctgtacgggtttttcgttcaggagcaataggctgtgtcacacagcctaggtatgtagtaggctataccatttaggtttgtagaagtatactctatgatgttcacacagtgatgaaattgcctaacagtgcatttctcagaatgtatcctcattgttaaggaacacacgactttatcattttagcaaactgctttgccattgtgacaaatgctactgttaaaattgtatacgttttttttacttactaaatgtttttagttttgctaagtgaattattaaaccatatgcttttaagctatttaggaactacaaaaatattatacatatccttgaaaatttgcactgactatattaaaaagttttagtagatgtgcattcatattcagaaaattcttatttttctgtatctgcttaacattctttcactgatggatatatcagtgccttaaaaggcagccattctattactttatatattttaaacattttatttatttggaagaaatacgcactccctataatttgtacttataacattttttatttttgattattatgggcacataatagttgtatatgtttatgagatacatgtgatgttttgatacagtcatacaatgtgtaatgatcaaatcagggtaattgggacatccatcacttcaagcctttattattttttgtgttaggaacatttcagttctacttgtttagttatttattgcttttgcatcaacctaataaaaatatacaataaattattaactgtagtcaccctattttgctaccaaatattcattctatctgtatttttgtacccattaaccagcctcactttatcccctgctctctgctacctttcctagcctctagcaactatcattccactctttatagtccataaattcaacaatttttgtcttccacatgtaagtgagaatacgtgatatttgtctttctgtgcctggcttatttcacttaacattgcccttcagtttcatccgtgttgttgcagatgacaggatttcattcttttttaatggctaaataatgttctgttgtgtatatgcatagaattttcttctcattcatctgttgatggacacttaggttgctttcgtagcttggctattgtgaatagtgctgcaataaacatgggaacgcagatatctctttgatatacagattttctttcttttggatatatgtccagcagtggtattgctggatcatgtggtagttctatttttagttttttaggaactccaaactattcttcatagtggttgtactaatttatgttctcaccggcagtgtatgaggattctcctttctccacatcctcatcagcattattgcctgtcttttggataaaagccattttaactggagtgagattgtatctcattataattttgattgtatttatctgatgattagtaagtattttttcatatacctgtttgccatttttatgttgatatgattaggctttgtgtccccacccaaatctcaattgaattgtaatccccatactctccacaatccccacgtatcaaggaatagaccaggtagaggtaattacatcatgggagcagcttcccccatgctgttctcattatagtgagtgagttctcatgagatctgatggttttataagtatttcatagttcctcctgtgttcattatcctccctgccaccctttgtagaaggtgccttccttccccttccccttccgccatgattgcaagttccctgaggcctcctcagccatgctgaactgtgagtcaattaaacccctttcctttataaattactcagtcttgggcagttctttatagcagtgtgaaaacgggctaataacatatgttgtcttttgagaaaagttctattcagatcttttgcccatttaaaaataagatctttttttccctattgagttgtttgacaactttgtatattctggttattaatcccttgtcagagggtactttgaaaatattttctctcattctgtgggttgtctcttcactgtgttgattgtttcctttgctgtgcagaagatttttttagcttgatgtgatgcctttgcccattttttgctttggttacctgtgcttttgaggtcctactcaagaaatctgcccagaccaatgtcctggagtgtttctccagtgttttcttctagtattttcatagtttcatgtgttagatgtaagtctttaatccattttgattttattttcgtatatggtgagaggtaggggtctagtttcattcttctgcctatggatatccagttttcccagaatcatttattgaagagactgtcctttccccaatgtatgttcttggcacccttgtaaaaaacgagttgactgtaaatgtgtgaatttatttctggagtctctattctgttgcattggtctatatttctgtttttatgccagtacaatgctgttttgactattatggctttgtaatataatttcaagtctggtaatgtgatgcctcctgttttgttctttttgctcaggatggctttggctattctgggtcttttgtggtttcatataaattttaggatcattctttctgtgaagaatgtcattagtattttgataggcattatgtttaatctatagaacctttgggtagtttggacattttaacaatatttttccaaatccgtttttttgtgtattctcttcaatttctttcatcagtgtcttataatttcaattgtagagatctttcacttctttggttaagttaattcccagacattttatttcacttgtagctattttaaatgggattacttttttttggtttctttttcagattgtgcactgttgccatgtaggaatgctactgtttttttgtatcttgattttgtatccctgcaacattactggatatgtttatcggttccagtagtttttggagtctttaggttttctaaatataagatcatataatctataaacaaggaaaaacttgatttctttctttctatttaggatgtcctttatttctttctcttgtctaattgctgtagctaggacttccagtactgccttgaatacaagtggtgaaaggatcctgtctttttctagatattagaggaaaggctttcagtttttccccatttattatgatactagctgtgggtttgttgtatgtggcttttaaactattgaagtatgtttcttctgtacccagttttttagtttttatagtgaaaggattttgaattattgaatgcattttggcatcaattgaaatggccgtatgatttttctcttcattctgttgacaccatcaggtactaggcttttgtttgatgggagacatttcatcagtgcatccatcttgctatgtgttattgacctactcaggttttgaatttctccatggtttaatcttggtatgttgcaagtaatgtatctgtttcttctgttttacagtgtattggcactttgtctcctaatagtctctaatgattctttgattttctgtggtatcccttgtaatgtctcctttttcatctctgattttatttatttaggtcttctttcttttttctttgtctgatttaagatttgtctatattttcatcttttcaaaaataaacttcatttcattgaccttttgtattttttattattgatttaatttctgctctgatctttattattttatttcttctactaattttgggtttggtttgctcttctctttgtgttctttaagatgtgccattaggttgtttatttgaagcttttctatttttttaatgtaaggatttattactgtaaacttccctcttagtactgcttttgctgtattctttaggttttgatctgtttgtctccattttcgtttgtttctggaaattttaaaattttcttctgaatttcttcattgaccgaagtggtttttttagaagcatttccatgagtttgtatagttttcaaagttcctcctgctattgatttctagttttattctgttgtggtcagatgagatacttgatacttgatatgattttaattgttttgaatttttgagacatgttttgtgtcctaatgaattgtctatcttggagagcattctatgtgctgaggagaagaatgtgtattgtgcagctattagatgaaatggtctgtaaatgtctatttggtctgtagtgcagattaaggtctgatctgatgtttctttgttgattttctgtctggatgatctgtccaatcctaaaaatgtgctgttgaagtcccaagatattattgttttggggtcttctctctttttagatctaataatgtttgcattatatttttggtgctccagtggtacatatagatttacaattgttctatcatcttgctgaagagactcctttatcattatgtaataaccttgtctctttttgcagtttttttctcttgaaacctatttatgtgatacaagtatagctactccttcttgctttttttttgtttgtttgttgccattggcatggaatatcttttttcatccctttattttaggtctgtgtgtctttatgggtgaagtgtttcttctaggcagcatgtagtggggtcttattttttatccattcttctatgtcttttgtttggagaatttagtccgtttacattcaatattattattgattcgtaagaacttattactgccattttgttgtttgttttctggtcattttgttggtctttcttttttccttctgaattcctttgtataaaagtgatttttttttctggtagtatattttaatttcttgctttttattttttgtatatctgttttaggtttttgttttgtggttaccatgaggtttgcaaataaaatcttataaccagttattttaagctgatgacaaattaattttgattacaaggaaaagaaaaaaaacaaaacaaataagcaaataaaaaactaaaaaagctctatacattctttttggctttggactttttattgtctatatttatatctttttatacagtctacctgaaaaagttgtggtagtttttagttttgattggtttgttttttagtttttctactacagatatgagtgctttatgtatttcagttatagtattaagcgtattctctgtatgtttgtatatttactattgccagtgagttttatacctttagatgatttcctgttgtttgttaatatcctcttgtttcacattgaagaactccctttaacatttcttataagacagacatgttgttgatgaaatcctttggtttttatttttctgagaaagtatttctcctttatgtttgaaggataattttgctggatatatataactttctaggttggatgttttctttccttcagcactttgaaaatgtcatctcgctctcctggactgcaagtttcctactgagaagtctgctgccagatatgtcagggattctttataagttgtgtgcctcttttctctgctgcttttggatctgttccttatccttgacctttgagagtctgaatattatataccttgaagtaggtatatactcaaataagtatttgagtatatttgaggtatctgttggtgttttataacctcgtatctggatatttatatctttctacaagtttggaaagttctcagttattatttctttgaataaactttctagctcaatctttatttctacatactaattaaggccagtaactctttaggataacttttcatcttctttataaaccagaggttgtaaattttgatgaattaccacttattattattttaaaaaatgtctgtactttttgtattctatctaaaagacctttgccaagctcaaggtcacatttttctcatgcgttttctaggagatgttttataattttggcttttgtcctcagatatttgtgatccatttgagtgaattttcatatattgtgcgaagtaagggctgagatttttataaaaataggctgcgtccagtggctcacacctataatcccagatgctcaggagcctgaggtagggagactgctggagcccaagagttcaaggctacagtgaactatgattgtgccactgcactacagcctgtcatttagagacaggcaaaaccctgtgcctgaatgaatgaatgaatgaatgaataaatatccaattgttccagctttttccattgaattaccatggtatctgtgtagaaaaatcaattggccatatatgtgtgagccgatttttgtactctattctggtccattgatgtatattatggttattctagtatcacactctattgattactgtagctctctaaatctggcggtgtaagtcttccatctttttttccattttaaaaagttttgagctattctaggtccttcatattgcaatataaaatttagaatcaacttgtcaatttttgaaagaaggctgcaaagattttaattggggttgcattggatctagagaggggaaaattgagtctttaacaatatggagtcttgtaatgcatggacatggtatatcacttctttatttaggtctcttttgtttcagcagtattttatatttttcaatatactggtgttgtacatagtttgctaaattcctaaatatttcatatttttaatattactaaatggtatttaaaaaatttaaatttataacagctgattgctagtctatgtaaaaattcattttcaaatatgggtttggtcatgcaacgttgctaaacacacttattaatatctgtagcccattggtcaacaacttattttctatatagatgctcatgtggtgtggtaataaacattgttttactctttctttttcagtgtgtatgccttttactaattttctttgtcttgtatttttaggatcattagtacactactgagtagaagtagtgacagcagatattcctgccttttcccttattttagcagggaaatatgcagtcttagcaatgtgtttaacatgacttttatcaggttgaggaaatttacttttatttctagtttgtttagtttttttcatgaacagtgttaaatttcctcgaaatagtttttttttccacatcttttgagaaaaacttttgttttttcattttctgattttttaatatggtgaatggtattgattgacttttacatgttaaactgcaattgcattcttggataaagcttacttggtcataatatattatccttttcatatattgctgaatttcatttgctaaaatcttaaagacttctatgtctatattcataagagatattagagtatgtatttttcttgtaatatctttatatggttttgtaatctggctaatgttaaatgatttaaagcatgtttcatcttttttaagagtttatgtagaattgatattatttctgtcttaaatggttgatagaatttgatcagggaaactatctgttccaggactttgtgagaatgattttaattatgtatgtattttctttactagatatagagatatccaggttcaaattgtaacaaatgacagggttttctccctttttaaggtcaaataagattacactgtgtatatacagttgtccctcagtatatatgggggattgattccaggaccccataccaaagccagtgcagtcggcctggggaatccatatgtaggaaaaattggccctctctgtataggaaaagttggctccccctaaacacaagttttgcatcctgcaaatatggtattttctatttgcatttggttgaaagaatctatatataagtgagcccgcacgtaagtggactcataaagttcaaacccatgttattcaagcatcatcaatatgccacatgtttttcatctattcactccattggatggacacttaggttgatgagcccttaggttgattccatatcttggctattgagactaatgttacaatgaacatggaaatgcagatatctttttgacatgctgatttcatattctttagatgtatacccaatagtgaaattgctgggccatacggtagttctacttttaatttttaggaggcttcatattgttttccataatgggcgtacttcttcccaccaacagggtacaaggattcccttttctccacattcttgccaacacttgttatcttttgtctttctgataataacgattctaacagatgtgaaatgatatatcattttggttttaatttgcatttttctgatggtgagtaatgttgaacattttttcatatacctgttgggcatttgtgtatcttcttttgagaaatgtccactcatgtcctttgcccatgttttagtttggttatttgttttcttgctgttaagttctttgagttccttatatattttcatattaaccctttaacagatatatcatttgcaagtgtattttcccatttcataggttatatcttcagtttgttgattatctccttgctatgcagaagcttgtttgatgtaatatcatttgtctacttttgcttttgttacctgtgcttttggcatcatatccaataaatctttacccaatgaatgtcattaacttctcgactatgtttttttctagtagttttaccatttcgtgtcttatctttaagtctttaatccatttttagttgatttttatatatgatgtgaaatgagggtctaattttattcttctgcatgtggatatccagttttcctagaatcattaattgaagagactgtctttttcctgttatgtgtttaggcatcttcatcaaaagttaattgactataaatgtgtgaatttattttcaggtcccctgttctgtttcactggtcttgtgttagtaccatgcctgtacaatgttgttttcattactacagttttgtagtagattttgcaatcaactaatgggaggcctctggatttgttctttttgcttaaggttgccttagctctttggggctttttgtggtttcatactgattttaggatttttaaaaaattttttgtgaaaaatgtcattgagagtgtggtagggattgctctgaatctgtagatcactgtgggaagtatggatattataacaatattaatttttccagtctgtgaatgtgggatctttccatttatttgtgtctttttcaatttatttcatcaatgttttatagttttcattgtacagatctttcacctcattggttacatttatttatttatttcaagtattttcagtttttttaatgagcaataaaagaaaatgtttcggctgggtgcagtggctcctgtaatcccagcactttggaggccaagatgggcggatcacaaggtcaagagatcgagaccttccaggccaacatggtgaaaccccatctctactaaaaatacaaaaattagctggcgtagtggcacgtgcctttagtcccagctacttgggaggctgaggcaggagaatagcttgaacttgggcggtgggggttgcagtgagctgagattgcaccactgcacttcagcctggcgacagagcaagatttcatctaaaaaaaaaaattcaatagttaagcatgactgaaacttgattatatctgctttttataaaaatatcttgatatctgtgtagataatgtagggttgggattaggtacatgaatagcaacggagttgtggagacttcttagcaagctaaagtggtagtaattatgagagattctggaaatttagctacactggcattagtgggaaaatgtaaactagtttgtttgctttttcagtaaactattttcaagaattaacaggactaaaacatgagaaagaaatgtttgaatgcttctattcagaatgcttctattctttctacattaaagcaaagagacatctagaagtcatctctgtagacaggtgaacagttacattacttaatttcctctgaatcagatttgtgcttaattgctgagagggcaccatcagggagggaattcagattaatgtttgcatagggtgtgcagtggaccagagtatatttttctatgttagcaagatgaactaatctagtgattaaaaaaatacccattaaagtaagatacaaagaacaaatacagttcagttttatcacatttatttcatttctgctgaatttagatactaccaacaatttggagttagctgcagatttttaaaaatggattttttttgttacttgtttagttttttttttttaattatactttaagttttagggtacatgtgcacaatgtgcaggttagttacatatgtatacatgtgccatgctggtgtgctgcacccattaactcgtcatttagcattaggtatatctcctaatgctatcccttccccctccccccaccccacaacagtccccagagtgtgatgttccccttcctgtgtccatgtgttctcattgttcaattcccatctatgagtgagaacatgtagtgtttggttttttgtccttgtgatagtttactgagaatgatgatttccaatttcatccatgtccctacaaaggacatgaactcatccttttttatggctgcatagtattccatggtgtatatgtgccacattttcttaatccagtctatcattgttggacatttgggttggttccaagtctttgctattgtgaatagtgccgcagtaaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgttttctgactttttaatgattgccattctaactggtgtgagatggtatctcattgtggttttgatttgcatttctctgatggccagtgatgatgagcattttttcatgtgtcttttggctgcataaatgtcttcttttgagaagtgtctgttcataccctttggccactttttggtgggcttgttttttttttttttttgtaaatttgtttgagttcattgtagattctggatattagccctttgtcagatgagtaggttgtgaaaattttctcccattttataggttgcctgttcactctgatggtagtttcttttgctgtgcagaagctctttagtttaatgagatcccatttgtcaattttggcttttgttgccattgcttttggtgttttagacatgaagtccttgcccatgcctatgtcctgaatggtaaagcctaggttttcttctagggtttttatggttttaggtctaacatttaagtgtttaatccatcttgaattaatttttgtataaggtgtaaggaagggatccagtttcagctttctacatatggctagccagttttcccagcaccatttattaaatagggaatcctttccccattgctcgtttttctcaggtttgtcaaagatctgatagttgtagatatgcggcgttatttctgagggttctgttctgttccattgatctatatctctgttttggtaccagtaccatgctgttttggttactgtagccttgtagtatagtttgaagtcaggtagagtgatgcctccagctttgttcttttggcttaggattgacttggtgatgcgggctcttttttggttccatatgaactttaaagtagttttttccaattctgtgaagaaagtcattggtagcttgatggggatggcattgaacctataaattaccttgggcagtatggccattttcacgatattgattcttcccacccatgagcatggaatattcttccatctgtttgtatcctcttttatttcattgagcagtggtttgtagttctccttgaagaggtccttcacatcccttgtaagttggattcctaagtattttattctctttgaagcagttgtgaatgggagttcactcatgatttggctctctgtttgtctgttattggtgtataagaatgcttgtgatttttgtacattgattttgtatcctgagactttgctgaagttgcttatcagcttaaggagatattgggctgaggcaatggggttttctagatatacaatcatatcatctgcaaacagggacaatttgacttcctcttttcctaattgaataccctttatttgcttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacatcccatcaatacctaatttattgagagtttttagcatgaagggctgttgaattttgtcaaaggccttttctgcatctattgagataatcatgtggtttttgtctttggttctgtttacatgatggattacatttattgatttgcatatattgaaccaaccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcaggatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagagcctgttattggtctattcagagattcaacttcttcctggtttagtcttgggagagtgtatgtgtcgaggaatttatccatttcttctagattttctagtttatttgcgtaaaggtgtttgtagtattctctgatggtagtttgtatttctgtgggatcgtttattggaataagagaatagcttggtcattgtggaagtatgaaatgattgtattttaatatacagctactttgttattacaaccagaagcagggttcaaaagccctaacaatgatgaatttcttttattatggccatctacaagtataaaagttttcaaaaaagtggtaatactccaccaacaaatgtaaacaagcgaaacttcaaacctagagcagtaatagagattggtgtttgccatataagctgttgaagggaatcttttgaagacatctacaatgacttcttagagaaaaaacagaccctatgtcaggttcacagtaaataatagccccctcatgtcttaactgtctaactgaatgtttatggaaaggcaagctaggaaataagcccatgatctggtcatttcttggtacatgataaagtacaaaatgtactcttcttgagcgtttagtttacttttgagcctcttaggattcttaaaagtttaaaactagattgggccacctttttttttttttttttttttgagatggagtcttgctctgtcacccaggctagagtgtagtggcacgctcttggctcactgcaacctatgcctcctgaagtcaaacgattcttgtgcctcagcctcctgagtagctgggactgcagaagtgcaccaccatgcctggctatttttttttttttttttttttgtatttttagtagagacagggtttcactatgttggctaggctgctcttgaactcctggccccaagtgatcctcctgtcttggcctcccaaaatgctgggattacaggaatgagccaccgcacctggcctagattgggtcaactttaaaatttatcttatggttgaaattactgtatttctaaatttaaaaatatagacataatcaagtaaagaatatatagtcttattggtagattatatcttggagatataatccttgcttatttttgagtattttattttagtttttaatgttgtaaggggatcttttttggtttctttttcagatagtttcattgttagcatataaaaatgctactgatttttgtacgtttattcatatcctgcaagtttacggaatttttaaatttttttttacagatttttggtggagactttagagttttttacatataacatcatgtgatctgcaaacagaggcaacacttctttccaatttggatgtctttcatttttttcttttgcctaattcctctggctagggcttcttgtattatgttgaatagaagtggtgggaatgagcatccttgtcttgttcttaatattagaggaaaagccttcaacttttcaccactgtagtgttggatgtggacttgtcatatatggcttttattatgttgaagtacattcctttgatacctaatttgctgagagtttttatcatgaaaatatgttgaattctatcaaatgctttttctgcatctattgagatgataatagaattattgtccttcattctgttaatgtggtgtatcacattaattgatttttgcatattaacccatcattgcttctttgggatatatcccattttatcacagtgaattattcttttactgtgatcttgatttttatttgctagtgttttgttgaatatttttccttctatatttatcaggaatattggcttttatatagtgtcattgtctggctttggtattagggtaatgctggccttgagaaataattttggatatgttccctcttctattttgtggaaaagtttgaaaaggattgttgttaattcttctttagatatttggcagaattcattagcgaagctcatttgttcctgggctttctttgttgggaggtttttgattaatgattcaaaaacttgattagtgtttcaatcttatagttgtaatgctcttttaagctgataacatcttaacttagatcacataaaataactctacacttttatgccaactctacccctcatattttatgtttttggtgtgacgatttatatattttattgtatattccttagcaaattattgtagctattatttttgacacttttgtctattaacctttatactacagataacagtgattcacacaccaccattacagtattagaatattttgaattgtgtccttacttttactagtgagttttatactttcatacattttagtctctttgatagctgataggactttgcctgttttttttcaatgtggcagatgttgccttctaattgacagttttagacgatttatatttaatgtaattatcaatatgcttggatttaatcatgctgttttgatttttgccctctaattattctattagtttctttttcctcttacgatttcattttttctccattattaacttcttgagtgtaattgttgatatacttaaacttaggtctactattttattattcagttctttgtgtttcctgttttttattcttgtttcctttttcctgtattcatttggattatttgaacattttttagtattccattttaatcttatcttaatgtgatatttactattatctctttgtaatttttaagtgattgctccataaattaaaaagtaatactttttagagtgtactaagaatcaatattttgtcacatggtttggaatgcggaaaccttacctcattacaggtacctttaccttctcctttcatatgctaccatttcttgtatatttcatctacaaacattgaaaatcccataaggccatgtaaatatttttgctttcaaccatcaagcatactttaaagaactcaaaaagagaagaacagtgtattgcatttacccagaaatttaccatatctattgttatttcctcattccaagttgccttctgcttcatatcccttcatctgaagagcctcatctagcatttcttttagagcagctccactgactgtatagattatcttagtttttctgcatcttagaacgtctttatttcacacttatccgtgtaggatatttctgttgcatatagaatcccgagttataattattagcacttaaaaaatgttgggccacttctttctggcctttatggtttcttatgataaaaccatagtcatttaaattgttgttcccttatataatttgttatttttctgtagcagctttcaagatgatttcttcatttttatttttcaacagtttaattgttacatgcttggtgtggatttttttgaaaataccttgtttgtgatttgctcaggttcctgaatctttaggactattattaactacatctttttgttttgttttttcaaatggttgctgtattatttacaatatacatctttagcttatcacattctacctttaattatgttatatcacttcatatatagtgtcagaaccttaaaatagtatacctgattttttaaattgtttctcttgagctaatatcatatctatataggttataaagaacacaataaattgttctagtgtttgtttttaacagtaaattatcattttagagagataaaaatgatagatgatttatatttatccacatattaactttctcctattctctttattcatctgtataaatccaaattctgtataatattctttttttaaattatactttaagttctagggtacatgtgcacaacgtgcaggtttgttacataggtatacatgcgccatgttggtttgctgcacccatcaactcgtcatttacattaggtatttctcctaatgatatcccttctccagcccctcacctgccgacaggtcccagtgtgtgtgatgttccccaccctgtgtccatgtgttctcattgtttaactcccacctatgagtgagaacatgcggtgtttggttttctgtccttacgatagtttgctgagaatgatggtttccagcttcatccatgtccctgcaaaggacatgaactcatccttttttatggctggctagtattccatggtgtatatgtgccacattttcttaatccagtctgtcattgatggacatttgggtttgttccgagtctttgctattgtgaatagtgccacaataaacatacatgtgcatgtgtctttatagtagcatgatttataatcctttgggtatatacccagtaatgggatggctgggtcaaatggtatttctagttctagatccttgaggaatcaccacactgtcttccacaatggttgaactaatttacaatcccaccagcagtgtaaaagcattcctatttctccacatcctctccagcatctgttgtttcctgactttttaatgatcgccgttctaactggcatgagatggtatctcattgtggttttggtttgcacttctctgatgaccagtgaggataaacattttttcatatgtctgttggcaatagcaggtataattttcattcagcccaaggaattttgttgtcatctcctgtagggcaaatctctgatttttttttcttttagtctggaaatttttgtttcactttcatttttgaaaaaaaatttgctgagtgtagaattctattttgatagttttcctttgtttttaatatagaattatgggttggcagttcctccccttgcccccccacattttactagcttaaaaatgtgactccactgtcctctgacttgcaagtggtttctgatgaaaagacagctgtcattcttatctttgttcttctgcttttttgtcttcataacttcatgaaattcttggtgtgagcttctttatatttcccactcccccatcccgatcttgtgtgtattttgttgcatttctcagtttcatggaattacagattttgttaaattttggaaattatttcttcaaataatatttctgtccaccacatcactatcacatatctcaaactcttatcactctggattaggctgcttgatattgttatccaggtttttcaatctttttcatttatgtgcttcattttggacagtttatatttctttataagttcactgttcttctgtaatctctaatcttgtgctaattctgttaaatgtatttttcatttgaggcattcatttataggcattctatttcatttataggcattctattagtttctaaaatttttgctattacttgttatcatattcatgttttctgcaacattattaaacatatttgagtatatttccaatcattttttaaaacattctgttctaccacttctatcttttgttttatttctgggtctctttctattggatgattttctttttgttatgaattatatttcctttgccttctatactttttaattttttcatatgttttaggcatgtatattttaaacttattggctattagattttgttgtattcctttaaggggtgttggactttgtgctgacacacagttaaattgccttttaccagcttgaacattctgggagtttgctccttagtcttgttagagtggatccagagcaactttcagtttattgctcatttattttggtactacatctcttctcaggactctacctaatgcctcctgtagtacgaggccatttttctattgttgcttggagcacaaactgttcccagtgctgtgtaagactcaagaggtgtttactagttttttcttggtcctttccatagccttaagtagttttcccgttttgcacatgcagatcagtactcagctaaagacatgtgggacttttctgcagatctctgtgttttctgtgtgtgcaagctggtttgatttctttcttttttttattattatactttaagttctagggtacgtgatttctttaaactctaaactttgttttctcaagttagtgagatcaccactctattttggatctcactgagtttctgtttaccttacaagtaatcagggtaattcattatgaaatatagtatttcacttaaaatactacggaagcaaaaactactataaaagtaaaaaataaaaatgactcaaatataacaagagttcttcattaggccatgatggagtaatttggaaagcatttcctgccataaacaactcaaaaaccagaaaaaatatatgaaaaatgcttcacagatgttggataacaagcagaagtaaaatatttatttctctttaaagaaagagaaatatttatttcgcactaaaaagtttatttctttctctttacttcctacatcttgtgtcatggccagggtattgcctacaagcagtatgctctggcaatcatagagcctacacttgtttctgtttcttttagagtcatagtcctatgctgtcacaggatcacagtgtaatgctgcttggtatctagtatccataaagcattttttattttgtttttttttttttctggtttctgagttgtttgtggcaggaagtgttttctaaattactccatcatggcctaatgaagaattcttggtatatttgagtaatttttgctatttacttttgcagtattatcctgagttagttcatgtattcatgcatctgttttcaccactgtcttttctcattaatgacctacttttgaaccagtggtttacttttttataaattgagaatatgataaagcacactaccaaattgaaaaaaaattcacgcatatgcaaataacaacagaggataagaacatatgttttctgaggtgatctatatgttgttatcttgcatgtttattgagaccagttggttccttagagcatatatacatttccaaatgcaaaacataagaagaatataatgagaatgtgactcaaattaatcttgcttttcaaatttgtctcctgtgtgggaagacaattgtttccttttaatttttcacctgaaactactataccacttatgaattccttgcctgaactgctagtgactgaacctagagaaacattgaggtagtacaagaatgcacattttggtgttagacctgtgtcttcgctcttacaattccaaagtttttttaaaaaagtttatcaagtagttaagtgaaatactgtatttcataatgaattatgccgattactggtagctgatcactagtagtgaacattatatttttaaaataaactttttattttgagataaatgtagttacaggtatataattgtaagaaataatgaaagtgattctgtataccctttacacagttttctctcatagaaacatcttgcacaaatgtgtaacatcctaagtctagatactgacatggatataatcctatgatcttacttagaaattcccagttttatttgtatttgtttgtgtgtgtgtgtgcctatttcattctgtgcagttttatcacacatgttgatatatctcccaccacagttaagatacagagtagttcttcaccccaaagatccttctcattgcccctttaaccacacatacctcctttctaccctggctcctcacaaccaccagtttgttctccattttataattttgtgattccaagaatgttttatatatggatcatttacatttaaggtaattttgatatattagtgactaagtctgctgttttattatttgttttctgtttttttccttttcttgtgcctctttttctctttacttgcttcctgtgggttatgtgaataatttttaggattcctttttgatgcacttgtatagtgttcttaatagtatctctttgtaaaattttgatagtatcttctgtataattttcttagtggttggtctgtgtgttaaaatatatatatttgacttatcacagtctactggcaccagtaatttaccacctcaggtgagatgtggaaaccttgctttcatttacgtcactttagctttacttttctcacttttaaatatcattatcttgagtatcggatggtgttataatttttttccatcatcatatattatttataaacattcatgagaaggataatctgttgtttgtattcatgtttctgctctatttgttgtcctgacttctttttttttttttttaattatactttaagttttagggtacatgtgcacattgtgcaggttagttacatatgtatacatgtgccatgctggtgcgctgcacccacttttctgatgctccaagcttccttcctttatctttctgtttgaagaagttcttttaaccattatttaaagagagacctgctaatgacaaattctttttttttttttaatttaagaattttttccctcttaattcctgaaggatagtttcactggaggtagaattcatactttacagttctttttctctccagcatttgaaaacagttgtgctacttcttttggacctccatggtttcagatgagaagtccattattattaaaattattgtttttctaggtaatttgtcatttcactctggctgctttcaaggtttttttccttgtctttagtttttagaagtttaattatgaggtgtcttggcatggatatctttgggtttaacctatttaagatttacttagtttcttgaatctgtaagtttatgtcttttacaaaatttggaagtatttggccatcatttcttttttttttattatactttaaattttagagtacatgtgcacaatgtgcaggtttgttacatatgtatacatgtgccatgttggtgtgctgtacccattaactcgtcatttaacattagttatatctcctaatgctatccctcccccctcccctcacccacaacagtccctggtgtgtgatgttccccttcctgtgtctatgtgttctcatcgttcaattcccacctatgagtttaaaaactctgtaagccccatttctttttcttctccttttgggattatggtgctacaaatgttggatcatttgttattgtcctaagggtctctgagactctgttcactgttttctctatttttcatattggataaattttatttatttttatttttaattttttgtttatttttataattttaacttttattttagattcagggggtgaatctcaatgcaggtttgttatgtggctgtattgcatgatgctgaggtttggagtatgattgatcttgtcacacaggtgtactgagctcagtacccaatagttattcaccccttgccccactccctctctcttgataaattttattgttctgtcctcaagtttaacaattctttcctttgtcatttccactccggttttgagcctatcccgttagtttttatttgttattgtagttttttttaaacttttttttttttgctgagatatttttgtttgtttcaagataatttgtaatagtagtgaggttgcagagaaaaaggaatgcttatacactgttggtgggagtgtaagttagttcaaccattgtggaagacactgtggtatttctcaaagacctaaagatggaaataccattcaactcagcaatcccattactaggtatatatccaaagaaatatattaataaattattctattataaagacacatgcacatgtatgttcattgccagcactattcacaatagcaaagaatcaatctaaatgcccatcaatgatagactgaataaagaaaatgtcgtacatatacaccgtggaatattatgcagccacgaaaaagaaagagataatgtcttttgcagggacatggttggagctgcaggccattatccttcacagattaacacaggaacagaaaaccaaatactgcgtgttctcacttataagtgggagctaaatgatgagaacacatggacacatagagggaaaaaatgcacactggggcctattggaggtgaattgtggaaggagggagaggatcaggaaagtaactaatgggtactaggcttaatacttgggtgatgaaataatctatacaacaaacccccgtgacatagatttaccaatgtaacaaacctgcacttgtaccccaaaacttataataaaagttaaaaatagttatagttacatgttggagtatttttatcatggctactttaaaattctttttagataattttaacatctgatccattcatctcagtgttagtattacttgattgtctcttctcattcaagtcgtgatttttcttgttgtcggtatgacagggagtttttgatcatatctttacattttgggtttcatagtgggagtctctgggttctattttaaatcttttatcttagcaggtagtcacctagtttgggttttgcattcaggtcttgtggtgagatctctctttgcagtcttaggccttgtggggaaggggagtgctttccctgcatatttactgtaagtagtatttggcaggtcccttttgctagggctgccagggtcatctggttttgtccattggactcgtgttcagtttggctaaggaataagcctacccaagtaaccttttgttctaaggatgggggttgagaagtgctgggcctcagtaaccttcttctgttgggtgagtgagtgtcatgagacacacattctccagtccctagccagtctgccttcgtctttacactttagattttttctttggttgtctcttacacagtttctaaggtctgtggggggagcagggaaaaatcagtctacactatcttgttccacttattaacttttaaacttttgatgtgttattcaatttttctagctttgaatttcctaatttgtaaagaagagatagcaataatataaccctccaaagattattattaaatgagataatgagatagttactgagaactgtgctctattagagaatgatgctgctgttgattgcaaggttgtttattgcaccattgtttctaagggcaaattgaaacccaaatgagtaacaaagtagagttatttaaataaattgtatattatcaacacaatgaaatttagctcttaaaaaagtaataaatgggacacagaatgatgccccaaatgtcttgttaagtgaaacagtagttgcaacatagtatttttagtacaaatatgtacacacacacacacacacacacacacacacacatatatataaacatatctatctaaaaaacatgtacatgtgttttatgtatacgaaaatattcagaactgtagtttgaaaatagtctgtatgtaacaaattgtgaaatgtacctctaggtagtgggctgggggaaagggtaacttttacattttatacctcttaattcaatattttttggtaaggatcaagtttatctttattaaaaggaaatgaataaaactatgaaaatcttttagttcaaatatatatatatatatatagttaagtggttaaagaatattaatcaaattatttctgataagttgtcttttacttcattttttggaaattacctccaaaatgtaatgcctgttagttacatatgagttccgcaaagtttcttaacatagattaagtaccagtggcttggatgacttttttggatatttctattttttatgatcattgtagaatcattttctttactaccttagaattttgtaaatgcaaagaatttttaagcattatcattttctattagttgatttgggtattttcaatgagctgactaggatgccacattttaggtggctggttagaggaatgatggagatgtgatctatatgcatatttaaaaacaaatgacagatttttatatagctgctttttataataaattttctaaggccaagaaattgtgggcttttcgtatgcatttcttaaaagcatcccttgcatatgattggtgtttttattagtgaaactgcattgggaaatgaatctattgtagatacagcaagcagagtgggattttaatatcggaaattagttacaaaagtgttagaaggactagagataccaaagggaagggatcacccagaaatccagaagtgctacatacctaggctggagcctatgatcacatttgccactgagcaactaaacataccagttttgctactgagcagggaatacctattaagccagcactgccattacttactgtaattgccttcctgttcctgctgctagaggcaaaatcagaatctttcctcttgccctttaatctcatactagtactcccattggtggaacctaatgtaacacaattgtcaagcgagtcttggaaattttattgtttaggttttcatcctctgcaatacaaaggactttataaaaaggaaagtggggcttataaccaacaaataaaggaccagcacagtactaaaaatgtgttcaattaattttagatttctaagggtagggatcatatcattttatctttataatgtcagtgactaactgtcacatagtaggctctcaaaatatttgttaaaaatttttttcagagctatttatgtaatataagaataaagttttcctttttctcttgcaaacacataaaatgttctttttagtatttcagagtttaacttcatctatggaaagaccagtgttactcaacttcaaacccagcacctaacctggcacatacttaataagtgtttcttgattaaattaatattagatatacaatgtttactcataaaaatatgtcattagaattaacttgttggtattttggtgatatattagttatatttaaaaatactacttgaaatttataatgtattttatttctgttacagcatcaaacacttggcttgttccagaaactaaaggagctattgtacaaggtggatatggccatactagtgtgtatgatgaaataacaaagtccatttatgttcatggagggtataaagcattgccagggaacaaatatggattggttgatgatctttataaatatgaagttaacactaagacttggtgagtacacaaaataacacattttctatgttgccattattattgtaaatgattgactttaaaatggtttctgacatagaaatacttactttatatgcattcattgtaaatgctgatatcgtcttaatttcagatgagtaattttgtttaccagtatgacttcgatatcatctgttcagggatttgttcttctttgcactcatattttattgtcatctgtaaattttaaaaagcatttatttagtttcatcatctaacttcctgtgaaatacagagcttgtggcatttaggtaaattttcaccttttgttgttataaacaatgctacactgcacttcttgcactgatcttttcatgtacatatttaagagttgctctagggtgcatacttaaaagtgagatttttgtatctgagagtatttatatcctcaactttattacatgttgccgaagtgcttttcaagtcactgtggtaatgtgtatatacttccaccaacagggtatgtgtccctgatccttcatgttctcaccaacacttgaaaattgtgagaatttttacttttgccaaggtgatgggtgtgaatagtattttaatgtgcattttcctgattagtattgtaaacatcttcttatgtgttgatttcctattgtttcctgtttagtgaattgcctactcatatccataatattctctttatgtttgaaatattattaattaatttttcatttattggtttttttggttatagaagttttaaaataaaatttttgttctaatttttctttgtaaaatctgggaaatgacttttttttcttttaagacagtatacattcttttaaacttctagcattaagttactttatgtgatcaaaggaaatacacaggtttccatcaaatcatgatttgttctaccctcttcactttcatacatatatcctaatttctactttttaaaaaaatatagaattataacaccttttttcttttggtaattttgataattcttatttttagtctaataaaatgtagttttattctttatatttttatattcatttttattttgtataactcataaatagcatcttctgtacatttaatatttgtaaatttttctctgacattttgctatgttagcaagtggaattgtggtatagtgatgaaggtactatcagtctgttacacattttaaacatgtatttaatttaatttaatttatttatttgagacggagttttactcttattgcccaggctggagtgcagtggcacgatctcagctcactgccacctccacctcccacgttcaagcgattctcctgcctcagcatcctgagtagctgggattacatgcacacaccaccatgcccggctaattttttatttttagtacagatggggtttcactatgttggtaagcctggtcttgaactcctgacctcaggtgatccacccaccttgacctcccaaagtgctgggattataggtgtgagcaactgtgcctggccctaaaaatattttttcaatgctgtgtcataccaaaagggaagaataacttctgtatgaaggaggcagtatagttcacagtaataataatgggtatagcaatgctcaggtaagaagaatcttaatgaaagtgaatggataagagagcagaattggatattatttgtgtaaagtcaaaatgagagattcagttgttgctcactacttgaataaaattttgttaaattttccatgattttctacctgaaaactttacatagtgaaagttttgcctagatgaatattattgtcagccctggcaattttagtatgtgcacaaatggcactggatatttatatgtaaaacaatttactaaaataatttgtaaattattttaaacacctcattacaaatatgttgtagatgtatgatgctttaatattttaatgggtcttaaatttctttaaacacacaaagttatcagtgagcactaattgattttttcattatccttaaaatttgtagtattctttaagcttagatcttttttagcatatttgtcaagtttgctattatatatggattatgtcagtggtccccaacctttttggcaccagggactggttttgtggagacagtttttccatggacccagggaggggagatggttttggaatgattgaagtgcattatatttattgtgcactttatttctattatttttattacattataatatataatgaaacaattatacaactcaccataatgtagaataagtgagaatcctgggcttgttttcctgcaactagatggtcccattctgggggtgatgggagacagtgacaccgaaagtgttttgcctatgttcagtctactccataatctcattttggttgctgtcactgcagaaaactctgctccacgaagacaggatgctggaaatagaagcaggctttttggtgcttttgtggcaatctcaggatattctgccttgactttaactcacaatgtatagtgatttgaagttgtcttaaacatacttttaaggctactgtcatttgcgatctcatgcagttgatcctcttctagcatggacaaagtcgattcacctggcttactcgcaaatgggtcgcgtatccattccttcccagtttggggtctttttgaagttgggaagtaatgctgaaattcttttgtaagctgtaatagttgttcatgcaccagctgggagaaagatggtgctgggagaaaaaaatctcttctaatgtttgaaacatgtcagaaattcgagagtttacttgtcgcccccataattccagtttggcattgaatgcagccactttacctgccaacttgaatgcagttgttattctctcctgaagtgacagaatgagtttcttgagcaggttgaatatgtcacacaagtaagcaagttttgcaacccattctgtgtcactgaaatgtgctgccagtggtgactgtttttctaaaagaaatctctgcagtagcccttgtaagttgaaaactctgaccagtgacccacctttagaaagccacctcacttctgtgtataagagaagacatgcggccgggtacagtggctcacgcctgtaatcccaacattttgggaggccaaggtgggcagatcacgaggtcaggagttcgagaccagcctggccaatatggtgaaaccccatctctactaaaaatacaaaaattagctgggcatggtgatgtgcgcctgtagtcccaggtactcgggaggctgaggcagaagtgcttgaacccaggaggcggaggttgcagtgagctgagatcgcgccactgcactccagtctgggtgacagagtgagactccatctcaaaaaaaaaaaaaaaaaagaaaaagggatgacgtgtgtgctttgcacccatctcctcacagagctgtgtgaacagatgtgagttgagggcatgtactttaatgtggttgataattttcatcacatcttgctaaatattgttaagttcaggtgacatttttcgcctagccagcatttctctattgatgacacagtgagtagactcacattcagaagcaacctctttgacccaagcagtaaaaccagaaagctgcctagtcatggcagatactccatttgtgcgtatattgacaaaaaatgaccaattcagttttcctgatatgtaatcattcaaagatttgaatacttctgcagctgttgtgttggttgtcaacaaaagttcacataatagtctgggcatggtggctcatgcctgtgatgccagcactttgtgaggcagaggcaggtggattgcttgaacttaggagtttgagacaagcctggctaacatggtgaaaccccatctctactaaaaatacaaaagttagccaggcatgatggcacacacctgtagtcccagctacttgttggtctgaggtggaaggattgcttgaacctgggaagtggaggctgtggtgagccgagatcgtgccactgtcctccaggctgggtgacagattgagaccctgtctcaaaaaaacaaaaaagagagagagagagaaatgtgcacataacatatcctcgtgcacagcctcctgaaaaatatattgcacaaaaacaaacgttttattgtcaacatcagttgactcatcaacctggattgcttaccaaggtgacttattaattctctctaacaattgtgcctcagtatcctctgctatttcatcaattcctctagttatggtgctagctgaaagaggaacacatgtcaccttttgaactgcagtctctcctaaaagactacaaatgtcttcagcaataggcaggatcaactcttcatcaatagtaaagggcttctatggtttagcaatgctgttagctactaagaatgatgctcttagtacagacccatttgatgaagtggtggctttcaataattgcttcggctcttcgtgttcactttttttcttttgaaaaactccaaaggcttgttttttaatgcagggtgcttggtctccttgtggtgaagcagttttgaaggtttcatggtttcattggatggctggttgcaacgtattgtacaaagtggacttggagaatgtgaatcacctgttgtaatgaacccgtaatttaagtaagactcttagtattttctttgaaatgcagctttctttttgttggcagtctaagagtcttctgctatctcatcattcccccttttcaaagaagctctccagtgatgtttgttttttactcagtttggctaaggtttgtttgtgggcttaccaaaactgtaactgaaacaagtgtgcagtgtgggaaagaggtgtggacagaaatggtaaataaaataatggggggggggggcggggtcaggcagtgcccgcatggactaaaataagtattagattctgccttcaagcttgctaccagatgcgactgtaaaattgaagtacatcatctcacttgccactataaagcctgctaccagatgcagcttaattatcacttgccactcactcactgatagggttttgatatgagtctgcaagcaattgatttattgtggtccctgtgcactcaaacctctctgctaacattaatctgtatttgcagccactcccaagccctatcatcatcacctcagctccacctcagatcatcaagcattagattctcatagggacatgcaacctagatccctaacatgtgcagtttacaatagggtttgcactcctatgataatctaatgttgccactcatctgacaggaggtggagctcaggcagtaatgcgagtgatggagaatggctgtaaagacagatgaagctgtgtttcctcacttgctactcacctcctgctctgctgcctggttcctaacagggtgttgagaaccctgggattatattgtataggatgtcaccattatgtgtccattatgtatcagtattatgtatccactgtatagactgatatttattttttaccacctcagaactggtttcggtttttagtagatatggttacatagatagggcactttgttgagatactaggaaatgtgttttgaggacttattctttttcagtggtgaaatgaattcttttggactgttacttcccctgagaaaaattaggaattttatttgcctaaagcatgagagaactatcaaaaccatgagaatttgtcagagatttaggagaggtacaatgtcaagggatacaagacaggcattttgtgtaattttaaccttgagacagttagaaatcctggaaacctcctgagacactgagcagtccttttgtcagccattacagaggaacaaaattagatatccagatgtgccaaggaagaggagccttggtacatacttaaggatttagtctggcccctgagattctaaaccctactcgtgataattagcccacctttgaatcatcataatcttttattagattatggtgaaatgcccataatgtagttagatggcaacataaaaagtaaatactttattgagtgagataacatcatatggaggcttaaagtatttcttctatatatcatatacaatatctggcacaaactaaaaaaaaagctcggaagaagataagatacgaaaaaacaacatccgttagaaacatacatataggataatggagtgttttagacacaaactttaaaataattattgttatgttcaaggaattaaaatttaaggtagagaatattaggacaggcctggatactcatacttatgaatcaaatggaaattctagaactgaaaaatacattgagtaaattaagaattccttggatggaaataacagcagattagacacagctgaagggggaaatatgaaatggaagagagatcagaaggaaacatccagaaggaagtaaagaaagacaaaatgatgaccaaaaaaggacagaaagaaatacaaggaagatgtggaaattgtctaacccacatgtgtaattggaatcctaaaaagagaagagtgaagacaaatgtgtaacattattttaagtgataatgaataagaaattttcaaaagtgacaaagacatcaagccacagattaaagaagttctgtgagcaccaaggggcataagtacaaagaaactcagaaatattatagtaaaactgctgaaaaccaaaacatgaagacaaaaatttcaaagcagatagaggaaaaagggcatatttcctttaaaggaaaagcatgaagacaattaattttttaactgaggaaatgggatccagaatacatgttttcaaatagcttaaagacaataatcatccatctaaaattctacataattaaatattcttaaaaatgtaagcaaaataagagcatttttagaaaaacaatgactgagataacttgacagtagtaggctttcgataaaggaaatactaattacaataagtgctattgaagtagaagaaaaatgatcccagatactggatggaatgtaatgaaattatagagatgattctaaatgactatcatataaagctatagtaataatagtggcttgcatatacacaaaatttaaatgcatggtcctaatagcacataagtcagaaaaggggtaaattagtgttaaaaagtctgaaagttggtcgggcatggtggcttatgcctgtaatcctagcactttggagagctgaggtgggcagatcacttgaagccaggggttcaataccagcctggccaacatgctgaaaccccatctccactaaaaatacaaaaaattagccaggcatggtggcatgtgcttgtagtcccagctacttgggaggctgaggcacgagaatcacttgtacccgggaggcagaggttgcaatgagctgagatcgcatcgctggactccagcctggacgacagagactctgtctcaaaagacaaaaagaaattccagttatactaaatgtgacagattaaatattccagttaaaagccaagaatttttggattggatataaaaacaaaacttagccatctgctgcttagaaaagataaaccttaaataaaaatatttagaaaagttgaaagtaaaaggaaggcataacagttcttaatttatatataatttataacagtgttgaaataatgtaaaattgaccaaacacaagagacaaaacatagtgagatgtttttaacccaattttcttggtaactggtagtaccaggagaccaaaaaaccggcaagaacataaaacatttgaataggacaatgaacaattttgtctcacttgatatttgagagcataataccttataattgaagcatatacatggtttccaagaacaaaggaactttcccggaatttactatattctgggttttaatgcaagtcttaacaaatttaaaaggattaaaataatacaaattaattgaccacagtgaaataaaaagtaactttttggtgattacataaaaataataagaaaaaccctaatatatatgtgtatatatatttatatataacatatgtgtatttaatatatgtgtgtgtgtgtgtgtgtgtgtgtgtgtgtatatatatatatatatatatatatattttttttttttttttttttttctttgagacagactctcactccgtcacccagcctggagtgcagtgacacaatctcagctcactgcaacctctgcctctcaggttcaagcaattttcctgcctcagcctcctgagtagctgggactacaggcatgtgccaccacgcctggcaatttttttgtatttttagtacagatggggtttcaccctgttagccagggtggtctcaatctcttgacctcgtgatctgcccaccttggcctcccaaagtgctgggattacaggtgtgagccaccgcgcctggccaaaaaaccctagtataattttcatactgaaaattttcatacttaaaattactgaatgatgacacatcaaaatgcatgtgattcagctaaggaggggcacttatagatctaaatgcatttattagaaatgattttctaaaagtctgaaaatcagtagtctaagaatccccttgagaagttagaaaaagaacagcagactgatcccaagaaaggataaagaaaataaagatataataaaggaaaggaacatgagataagagcatgaattaatgaaataggaaacatgtgatagaaatgatccataaagccaccaaaactcgacaaagttggttgtttttaatagtaatagataaatccccacacagacttagaaacaaagattacttaaataatccatgccaagaatgaaaagggatatcatgacagatcacatagagattaaaagttagtaagaacatatgataagcgactctatgaccgtaaatttgaaaaagtagatgaattatgacaaatttctagaaaaacaaaacttaccagaattgacacatacatgaacattgaaataatcttatgtcaaataactagaatttttaattgaaaccttgttgcctcaaaatacagaagcatacatacagatgaacaaataaaaacaaaacaaaacaaattctccaggccgtgatcactttactggtgaattttcccaaatatttaagaaataagcatttaagaaataaataacatcaatctttcacaaactttctggaaacagaaataattatgttgagatttatgaggccagcataaccttgatataaaaatatgaaaaggatgttacaggtaaggaaaattttagtattgtcttttccatggacgattccagcaatttagaaagaaaataatagattatttgggttcattcaaagaatataatgttacttaaaatttataaaatttgaataattaagaaaatagagaagtaatggtctataatcttgaaagatgcagaaaaaattatagataaaatttatcatgtatttatgataaaacctctggtgaactaggaatggaagcaaatcatttatgtggtaaaatgtacaaggacacatgaaaactttactgcaagcattatggtgaaatagagaaagctttccctctaagattgggaatgggataagggtgctcgctgtcaccacttttattcaacattgtattggaatttccagccagtgtaataaggcagattaatataatataatataatataatataatataatataatataatataatatgtatatgggtaatcagttgctgcaaataacatcaatataaaaaattaatccagagtaattctgtataccaggaacagtttaaaactgataatttaaaaataatataatttatgtcactgtcagaacattaataacctaaggaataaatctaatgacttatgtgcaggatctttacacagaaaactataaaaccttattgtgagaaattaaataaaatttaaatatatctcagaccaaattatgacaattgtttgaaaaactcaatattatgcagatgtctattctgcccaaattgatctgtagatttaatgtgatcccaaacaaaattttagcaggtgtttttcttttggaaattgacatggtgattctaaaatttatacaaaaatgtgaagggtaatttttgtataaattttagagtctccgtgtcaatttccaaaagaaaaactttagaagaacaaagctggaggacttttctatccaaattttagaagaacaaagctggaggagttctctatcagatctcatcacttatgattttacaataattaagtgttgttgcaaagacagggaaatagactaatgcagcaaatagaattccacagacagacctatatatttatgggcacttaatctatgacaaaggtggaactacagagcagtctttcttaataaattgttctgggccaattgggtgtacaattggaaaaaatgaatattaagccctacctcacatcatcataaacaaagatctgtttcagatcaatgttagatctaaatgtggaagtacaataatattctagaagataacagaggcaaatatcttcatatttatgagtaaagaaagatttcttaaatggaatttgagtagttttattagtaaaagaaaaatgatagactgaactatatttatatgtctaaaaagtcagtaagaacacaaacatgccatgctcatggatcagaagaatcaatattgtaaaaatggctatactggccaaagcaatttacagaatcagtgctattcctatcagactaccaatgtcattcttcccagaattagaaaaaaaaaactatcctaaaattaatatataaccaaaaaagagcccgaataaccaaagcaatcctgaacaaaaagaacaaagctggaggtatcacactacctgacttcaaactgtactataaagctacagtaaccaaaacagcatgatacaggtagaaaaatggacatgtaaaccaattgaactaaatagaaaacttgaacataacgccacacacttacaatcatctgatctttgacaaggctgacaaaagcaagcaatgaggaaaggactccctattcaataaatgatgctggataactggctagccatatgccaaagattgaagctggacccctacctttcaacatatacaaaatcaactcaaaatggatcaaagattgaaatgtaaaacctcaaacaatacaaatcctaacagacaaccaaggaaataactcttcttgacattggccttgataatttttggctaagtccccaaaagtaattgcaacaaaaacaaaaattgacaagtaggacctaatcaaactacagagctcttcacagcaaaagaaaccattagcagagcaaacagacagcctacaaaatgggagaagatattctcaaactgtgcatctgacagaggcctaatatccggaatctgtagagaacttaagtccacaggcaaaagacaaataaccccattaaaaaatgggcaaaggacatgaacagacacttctcaaaagaagatatacaagtgcccaacaaacatgcaaaaatggtcaacatcactaatcattagagaaatgcaaatgaggtatcacaccagtcagaatggctatttttaaaaagtaaaacaacaacaacaacaacacagcagattcttatgagactgcagagaaaagtgaatgcttagacattgttgatgggaatgaatgtaaattatttcagccactgtggaaaatagtttggagatttcttaaagaactgagctaccatttgacccagcaatcccattactgggtatatgcacaaagggaaataaataaatcattctaccaaagagacataggcacttgtttgttcattgctgtgctattcacagtagcaaagacatggaatcaatccaggtgcccatcaatggtagattagattaagaaaatgtggtacatacataccacggaatgttatgcagtcataaagaagagtgaaatcttgtcttttgcagcaacatggatgcagttggaggccataatcctaagagaaattaatgcaggaacagaaaataaaataaatcagacataaaagaaaacagtatattcttctattgatataaagttcagcaccaggaaaaacagaattatgggcttagaagttatgatagggattgcctatgattgtgtagtatttgaatgagtagcagcaaagcttctggagtggttatgtgttcactttgtgataattcattgaactatacacttaagatttttatacttttggcatatatattatacttcataaaaatttataaaaaaatagaaatctgagttcaatttgacttcttatatgctaaaagattatgataatttgacataccaaaagagggtcaattttttatgtaaagttagcaaattacgtttttattatcagtgttagaaaagaatggagacataaaatttcagtcatttctgctatcccactccttcaggagtagttgcatctggtttcgttacatttaataagtaagagagaataaacatcttgaacttataggagttcctgttgctcaaaaatgattccttttatgtttttggtatattttgctgattcatattatctttgctcaggcactttaactttggtgtaatgattttgaatattggggtcattgtgatcttcattttatagccttgttaaatgaggcatctcataactttctttgcatatgtttgtacaacttataatgggagcttatgtcttcattatttttctatgtgaagacttttctctgatagtggagacctcagattttcttggcctattgtttaggtcttttcttcaattgttgtattcctttagcctgtgaaaaagcacagtaagttttaacacataaggaatttattaaactttaccatttataactttcagctgtaattatcaactttttatttttatttttatttttttccagtgagggaaaaaagacttcaattatatttctttctttcttttttttttttttttgagatgaagtttcgctcttgtttcccaggctagagtgcagtggcacaatctcggctcactgcaacctctgcctcccaggttcaagtgattctcttgccttggcctcctgagtagctgggattacaggcacctgacaccacgccaggctatgtttttgtatttttagtatagatggggtttcaccatgttggccaggctggtctcgaactcctggcctcaagtgatccacccacctcgacctcctgtagtgctgagattacaggcatgagccaccatgcttgcccaacttcaattatatttctacagatattaaaaagataggtagtgaatctaatggtaatgcttctgtggtacaaattaattctgtacttttaaaatgtctttctaatcacatatacttaaaaaatgttttcataggccacacctggttacatgaaatgatttaatctagcttcaatttgatataatagaagttgtttttacattaaaatattaaaaactatgttatgaaattatttttttttgtgatttctctaaaaaatttcctgtccgaggttttggaaagcgatagaggttaattttataaattatgttattatttaaaacccatttcagtaaatactgatgaacatcagcatttttctttctctgcttactgagtgtctgaaatcttttcaatgaaaattttgttggctctttatcaagtcctgttttggaaataatcctaagtagttctcagtaagggagattgagaatttaaaatttaattttatatatttatgagggaaataatagaaatatatacgcacacaagcacacaaacatatagttgcgaagtaagatatcagagatttattaaaatgaaaataaaatgtttatacaggcaaaaagactattatctttaaaaacatcatgataagagatttggaattttggaatgtctggttaaaatcccatattgataatttaaataagtacttatctctgtagctttgcttttcacagtgattaaaaaatttgtagtacttattttttactagttctcttttataaattgggaaatatcacatatggacaaaagactgtatgatagtatgtatatatagtttcaaaaccataataaaatgaattccctgcctacctgtgctaagaaagaggacattacaataccctagaagcccccatgtgtccctttatgattgtatcccttatattatccccctccattattcttaatattgtgttatttccttgcttttcattgcatgtttttaccctccatatatgtatttgccagcaaacctttcatttagtttttctgtttttaaattttgcataaattgtttatcattgtatgctttcttcagagatctttaaaaagtcagctttatgctctggagatatattttaatggagagaggcagacaataaatatggaaataagtaaaatgtattttaaatgataataagtgctatgaagagaaaagaaagcatggaaggaagatagagagtttcagattgttgcatttaaaaagagtggccagagaagacctcataagacatcttaataaaacctaaaggcgattaaggagcgagccatgcaaatatctgggggacaggtgttctaggaggaggtccagctagtgcaaaagccttgagatgggaacatccttgtcatctggaacagcaaaggggctagtgtagtcgaatgtcttggagtaagatggaaattatcttcccttagagaaataactggaaacccagtcatgtagggccttagaaaacattatagagcttttactttggtatgggtagactttgagggttttgaacagatatgtgacttatctgacatatgtgacatgctctgacttagatttttacaggagcggtgttgtaattacgatgcaagagcagaagcaggaagaccatttaggaggctattttaatgatctaagagggagatgatggtatctggaaccatagaggccaatgtgaaggtagtgagaattggttggattccgaatatattttcaaggtagaaccaacaagaattgaaaaaactaggggactggatatagagtggatgagagagagagagagagagagagagagagagagagagagagagagagagagagagaaatagtgaaagatgaagcaggcatttggcttgaagacctgaaagcatggagttggcattagttgggatgatgaattttgtgggagaagtaggtttggtgtcaggaagaatggaaacttggttttagacacgtttaatttgaggtacatactatacagcttgtggatatgttaaataggtggctggatgtaggaatttcaggatctggacactctaattttctggtcaaagagatgaggagaaacaaccagaaaaggagactgagaatgagcagttaatgagttaggaggaaaactgggagaatatggtattctagaagccaagagcatatttcaaaggaaagagaatttgtcagaagctgctgattggtaaactaatatgaggattgagtaatggtcatggaatctggcaaaccagtgctttttgctgaacttgacaagagaagtttcagtgggtggtgaagtcttgattggcatgtgtcaaataaagatgagagaagaggaattaaagaaaagtactaacaacttttttgaggagttataaggaaaggaaagaaacagggtaacaagtggtaagggatgtgggacaagatatatatatttttaagtttggagaaataattatgtttgtaggttgacaggaaagatcaagaagatgtaagaaatgatgccaaaaataaagggaataatttgctagagggatgtactcaagaaaacaagtagcaatgggatctagtgaacaaatagagtggtaaaccttacctaggaagagcatgggcactttattcataagaacagatatgaagtcaggttatttgaatacaaatacaggtaaataagtagaggtggagagaactcttgaaaattttgtttctttttattttctcagtgaagtaggaagtagagtcatcacttgagggtgagaatgagggatagtggaagattgaggtttgaaaagagaagtatgaaatcatttaggagggagggagagtgaatgagttagggaagtgtagtaggatccttggcagaattttcccatgtgagagacccttaatgtgcgaacgcagagtctttttatattttctgccttactgtggatgcatactggaattgtccttagtttttactattatgagcaattgtagcaaaaatattcttatttagtcttctattgtttcacgacagtttgtctaagctatttacttaatagtataaatgcttgttcatgctctattttacccaactatactccagcctcatcttactaatttgcacttctaccaggggtgaatgacagttcccatttcttctcaacaatctcattaaggtttgatgttttttcatttttgaatattttttgccaatatggtgagtataaaatggtgtcctattttggttttaatttgcgtttccttaattgctaatgaggtataacatcttttcatatttattggccaaacagctactctgaaattttcacccatattgtcatatgtagttgtttgtgtacccttttttgataataattttttgttagttttatattttgccaacattttatctctcagattgtggatcatctttttactctttgtgtaatatttgataagcaaaacttattaattttaatatagcagaagttgtcagtattttatggattttgctttgtgtcttgcttaaataatacttacttaccttagtgttttcaatattgccttccacacatttagtctttaacccaactggataaggacttttgtgtgtgtgtgtgtgtgtatgtgtgtgtgcacaaccagaactataaatagtgctcccagaactatttattgaaaagtccattccattagtggtctgcaatactaacagtttttttggttagaattacttccaggtgattgatattttatatgcttttctaggtgaaatctgtattcatttcctatggctactataataaactatcatagacttggaggcttaaaacaacagaaatttagcttctcacagttctggtggctaaaagtctgaaatccaggtgtcagcagggccattccctcttgaaaggctccagggaagaatccttctagccttttccatcatttggcagctccagacattcctgggcatactttgattgtagctgcattactccagtctaactcttggacttcatatggacttctccttgtgtgtttgtatgtgtctgaacgtggccttcttgtaaggacaccagtcactggatttaggacccatacttgtttaggattagatctatgtgatctcattttaacttaactatctgcaaagaccctattttcaaactaaggtcacactccaaggttccaggtgaacaattttgggaggacagtattcattcaaccagtacaatatcttttaatttctttttctgtttatgatctgatagactgaaaggcaattgattttttattactcttatgtctaacagtttgctgtatttttgtaatttatgtgtagacttttttagcgttttttaaataatagttgatcagattatatacaaataatgacagttttgtttcttcctttctgggtcttacagctttatatttttctcgtcttacaatttctgctataatcttcagctcattgttgaatagaagtgtgataacaggcatctattttattcctgagcttttaaaaaatgctttcagtatttcttcactaagaatgatgttcattgtgggttttttagatatcattataaagaaaggtctcttttttcctggtttgataagggtttatattatgaatggatgcttggttttgccaaaggctgttttaggaatgacttacttgatttttctactaaataatttaatgtggaatattattttaatttactttattattaactcaacttgggttaaatcaaacttagtcataatgtattatgtgttttttttagtttgctagtatttttgtaaggatttttacattgatgttaatatgtgagatttgcacatgttttttttgagatattcatgtcagctctttggtggtgttacttcgggcttttaaaatgagttggggagtattctttttaatactctagaacatttatcacatgtatatatgtatatattattggaattatttttcctattttaaaataataaactttgggccaactaggtctgatgttttcttcagggtgtagagttttaactactgaattcaatataatagttgtaagaacattcagatgttctatttgttgttgagtctgttttggtaagatatatttaaaggaatttatccatgaaactgatatcttcagttaaattgttataaagatgttaatatattctctcaggatcttttagtatctgcaatatctgtagttgtgttcccttttaattatttttaatactgcatttatttatatctccctatatatctatgtattgtttttgaatggagttgcttacatgatgccctcttaagcataaatattttaaaatatatttactaaaaagcaaagatactctcttacataaggatcaaatttagaaaataacatggatagaatattataatctaacacatttaattttttcaattgtaccaatattttttacaaattataacattaaaattgctagattcgatttttttctttttcttttttttttttttttgagacagggtctcactctgttgcccatgcttgagagcagtggtacgatctcggctcactgcaacctccacttcccaggttcaagcgatcctctcactttagactcccgagtcactgggaccccagatgggtgccagcagggccgactaatttttgtatttattagggactgggttttgctatgttgccctggctggtctcgaactcctgaggtcaagccatccgcccgccttggcctcccaaagtgctgggattactggtatgagccggatttgatttcttaataagttttcatgaatgttcacatatgtgattggcctgtggttttccctttttatactctccttctcagattttgatacttttttccttactgagtttgggtatcttttcctgatccaggattacatccaggagcatgcaaacatttagttgtcatgtctttttagtctcctttaatttggaatagtcatgatctttcatttgaagtctgtgcctcgtttgggtttatctgatgtttctgcatgattagattcacattttgtatttttgttaggaataccaaaatgtcatattcttctcccatggctggtgaagttaaatttttgtgaaaaaaccttttttattgagataaaagtcataacataaacttcttaattttgatcatttaaaacagtacaatttagtggttttcagtatattcataatattgtgcaactattaccactagttccagaatatttccatcagccccaaaagaaaccccatacctgtctattctctctatctccatcttctggcaaccactaatttaatttctctctctctatggatttgtctaatctggatattttgtatgtatggaattgtacaaacatggcctcctgtgtgtggcttctttcacttattgtgattttttttttccagagttcgtctgtattataccatatatcagtgcttcattgtttttgttatgactgaataatattccattatctcaatataccatattttaaaaatctatttgtcaattaatagacatttgggttgttttcacttttgactattaagaatgaggctgctgtgaacatttctggaaaggttaacttttatatcttggtaaaagtggtatattttagttttctcaatggtaaatatactgtttttcctttttaaattactaagtgccttattgggagatactttcagattatgtaaatattttatttcttattaaacctttacataatagttttaatacccattgatgattctcactagaaagagttattagtatgatggttactaagtggttatatttcattattccttcttagtctccccagtctatatattcatttatatcagtatgaattcatgtatttttattttatttaatgttttgtaatcaattgctattctttattctggtgcttatattgtcacagatttgcctagtgagctcctttcaatcaggtgtctgtattctttagatatgtccccatcattctttgtgcactcctttaccttctgcacaaacatttgtccctgccctagtgctcgaataaatcattaccctcaaggaacctaggttccttttagtggagaatgttctttaaaaactaagattagagaactacgcatatatccatttatatcctctatatccatttatagatctgggcatgtatctgtagctctacatatctatctgtgcttaaatgctgtctgtctaaattgcataatgatgccatacagcattacagggatcatttttgccttcccctctttcacatttgtaaatctcttctgccagtgagaaacttggtttccattttatgcttcatacattacaaaatatttttgtatgtgaagtatgaggaacaagatttactttttccatttaatataccatatctggtaaatcagatgtaattttaatccccacattttttgtttgtttgttttgtttttttaacaataaactctatgttttagagcagttttagttttatggagaaatgagcagaaagtacagaatgtttccaaatactctcatctcccctatccccaggtcctctattatgtgtcttacgtgaatatggtacatttgttacagtcagtgggtcaatgttgatacattactcattaactaagtccatagtttatattaggttcacttttgtgctgtatattctatggattttcacaaatgtatagtgacatgtatctacaatgatcatttcatacagaatattttaattttcctaaaaataacctgtgatcctcttgcttatctcttcctccctccaaactcttggcaaccactgatatttttactgtctccatacttttgccttttctagaatgtcataaagctggaatcatgtagtatgtagccttttaattttggcttctttcacttagcaataagcatttaaagttcctttatgtctcttcatgacataatagcccatgtcttttattgctgaattatgttgcattgtatggaaaccatcttttgtttatccagttacctattgaagaacatcttggttgcctccaaattttgacaattatgaataaagctgctataaacatctgtgtgcagatttttgtgtggacatattttcaactcattcaggtgaccaccatggagtgcaattcctggatggtatggtaaagttatgtttagttttgtgagaaactgccaaagtggctggctgtatcatttttcattcccagcagcgatgaatgagagttcctgttgctctagatcgttgccatcttttgtcagcattttagattttagctattctaatatgtgtgtagtggtatttcactgttattttaatctgcatttccctgtgacatgtaatgtgggatatcttttaacatgcttacttgacatctatatgtcttctttggaaaggtgtctgttcagatcttttgccttttttaaaattgagcttgttttttattgagttttaagggatccttgtataatttggataccagtcctttattagctatgtgttacaaatatgttctcccagactgtggcttgttgtttcattctcataacaatgtctttcactgaggagaggtttttaattttaatagagtccaaattatgacttttttctttcatcatttatgcttttgttgctgtatctaaaatgtcatcaccaaacccaggttacctagattttctcctgcgttatcttctgggagttttatattaaataattttgcattttacatttagctctgcgatctattctgagttaatttttgtaaaagatgtaaggtctgtatctagatgattatttctgttattactactgtgatgccctgttgttccagcaatatttgtccaatagacagtcctttcattgttgaatcgttttttctattttgtcaaagatcagttgaccatatttgtatgtgtctatttctgagctctctattctgtttccttgatttatttgtctattcttttgccagtcccagggactgacttgattattgtagctttatagtaagtcccaaagccaggtgatgtcaatctttgactttgttcttcttcttcaatattgtgctggctattttaggtcttttgcctttacatataaattttagaatcagtttgataaaaatttggtaaatttattactaaaaatcttgctggaattttgatttgtattacactgaatctgcatatcaagctgggaagaactggcatattgccagtattagttttcctatctgtgttcatgtactatctctttatttatttagatttttggtttcttttattgtttgtagttttcctcataccagtcttgtacatattttgttaggtttctacctaagtatttctcttcttttggttctaatgtaaatggtattgtgtttttgttcttgttcactgctggtatataaaaaatcaattgtatattacccttgtgtcctgcaaccttgctatgctagcttattagttctagagggtttttttggttgttgttgttgttgttgttgattctttgggatttacttcgtagacagtcatatcatttgtgaaaaaataccattttatttcttccttcccaatctgtatatcttttatttcattctcttgtcttattgcagtagcaagaacttccactaaaatgttgaatagaaatggtgagatgaaacatccttgccttattccttttcttggaaggaaaacattgtttctcaccattaaatatgatgtttttatagatgtttatcaagctgaggtattttccctctattcctagtttgctgagtttttatcatgactgaatgttggattttgtcaatgctttttctccatctattgatatgatcatatgattttctttgttagcttatcgacatgatggattgaatcaattgactttgaatgttgaaccagcctagcatacttggaataagttccaccttcttcttcattatatttaaattatcttagcttaaatattgctctactagagaatattttgttccttgatccatattatttatttactgtccactagattatagtattttcttgttttgtaaagaaaaattagagactagagattattttattttattttattttattttttgtgatggagtctcactctgttacctgggctagagtgcagtggtgcgatctcagctcgctggaacctctgcctcccgggttcaagcgattctcctgccttagcctcccgagtagctgggactacaggcgcaggctaccacgcccagctaattttttgtatttttagtagagatggggtttcaccatgttggcaagcctagtctggaactcctgacatcgtgattcgcccacttcggcctcccaaagtgctgggattacaggcatgagcaccgcgcccggccggggctgtattttttcttagcctgcctctcctcctggggaaaaacttctgtgctactgctttggagttgcaggtgggtgggcttagtggcctgttcctcttagagtgacaccactactttatgtacagagcactagatggggatagtagtctctggagtcttctcaacttggctctttctggatgcaacagtctgccttaggagtgaggtgggatgaaggctattgggtccaatgttgttagcctgctggaattagtgtatagctaccaccctatgagtggcaactgggcagaggaagagcacccagacctctcatgatctttcccagaacagagcttctgtaacccagagctggagggaatgagaagtgctggtatcctgccactcctagtgagatatcgctggcctggagtgggagttgagggatgaaggagccttatgttcttggctttacttgcctggggtagaatttctatcatgctgaattggttttgtgtgtgtgaggcaggcgtgagggggttggggtaagtaattatctattgccatagactattgctgttctttttgagtaaatgtttctttatttggtgttgctcttagcaaaattttcttaggttaatggttgctttttataatttttaccaattatagttcttttcctagtgggagtgtttgtggaactcctcatgttaccattctgtaagtgagcttcatacttttttcctttttttttttttttgagacagagtctcactctgttgcccaggctggagtgcagtggtgccatcttggctcactgcaacctccgcctcccgggttcaagcaattctcctgcctcagcctcccgagtagctgggactacgggcacgtgccaccatgcccgggtaattttttgtgtttttagtagagacagggttttgccctggatcaagccaggatggtcttgatctcctgatctcgtgatccacccgccttggcctctcaaagtgctggagttacaggcgtgagacaacaccacgcctggctgagcttcatattctttagaaattaattggtattataatccatggttttggagctgctacatatactatactaactatactttacgtattagctatgtttatgtatataataattctaacttctaattgtttgtatcagggctttagagtagttatttaatatttatttatattgtcatgcacctttactacatatccattcattcagatcagttataattgtgagcatatatttataatattttctctcagaattatactttaattaaaagaacatttatattaattttaatgtttcacaagatgcattgtaattgtaatttttgattacacaaaaaatatatatctcaaatatatatatatatcttgagcaaatgtacctattcatcaatgagtgcaatctatagactccacttaggtaaggtacaaaaacagcaaatgaatttatgctgttagaatagtggtaatattcttatagttttttatgtgagtgctgattacttagttgtgttcatgttgtgaaaaatcattgagttttaggcttctgatatatgcagttttatgcatgttatacttaaataaaatcttaaaagtttattatggagtccatatgagttacacagttttaaccaaatatagtttagactaaatttactatatttaactttttacttatttggtattttaaaatgatgttttgggcctctagttttaagatggcttgtttcctatctttgtaaatgaaaaaataatttataatataaattattatgagtattaaaaattctttttgatattgtgtctcctcaaagcattttaagatgctatgagcctcaaaatatttttttttgaaatattgaagtttagaggtcatttataaattgttaaaaaatatgtttttttcccccacaattccagggaaacctctatatgcaaagtagaccctttatataacatatataaaatcagggaggtcattttatcctttgtaatacatttttaaattttattctgtaggactattttgaaagaaagtgggtttgccagataccttcattcagctgttcttatcaatggagctatgcttatttttggaggaaatacccataatgacacttccttgagtaacggtgcaaaatgtttttctgccgatttcctggcatatgacataggtatgtatctgttaggattgtacaaagtaggaaatatcagaaattttccatatagatattctcaaatacattaattgatagcatgtgtatatgtcattttagagttaagtgatagaatatgaatggaattctttctaatttcagcacagtagtattatagtaatagagccaggagaacagaagtactgagcagaagtagtggtagatacagggaatacaaaaagctagatttggatgtcctttttgaagactttttatgttgtttccctttgtgaacactatatcagtttattgtgtttgctacatattaattttgataatgggtagatatggaatactgttgaattatgtaaatttttatacatagtaggaatgtaaacattttagattttaagggataagcaaaaatatattaaacatttccgatatacttactatatataggaatctgatagaactagagaaaggaatagagatagtagagctaaagaaataagattttgagacgaaatggaaacccagatgtatctgggaaacaactatataagcatgttttcccaaagaactaaaaacagtttgcatttatacaattcacctaattttagttacgcaatataatcctatcaatttctgaatatttaagtgaatgtatttattgaaatactaaatttaggtatccagtagacccttgtagtgaaaacattgtttttctatgtatcatattatatataaaacctagctgatatttaaaatatacttatcagtacttaagagcaccttttattgagggtataaataaagtattataccaatttgaagcgattaggaaacatttttataagtaaaataaaagaataacacatttaatagatgtaagaagtatactttttctcttaaacctcataaaggcacataatctgctttggtaaattatttcaagtagaatcatgtaaagaaaactctgactattaataagcactttaatctttttactattacagttgtttcaaaggaaattcctagtagtaaagttaagcatggtttttaaatctaagtaatgaatgtcattctgtgattaatcatttgatactagtaatttgatctttttctttttgaaataataatttgaagtggtaactcctgacgaacatgggattgtctcagcttttaggaggctcatgaatcattgtttgaaattagtaaaatgggttgaatgaagtactgaatctaggctggcagtgactttatctcattgctagattgggcctgtcaatatattattgttttggctatggtgataagaccctgggcttatttttctggaagttgatgaaagttttgtttgtttgtttttcttctggggaaaaaaaatcccacaaaaagtatacattgttgttgtcattgttaaaaatccatgaagtggaattttgaacttttgcaaaaggttcttcaaggagcttccacacaatgtctgtacttcaatgaagaatttaaggttgagctattttctggctgacaaaatgggaatgtatttttatttttttcatattgttgaagattatgatatatcaagttttatgtgtcaaaaaacttaagtgaaaaaatttggagaattttgtttcagaaatagaaagatgtcagattatgatgattctaattactactatttatttaatttccttctatgtgctaggtactatgttaagtaatttatatacaaaatctttaacctaccttgtagcatggtactattatcctaatattcagaagattaaacagatgagagtaacaggaacttgccaaagccatgcaggtagtaggcggtagatctaacttttgtaactcctaaaacttgtggtagtctttctatttgactacatcatgctgattagttgggcccagtgtatgttcttaattatggcaacaaattaccttattcttagtaatgcttgtttcttaatgctgtagaaatatagaagaaaatatgagttccattttttcaagcaagttgttcagactggaggaaggaatagcatattttaaacagttttacattttaacaaaggtttttttttatcccctgtgctaacactgacaacaaaaacataaagacagttccacaattcaacataggttaaaactgttcggctttatctcatttgattatttgtaggtagttctcaaaaatgttctctaaaataatctgtttgatcctcctgggtttggagtatgaaatgttggactatttttctgggaaaaggtatttttcatattattatttatacttcaacaaatgtctttcaaaataattgttttcctcatggagtatgtttttgtggaaatagatataagcattatatagtaaaccaattaggaaacagaaaaagtgtcatgttgctagtttttcttttcactgtggtacaccaggacatttttggtgcatttatggaaggcacttaaaagcttagctgattgttttgtgttatatgatatttaaacaggaatatttgtaccatttctaattttttattgttgcaaaatgtattatttgaacattactctcacagtaaattttatacagtcaatatcgctaatctttgggtatataaccttgccttcacagttcccattctattattgcatgatggatgtagaaggcatatgctggtgattttcaatcatgctcataccttggcatcctctttggaggttggttggaaaaaaaaaataacttacgtaatcagattctttgagattggatactgggcatctatgttttttaaaagtgactaaagtgcagctgataatacagctagggtggtgaataagataggttgagtataacacatagcatgacacatttcttaatttgactgtaacatatgacatgacacatttcttaatgttctagtttgtaaatctagtttgaggtcagatttgagaatccaaaaacttaatttttttttgttattgttagtgctgttattattactttcagaaagccactatggcaccttcttcaaggttaacaagaactttctggtaaagataaccttctatttagaattcacacagaattctgaaacaagatgcaaaacaacttattgactatgtttttttcttaatcaaaaagataatagaggataacagaaacatgaaaatgtaatttcctgagttaaattatttaagaatgggtagggaataggatttgtataagaactatatcttgcagaaagcagaacagctgaaatttcaaatgagatttaacgaataatcgagttttcaaaataaattccctgaacatagtggtttacttatgacattaatttctttgtagtgattatttaaaaactaaatcagtaaaaactaaaaagtaattttttatttgggaaagtaatattttaatggtagtatataataatgtatattcttaaccattttataatacagtgaaattgcagttctgtatactcttaaaagatcacttaactggccgggcacagtggctgactcctgtaatcccaccactttgggagcctgaggcaggctgatcacctgaggtcgagagtttgagaccagcctgaccaacatggagaaaccctgtctctactaaaaatacaaaaattagctgggtgtggtggtgcatgcctgtaatcctggctactcaggaggctgaggcaggagaatcgcttgtaccctggaggtggaggtttcagtgagccgagattgcgccattgcactccagcctgcgcaacaagaccgacactccgtctcaaaaaaaaaaaaaaaaaaaaaatcacttaactaattaatgaagcctgggatacctgattttgtccaactgtttggagtgatatatatgtatacatatataatagatatagtttggtaaggcatataatttcatagcaaaatcatattcaaattaagacatctaattatttaattttttggaatactcatgcaaagttatgaaaattccaatctgcttgcttttcatgtttataattatttttattttctggaggttattttattagttcctctctctgtttatccgtatttctctatgcacttcgttaaattcttagggctctttcttgatgaaagtggtaccacttacctggccatctgaaagaaacaatttctttgtagatcaggaaaatccttagaatcatcacacatttctttcaatgaatttagccaactgtcgactgttttaagcttcattgtatcctttgctcaaggtgttctctttctttttgttgggattatatacaagaaatagtagtttaatcttttttaaaaagaggccactaaataaaagaaaaaataaccttttattttgaggaaaggatgaactaacatttatctaatgttttcaacagtgcttggcatgtcacacatgatttataatataattattgttacatctgtgtagtgtacattagtatatttaatttatagaagaagacactgtgatttaccatggttaaacccaaactcacacaggctataagatgttgtattcagaatttaaagttaagtctacattcagagtccttttgatattaacactatacaccgtgatatttatttttcctggtttaacaggaaaaaaaaggaattttagttggaaagaacttgttagtgtagtgagacattcaaaaatagtttttatcaatagatttaatcatatttctgagaggtatttgaatttcactctacctgtccccctcccgaataagttgattggaaaatagtgacctcaagatagaaaatccaggagaaagaaaaggataatggataatgaatctctctcattcttaacaagtctgtatccattttgagagactgtattgaatacaaaaattactgaataaagattaatgaaaaaaatgctctgaaaaagcagcctctttaataaatagttctgggaaaagttgacattcatttgcagcagtatgaaactagaccctcccctctaaactaaaaatggatcaaaacaataaaacaacagaaaacaggaataatccttcaagacatgggtctggagaagactttctgcaaaaggccgcaacagcacaggcaacaaaagcaaaagtaaacaaatgggatcatataaaataaaaagcttttgcaaagaaaaggacaatcaacagaatgaaaagacaacctccagaaggggagaaaatatttgcaaactattcatctgatgggggattaacatccagaatatacaaagaactaaaaaattctcaatgataaaaaaaacctcaacaaacaatccattttgcaaatgtttaacaaaaataggcaaatgatctcaacagatatttctcaaaagaagacatacaagtaaccaataatatatgacaacatgttcaacatcagtattcatcagggaaatacaaatcaaaacacaatgaagtatcatctcacgccatttaggatatctattatcaaaaagacaaaaaaataacaaatgctggtgaggatgtggaacaatggggaaatgtttttgatggaaatgtaagctagtacagccactatggagaatagtatggaggttcttcaaaaactacaaatagaactattatacgatccagcaataccaccactggatatttatccaaaggaaagaaaatcagtatattaaagagacacctgcacctccaggtttattgcagtactattcacaacatccaagatatggaaccacctaggtttccaacaagggatgaatgaatttgaaaaatgtggtatatatacatgctgaaatactattcagccataaaaagaatgaagacctatcatttgtggcaacatggatggaactggaagacattatgttaagcgaaataagccaggaacagaaagttaaacactgtatgttttcactcatatgtggaagctaaaaaaagttcatctcatagaagacaaaaatagaacagaggatactagagtctgaggagggtgggggaagtggtaggttacacagagagatttgttaaagaatacaaaattacagctagataggaggaatacattgtagtgttctataccagtgtaagatgacaatagttaactattatgtgtagtttcaaatatctagaattaggatattgaatgtttctaacacaaagaaatgataaatgttcgagatgattgatatgccagttaccctgatctgatcactatacattatatgtattgaagcatcactatatactccattaatatgtacaattatttctcagtaaaaaatgtaaaaaaggaaaaaagttttaaaaagtcttaactcttgggggaagaaggcaggacaaagaagtcatgaatgtagaataaaaattttaaaataaaatattaacacataggctccaaccatatttcaaaagtttaataaactatgatcaagtaggattcattctaggaattcaactgtgattcgttatctgggaatctataaatataatttattagttcaaaactaccaaagcaacaggacatatcattgtatgttaagacactataaaataatttcgcctactttgcctggcagacagtaaaaaactaaataaatatttatttaatgaatgccaggggacaattcctgagagaagatacgggtatgaatgagtttttttttaaactgagaatgagttaacctagagtaaattgtgcttattttagaatattaaaagaagttttgaagtagggagccaaaaaacaaaaccccagtaaagtaccatcatttcaggggcaggtgggaaaagatatttggcaacatccagaaatgtaattttctattacagaagttttgaaatggctaatataggtttttctttatattcatcttgttgtgagccttgtacatacaacctatgtgtactttctgtcttatttcaaatttgcatttaagactaacttatgaattggcattttaagtgaaacagtaaaagatttttatttttttttgagttggagtgcaatggcatgacctcggctcactgcaacttctgcctcccaagttcaagtgactcttctgcctcagcctcccaagtagctgagattacaggcgcctgccaccatctccggctaatttttgtattttttttgtatttttcagtagagacaggatttcatcatgttggccaggctggtcttgaactcctgacctcaggtgatctgcctgccttggcctcccaaagtgctgggattacatgcgtgagccaccgtgcctggccaaaagattttttaaagtgtctttacagtaatacagatatatatatatacacacacacacacgtttatatatatgtatatgtatattgtgaaaaaacatgagcatttatggaaaaattagccagtgaatttacattttccacttgcattttttaatgtataattgttaaaataaatcagtctgccttcagcttgagtttttaatgtaattatctatccctcacgtgtaaatagttttgatggtatagtaccgtttgctcaaatttgggtttgagagaacagtaactctaattttttgatcttatgtgtattgagtatatggttcataattaatatttagtaccttaaataatgagtacattatgttattttattttttatttttttaagcctgtattccagagagtgtatattatcttggtcttcattcttttcatcgtggctgttttgttggtatagaatattatttctgtaattttcatgatgtcagtaactatggaatttgctttaatttgtttggccttgaactgtttatgaagtgataataacctaagtgctccagaaatatattttcttcttggcaagaaatataaattatagtcagacagattaaaaatgtaggagactttttagtgtaagaattggtttagactacttgtaaacacattatatttatttagtattgagctttaaggcatttgatttatgcccacatatcaagctggcatatttgtgttttcttcctcttgttatctggacagcagagaattccccatatggccatagggaggggtgttgatgtaacagtggtggatgacatagggatttgagctacatacttacacagattgcttgtgccctgtgtttctgctcatacttgatcatgggtaccacttccattttatattcttagggttattggtaacagaactagctcatgattgcaaactctcaacacatagtcacttgattacccatggtcaagcattctatttttatctggacccagtggcatggcagtaatagaggtatataactttccaccacagatggtatggcctttgacatgtgtgtgaagcctgcattgtgattctttcactggggcttgccataaattccacatactactttttccaacagtgacactaccaataactatagtatgtactgggtcatatgtgcctagctgcagagttgcatgcagggtagacttcactgacagcagagctatttcctaccctggctggaaagagctggcagcctttaatgtcttccagtatatgggctgaagcagcattcctaggagtggaatatgctgcctttagaacacaaagaggcctaccagatggtttgctttcttctttgtaatgggagttgcaagatgcataattggtcttttaattcagatgagctgtctgagaatgttcttgtccactggacccctaaatattttaccaatatcaaagtctctgaatctttgtaggttttattttccatcctttgaagcatatgtcttaagaaggtctctgttgcattattcttgcccatctggcccaattagcataatgttgttaatgtagtagaacaatgtaatgttctgcaagatgtccaacaggatcaaatgtattctgactatgtatgacaaaagagggcggaattaatatcatcctaaggcaaaagtgtgaaggtatactagtttcccctccatgtgaatgcaaactatttttgatcctcttttttgatagttagcaaagaacacatttgccgactccatggccatgttaatcttctctaataaagatatacatcttgcacgacacctgcaattttagttctacttggtagtaggtgtctgctatcctttaagctttgtttagtttgccaaactgatgatttaaatggagatttgatggggtccattatcctggcattatttagattctttagggtgatactaattgcttctacccactctctctggaatgtgatagtattttaaaatttattgtattatccaggggataaaagctcccagaggcttccactgtgagaaccaaagaccaaatgtggtaggtgttgtgccatttgttaagcctgtttattccaattctatatccagcgactgaagacatgatcactgggtgagtctgtgacccagtggacccattttgagctggaccttgtccagctgttttcctattgtctcccatcattgggctaagttctgttacagttgctcctactatcagctttggtctatggaggaaagccacgaaattcttagtgatgctagtgtctctcccaccatcatattcttcatggctttggtaattggcatatcctctggccctttccatagataaaatagcctggtgggttttctggcatcacatagtgtattgacttcagcatgtgcacatttttagacttttaatcactgcctttactgtttgctatggcagttccggcattttgaccttacttagcatgggtatacttttcatgttttacatgtttctaagagtcatccagatagcaagtgaacatcacctcttgtggcatccttgtcagaaaggaaaatcctgcatcttggcagaaggctttcaaatcagtaaactctccctaatccaatcataaggttctggccaccttgatcaagctcccctctgaacctagtaccacttgtactctcccacctcctgccaacatgtgctgtctagctgtctaggtttgttgttgttgttgttgttgttttgagacagagccttgctctgatgtccaggctggagtgcagtggttcgatcttggctcactgcaacctctgtctcccgggttcaagcaattctcctgcctcagcctcctgagtagctgggactacaggcgcccgccaccacgcccggctaattttttgtacttttagtagagacgggggtttcactatgttggccaggctggtctcgaactcttgaccttgtgatctgcccgcctcgacctcccaaagtgctgggattacaggcgtgagccaccgtgaccagcgaaggtcttatagattctttggtcgtatactctctttctttccttagcagtcccagcatgtacctagatgagttatgttgatacccaacccaagttataggccctctggccagtactgaagatgtgagcagattctgccctgcgccacaggtcatgctggagagtagcctctacattgtgtttaagcaaaggcagagtgctatctgtcttttaggaaggtaggatggatcatttctgcagtgtcagatgattcaggaaaatttgggaattcaaaatttgggaagactttaaggagcatcaacttctgatattcccattttgtgtgtcagagtcctttttcttctggggcttgaccttctttaattgacagatcttctataattggcagtctcgttatatggtactgaggagaccctctggctttatcagcctttcattatctttttctagagctcactggggctaagcagtagacatgcaattctagtatcttaatagttacccttcctcatgtttttcaagcatctagtacttcactcctgctatactattcccttctattggcatgccttcctactttatcactagtttaagtttttgcagttgcttaatggccactttgtgccaagagctatctgtgctccacctaccaccaatgatgagtttttcattgctagcctggcaatgtatgatccagctctcaaactccaacttatttcttactttagtataccattcctgaaacaagtcagagtttgagtcctctggaaagcagactctgaggtagagtttagtattcatgatgttaattgggagtacccttacaatcaatgcctttgcaagaggtagggggatgatgcagaattggacaaagggagaagttgagttgtgatgctcgatggataaccttagtcaaccctgtaaggattgactgaaggcaaaataattggtcatacttctccaatgttgggctggaatggccaggcctttataccaatacattgatcagtcattcaatatgggtcattctaggaagggtgtgcccttgagtgaagtgggcctgtgttcctcaggcagtttgtgaggtagcttgcaactgactcttcactgacagcactgctagcaacccagacaacaagtttttttttgaattatgatctgggcagcatatatccatgtctaccagaaatatccaaacttcagatgattgacaccaaataaaaatttatttttcacccattatacatgttcatcattggtgggcagggcagattttttttattattattatgctttaagttctagggtacatgcgcataatgtgcaggtttgatacataggtatacatgtgccatgtcggtttgctgcacccatcagctcatcatttacattaggtatttctcctaacacccatcaactcatcatttacattaggtatttctcctaatgctatccatccccaggcccccaaccccacaacaggccccattgtgtgatgttccccctgtgtccaagtgatctcattgttcagttcccacctatgagtgagaacatatggtgtttggttttctttccttgtgatagtttgctgagaatgatggtttccagcttcatccatgtccctgcaaaggacatgaactcatccttttttatggctgcatagtattccatggtgcatatgtgccacattttcttaatccagtctatcattgatggacatatgggttggttccaagcctttgctattgtgaatagtaccgcagtaaacatatgtgtgcatgtgtctttatagtagcatgatttataatcctttgggtatatacccagtaatgggattgctgggtcaaatggtaattctagttctaaatccttgaggaatcaccacactgtcttccacaatggttgaactaatttacgcttccaccaacagtgtaaaaacattcctatttctccgcatcctctccaacatctgttgtttcctgactttttaatgattgccattctaactggtgtgagattgtatctcactgtggttttgatttgtatttctctgatgaccagtgatgatgagcattttttcatgtgtctgttggctgcataaatgtcttcttttgagaagtgtctgttcatgtcctttgcccactttttgatggggttgtttgtttttttcttgtaaatttgtttgagttctttgtagattctggatattagccctttgtcagatgggtagattgcaaaaattttctcccattctgtaggttgcctgttcactctgatggtagtttcttttgctgtgcagaagctctttagtttaattagattccatttgtcaattttggcttttgttgccattgctttggtgttttagtcatgaagtccttgcccatgcctatgtcctgaatggtattgcctaggttctcttctagggtttttatggttttaggtctaacatttaagtctttaatccatcttgaattaatttttgtataaggtgtaaggaagggatccagtttcagctttctacatatggctagccagttttcccagcaccatttattaaatagggaatcctttccccttttcttgtttttgtcaggtttgtcaaagatcagatgtttgtagatgtgtagtattatttctgagggctctgttctgttccattggtctatatctctgttttggtaccagtaccatgctgttttggttactgtagccttgtagtatagtttgaagtcaggtggcatgatcctccagctttgttcttttggcttaggattttcttggcaatgcggactcttttttggttccatatgaactttaaagtagttttttccaattctgtgaagaaagtcattggtagcttgatggggatggcattgaatctataaattacctttggcagtatggccattttcacgatactgattcttcctatccatgaacatggaatattcttccatttgtttgtgtcctcttttatttcgttgagctgtggtttgtagttctccttgaagagaactccttcacatcccttgtaagttggcttcctaggtattttattctctttgtggcaatggcgaatgggagttcactcatgatttgactctctgtttgtctgttaatggtgtataggaatgtttgtgatttttgcacattgattttgtatcctgagactttgctaaagttgtttatcagcttaaggagattttgggctgagatgatggggttttctaaatatgcaatcatgtcatctgcaaacagggacaatttgacttcctcatttcctaattgaataccctttatttctttctcttgcttgattgccctggccagaacttgcaacactatgttgaagaggagtggtgagagagggcatccctgtcttgtgccagttttcaaagggaatgcttccaggttttgcccattcagtatgatactggctgtgggtttttcataaatagctcttattattttgagataccttccatcaatacctaatttattgagagtttttagcctgaagggctgttgaattttgtcgaaggcctttttggcatctactgagataatcatatgattttgtcattggttctgtttatgttatggattatgtttattgatttgcgtatgttgaaccagccttgcatcccagggataaagctgacttgatcgtggtggataagctttttgatgtgctgatggatttggtttgccagtattttattgaggattttcacatcgatgttcatcagggatattggtctaaaattctctttttttgttgtgtctctaccaggctttggtatcaggatgatgctggcctcataaaatgagttagggaggattccctctttttctattgattgggatagtttcagaaggaatggtaccagctcctctttgtacctctggtagaattcagctgtgaatccatctggtcctggactttttttgtttggtaggctattaattattgcctcaatttcagagcctgttattggtctattcagagattcaacttcttcctggtttagtctcgggagggtgtatgtgtccaggaatttatccatttcttttagattttctagtttatttgcatagaggtgtttatagtattctctgatggtagtttgtatttctttgggatctgtggtgatatcccctttatcatttttattgcatgtatttgattcttctctcttttcttctttattagtcttgctagtggtctatcaattttgttaatcttttcaaaaaaccagctctgggattcattgagtttttgaagggttatttgtgtctctgtctctttcacttctgctctgatcttagttatttcttgccttccgctagctttttgaatgtgtttgctcttgcttctctagttctcttatttgtgatgttgggtgtcgattttagatctttcctgccttctcttgtgggcatttagtgctataaatttccctctacacactgctttgaatgtgtcccagagattctggtatattgtgtctttgttcttattggtttcaaagaacatctttctgccttcatttagttatttacctggtagtcattcaggagcaagttcagtttccatatagttgtgcggttttgagtgagtttcttaatcttgagttctaatttgattgctctgtgttctgagagacagtttttttgtgatttctgttcttttacatttgctgagtactgctttatttctaattatgtggtcaactttagaataagtgcgatgtggtgctgagaagaatgtatattctgttgatttggggtggagagttctgtagatgtcttttaggtttgcttgttgcagagctgagttcaagtcctggatatccttgttaacctctctcattgatctctctaatgttgacagtggggttttaaagtctcccattattattgtgtgggagtctaagtctctttgtaggtctccaagggcttgctttatcaatctgggtgctcctgtattgggtgcatatatatttatcatagttagctcttcttgttaaattgatccctttaccattatgtattggccttctttgtctcttttgatctttgttggtttaaagtctgttttatcagagactaggattgcaatccctacttttttttgctttccatttgcttggtagatcttcctccatccctttattttgagcctatgtgcatctttgcacgtgagatgtgtctcctgaatacagcacactgatggatcttgactttgtcttttaattggggcatttagcccatttccatttaaggttaatattgttatgtgtgaatttgatcctgtcattatgatgttcgctggttattttgcctgttaattgatgcagtttctttgtagcatctatggtctttgtaatttggcatgtttttgcaatggctagtcccgtttgtttctttccatgtttagtgcttccttcaggagctcttgtaaggcaggcctgatggtgacaaaatctctcagcatttgcttgtctgtaaaggattttatttctccttcacttatgaaggttagtttggctggatatgaaattctgggttgaaaattcttttctttaagaatgttgaattttggcccttagtctcttctggcttgtagggtttctgccgagagatctgctgttcgtttgatgggcttccctttgtgggtaacttgacctttctctctggctgtccttaacactttttccatcatctcaaccttggtgaatccaacaattatgtgtcttggggttgctcttcttgaggagtatctttgtggtgttctctgtatttcctgaatctgaatgttggcctgccttgctaggttggaaaagttctcctggataatatcctgcagagtgttttccaacttggttccattctccccatcactttcaggtacaccaatcaatcaaatgtagatttggtcttttcacatagtcccatatttcttggaggctttgttcatttctttttagtctgttttttcttactttttcttctcgctttatttcattaatttgatcttcagtcactgataccctttcttctacttgattgaatcagctattgaaacttgtgcatgcgtcatgaagttctcctgtcatggttttcagctccatcaggtcatttaaggtcttctctacactgtttatcctagttagccattcgtctaatctttttttcaaggtttttagcttccttgcaatgggttcgaacatcctcctttagctcggagaattttgttattacctaccttctgaagcctacttctgttaacttgtcaaagtcattctccatccagctttgttccattgctggtgaggagctgtgatcctttggaggagaagaggcactccaatttttagaattttcaccttttctgctctggtttctccccatctttgtggttttatctacctttggtctttgattttggtgacctacagatggggttttggtctagatgaccttttgttgatgttgctgctattcttttctgtttgttagtttttcttctaacagtcaggtccctcagctgcaagtctgttggagtttgctggaggttcactccggaccctgtttgcctgggtatcaccagcggaggctgcagaacagcaagtattactgcctgatcctccctctggaagcttcatcccaacggggcagccacctgtatgaggtgtcggtcagcccctactgagaggtttctgccagttaggctacacgggggtcagggacccacttgaggaggcagtctgtttgttctcagagctcaaacgccatgctgggagaaccactgccctcttcagagctgtcagacagggacttttaagtctgcagaagttgtctgctgccttttgtttagctatgccctggccacagaggtggagtctagagacggtaggccttggtgagctgtggtaggctctgtccagtttaagcttcctggccgctttgtttacctagtcaagcctcagcaatggcggatgcaccccccagccaggccgctgcctcgcagttcaatctcagactgccgtgctagcagtgagcaaggctctgtgggtgtggtacctaccaagccaggcactggagagaatctccttgtctgctgattgctaaaactttgggaaaagcgcagtatttgggtgggagtgtcccgtttttccaggtagtctgtcacagcttcccttggctaggaaagggaaatcccccaaccccttgtgcttcccgggtgaggtgatgccccaccctgcttcggctcgccctctgtgggctgcatccactatccaactagtcccaatgagatgaaccaggtacctcagttggaaatgcagaaatcacccatcctctgcgtcgatcacactgggagctgcagactggagctgttcctattcggccatcttggaacgcctctccagatttttttttgtcattatttagggacccaggctgacagaagacataggctttcattgctaatcaaatgcctccaaccagaaacacagatattccagtagcttgcattacattgatacattcaacttctagggattgtaagagtataattttgtgccagaaggaaaggaactgaaatattttattgaacagcacaaatgtctatcaaaagtattgtatgtaattcttttttaaacttttagtataattgaagattgaagatgatgtcttggagatagtaataaagctgtcacttcctaccgctacatgtattgaaaggcaaataacttctagaagtagaattatgttttattattatttgcctaaattaattgccttcatgtataattacattactattactgtactgtaatgtttctcttctgcaggacttgtgtactttaaaaacaaaacaaaagaaaaccagaacatgactgagagcataagcactattttgtaaacagtgggattaaatgaaagtatacatacttaagagtgaaaccctctagctaccctttatccacttagggtcttcctaaaatgctgttagtccgatttatggtttccaggcaggagactggaaaattatctgaagaaatctgaccagcctaagagaaagcatgtagagatactgacatttggaggtctctaactgaaatggttccacctgatcagaatcccagaggtcaacatgtccttcttaagcactaaattcctaatgactctggtggtgcctcactcttaaatttgcagcctgttattattttgacaattacaaaaagttactaaatttgatcaaaatgtcaaacgagtaggaaaaaataagaaattaggggaaataaagataatccacagaggagattataagttaaatctttatggacagaagatgttacatttgtgaagcaaaatgtgagattttaataaaaatagttaattcagaaaagaaaaaaatgagctcttggaaattaaaattaggaaaacaaatcaatgatttgaagataaagtgaagaatctccataaagtattatgaataatggacaaatggaaaatagggtaaaaaatgagaaatttaatatgactgttccagaaaactttgtatctcagtaatagaattgaaaaagcaaagaacataacattttagacaggaaggaaattatcaagtgagtaattcaaaaatatgtttgggattgaagtacacaaattttaagactaaaagagcctactgagccccagaaaaataaatacaaaagactcacagcaaagctcattacaaaaagacaaaaagaacctaaaaacttatatagagagaaaagaaataggacaaataaatcatgagacttgatagcatagtgccttacaaaagcaatacgagaagccagaagagtggactaataccttcaatatctgaaaatgctttccatgttagaattctaacaccaatcaaatcatactaaaagtgttagagtgaaataaaattattttttagaattgcagattctcaaaaatatacctccaatgtacactttatttagatactttaggattatatctcctattgaagtatgagattaaataaacagatgaaatctaagaaatggaatatataacaggggagaaatatggagggaatccttatgatgatgtaataggcctagagagcagtaagttcagattggagaagaaagatggagtttcaggagggatgtctttacaaagtaaatgaaattgccagatatcttgatgtattagaagatattgagaagaaatgtacacatctggcaaagggttgggggagaaatagcagtagatatacagaaaggtaagcaaaaaagtgaaaatataatttgtggagaaagtaagttatttaagaataaaaatgtagtatgctacctggcttatctgtgaataatatcacagatatatactatcaaagataataaaaactgaacattagctgagtgtggtggtgtgcacctataattccagaaactctggaggctgaggcaggaggattgcttgagcccaggaattaatttagtccagcctaggcaatacagcctaggcaatatagcaattccccatctctaaaaaacaaataagaaactgaatattgctctaaacaaaattataatataaatgtatagagaatggagggagaggaaatatgcgtgtgtaagtctgtgtaagagcttaatcttcaccatctgaagaaggaagtcaggcatattatctgaaactgggaactaggcatgctgtttagaacagatgaaaatacaagaaacaaaaacaaaaacaaactctttatagctgtttatttagaattaaaagtgcttacctccatgattctggaatatgctttgggaagatagggggcagtggatttttttttttttttgataaaccttgtagaaatattggacttttgggcctcacacatgtatatatttaaaaatgataaaataaaagcaaagtataacagtacagaaattaaatgatgcacaagttagtggatcaaggataaatgttcaaaaattgggaaaattagtgcattgacatatacttggaaatatctggaaaatatgatatatgggaaaaattaagtttgatgcttaccagatatacaaaaataagttgcaaaaagattgaagaccaaaatagtaaaagccaacagaaaaacctttactggaaaattagagattatttttaaaatctcagtttactgagtaaacaagcacagatcataaggtgacctaaaggtaagaccaactttctgtaaaacaaggtttcataaactaagtgaaaaaaagatgctgtagcatggaagaatatatggtaatacatatagccagcaaaggattagtatccagaatatttaatcaagaatcctttaaattattaagaaaaagacaaaaagcaaatagaaaaatgtgcaagtcttaaacagtgatttcatagaagactaaaacaaataacctatacatgtgaaaataagttgactcaccagtaactggaaaaatgtaaaatcaaaccattcatcagattggtaaaaattttaagtctgatagaactacatgttgtagagaatataaaacaagaggaactgttgtacactgctaatgtgagtcaacacaactactttggggagcaaattgggaaaatctagtaaaatcgaagttgtgtcttttcttatacctcttggaaatctagagaaacattcaaaatatgcacaagatacatataagagtgaatataccaacatgacttgtaataggaaaaaaatctttaaaaaggctaattattaacagcttaatgggtaaatattttgtgtagtcataacatggaaaactctaacatggttacaatgagcacacagtaccacttgtatctataaatttaaatgagctgttgaattgacatttctccaaagatatacaaatgtccaataagcacatgaaaagatgctcaacatcactaatcattagggaatgcaagtcaaaaccacaatgatatactaattcatactcattaggatggctatgataaaaaaacagaagataacaagggttgacgaggatgtggagacatatgaacccttttgcattactggtaaaaatgtaaaatggtccagctactatggaaaacagaatggcagtttcttaaaaaattgaacacagaattactatatgatctgttaatcaaatggacctcatacaagttatttaccttcatgtaggtctgattcttcatttctaacatagggtaatacctgctccatcaatttcactggattcttataaagaccattttaagatatgcgatgaaaacactttggaacttttatgtgtacttaatttataaaagtatacagtttatactttatataatttcttttgcaccaacctaatagtgctacaaacatataatgtacatttattaaattaactctaacatgtaaaattggcagtcttaatctttatcataggcctccataataatattttctaaaatgtgatcttcagagcattgactcttgaggatcttaataggcattatgtgaaaagtgcttctttggataaaacattgggaaaacactgtgttaaataaagttaggttaggtttctgtacctttacactctctcttttgagaatatttaataggcagatataccatgtggactaaaaagacagattatacactttttcgggggagatttgtgtttcctggattatactttagcatatacaggtcaacatatattttattgttctcagtctttcagcatcattctctttttttttttaattatactttaagttctagggttcatgtgcacaacgtgcacgtttgttacgtatgtatacatgtgccatgttggtgttcagcatcattttctaaacttacagttttggtttttataattttttgatgttcattaataaaatattgagttgaaaccaaatttattttattattgttatagatgtaattacttaaataagaaaacaagtaattcattactttaacttttacaactaactgtacttaagattattttcttgttccataaaggcttttacctaaacaaaattaatttgttttaaaaaatcttgtatctatatgctttcatgaaataccaaagcatgcctttataaatatgacatttctaagaagttgaaatctaaaacactgtattgagaatgttcctagtcactgaatgatgaattattttaaatctcaaatttacgttagtatatatgtcagttctgagtttatattgaaataatacacatttttcttaaccactttccatagtttctatatagttcatagattatttatgattttcattttttatctagaagttttgcagttaaaataattcccttctatataaaaaagcttttttgagaattcaaatcattaaagtgatttaaatgttttatcctgatgattatatttttaggtattctttcagtgaacattgtatctgccattgacttttgtatgcatacatgtcatatttgatttagtatttaactttcaaagaggtgtgccctatactgacattcataagttttacttggaatatttaataaatatatgtcttcgaaattatcttccaatataaaatacctctaagttcattcttttcattttcttgttctcatatgcttaaaattatttgtgagaattctaggcaagagttatttttatttaatgaataatgttagttgagtaaatacactaaattgtaggtcatggaaaattaatgagaatttttttttgcttcctgcttatgcatagtgtatctttaattcggccaatgatgttttcatattatttgtcttagtttattcttttatttcattttttgtttttctgttttcttttttctagcttgtgatgaatggaaaatactaccaaaaccaaatcttcatagagatgtcaacagatttggacactctgcagtagtcattaacgggtaaaagaagcacatttccaatttttagagggtcacttatatcagtcatactatcctcatattctggtattctttttgaaaattatcattggtacttaatggtattggattttatgcatctcttctctaccatagaatgcattttgatttgtcaatcatatctttttttcctttcttgtttaatatatttaagggacatgggagtaggtaaaggaaaggtgctgagataagacatcagatacccttttatgtcatcctgccttcttttctttttccagagatcagataaggaatgactcttcttttaaaaagatggaactgaaatgatagagaggctagccccatatttctatcaaggagaacaaggaaagtgagaagaattagattctcattttagttctgtcatttactaaatgtgtgatttttgacaagtctcttaacctctctggaccttaaaatcattatatccattgagaaattggactcaatggtcattacattgccttccccatttaagttaatataatttttgtatttctatggcaaaaatttggtaatttggaatccagtgacagtaaacaatctgctagctcatttagtggcttaacatttgtaaatcagaatgacctttttataagcccattttattaccaccttatcctaaatatgtaaaaattctccactattgccacaaaatgacttaaccacaatgaaactgtgtaactgatatcaagtggctgtccaaacagtaatacatgaaaactgtgaaacataaaacctccagggttctctggttgatttttattttacttttttaaaataataaaagacattcttgaagacttttttgactgattcaatttattatgttaataatatttttgacatgaaaaatatgctgttttaagggcattggcactgcttggtattaatttagtattgtctaggcttctctttccagactgaatttaaaaaatctttttgattattttactcttagttttcttattttaaaagaatgaaacaccataagaagaactcggtatctaatttcaaaattctgtgtctatattgaaaagttataattctagatagcagttctaaagtgtgtcttgtccatgtatagctattatctatttttttaaaacattgttttctatattattaaaaaaatacttatttttctgacaaaggaatattgtatataatcattgtttcttttcctttcttgtattaacaataaaacatgttttgaagacttagtgttttcttaatatattaagatttatagaatatttcatattttgtctggaaagtcttcaagaaattatatagtagttcctctggtgtttttatatcatattgtatgctagaaatatgattttaaagaacagtactaacagaagtacttaaaatagtataaaatgtatatttaaatctatgcttatttttataactaaatcagtagatagggacttttaatagcgtttctttaagattcttgttttgtttttaataggtccatgtatatatttgggggattttctagtgtactccttaatgatatccttgtatacaagcctccaaattgcaaggctttcagagatgaagaactttgtaaaaatgctggtccagggataaaatgtgtttggaataaaaatcactgtgaatcttgggaatctgggaatactaataatattcttagagcaaagtgccctcctaaaacaggtaaatttctttttcttttcgtctttgtggcagcaaaatttctcttctacagaagtagaaatatcttctgcttataagaattactttagtagctacagaaatgaaaaatttgtattaccctaattaggaattctaatgtttgaacctagtgattaataatttaatacatttattagctatttttagctttatttttgaaatctgtatatatagtatatatatcaatattttatatataacattgtcatatatatgaattattttctaatataagtttaaaatgctttccagtacatcatttctaagaagtgctgttagattcaaagaaataaaatgaaataatttattttccatgtggtatttttttttcttcctgaattattgccaaaccacaccataaagtaaaaaaatgttacagcatttcatgactaatgatctggttttatatttcttataaaatggtgaataaataaatgagacttatgaaaagttaccagtcaattattaatcagttagctaattaattatttggataaatattgtttagttttttaagtgctgagagtttttatacatttttgcggttacaattaataaatgtatttttaagttttactaatctatattaattcagatgtcttttatatctttagaaaggatgataaacagtatttgttatgatgttttcttttgtatgtatagtaatacactttgttcagtaaaatatatgtaaatcctttgactttctctaaaatacgtaaatttatttattttagtttattttttgagacagagtctcactctgtcacccaggctggagtgcagtggtgtgatcaaactctgtctcctggtttcaagcaattctgctgccttagctttccgagtagctggaattacaggcatgtgccactatgcctggctaatttttgtatttttagtagagatgggttttgtgatgttggccaggcttgtcttgaactcctgacctcaagtgatccgtctaccttggcttttaaaagttctgggattgcaggcatgagctaccgtgcctggcccaaaatgtgtgaatttaaaatgtctgtaggatccttgtatattgaataattaaaatgggggtaaaaggtcttgaaaatcctgtaaacacaattgaactacaaaagttgtcttaatctttagaaaacttactttgaaattgaaggtcatttctttggttaaaaaatgtcttagtgattcttaatgattcttaaatagatattgtaaattaagaagagtaagattttcttttccgtgctgatatatcgtcccccatttgtattatagctgcttctgatgacagatgttacagatatgcagattgtgccagctgtactgccaatacaaatgggtgccaatggtgtgatgacaagaaatgcatttcggcaaatagtaactgcagtatggttagtatttatgggtaaatggtgctgtagttacaacagactgctgctttatgatcattagcttaccatttagtagcactgtagaaaaaaagcactttacacattaagacatttagaaagtatatagggaatcattcacttcttggcaaattgtgaagttagattggtttgttgttcaaatttgtcagtctagattccattttggatccatcaactttacttcttttcatggatgagactgggaacattttttcaaaactgatattgaaaaagactatagctataaatgttgtcttctgttcctatgaaaataagattatataggtaggtattgaaataatttccattggattcctgtcagacatgcattagtggtcgtgtggtctagtgctttgttttcacactttgtgtgtaagtttaacctgagtttttggtagttgtagtttctcttttaactgtctatacattagtggttctcaagttgaggcaattttgtctcacaggggacattttgcagagacattttggttgtcacaaatgtggagctgctattggcatctaataggtagaagcaagggagctgctaaacattctacagtttgataagattttttaacgtcctttttcatctaaagtagagttttagcactattgacattttgagccctataattatttgtttatttgtttatttgttgtgggagggctgttctatatattgcagaataaaaaaacataaaatatttatggcagatgaaaatgggttaagagaagcaaaaattaagattttaagtggtagcatctaaacattctatgttatgtagaagatatcaacaaattgaagggaaaaattttaaaaagtagtatttagtagaattaaagatttttttgttttgttttgtttttttgagacagagtctcactccatcacccaggctggaatgcagtggcatgatctcggttcactgcaacctccacctcctgggttcaagtgattcttctgcctcagcctcctgagtagctgggattataggcaggcaccaccatgcctagctaatttttatattttagtagagacagggtttcaccatgttggccaggctggtcttgaactcctggcctcaagtgatgtgcccacctcagcctcccaaagtgctgggattacaggcatgaggcactgcacccagcccaaagattctttcatgggcctatagcttgagtaaaaataaatagcatggatacatatttccaactgaatataatgtatcattttttcttttttggaaattttattactgaaagtatctacttgtttttcaagatagcaggcagaggtaaaaggcaaagaaaagggagttgaaactaagtaaaaaatttgattgtataattaaaaaaattcttcactaattaataattcaaaatatgtaagttttatgactttaatctaattttcagaacttaaaatggagggaaatttgcagttactgactcattagattgaacccttttgttttcatacatactctgttgttatatactttccagtgatacaagttgttttaataacaagatatacttcaattttatttgagttttaacattaatataacatggttatgctttgaaaatttaaattacgtttgaagatatccactgatattcatctaatgggagttattttagtagaagtcggagttaaataaaataagacatgggaatcagggacttgtattacagttcttcagagaaacagaatctgtctatatatatatatacacacatacacagtttatatatataaataaataatatatatttgtttatatattatatataaatatataaacatttgtttatatatttgtttatatattatatataaatatatttgtttatatattatatacagatatataaacaaatatataaatcttttatatataatatataaatctattatataatatataaatatctgtatattatatataaatatataatatatatttgtttatatataatctataatatatgtgtatatatatatataaaatgagatttattataagaaattggctcatgtggttatgaaggatgaaaagtcccaggatctgccgtctgcaaactgaagacccaggaaagttgatgatgtaaattctactctacgtatggaggcttgagaaccaggagtgcagatggtgtaagtctcagtccaagagcaagaaaaggcagagagaggaaattctttcttcctctacttttttgttctttcaggccctcaattgcttggatgacgcccaccatagggagagcattttactttacttggtttaccaattcagtctcatccagaactgccccctacagacatatccagaaataatgcttagcctaatatgtgtccaccccatgtcttggaaaagttgacacataaaattaaccattacaagtctaccccttgtcaacttggcacctatacatatctacataaaccatacttaattttcaaatgaagataataacaaggtcataattctacctaacataatacaagtatcctgtgtacaactggaaaacacatcaatctctttcccagaaaaggaggtaaagtcctggagtgatatttactcctctccttgatattctgtaaattaaatactatgatgtaaaatcaacagtacttaaattctgatatgagcatcttatgttacatgatgagggaataagagaagaaagaaaacaaagatattacacacacacacacacacacacacacacacacacacacagatgtattcttagcaaaatgaggaggaaatacagtccttatttctgtaagtgatcatgtggttgtagctaatatttatacatatattcttttttttattatactttaagttctagggtacatgggcacaatgtgcaggtttgttacatatgtatacatgtgccatgttggtgtgctgcactcattaattcgtcatttacgttaggtatatctcctaatgctatccctcccctctacccccaccccacgacaggccccggcaattcctcaacgatctagaactagaaataccatttgacccagccatcccgttactggatatatacccaaaggattgtaaatcatgctgctataaagacaaatgcacacgtatgtttattgcagcactgttcacaatagcaaagacttggaaccaacccagatatccatcaatgatagactggattatacatatattctcacctaaccattttgtatttcctttaccttcagcaagcaccttacctgcttgtagttttttatctgttggggtgactcaaacctttattcttgaagggtcattcttcattagtagtcctgcttgaattggattgttgtagttttccattgatcttaatcacagggtaatataatttggacatttgtccctgcccaaatttctgttgaaatataatccccggtcttggaggtggggcttggtaggaggtgtttgaatcacaggagtggatccctcatgaatggcttgggccacccgcttgttgatacgtgagctcttgctctgggttcacttgaggtctggtcgtttaaaagtatgtggcaactccacctccattctcactcttgctcctattctgccatgtgagatgcttactgccactttgccttctgcaatgagtaaaagttccctgaggcctctgcagaagcagagcagatgctggtgccacatttcctgtaaagcttgcagaactgtgaactaactaaacctcgtttctttatgaattacctgatttcaagtattcctttatagcattgcaagaatggcccaacacacagggtgtagggtatggtaatactgaaagacgccataagggatctcttgtattctagacatattcttcctagcctcctgtgtgaagtggcagttcagtttccctgtactagaagcagtcaccccaatgagcacagtaactcttctttgactgatgatttagaggtgtaaggaacccaaagtggccaagtggcagtcttaatttccaattctatggaatcagtgttgtgttttctggaaaaaattattccttcctctggaattaagacatctaggtcagcaaagaataaggtcacaggaataggaagaaaaatttcgctaatgaattactaagggcagtagtgagtagtaccactcccatttccaccccttgattattggacccataaatgctggctgtgagagaaaaagcaccatatattggatgctgactcagagcttatatggctttctggagaacccttctgtcagccttgcaaggtattactacgtagctggcactgtaactgaatcatcaaaagcccattccactgttttatgaaacgagttgcttgacaattgtagggaacatgataagaccagtgagcataggcccattgctgtcctccatgtgctgtgacatgagttccttggtcaaaagcaattctgtatggaataccaagatagtagagaaagaattctgtaagtttactgatggcagttatggcagaagcattgtgagcgaggaaggcaaatctatagccagaataaatgtctgtttcagtaaaaacaaaatgcttccctttccctgattgaagctgtatcaaccttcctccaggtagctggctgattacctagggggatggcaccatatcaggagctcagtgttggtttctgctactggcatattgggtactcagcagtggtcatagccaggttggcctcggtggatggaagtccattttgctgagcccatgcataatctccatccctgccaccatggccactttgtccatgagcccgttgggtaatgacacaggtggctagggaagaaggtatccacagaagtggtcatcttatccatgtgattattaaaatactcttttgctgatgtcacgttttggtaaacatttacgctggatacaagtatcttcacttatttgccattcagtgagatctgtccgcatcccttttccacaatttttttttttgtcaccaattttccattcatgttccttccaagttcctgaccatacagacaaaccattggccacagcccatgaatccatacataattgcacatctggccatttcttcttccaaacagaataaacattgagaagcactgtttgattttgcccactggaaagatttcctttcactactgtacttcagggaggtcccaggaagggatagcagaacttcagcagtccttttttgggtggtacctgcatattgtgcagaaccatctgtaaatgaaaccagtcttctcttcctctgtcaagtgatctagggaacttctcttgaagtgataggtcagactgggagagagaaggcagtgtggcagaagtggggatcatgggcatttgggcctcttcatgtaacgtagttgctccttcagggcctccttgagcctgatcatgtatataccacttttatttgatgatagagtgccgctgtgcatacccaacctcatgggttggtgggtcagataacacccagttcatgatgggctgaaatcacataatttggtgacccatggttaaacattcagtttctattaaggcccagtagcagactaagagctgtttctgctaaaggatagtagttatctgcagaggatggtgatgttttgctacaaaatcctaagggtctgcactattatttgcctataggggcctgccaaaggctccaaacagcatcctgtctgccactgatatttcacgtaccattgcacctgcaggatcatgtagcccaactggcagagcttgtatagtactctggacctgttgcagagccctctcttattctgagatctacttggaattcgcagctttttagatcacttggtaaatgggtcaaagtaacataccccagtgaggaatgtgttacctccaaaatccaaagaggcctattagacattctccctcttttttgttttggttataggaggggccagaggcaacaacttaacattcacctttgaaagggatatcttgacatgccccatactgctagacccctagagatttcagtgagttagaaggcccctgaattttagatgaatttatttcccaacctctgacaccaaatatcttgccagtaagtctagagtagttgctacatcttgctcactaggtccaatctatgtgatgttatcaatattatggatcagtgtgatgtcttgtggaataaaaaggcagttaaattcctcagaactaagttattaaataggagtggagagttggtatactcctgaggtagaacagtgaaggtgtattgctaccattgccagctgaaaacaaactgcttctggtgatctttactaacaaatttcaagaaagaagcatttgccagatgtttagctgcttgccagtttccagggaatgtgttaattgcccaagcaatgaaaccacatctgataaggcaattacaattggtattaccactcggttaagcttatgataattcactgttattctccaaaatccatctgtcttctgcatagactaaataggcaaatttcatgggaatatggtgggaattaccactcctgcatcctttaagtccttgattgtggcactaatctttgcaatccctccaggaatggagtattgcttttggcttaccatttttctacatagaggctgttctagtggcttcttcttggcttttcgctccgtaattgtcctcactccacaggtcaaggaaccggtgtgagttttctttcagctgctgagtatgtctattccaattatgcattctggaactgggaaaatagccacaggatgggtttgggacccagtgggcccactgtgagagggacctgaactccactgatcatctggcagtcataagcctctgactggtggcccacagtgatgttttgggtctcctggaattaatgtcagtttagaaccagcatctggtactgatactgattatttccctttccccagtgcatagctaggatttagtaggatttctatatattttactcctaggagcaacttcatgctcaactcaccaatgccatagatgtaagcaagtcagactattccaattgctgctttaactctgctgttcatcatagtaacctcacccaccttgcctttgttagttgagtgctgctacctagcccctgccaacctagatccaattattcctgttgcatttatgtttcccaattcagtggctgcacttcccactgcaaggctgggcatacagaaaacagcaatcatggagctcttcaaggatgccagtgctcccctcccaagtttattcctttcaatactggtgaaaggtgtgtcttctggaccctctcagtgagggtgagcagatcttaaaggacaaatccactctaacattccaatctccctaagccattaaatgtcttctatattaaaccaaggcagatccagcatttccaagtcactcactgtgggccaccttttggtctatgttttagccaactaacagaaagagccctttctaactctccaagctataacatcaaatgtataatttctgcttagtgagcccatatcaataaattttgcctgatccaactttatgtttcgtctatcattttccaatacttttaccgttctggaggctgggaagtccaagatcttggtggtagtagatttggtatctggtgacggcctactttctggttcacagtagatgtcttttcactgcttcctcccctggtagaaggggagctcttgtgtcttcaaccccttataatggtgttaatcccatatatgaggactccaccattatgattaaattacgtcccaaaagttgcacctcctaataacatcacattgggattgggtttcaaaatatgaattttgggagatgcaaacattcagtccatgacagacatttacatatgaaaatacaacatatctgagtgaaaacagacatatcttaaaaattgtattatgtaaattgctatcaagtatttataaagtggcattttgctttatattttattcaatgatgatgtgttaacaaggaaaacattgggtgagatagtgtaagagagcagatggtactcacttgtaatttagaatttgatgtaatgtgtcctttagacagttttatcagaatgtcttgtgattaagctaaaccaaatgttaatggcaaagagaggtctttgggatttcagtctagattatgtacattgatatcctatttcatataggtcaaacaatgtgctttattctcacatattttcatttacaatttacatgtcagtatattagagtgaagatcagtagagtagtggttactattcataagcgtgtctggttcattaggccaaaaatgccagctatgtttcagaataatagctttcttttaccattgattaacttggctctatgtgtgattgaaatataatttcattttttgtacttgtttagtatcaataaatgactatatttttcttaatgaagagcagtagagttatttggatggagactctgttaccattgttattctaaagattgacataaaactattattctttttcttattccaacatgtttagccattctcatgtcatttttataggttattttatttatctgatacttcaggtaaatttaattatttttagttagctatcaaatgtttagaactatactgtaatgattatatagaataatgctaatatttatatactatatgaaaacaaaaaattatgaatcagaacaaataacaataagaaagtatgtttctaatgaaaatgaagtggttgaaaaagtcataaaatgatttcaaatttacaaaaatgtatcttctgtaattttttaggatgaataaagataaaaattatatctgggtactttttatctgctactttacagtaagtgtaaaatgctctaatagaaattaacacctttggaatggaggtgatggcaatgtattttatgaaggaagtggcttataaataaatacttggtgagtgacatttaaagtctctaagtggttaaaaattgcttcaataaattttatctataggatagctataacttaattttaactcttaactttattgagtgaaaacaaatatttagctccattacatgagaaggcctgaggtatttatacctatagtcaaaacaaaacaaaaagattgaggtgggggctcaatgtttagcattaaatctttgtatttttttttcttataaagtagagccacaggaaaagctgagccaaaaattttaatatctatttttcatgagttaggttttatcataggtattgataatatgtgaattatctgaacctgggtatatgtaaggaaccaccatcaaagtttctatattgtctactttttttctttattggaaattaacttttaatctctcaatgccagattagttgaaatatgattacattatgtagatttggaaacaaaataaaacttttgcagattctttgaagcctcaatggaggaaatgtgacagatatatacagaagaaatctcaatcaaccagaaccattatttagtgtctgtggaagtaaaattagtttgagttgtgacagtcatttatctttttatattgtattgggttttgataaagcatctttttaccttttactacttttcatttctgcctcattcccaggggtctgcatgatacttttattaagactagaaccattttatgtcatcattaatggaaatgactttgtacatgactttattttttgaattggaaggctgttttcgaattcactggaaaaagttttcattagatggtgcctgtttaaaattatgtaatttgcacacttcattttttaataaacattcattccaattccaagaacaatagtttaacttgttaaaagaaaaacttgggacaaaataaatttagcagagcttatttgaacaaagattgattcatgaattgagcagcattctgaaccaagagcttcggacacctccagctatcaatgtgagcaggaagtatttttagacagaaaaaggaagtgacgtttaggaacatcttgattggctacaggtcaccatttgccctatttgggcatggtgtgatgaggcatttaccttgtatggaaatagtctgatcagttggcagcatgtgtttggctgaagctcagctgctgtgattagctgagactaagctatctgttgtaagaatacactcaaattatgttgcagtttgtttacatactatatcaggccaaatttaatttaatctccccttttggccagctgtcagttttgagaaattgaccaaaaaccttaggcactaatactactttctgtcactatcataatggacttgttttgtctgaatatggaattcacaatttgcaatgtcaagtcagttggatgatttttttatattctctttgtgtttttattattttaactatagtgagaccatctgatatataacagatggctgcatatgaacatataagacttgagaggggccgggcacagtggcatacacctgtaatcccagcactttgggaggccaaggcaggtggatcatgaggtcaggagatcgagaccatcctggctaacatggtgaaaccctgtctctactaaaaatacaaaaaattagccgggtgtggtggtgggcgcctgtattcccagctactcgggagggtgaggcaggacaatggcatgaacccgagaggtggagcttgcagtgagccgagatcgcaccactgcactccagcctgggcgacagagcaagactctgtctcaaaaaaaaaaaaaataataataataataaagactcttgagaagatatggcatactaaggagactattataataatgactatcatgagggtaatattaagagactgaactatacttcttaataggtgcttccatgaatcaaattggtcaaaatcaaatatatcaacaacaagccagaagaggaatctacttgttttaatcaattatcttgtttgttgatttcttaaaactgaatttctatcatgtcggacataattttccaagggcaataggaggtgtcatctgttgcacacactcttccctcttcagtcaacagataggccaaagcaaccatgttatctaaaacaactttagcaagagaatttaaagatgtttgatgggcaactgtagccaatttctgctatagtagctaatgtttgcgacagatttctaatcatagtctcatttacatttatgccaagccagggaaggagcattctaccaaaagatgcctgtttagggatacttagacttgcttgcaaactcctctttattctatagttaaattaagaggtgtagaccaatgttcaatttccaattggttattggaaataatcatgacaattctaacagtattactgttaaaatccctattcaacattttccacttattgagacatggagttgctcacatatatggttggttgttaaatcctatacagataaaaatataccctggtgaggcacgacagacagttccttgccttgtgtgttaggggccacagtagagaagcactagtaatatttctccaaggctccattatgaaatcattgcatggttgaaggatcttgacaattaaagggattagggtgataaatttctctacaaactgttgaattacctttcttttggttatcctattccatttctggcataatgtaactgcaaatccctcataggttttgactactgtcagatttaaacgaagaacctgatgtgtgaagctaaaagcctaaccctgtacaaaggaccagatattgctcttagaacatcagagaaatttgttagaaggtgaagcagagaatctctaagatcatttaaggatttgtgtttaacataacatatccaacattcagttacgttgcctgcaaaagctattgattatgaaatcataataagcatgttatcttcctgggtatatataaaaaataaaaacagagaaaagaggaaaaggaccatggtttcatggtgactaaggaaagaagtcttgatctgtcttcttgggaaagctttcatgtctaggatgtcatttgtttctgaggagaaaggtccctggtcaattttgccttgaggtttccagtgggtgtactgtcctgagactgggaagggtcctcttaaattgagaaatgtggatccaaggctcaggctcaaggccctgaagttttgctgcagagaagaacttcgtgtagtcccttacagctgacttcaagggcagtctttctctggtgtctcttttgaaaagacccagtctccggggtgtagaccatgaaaagtctggttgtcatcagttcgtgggggcttcttctatctggtgaaaatataccttggcaaaatgcattaaagccttgcaatatcaagtcatgtcagagtttataaaagcagtaaatacatgaggttctattattacgggcgtaggccttccagtaaccattttataaggggtcaatctatgttttccagtgggagtggatatgattgccattttaatttgtaatacctttgaacaaggcagtgtagttagctttgcctaatgccattgtgtttataataccttatttgaatattttgcagtttgtccattgaaacatatgcctctattgctgtgattggctgggactcaactatctgttacaagaatatgcttgtaagttaggttgcagtttgtttaatcctaaattaggttgtagttcaccacttgtagaggcagcttcaggccaaatttaatttaatttaataaactaatgaaataaataagggagagtctgattcagttgaattgtatttggagttagaaatgtttattttaaagttcaccagaggatttaaatatacactgaagtttaagaatcattgctgtacaaaggtgaaaaataacatgctcttttaattttgtagtctgtcaagaactacaccaaatgtcatgtgagaaatgagcagatttgtaacaaacttaccagctgtaaaagctgttcactaaacttgaattgccagtgggatcagagacagcaagaatgccaggctttaccaggtaaagatttcaaaatttagtaaatgagtttatggtctacagataaatactgacatagaaaagtacatttagtaaggacactacattttctaaaattaaagtcatagtaaatatcaacctataatattgtagtactaataacactgtttctacaagaaaagttttttgattacatatttgcttccaattattttaaggtgttcatatgtttatgatactgttgaactgattagataccttttcatcgaaaaaaatcttaaaaatgtagaaaataataagcactcagacttaatattcagatttaacaaatactaacattttgttatattttatttaagtgccttttattttccaaactcagtgcatattttcattatacattataacatttataaaaaatattttaaggcaacaataatatagaacatattaattatatattatatattttgcctctctgtatcctaaaatatatatattatatattttccctctccatatcccagggttttaaaaatattatatatataatatattaacaataaatacataaatatattacttatataatatgtaacatatatttattaaaattatatatctagtaattttaactaaatatataatttatatatttaataaatttaaaccataaatttatatatttattatattacatttataatatataatataatataaattatattttaatatattatcctatataatataattttataataaatacatttctttttttatttttttaaaattattattattatactttaagttttagggtacatgtgcacaatgtgcaggttagttacatatgtatacatgtgccatgctggtgtgctgcacccattaactcatcatttagcatcaggtatatctcccaatgctatccctcccccctctccccaccccacaacagtccccagagtgtgatgttccccttcctgtgtccatgtgttcacatttcttataataaatatgtgcttttatgagaatccgaattttataaactacagcaaagctcatttttaaaagtaatttcattttttcacagttaacattgctagtggatgctaagtactcttcctttgaaatataaaagataaaattagaaaattgaaaggtaatacaggcatttaaccagttctgcttgttatacagataaactgagatccatgctggttaagtgatatgctcaaaattatgtgacttgtaaatgacagagttgtagctattaactaggtgttttatttctgtttagtattttacctctctttatcccaggttttttttttttaaaggtggaattatttttttattattattatactttaagttctggggtacttgtgcagaatgtgcaggtttgttacataggtatacacatgccatggtggtttgctgcacccatcaacccatcacctacattaggtatttctcctcctaatgctatccctcccctagccccctacccccactttttttttaaagaaaagtttctgagcctatttaattctaaaacatattggaaaattccatcacagaatttgtctgaaagagaatctttcttacaagttaatgtgataaaaatcaaaattattctgcctttaaaaatgccattgcggtcaggtacggtgtctcacacctgtaattctagcactttgggaggctgaggtgggtggatcacttgaggtcaggagttgaagaccagcctggccatcatggtgaaaccccgtctctactaaaaatacaaaatttagctgggtgtggtggtgggcacctgtaatttcagctactcgggaggctgaggcaggagaatcacttgaactcaggaggtggaggttgcagtgagcagagatcacgccattgcaccccagcctgggtgacagagtgagactctgtctcaaaaacaaacgaacaaacaaacacaccattgaggcgctggaatgtcattcatactttgaattttgtttacatactggcccttaaagcctttaaacagtgcgatgtgcatgtgtgctcattttgagaaagatagtattaataatgcagtaggcagggtttaagaagcaacagtgagatgatactaagaagttgaaagtggtattggtctctcagaattaaactataaaatgaaaatgtagatcaatgaaaatatttacaaagtttcctgaaaatgacaaggttaatcttggaccaaaataagatttgaatgaaggaatgtatacatttcaaggaatattactttgataagaatggaaattagttgccagtggaagtttggaaaaatgatagtaaagttacttttggtagtactcatctactcattccctaggaaaaaaatgttgctttgttataaaggctccacttgaccaggctattattttggaaatgtaatgaaatatattatgcacaaattctcttttcttaattcatatttactaagcagccaactggttatatatcgtttgatttccattcagcttatctcaaggaagtgaatgctctaaatagagggcccagtctgtagagcagttgtacaattccatgacaattggtgtattgcattttttttacattgatctcatatgagcttggcaatttgaatttatctcactaaactcattataaattaattgccttccttttaaccccactgctaagttgttgcttaatactacaaaagcctgaagtataaaaatatttggtttggtagtataatttagtttagccacaaaggcccatgcatttgtttttatttgtatgatttgtcaatgaactatttttgttctcactaaaaaataaatgaggagacaggcaataataatctaaattcttccttgattcagtaaggtgagaaaaaaccgtaatttaagaaaacgtttgcattgtaaggaaaagttttttggtattttggatttaaaaggactgtgaaaattgaaacacatatagcttcaaactgaaaaccagggcatgctacacagtcttattaaatgataattatagtttattgagggattactatgttccaactgctgtgagattttcatggtacccaatttaatccttagagcagcaaccgtgaacgaacaggagtccccaagatgctttcgagtgggtccatttggtgaagactaatagtactgagacattatttgcttttaaaattttccatttgttatgggtttaccatggagttttataacggctatctgttgtatgctattccaatagactgaatgtagaagaaggtatgagaatatagctgtcaaatgccaaatattgaagacatttacaaaaatataaaacaataaaaataaaatatgctattaagttgtaatgttccccttcaacattttgttatgaaatattaaaacagaaatattaaaaaacagaaataattgtggagaggacacccaatacctacattctagattctgcaattaacatattgctctatctgcactatccctgatctctctgcctatccatcccctattcattcattaatccttctttattttttgatgctgaggtctaatttgaattgtcagctactttccctcgggaagggaatttgaggatacgtttcctttgggcctatttgtataccatagtggggcaagacatctcagcagctggaagagtgcatttatagtggggtttaaaattattattttaaatgaataaatacatgtatttgttaaagttaccatttttaattttaaaaccatttttaattttaaaacgctccaaatcagtagatatagcatgcataaagagaagttctgtgggaccctcaataatttttaagacttaaagaccaaaaatttgagaacagctgctttagaacaactttataagagttgcagcaatatatccaaggtccttcatacagggctagaggcgctaatacatttcatatgatatagaaactaaaatgtaatctaactttatagatcagtatatcaatgaaacactattattaattagtgcacactaaagtttagccttattaatatattatataaacctgtgttttggaaaacggtgtttcaagttcaatttggattctatagataaaccattattactgaacagtatgtttcatttttagaaagacatgaataattgtgtaaaaataaacattagcaaggaaagatcatagctactttactaatcataagtgaaatgagacttctctacccatgcttatgaaagaatcagagaacccaacttataccacaactatatacctgagctatagaaattagatttagaggtcaattagcttcacttataggagtaactttgaaactgcttctgttataagcttgttgtttttctattaaagtaatcttgtcttatgtaaactagaccttgggacataaatatagtagtgattttacttattgaaataccatatgccaatataccagatgttacacagaaaacctagcagtcaacacatttaacagatgtcatagagccataatttatctcatgtttaagatttaaagaaaaagttgggatgttctgctttcattctctaccaaactattagaaaaatttatttgaaatattgagatatttaatatgttttatttcaaaaataatttaaacaaatacagaagtactttgaaataattgaaaaatacatttgctttttggtaatctaacaataagacacattttttttcttactagctcatctttgtggagaaggatggagtcatattggggatgcttgtcttagagtcaattccagtagagaaaactatgacaatgcaaaactttattgctataatcttagtggaaatcttgcttcattaacaacctcaaaagaagtagaatttgttctggatgaaatacagaagtatacacaacaggtaacatttctacttgtttacattatggaaatatgctatgataatttcataattatttgaaatttttttttggttttaatacattattgttgctaattttggaaataaaagtgaaattgatttctcaagtgaattggcagaagacttattttgtataagtaataaggtaataaggttttgtaaattatcactttttgcagagtaaaccactgtattaccttaccaagaagtgatcttatatgaatagatacacttaaagagtatataatttaagaattataactgcacttggtatagtgtggcagaaacaatttttgctgaaaacttttcagagcaattatagtcgatcctctgtatctatggattctgcattcatggagtcaaccaaccgcagatgaaaaatatttttaaaaagtatggttgtgtctgtactgaacatgtacatactttttttcttcccattagtctctaaacaatacggcataacagctattcaataacatttacattgtattcagtaataatctagagatgattttaagtatatgggaggatatggataggttacttggaatactatgccattttatattacataaggggtatgatatttatggatgttagaatccacaagggacctccgtatcctccatggatacagagagatgactatgttaccaattacttgctatatagaaacaagtaatgcttacttgttacagcttactttaaagaagcattgtagatagcatatcaaaatggtggacagcataaaatctggacatatgcttatttctacaacttagtagcaagttaacatccctagctctatgtttctcatgtgtaaactggcataataatcatggctacttcatatgtttattgtgggtaataaatgagatactgcatgtaaagaatatagaaaaatttatttttgagagttaactttggttacaatttttactatttccattttaagggatactatttttttgtctttgttcccactactgctattactactatttccaggaatcattatttagacaatgaatttttaggtaactaaatgaatatttctggtaaatagttaatattgaaactgattgtggaaaaatgtcttaatttttctatggtaagtacatttttttgttcaagcttctattaaaatttattttattgtcactgaagaattgtatgtatttatggggtacatagtgctggtttaatacatataatgtatagtgagcaaatcagggaaattagcatatccattatgtcaaacatttattatcatttacttgtgttgggaacattcaatatcctccttctagccatttgaaactatgtgatatattattgttaacaatagtcatcctacattattatagaacattagaacttattcatcttatcgagctgtaattttcaatcctttaataaatctcttcttatccctccctttcgccttactcttcccagcctctagtacctctcctctacattttacttctataagatcaactgtttttttttttttttttttttttagcttccacttatgaatgagaacacagggtgtgtaactttctgggcctctcttattttacttaacaaaatgtcctccacttccatccatgttgccatgaatgacaggatttcattcttttttaatgactgaatattatccccttacttatatttaccacattttgtttatctatttttttcttgttggaaacccaggttggttccacatcttggctattgtgaatagtgctgcaataaacatgagaatgcaggtatcccattgatatactgattttctttcctttggataaatgtccagtagtgggattgctggaacaaatgatagttctatttgtagttttctgaggaacttctatattgttctccataggggctgtactaatttacattcccaccaacaacgtataagaattcccttttctctgcatcctcaccagtattttttgactttttgataatagacatctggaggtgagatgatagctcgttgtggtttttatttttgtttccctgatgattagtgatgttgaccatttttttcacacttttgttggtcacttgtatgtcttcttttttttttttttattttttttgagacagtctcgctcagttggccaggctggagtgcggtggcatgatctcggctcactgcaacctccgtatcctgggctcaagcaattcttccgcctcagcctcccgagtagctgggattacaggcgtgtgccaccacgcccagctaatttttgtatttttagtagagacagggtttcaccatgttggccaggctggtctcgaactcctgacctcaggtaatccgcccaccatggcctcccaaagtgctgggattacaggcatgagccaccgtgtccggcctgtatgtcttcttttgggagatgtctgttcagatcatttgttcttttctaattcagattgtggttcttttgctgttgaaattttttagttccttatatattctggatattaattccctatcaaatgaatagtttaccaatattttctcctattagtctgttttcatgctgctgataaagacatatccgagactggggagaaaaagaggtttaatggacttacagttccacatggctggggaggcctcagaatcatggcaaaaggcaagaaggagaaagtcacatgttacatggatggcagcggggaaagagagggagagcttgtgtaggggaattcctctttttaaaaccatcagatcttgtgagacttattcactatcatgagaacagcacaggaaagacctgcccccatgattcgattacttcccatcagatccctcccacaacacgtggtaattcaagatgagatatggatgggaacacagccaaaccatataatctccctttctgtaggttgtcttttcactgtgttgtttcctttgctgtgcagaagctttttatttttatttaataccatttgtttatttttgctttagtttcctgtgcttttgaggtcttgttcataaaatcttttagtaaacccattcctgaagttttttcatatgttttcttctagcagttttattgttttgggccttaaatttagttctttgatccatttttttgttgttgtttttgtatagggtaagaggtgggggtctagtttaattctaatgcatatagagatccagtgtttctagtactatttattgaagagattgtcctttcccctatgcatgttcttggtgtaattgtcaaaaatcagctggctgcagctatgtgaattatttgtgggttctctattctcttcaactggtgtatgtttatgtttttataccagtaccatgctgttttgtttactacaactttgtagtgtattttgaagcctggtagtttgatagctctagctttgttcattttgctcaggattgctttggctattagggctcttttttgttccatacaggttttaggattgcttttcctatttctgtgaacaatgtcattggtattttataggtagtgcattgagtctgtagattgctttgagtagcatggttgttttaacaatattaagtcttctgatccatttgcatggaatgtcattccatttgtttggatactcttcaatttctttaatcagtgttttgtagttttttttttttgtagaggtcttttaccttcttggttaaattaattctaagtattgtaaatggtgttaccttcttgatttattttccacctagtttgttgtttgtgtatagaagtgctaccgacttttgtgtgttgattttgtaacctgaaactttgctgaattagtttatcagtactaagagttttctggtagagttgaagtggtgtcattcctctagggtaatacccgaggttctttgcctcacaccaaggaaatcaaggacacagacacacaaggagtgaaattaagagcagaggttgccaggcatggtggctcatgcctgtaattccagcactttgggaggctgaggcgaatggatcacctgagatcaggagcttgagaccagcctggccaacaaggtgaaacgccgtctctactaaaaatataaaaaattagctgggcctggtggcgggcgcctgtaatcccagccacttccgaggctgaggcgggagaattgcttgaatctgggaggcggaggttgcagtgagctgaggtcgtgccattgcaccccagcctgggtgacaagagtgaaactgcagccccccacccccgtccaaaaaagagcagaggtttaataggtgaaagaaagagaaaacctttctctcctgcagagagagaggggctctggagtgggtcttctagttctgtggtgaaatgcatggggttttatagacaagcttaaggaggtggtgtctgatttacatagagcccaaaagattgatctgaccaggtgtgtcatttacatagtgaagaagctggctgccctaccttaatcttttattatgtagatgggttctctacttggctagtgccatgttgcctgttcctttactgtacacgtggttgacaaagaaaagggaagatgtagcctccacgttgaacatgcctggcccccaggtagccttcacctagtggcacagctgccggcattcaccggtgtaagcttccagctttcttatctctgtctgcagctcaatttcacaggctgctctttgttagaaaaataatgattttggagctgctttttgttaaaagggaagtcttgctcaggactctcttaccctcactatctacctaaataatttctttctagttcttgtataagagtcttaaggtttttctctgtatcatgtcatctacaaacagggacactttgacttcttctgtttcaatttggatgtcttttatttcttctgttgcctaattgccctggccatggacttacagtgctgtgttaaataattgtggtgagaatgggtatccttgtcttgttccaattcttagaagaaaggcttttagcttttcctgttcagtatgatgttagctgtgggtttgtcacatatggcctttattattttcaggtacattccttcctaaataaaggtatttatttatttatttccttcctaaattaggtaattcctatgtaaatacctaatttaagtttttatcttgatgagatgttgaattctgttgaatgcttttgctgcatctattgagatgattgtatggtttttgtccttctatcgatgtgatatttgatgtttattaatttatgtaggttgaaccatccttgtagcccttggataaatccttcttggtcatggtgtgtattgttctgatattgttggattcattttgctagtattttgttgagcattgttgcatatgttcatcatagatattggcctctaggttttttttttttttttttttaatgtccttgtctggttttggtatcagtgttatgctgacctcatagaatgagttaagaaaatcccctctccttcagttctttgaaataatttgagaagaattggttttaattatttttgaaaggtttggtagaattcagcagtgaagccatctggtcctggacttttctttgttgtgagacttttcatcattcattcaaaatcatgaattttgttggtattttcaacttttctatttctttttggttcaatttctaggtttcatgtgtacagaaatttattcatttcctgtaagttttcaatttcttggaatatagttgtttatagtagtctctaatgaccctttatgtttctgtgttattttaatgtctcctgaattttcacttctgattttatttatctgggtcctctctctttcttgtttggtctagcaaatggtttatcagttttctttattttttgaacaagaccaacattttgtgtcattgatcttctgtattattttagtcctgatttcatttcaataaagatcatgattgccatgatctttatttttttccttcttctaattttggattttttttttcttactttgctaattctttgtgatgcaacattagggtgtttatttgaaatcattctgtttgttttttttgatgtagatgtttattactataaacttccctttcagtactccttttgctatatcctataggctttggtatgttgtgtttctgttttcagcagtctcaagtaatttttaaatttcattcttaatttctttcttcacccagtgttgaggactatattgtttaatttccatttattcacattgttttgaatgttcctctttttactaatgtctagttttattccattgtggtcatgtaagatagttggtatgattttgatttttaaaaatttgttgatatttgctttgtgtcctaccatatatggtcattcctggagaatgttccacatgctgatgaaaagtatgtgtattcttcagtacagtgttctgtaaatgtctgttagatccatttggtttatgctgcagtttaaatctgatgtttctttgctgattttctgtctagatcatctgtccaatgctgagagcatggtgttgaagtctccaagtattattgttttggggcatatttctctttttatatctaataatattttccttatgtatctaagtgctccaacattgggtgcatgtatatttacaatttatagtctcttactgaattaatccctttcttattgtataatatgcttctttatctcttttacagcttttgagttaaagtctgctttgtctgatataagtgtagctactcctgttcacttttgctttctgtttgcatggaatatcttttttcatcccttcacttttagtctatatatgtctttccaggtgaggtaagtttctcttaggcagcatattgttagttatttttttaaaaaataccctcagacagtctatatctcttaagtaagggaattcatttactttcaaggttattattggaaggtgagaattattcctatcaatttattggttgttttctggttttcatacatcttttcttcctttgtatatcctttctatcctttgttcctttcttcctctcttattatttatttttgtagttacatggctttttgtagtgatatggttttatttctttctctttctccttagtgtgttggctctaccagtgagttttataattttgtatatgttcattatgttggttatcatcttttctgttctagatgttaggctcctttgagcatttattgtaaggctagtctattggtgattaatttcattagattttgtctgtggaagatattatttctccttaatttctgaaggatagcttttctgggtataatatttgtggttgacagttttttgttttcttctcaatagtttgaatatatcattccattcctcttggcctttatggtttctgctaagaaattcactattgctgaaatggggattttcctatatctgactttatgcttttctgttgctgcttttagaattctttctgtttgattgttgatgatttgagtattgtgtgcattgtagaggacctgtataggctggatctatttggtgttctctaagcttcttcgacctgcatgtccatttctttctgaagacttgggaagttttcaagtgatttattaaatatttctagacacctgttcccttctgttctcttttgtagttcctataatacaaataggttttcactaaatgtttcttgtaaatgctgtaggccttcctcactccatattctattttatttttgttacctgtgttatttgcttttaagtccagtgattcttctagctgggcatggtggtgtgaacctgtagtcctagctacttgggacactgaagtaggaggatcacttgtaagcccaggagatcgaggctagcctaggcaacatagcaagatcccatctctgttaaaaaagaagaaagagtaattattttttctgcttagtcaagtctgtggttgaagctctctgttgcatttttaaagttttattcattgaattcttcagatctaggatttattttgttctttttttctgatatctctgttgttgaatttttcttccaaattatgaattgtttttcttattttgttgaattgtctatctgtattctcctatatctcactgaagttccttaagattattttgaattttctttctgatatttcatatgtttacttatgttgggttctattagtggagaaatattgttttcctttggggatatcatgttttctttgctttttcatgtttgatgtattcctacataaaattcttccaattttatggagtaggttttgtatggaaagaattattagtatgaatgggtcttggggtattagttcaatggggtgtattggtattggttctaggtagatgaagtagtgtagtctccatgtagtttcttcagctataatccacattagtgacatagtagtgacattttcaagtgtcttggtagcctttgcaaagagagtttgtagcagtggtgatgtggctttgttggagagtgtgctcaccttgctgtttctcagattacgggcatgtgagtacacacagtgggtagggcaacttgcattctggcttgctggggttgaggtcataggactgtcactcttggagcataggcatgcagtcacttggctgacctgggggcttgcctgtcaggaacaacctatgagattggttttcaagcttaagatgtgagtgtatagctgctcagttggcctggaaagattttttccagggttggcctttggggctgtttttcaggcccaggagacaagttgaaggctgcttggctgtcctgggggcttgcttgccaggaacaacccacagggctatttcttaatcccaggatgcaggtgcattgctgctcggctggcttgggggaatatctgctgggagtgcctcatggggtcgtgtctcaggcccaggatatgcttatatggctttctggcgagcctgtgggtgtgcctgccaggggtggcctgtagaggtgtttctcaggtgctggatgtggactcatggctgcttgtattgcctggaggcatgcccaacagtggcagcctgtggaactgtttctaggccctgattgccagtgcaaggcttttaggcaggccaagggcctgcctggagaggttgcaatgtggctgtttctcaggccctgagtgcaggcatgtagccgctcctctggcctaggggcgtattagctgcacagagtctcaagggcctctcctgcttgggggagggcatgcaatggtttgactggcttggctggctcaaggaccacattgtcctgtgtgggactgccagaacattcctttggctcagaagtgcagtggtggggattggtttccctgctgtgtaggaccagagtcacagccaatcctggacctaggctccattcagctggggttgtggcattcagccgcctgtgtgggcttggtggaacgaaaatgaactgcagtactggagagatgcagaggctactggacacttgagcaaggtacactccagaggtggctctggtctcaacatggcaccatgctgcagcatcttggctcaagggcttgagtagggaatgagaagtgcacaccttgtattcttaattgagggcaatgcagctgagggaattcctggcagcttctaaactgggctcagagcttgtaaggactgtgggattcttctgtagtaaggattataggtgtttttggtagcaatgggggctggtggggatcttctccttacctattccctataacacgaagtcactgctgatcctaaacagatccaatccaggtggagaagacagggcaaaggctgggtgcctccatgctgcctttctggacttccattcaccacaggtgcatctccactcccccactgcactccagcactctcccttcgacactccagtcaaagcatagctctttattcattgtctcaatcctctcttgtggtagggatgagcaccaggtgtctctagtcagacatcttgctgacatcactgctgaaatttttgtatggacactcagtccactgttactgccaaccctaatttttgtgatgaaatatattaatattagcatgtatatttctcatgagtatcaataatggataatctaatttctatccccagtttctgtctatacagccaaagccctcttccccattaataaaactgatgaattaattatatcctttggcttttataaatattaaaatattttgaagtggatattgcaatatggtacttcttggccttaagttttttttttacgtctgggattaatagggtaaagaaaaactatactaatcatatttatatgaacagttgattcaggaaactacttttctgtgaactgtagctatttttctgtgaaggatagagcagtagttattcatttggtatacatttattactttcagtgtacttggcaatctactgctttctgagattacagagatcaaaagacaattgctgttctcaaagagcttagtggggagagaaacaaacacaattctactgaaatgtgataattgcaatgatagatgcacacagggtgctatatgaagataaagggtaggcatctaacgagtaatgtggacctaagaataatttcctagaggagtgccctagctatgtcttacaggatttggagttggccagcacatgaaaatattggtaaagaggccagagaaatgcctaagtcttttctcttgtcttgagagctactagcttaatggctagaggataagatatatgaggtagcatgtaggagagacctatcagttttataatatttttgaagaatgtgacaaggtgtatttgtaaagtattatttttagcatatgggacaaacaacataagttaaaatctgtttatattcttgtgatgccaggagctttatttcttttactacaaaaaataagggacaattaccgtccgggcgtggtggctgacgcctgtaatcccagcactttgggaggctgaggcaggccgatcacaaggtcaggagttcgagaccatcccggctaacacaatgaaaccccgtgtctactaaaaaaaatacaaaaaaattagctgggcgtggtggtgggtgcctgtagtcccagctactcaggaggccgaggcaggagaatggcgtgaacccaggaggtggaacttgcagtgagccaagatcgagattgcgccactgcactccagtctgggcgacagagtaagactccgtcttaaaaaaaaaaaaaaaaaaaagggacaattaccaatgaacatgtgaaaattagttctcactaccacttatgcagagcttattattggcagattcaaattccctgatatttagaaagtactgatatttgatattagaactctgttgttttctttcttgcttaagacatattatttttagttcttacaatataaccttgaaatgtgcttttttgagattgcatatttcaagattgttatgttagtgttcactttttcttccctattataaataataatgattgaactaataattattttgaatgtgtgatgaacttagacttgataagttcatcacacattcaaaagttccatttgctaaggaatgtgatgctaactagcatgccctgtaaatgaagaatgttttggtttatcagaaagctgaacttcagcaagatttcaaaggtggagacttctgcaaggtgacattcaattatgcatatctttatataaaatgaattctgagtcattacagttgtataaactgaagataacccttttttggcaaataaagattgacaaattcatgcactttatagagatatcttgggtcaaatgatcatttacttatcagaaatggctaatgaaatgttacagtgatttatggtgtgctgcagtaaattttcataatatagttatttatcttacataagataatgaactgcctgtccagttcatttactgagtaatagttactttaaatgttttatcagcagctccatttttctgttttcctcctcttcctctcagatttttatcacgatgagttagggagtaatatttcattttaaatgacttgtcttgactatagatagttcagggatataggcagaattgctgtcatgtgaaacacagttgttaatctgaaatatctatgttgaattgactcctgctgttattatcaagagctataagaatgttttaggtttttgcttattaaaatatttttcagaataatatatgaaatatatgctggtcacaatgtgaagcagcatgtgtgtttttataattagaagcattatttattaagtaccatctttgttttaggcactgtgctgatgatggaagataacaatttttattctaatgaattttgtttagcaaaatttactgattacctactatatgtacagtacttgggcaatatcagatctattgtcataacaagaatttataagatatttaaattttatccaagaaacatttgttgagtgtttactatgtgaaatttattgtatttgtactctgcacacatttctaggtgtggctatcttttaagatctctaggactatatgcacatcataattagaataaatactggatataaatatcttatttctatgttgttaatgtctaaggtggagaaacatttttctctatcctggtactccataatgtttaaaaaaaaagaacaatgtggagttttgacatcatttcacattgtaatataatattggtagcttagtattttggaaaataaatctattatcatatatattaaaatagagatgtttataatataaaaaattgtaaagattagtaacttggatcatgaatatatcatttttaatataagaacattttaaaattgagtaattattaaggttataaatatggtaaagatttttatttcaagttaattttgaaatattacagcattaagaatagttatgtagtatttgtcaatcttagttaaattataggcacgagcatcagattttattacttttgttgttttttgttaataaaattatatgacataaatttatccaaaaatcatatagaagtccagatttatttgtagacgtctgagctaagagagaggcagttattcttctgtaagtctttttgctaggtcttgttatgaagtcttcactcagactctatatattgtttgttgattttattttctagtttcacaatgcagataatggcaatttatctttagagtcttaatcctataactgattacattgatagtagtaatagtaatagaagcagcagcagcaataacaatatgttaagtttttaaataatcctaccttatcagatagataattatatctccactttatagaagagtaaactgaggttcatgaaggctaaataaattattccaatcatgtagctaaatataaaacctgtgttttaaaaacagtgttctattctacatcattctccaaaatatgctataattgttaattattcttagtactaaaactcattagaaaggcagctttatatattttcaaatataatttttaatgatagtgaactatttgctaaggaatatgccatatttttacatctaactttctttgaatgccccttttcctgttgtttacagaaagtatcaccttgggtaggcttgcgcaagatcaatatatcctattggggatgggaagacatgtctccttttacaaacacaacactacagtggcttcctggcgaacccaatgattctgggttttgtgcatatctggaaagggctgcagtggcaggcttaaaagctaatccttgtacatctatggcaaatggccttgtctgtgaaaaacctgttggtaagtagtccagtaaattagcattcctttaaaagtatgtttcccacccatcttctcattccttccttctagggtgtagtcttattctatgatatttatgtaaattttatttttatacacattcttccccacttactattagtgatctcagcattaacttgtgaaaataacataatattattattttatgcaaactttgttggttcaaatagtgagattgtggttgtagttacttataatatgacaataatctattcttaattcattaatgtcttttacttttatcatgatagtgtttgggaagaagatttgcttttaagattaatggctaattgggactccttttactcttgtagacatatttcagttatcaagtaaaaagaaacatttttgttacatcttctgaaatggatttttgttaagtaagaaaggaatattgaattcttttcttttaaatcttatatttttatcatggtaaaatgtacttaaaatttaccattttaaccattgtaaatgtattttaatgccaattcaatggcattaaatactttgacactgttgtgcaaacatcatcaccatttagctccagaactttttcattttgcaaaactaaaaatctgtacccattaaacaataactctccatttcctccaccccaccccctacagtccctagcaactactgttctactttctgtctctatgaatttactacttcaggtacctcatatggtgaaatcatacagtatatgtgctttgtgactggcttattcccttagcataatgtctttagggtttaaccaagttgtaggatatatgagaatttccttcctttttaaggttgaccaatattacattatatgtaaatactacattttgttcatccattcatttatcaatggatacttgcgttgcttctacctttttgctattgtgagtaatgctgctatgaatgtgggtgtatgaataactgttcagcttcttgctttcacttctttggggtatatatatatagccagaagcagaattacaaaataatgtggcaattctgtttttcacattcccaccagcagtgcacaaaggtttcaatttctctccatccttgccaatatttatttcctattatttttaaataatggccatcttaaaggctgtgataaatattgtatcttgtgtaatattttatgataagctgtatttttattctttgtttatatcaaagacatgttcacttacaggacatttactttgtaagatgtggaatgctatggaaaacgtggctgggaaaaaattgtggctgggaaaataaacagtgctggtatacaaactaggtcatagattacattactgcttataatacttaaaattatacaactttatatactttgtaaagaattacaaatttcaaaggagttatacattttcaaatttaataaaaattttaagaagtattgatatatcatctttgtttttatctacctcatcatattataatgccacagttggcttaattgaaacatgccctgaacagcaaagcaaagaaaacccatacaattgtgttaacatgaagttaaaaatgaaattattgtatttgtttatttattccagttagtccaaatcaaaatgcgaggccgtgcaaaaagccatgctctctgaggacatcatgttccaactgtacaagcaatggcatggagtgtatgtggtgcagcagtacgaaacgatgtgttgactctaatgcctatatcatctcttttccatatggacaatgtctagagtggcaaactgccacctgctcccgtaagtatttatctagagtgacttttcacttgacagcaacgtaaatttacttttctgtgatgtaaagaagaattaaatatttgaagaagtttcaaaaaatgagaaaaaatattgttacggctacttttgaaaccaactggtactgttaacctctgatttttattatatcatcattttgcatgccactaagtatcttaccctaaatattaacatattgccacatatgtacagcctcttttccctgaactgtgtgtatgttgcagacagtataacacttcatgagagtgttcacctcaaacatcacagattgctttggtgagcctttttagtatcttttaatctagtgcaattcccatatcttttccttatatgactttgatatttttgaataacctataccaattgttttggaggtttctcaatttggatttgtctaatttttccctcatgattagattcaggaaagcattttggggcaagaatattttatcaatgttggtatatctgctacaagtatagaatgcacagtcttgaaatcacatagagttatgtcagcagggcagtactgggcttgctatgagttatacttcaggagaaagattttgccccttgctgatctctcatgttttctaaggactataggataaggctgcacctgaatgaatatttaatactgggtactatgtggtgagagtggccttgcttacaaacacaaatggcgtcagaatacagctgccaagggaattgcataatgctactgggagcacttgttagccttgtaggaacttaagaccgtgtgaaactctttctgcttgggagaaaaaagtgccaatcttagctagcttcttcatagcagagaatatggtttatctttctgcaatccactctttgacactgacgctcatcaaaaatatgccttttcacctgaattaattggtatgttcagatttggaacaaaaaagtagaaagttttacttactcctgctgctctcatgacctgtttctcaatgttggttgcattcattcatatcccactcattggtatctgtccctcttgtaattaatccagactttatgtccttttttttttgaataatatacttttcaggggcccagtagttaccattctaccaccatagaaagctgcagaatcacctgagataaagttggtatgcaggtttttttttttttttttttttgagatggagtctcactctgtggcccaggctggagtgcagtggcctaatttcagctcactgcaacctccacctccctggttcaagtgattctcttgccttagcctcccaagtagctgggactacaggcatgtgccaccatgcccagctaatttttgtactttttttagagatggggtttcactgttggccaggctgatctcgaactcctgacctcatgatccacccagctcggcctcccaaagttctgggattacaagcgtgagccaccgcgcccggccggtatccaagtttatgtccgttgaggatgctttgatttgaacaaagcaaaatatcagttatttggtaaagtccaaacagacaaataaaatcagaagttcttttgcttctttttcagttcccttcttctcaacatctgagtgtccaggaagctcacaaagaaaaaaggagcaagactccttggatttttttttcttccaatactttaacctgcagtaaacaggatttgaaatgagtgaatctaattaacatgttggtgtgtttgatccaggttccaaagaaactgtagttacagttcagtcaaaggagacaaaataacagccacttggagtctggtgtatctattaaactcaggaatatgttgtggttgaaatgtattcaatgagatagggaaagcaacagtttccctctctatacaggaattctctccaggggatctttatcccgattctaattcctttctcctaacagccctaagttctccactatcatcatctctcttcatttgtcatatttgaaacttttaaaggtcaaaggtccattttaggtttttgcatcagtccactggtttccctctgaccctttctctccaggaaacagccacttggagttttcctaggagtgtaggccataacacagcttgtttctataacgttcataagtatcttcaggactttcttattagatcattgactttcttgcagtccctccataggagcagccactggcagcctgactgatgaaaatacaaacaactatcccagcagcaatatttattttctgcccgtccactcttccttccctcctttgagctttcttgtttttcctctgagaggcaacccattctagttagcaattatagtaatgatatggctcccatgagtggaggaacaccagggctcttgtctcacgttgaattagattaaacaatacggacacacgtggagtggttttaaggagcagagagtttaataggcaagaaagaaaagaaaaggcagaaggttcgctcttacagagacagagggatgggggctccacagccgaaagaggaaaccccaagtgtggtgcgtaccaggcaggtatatgtagaggctggaggagggggtgtctgatttgcatagagcttaggggattggtttgaccaggctttcattcaggtagccctcggaaaaaaactggccttcccaccctagccttttaatatgcaaatgcagggcaccatgatgttctacacacatggggatatgtggggcggccatattcccaaatacatgtggggcaagggcaagaggacaaaggtgggaatcgccatgttgagtggacccagtttctaatggcttgcatatgcatactaaaggttgccggcttggctctaagagctgggacttttctgttagacaagaaacacttttggaggtgttttaaaaagaaatgaaaactttccaaggactccttttttctctatctgcctaaaataatttcttaataacttctatcacagtaacttcataattctgagatccctgttggtggtaaatctagtatgttgaagcctgtaagtgtatggcccttggacaacatggtcacccagttgatactagtccttcttgctcagatgagtcatcttcccatttagaggtagccactgcataaggcaatgcacgtagagacttactgactttctaggcctttcatcactctcagtggtccagtcaaatatgtatttggtccatagtgggcaccactgttacttgaagagctaaggcaaaacagtaacacaatgcaggctggaatcccagctgcagctgttgtgttcatttgttccttcaggctcttggcatgaagtggagaggtatgcctgggatggacatggttggatgtattatgagttgagctccctgttgatatccttttttagggattgtggtaaggaatgggggtgttgtacctgatcaagtgggtggcagtgtggtggttgcaggcataaaatggcctttgtgcatagcaaaacatttcaaaactaggagccagctgcccaggagagttgaatacaagagttgaagacttgtggggaatgagacaatgcgcaccttctcctgcctcaatagtcatgcttgtctctcgacaaacattattgttcaatgaaagaagctagacatgaaagattacatactgtttgactacatttaggtataaagttaaaaaatagtcaaaacggcactgtattgtttagaaatgcgtatttaggtggtaaaactatagagtaaggcaaaagtgtattctcaaaaatgtcagctagaggatgttgctgggggaagtttaggggtgctgattaggaaatgaaacaagagaggcaatgctccacttctaggctttgtgcaggtccagagtgtgtgtttataggaatttattaatcttatatttttctttatgtaattgtatgtgtgttatatttcacaataaaagaggctagaaagtagggaaaaactggtttgtgaaagtctaagctcttatactcttaacaactttctaaaaattatttagaattaagcttatgttgtcacaaatttttcttatatcccattccttctcatttgttctacttttttgtttttttacaattttttttggtggtataacacacataacataaattttaccattttaaccattggtaaataatctttagtaatttctttcaaataaattgtgacataaacttttgagtctttgcatgtctaaaagtgtacttttcattttcacttgaatgataaaatggctaaatgtggtattccaaataattttttccttggaacctctttagcactcagtgttgtggataagaattccaatgccaatctaattttcattcctttgtggaacatcttttttatcccccctttgggagcttttaagatttttttctttcttgttggcattctaaaatttttcattgttttaattcagtttttcagtgattgatgtggatctttaaaattaatttttttttacagtttttcattgaagaaaaggatttttagattttttagattttctcattggctctttaaatctgaagagtagtttgtttcttcatctgctaaaaatgttgtgtaatgtcttaaaatacatgttttcttctctttactcttgttgcaaatattaaaatagttgctggaacttctagatatatcttaatatttcttaactctgtttgcattttttgtatttttgtttgctaatatttagctatttttctttttataatcctttgagactttttatttatttgaaataagttttttgagaacaatataattatacagtgcaaatataaaaattgttgtaactgattttttttgagaaggttaatgaaacataattcactattttaacacaggtatgaattaaattctaccactgacaaatcaaataatgataactaaataccgctggtgggattgtcagctaggcaagcataagtcaggtcttcaggtctgccattgtctctcttgtttttgatcttttgcttcttttgttttcttgattattatagaggcttcattgtctacttctaccatttgttccttgagcagatagtctagtttgctattttttctcctctatagttcctttctctgttctgttgtcatgttcgcctttcctgaagctgtgtatagatcatttgtgctgataatgtccaatactactctaacagttatttctatttcacagggtttttttgttggtttttgtttttttgagacagagtctcgctctgtcacccaggctggagtgcagtggcacaatcttggcccagtgcaatctccgccttctgggttgaagcaattctcctgctgcagcctcctgagtagctgggactacaggtgcctgccccatgcctggctgatttttgtgtttttagtagagacggggtttcaccatgttggccaggctggtcttgaactcctgacttcaagtaatctgcccaccttggcctcccaacatgctgggattacaggtgtgagctactgcgcccggcctccacaggttttttattatacaccctgtgtgtcgttgtggggaagaagggcattgaacattgcctcaaggagactttgtatttctgaaagaagtagttacctggcagtgatccactgtttgtgaataatgaactccttcattatgtttaatttttcccgtgtttttaaccaacagacatttgtagagtagtgaagaaatgccaggaagtacaatagggactaggagtaaaatgacattcttgttcaaaatacaagttaaaagtagctgagtgttactctttcataggtgtcagcttcttggcaatggttttagtgtgcttttgactttaactttatgacttttcaggataaattatatatatttacattatcgttttctactacacgtctattcatttaacatttgagtctttaaaatatttttatacttatcaacaaaactttgtattggaagtggtcttttagttgccttcagaaagttgcctcaatgttcatttgaggtttactggtaaatagaaattaaggcaaacttttctttggaaatgagaaacaaataggattttgcaatattctccagtatttttcagtcataatattgtgatatcattgtttaaaattcacgaattgaagagaggaaatgttttttaagataatttttgactaatggtttctgagaaagctttgctaataattggcattattagtaattgatatattttgggtagacagatattctacttgtgaaaatgaattccagggcaatgtttaaagaaaaataggagatttagtcccaaatgtataaaggttcaaatgaaaattcaattaaatttgtatagtaaaaatagaataatacacaacttgaggataaggtgttatctcacaaatctgtatttttttcagtatttgtaagtttatgtgttcaatttaaacacttcaacaattaaggaaggtaatcatttttaaaatttgatgacaatttcttacagattgattttttaatattcttacccatttgaaaaaccattttgaatattttacaacttgatcttttgaaaagccaaaaataaataaacaggattgctccaattaaccatatttcatacaagtccttatactacacataactttaggaacaatagcatagcctgcataaggtttctcatatattatctattttgctgtgtagaagcttttgagtttaattaggttccttttatgtatttttgtttttgttgcatttgattttggggtcttagtcataaattgcttatgccaatgtccagaagagttttcctgaggtttcttccagaatttttatggtttcaggtgttagatttaaatctttaatccatcttgagttgatttttgtatatggtgagagacatagattcagtttcattcttctacatatgttgatccagctatcccagcaccatttattgaatagggtgtcctttcctcaatttatgtttctgtataatttgccaaaaaatcagttggttgtaagtatttggctttatatctgggttctctattctgttccatttttctgtgtatccccatttttctatgtatctacttttatacaaatactatgatgttttgattactatagtcttatagtataatttgaagttgggtaatatgatgcctccagatttgttatttttacttaggattggtttggctatttaggctcttttttggttctatatgaattttaggattattttttctaattctgtgagaagtgatgttggtgatttgactggaagtgcactgaacctgcagattgttttgggcagtatgattattctcatgatatcagttcttctaacccctgagtgtgggatgtgtttccatttgtttttgtcatctatgatttctttcagcagtgttttgtagttctccttgtagggatagtttacctgcttggttaagtatattcctaggtattttatttttgcagctgttgtaaaaggggttgagttcttgatttgattctcaggttggtcatttttggtgtatagcagtgctactgatcagtgtacattgtttttgtaaccttagactttactgaattgatttatcaaatctaggagtcttttggagggctctttagggttttctaggtatacaatcatatcaaagtctttagggttttctaggtatacagtataaaatcacttcatagtctttagggttttctaggtatacaatcatatcattggcaaaaaagggtagtttgacttccttgtttcctatttggatgccctttatttctttctcttgcctgattgatctgggtaggatttccagtactatattaaatagaagtgacgaaagtgggcctacctgtcttcttctagtacttagaggtaatgcgttcaacatttccccattcactgttatgtttgctgtgggtttgtcatatatggcttttattattttgtggtatgttccttctctgcctagtttgttgagggtttttaattataaagatatgctggattttaatgaatgcttttcctgtaattatttgagattatcatatcacttttgtttttaattcattttatatgatgaatcatatttattgacttgcatatgttgaaccatccctgggatgaaacctacttgatcatgatgaattatctttttgatgtgccactggattcagcttgctagtattttgttgaggattttttcatttatgttcatcagggatattagtctgtagttttcttatgttcttccctgactttgctgtcagtgtgatactggcttcatagaatgagttaggaaaaatttcctatttctcagtcttttgcaacagtttcagtaggattggtaccaattctttgaatatctagtataattcggctgtgaatcccctggcccttgactttttttggctggcaaattggtattactgattcagtcccgctgcttgttattgatctgttcaggattttgatttcttcctaatttaagctaggagagttgtgtgtttccaggaatttttccatttccactagattttctagtttgtatgcatagaagggttcagagttgtctcaaatgatcttttgtatttctgtgatgttgtttgtaatgtctccattttcatttctaattaaacttatttgaatcctcttctttgttaatctagctaatggtctatcaattttatcttttcaaaaagactagttttcatttcattggtcttttgtattttgttgctttcaattttatttagttctactctgagatttgttattttattctgctggctttggatttggtttgttcttgtttctctagttctttgagatgtgacattaggttgtcagtgtgtgatctttcagactttttgatgcaggcatttagtactataaacttttagcaccacttttgctatattcaaggtttagataacttatgtcacagttattgttctttttgcagaatttaaaactttccatcttgatttaattgttaaccccaaaatcgttcaggagcagattgttaaattttcatgtatttacatagttttgaaggttccttttggaattgatttctagtttcattctactgtggtctgagaagatacttgatatgatttagattttttttttttttttttgagacagagtctccctctgtggcccaggctggagtgccgtggcacaatcttggttcactgcaacctccacctcccggattcaagcaattctcctgcctcagcctcccaagtagctgggattacaggcacatgccagcatacctggctgctttttgtatttttagtagaaaccggtttcaccatgttggtcaggctggtctcaaactcctgacctcatgatccacccaccttgtcctcccaaagtgctgggattacaggcgtgagccactgcgcccagccgattttgattttttataacttattgagacttgttttgtggcctgtcatatggtctatcttggaaaatattccatgtgctgatgagaagaatgcatattctgcagttcttgggtagaatgttctgttaatatctgttaagtccatttgttctagagtgtaatttaagtccagtgtttctttgatgactttctgctttgatgatctgtctagtggagtgttgaagtcctccaccattattgtgctgctgtctatctctttcttaggtctagtattgattgttttatgaatttggcagctctagtgttaggtgcatatatattttagattgtaatatcttcttgttgcattgatacttttatcattatataatgaacttcttttttttttctttactgttgttcctttaaagtctgttttctctgatacaagaatacctactcctgcttgcttttggtttccattggcattgaatatctttttccacccctttaccttgagtctataagaatctttaaatgttagatgtgtctcttgaagatagcagatatttgctttgtggtttttcatccattctaccagtctatgtcttttatgtggagcatttataccatttacatgtaacattaattttgagatgtggggtacatttctagtcatcatgttgattgttactagttactttgttttcttcattgtattattactttataggccctgtgagttttatactttcaagaggttctattctggtacatattgacctttcattttaagatttagaactctttttagcttttcttgtagggctggtctggtagtgacaaaatccttagcatttgcttgtctgaaaaggactttatttctccttcatttatgaaagttagttttgctggatacaaaattattggctggcagttattctgcttaaggagggtaaagagagaaccttgatcccttctggcctgtaaggtttctgctgagaagtctgctattagtctgataagtttttctttatagattatctgatacttttgtcttagtgctcttagaattcttttattcatgttgacttcagagagaatgatgactatatacattggtaatgttgtttgtgcaatgaatctctcaggagctctttgagcttcttgtatttgggtgtctacatttctagcaaggccaggggtgtttttctcaagttattccctcaaataagtttttcagatgtttttctctttcttttacctcaggaacaccagtgattgttaggtttggctgttttacctaatctcatatttcttggagactttgttccttttttaaattattttttctttatttttgtttgattggtataattcaaaagctttgtctatgaggtctgaaattatttcttctactttgtcttagagtagtatttgtctaagacaaagtattgttaaaactatccacttgcattttgcaattttctaaatgtgcctttcatttccagaagttggtttctttttttaaaatgtattattttgttaaaatttttatttatatcctgaattgtttttttacattttcttatgttggttttcacttttctcttttatctccttgagtaacatagtagtcaaccttctgaattctttatctggcatttcaaggatttcatcttggtttggatctattgctgaagagctagtgtgatctttttggcagtattataaaaccctattttttcatattgccagaattatttttctggttccttcttatttctgtaggttcttataattatttttgaatttatttttgattcaactgtgcttttttcatttcttttttccccttgagaatgtgactttaatgtttgtagtttattttaatctaatttggctcttggtgctttcagtcatgaaggctctgtatgagttccttggtcatagagagccttttcatggtggctttctcagatactggttgtagtagtgatgtgctccatttataagtaggtgcactgtctcctgtggggttggaatggcagaggtatcatgaagcttatttcattcgccagtggcgtgtacttatttatttatttatttattctttccccagtattttattcactgggttgaacaattcagactttaggtcaataggtggtgtccacaggtaaaatctggctgttgctaaagcaggtatcatgatcctttcttaagaaaagatagttttaaaataaaacttactttcttaggaaatacctgtataacaatattagaaaatttgatttattcagggtgagtcccactaaagatttactttctcctcacgtgatatatgatacaaatcattacatgatagtaaataattggaatgccaagccaatattactaattagatattttcccttatgtcctattgatagcatagtaacccaatatacttttgaaaacaattagaataaactagttaacaatactgtgggctaactgtaatcatagatatacaataaatgttttaaaccaacaaaactaaggagggacatggtaaataggaaatgttcagttatctaaggatttttaaaactgtgtcatttagcgctgtgtactgttgaaaaaatgtaagattttaaaggaagactgtgtcaatgaattatttatctacaaatttaacattagccacttttatttaatgactcaaagagtattcttccttttttatttcttattaagaaaatacaggaggtgatacgtactctctaccttcctatgaaggcatgagatccttacctctcaaaggattgacaactacaaataatgttataattggtaaattttttaaatccagtattctattatctgtgcagagtcaacgatatcaagttcctgatattcactgagaaatttgtgccattgtttgtagttttcttaggaatgtttttgttttaaacactgagtggcagctgagccattaacattatacaatgaaattgagtctgccagaaatctaccattttttcttccattgttttttctttcatgtgactagaagacatcattcatgatgccgtgtatgtctgtcagtatcttctatttataaacaatccccaagacaaaatataatattcctagctaaataatagtaaaagtaactatgtaaataggaaaagactctcagcttaatgtaagatgctttggttgttaagtaaaggtttaaaacatttcatagcaatggctatgtctgtggtgtttgactataatgtctgcttatctttggcaaacttcaccatattcataggctttgttgagtctcataggttatacctgaatcaaaaaacaaaaagacaaaaaaccaacaacaacaaaggttgagtatctgcaaatgagtcatggagtgttattttatagccctgaaaactagaatgtgtgctctggttgcctggctgaaggagagtaccaggttttcatgttcccatccagcttggctttttggatgagattaagtttattcatcacatagtagccaaatactagtatcttggacccttgtgaggagcattgtccataataggtagtccaaatatagcccagcaatctcaggaaatgggcagacgtcacttatactggatgtccacaggcagaatacagagttctttcattgaatgtccttacgaggcacaataagaatggctaacatggatttatatcacagacaataataaaggtggtctgtagggccctaaaagttctagtactgccaaaattttcaggggtcttcaattactgattttatttttctccatgtcatggttaaccacaccttttttcactcctgtggtggcctgtttatctcctctttgtttgtgatgtatgttttatttgcttttagtaattgctgtctcttaagtattattgcaaaaatgtttgcattaactatagatgacctttcatggtttttatcatgatcatatttattttttattagcctataattctgtttgaatatatagtcatgttaacatatttgtcaatgttcctgtcacgcagctcaaaattgttctggattgagaacctgtggacagtgtttggaacagcctggatgtggctggtgcaatgatcctagtaatacaggaagaggacattgcattgaaggttcttcacggggaccaatgaagcttattggaatgcaccacagtgagatggttcttgacaccaatctttgccccaaagaaaagaactatgagtggtcctttatccagtgtccaggtaataataatgtaatggaaacaatttcagtttctgcttaagggatccaagaaggagtttttgttcttataataaagaaaatttagctttaggaaaaaagcagaatgaaaatgagactaaaatgtcaaagataaaaaattattccatagactatatctatctcagtttatgcaggtggtattcagtttagaatcattagataggctaaatgaattcatggaatatcatgattagctttcatttcttttttaatattttgttatttagtttaagttttgggatacatgtgcagaacgtgcaggttacataagtatatgtgcaacatggtggtttgctgctcctattgacccatcctctgagtttcttcccctcacccccagcccggcaacaggccctggtgcatgttgttcccctccctgtgtccacgtgttctcattgttcaactcccactttggagtgagaacatgcagtgtttcgttttctgttcctgtgttagttggctgaggatgatggcttccagcttcatccatgtccctgcaaaggacatgatctcattactttttatggctatgcagtattccatggtgtatacgaaccacattttctatatccagtctatcattaatgggcgcttgggttggttccatgactttgctattgcaagtagttctataataaagatacatgtgcatgtgtctttatagtagaatgatttatattcctttatgtacatacccagtaataggattgctgggtcaaatggtatttctggttctagatccttgaggaatcacagtgtaaaaacaagcctctttctccacagcctcgctaacatctattgtttcttgactttttaataatcgccattctgactagtgtgagatggtatctcattgtggttttgatttgcatttctctaatgatcagtgatgttgagctttttttcatatgtttgttggctgtgtaaatgtcttcttttgagaagtgtctgttcatatcctttgcccagttttttacggagttgttcatttttttcttgtaaatttgtttaagttccttgtaaattctggatattagacctatgtcagatgggtagattgcaaaaattttctcctattctgtaggttgcctgttcatgctgttgataagtttcttttgctgtgcagaaactctctagtttaattacatcttatttgtcaattttgacttttgttgcagctgcttttgggattttcattatgaagtctttgcccatgcctatgtcctaaatgttattgcctaggttttcttctagggttttttatggttttgggttttacatttaactgtttaatccatcttgagttaatttttatataaggtgtaaggaatgggtccagtttcagttttctgcatatggctagccagttttcccagtaccatttattgaataggagatcctttccccgttgcttgcttttgtcaggtttgttgaagatcagatggttgtagatgtgtggtgttatttctgaggtctctgttctgttccattggtctacatctgttttggttactgtagtcttgtagtatagttcgaagtcaggtagcatgatgtctccagctttgttctttttgcttaggatcgtcttggctatatggggtcttctttaattccatatgaaatttaaagtagttttttctaattctgtgaagaatgtcaattgtagcttgatgggaatagcactgaatctataaattactttgggcagtgtggccatttttacgatattgattcttcctctccatgagatagaatgtttttccagttgtttatgtcctgtcttatttcattgtgcagtgcttgctttgtagttctccttgaagaggtccttcacatcccttgttagctctatttctaggtattttattctctttgtaacaattgtgaatgggagttcattaatgatttggctctctccttgtgtattgttggtgtaaaggaatgctggtgatttttgcaaattgattttgtatcctgagactttgctgaagttgattatcagtttaagtagtttttgggctgaaatgatggggttttctaaacttaaaatcatgtcatctgcaaacaaagaaaacttgacttcttctcttcctgtttgaataccctttatttctttctcttacctgatagcccttgccagaacttctagtaccatgttggataggagtggtgagagagggcattcttgtcttgtactggttttcaaagcaaatgcttccagcttttgcccatttaatatgatattgctgtgggattgtcataagaagctcctattatcgagctgtgttccatcaatacctagtttagtgagagtttttaacatgaaaggattttgaattttatcaaaggccttttctgcatctattgagataattgtgtactttttggctttggttctgtttatgcgaggagttacgtttattgatttgcatatgttgaactagccttgcatcccagggatgaagttgacttctggtggataagtattttgatgtgctgctggattcggtttgccagtattttattgaggattttcacatcgatattcatcagggaaacgggccagaattttctttttttgttgtgtctcttcctggttttggtgtcaggttgatgctggctttataaaattagttagagaggagtctctccctttcagttgtttggaatagtttcagcaggaatggtattaggtcatctttgtacctctggtagaatttggctgtgaatctgtctggtcctgggctttttttggttggtaggctattaattactccctcaatttcagaactgttactggtctattcagggattcagcttctttctggtttagtcttgggagggtgtgtgtatgtgtccaggaacttatccatttcttctaggttttctagtttatttgcataggggtgtttatagtattctctgatggtagtctatatttctgtggggtcagtggtcatatcccctttatcatttttttattgtgtctatatgattcttctttattttcttctttattagtctagctagcattctctctattttcttagtttttcaaaaaaccagctcctgaattcattgatgttttggagggtttttcatgtctctatctcttttagttctgctctaatctcagttatttcttgtcttctgctagcttttggatttgtttgctgttgcttctctagttcttttagttgtgatgttagggtgtcgatttgagatctttccagctttctcatgtgggcatttagtgctataaatttttctctgaacactcctttagctgtgtcccagagattctggtattttgtctctttgttctcattgttttcaaataacttcttttctgcgttagttttgttatttacccaagagtcattcaggagcaggttgttcaatttccatgtaagtgtgtggttttgagtaaatttcttaatcccgagttctaatttgattgccctgttgtctgagagactttgtaatgatttcaattcttttccatttgctgaagagtgttttacttccaattatgtggtcaattttagaataagtgccatgtggcactgagaataatgtatattctgttgatttggggtggagagttttgtagaagtctattaggtccacctgatccagagctgagttcaagtcctgaatatccttgttaattttttgtctcgatctgtctaatattgacagtggggtgttaaagtgtcccactattattgtgtgggagtctaagtctctttgtaggtctctacaaacttgttttatgaatctggatgctcctgtattgggtgcatatgtatttagaatagttaactcttcttgttgaattgttctctttatcattatgtaatgcctttttttttgtctttttaaatctttgttggtttaaagtctgtttgtcagagactagtattgcatcccctgctttttttttttttaactttccatttgcttggtaaattttcctccatctctttattttgagcctatgtgtgtctttgcctatgagatgggtctcctgaatacagcacactgattggtcttgactctttatccagtttgcaagtctgtgtcttttaattgggggatttagcccatttacatttaaggttaatactgttatgtgtgaatttgatcctgtcatcatgatgctatctggttattttgcacactagttgatgcagtttcttcattagtgtcattgatctttatatctcggtgtgtttttgtagtggttggtactgccttttccattccatatttagtgcttcttttaggatctcttgcaaggcaggcctggtggtaacaaaatcccttagcatttgcttgtctggaaaatattttatttctccttttcttattaagcttagtttggctggatatgaaattctgggttgaaaattattttctttaagaatgctgaatattggcccctagtctcctctagcttgtagggtttctgctgagaggtccactattagtctgttgggcttccctttgtaggtgacctggtctttttgtctggctgccattgacatttttgccttcatttcgcccttagagaatctgatggttatgtgtctttggttgatcttctcatggagtgtgttagtgatgttctctgtatttcctgaatttgaatattggcctgccttgctaggttggggaagttctcctggataatattctgaagtgtattttccagcttgttttcattctccctgtctacttcaggtactccaatcaattgcaagtttggtttctttacgaggtcccatatttcttggaagctttgtttcttttcattcttttgtttctttagtcttgtctgcatgccttatttcagcaaggtggtcttcaaactcttagattttttcttccacttcgtcacttcggctattgatacttgtgtttgcttcatgaagttcttgtgctgtttttttttcagctccatcagatatttatgtttctctctaaactggttattctagttagcagctcctctaaccttttatcaaggttcttagcttcctttagctcagcgtagttttttattacccaccttctgaagcctacttctgtcaatttgtccatctcatcgtctgtccagttctgcgcccttgctggagagatgttgtgatcattcggaggagaataggcgctttggcctttgggtttttggcatttttgttgttgttgttgattctttctcatcttcttgagtttgtctagttttgagtttgagtttcagtttgtctgttttctttgaggctgtttacccttggatagggttttttgtggggccttttttttgttgttgttgctttctgtttgtttttctttcaatgatcaggtccctcttatgtaggactgctgtggtttgctgggggttcacttcagcccctattcatctgcttcgctcctgcccctggagatatcactcaaggagactggagaacagtacagttgggtgcctgcgccttcttctgggatctctgaccttgagggtcagcaagtctgtgtcttttaagtggaaagtttaatttgtttaccttaaaagttactatttgatatgtgagggcttatttatggcattttgttaattgatttatggttgttttatatatcctttgctcctttcttattgtttatcattgtggttttttagttttctgtagtggtagcatttgagtcctttctctttcttatttgtgtccttgcttcgtcagggagttttatactttcatttgtttttatgatggcaaatattgtcctttcacttcctgaagcgtctgtttcaggtcttggctagtggtaatgaatttcctgtttttgcttgtctgaacatagctatcataatactgaagagggaaaggtgaaagctttttttttttttttttttaaagaactggaacaacacagagatgcccacttgcaccactcttgtttaacatagtactgaaagtcttcagactgagcaattaggcaaaagcaagaaattaaatggatctaaattggaaagaagggagtcaaattgtacctgtttgcaggttacataatcttatatgtagaaaagcataaagattctatcaagaaactgttagtactgacaaatgaattcagtaaagttacagaatgcctaatcaacacacaaaaatcagtagcattttcatacatgaacaatgactaggagaaaaggaaatcaagaaggtaataccatttacagtagctacaaataattaaaatacttaggaataaatttaaccaaggagatgaaagacctagaaacttttaacatatacattttaacttgttaaaatatttttcagatttatattactaccagtgagatgtaataatgttattcatataggtctattctttttcttcattttggtcttatttttgctactacatctatatatgttgtggacccaacagtactttaataaaattattactttatataattttatatcttttaaataatttgagtgatgaaaggaggataagtatatagttatagcttttattatattaatctttttaccatttctggttttctttatttgttgccatggccccaaaccatcaggtatcatacctttagcccaatacaggttttcttgactcacctattttgtgcttttattggcaaacatgttacatttttatggttataggacaaataataccattatatacatatatttaaaaataattccttaaaaatatcaggtaatagaaaaaaggaaaataaatatgcatttcctatttttattattacacagtaattaccagtactgtttttctttttgcatggagttgaactaccgtctgggtcacttgctttccttgaacaacttcctttagtatttcttgtatggctggccttctagcatctcattctcctaattttttaatatttaggaatgtcattatttctccaattttctaaaggtagatttgcttgatagaggattcttagttagcattgttcttttgagtatatattattatactgcttactggcctctattatttctgatttaaaatcagttgttaatcttattgggcttttttgtaagtgagaaatgattttatctctttcttctttcaagattttgtccttgttgctttcatcattttaattataatgggtctttttgtggatctctttgtgtttgtcctatttagagttttttaggtttcttggatgtgtaagttaatatttttcatcaaatttgagttttcagaaatgatgttttcaaataatttttattttcttttctctttctccctcctctctttccagtgtttctattattcatgtgatggtaaaattaatgatgtcccatatgtttttccaagctctgcttacttttctccattcctagttctctctgtattttagattatataatctgtcagtctatctttaagcttgctgattatttttctaccagttcagatcttctgttgaattcttctagtgtatgttattgtacgtttctacttcatttgtttttttcttaaaaatttttatttctttgttgatattctctatttgatgagacattgtcatcatacccttcttcttcaggcatgatttctccctcccctcccctcccctcccctcccctcccctccccttcccttcccatttatttattgagacagagtttcactcttgttgcccaggctggagtgcagtggcgcaatctcagctcactgcaacctccgcctcctgggttcaagcaattctcctgcctcagcctcctgagtagctgggattacaggcatgtgccaccacacctgactaattttgtatttttagtagagacagagttttgctgtgttggccaggctgtccttcaactcctgacctcaggtgatctgcccaccttggcctcccaaagtgctgggattacaggcatgagccaccgtgcctggcccgttattttttatatctttaattatttttgaatatttttgtctctttttttttcctgagacagagtctctgttgcccagcctggagtgcagtggcgcgatctcggctcaccgcaagctccacctcccgggttcacgccattctcctgcctcagcctcccaagtagctggaactacaggcgcctgccacgacgcctggctaattttttgtatttttagtagcgatggggtttcaccgtgttagccaggatggtctcgatctcctgacctcgtgatctgcccgccttggcctcccaaagtgctgggattacaggtgtgagccaccgcgtctgacctatttttatcttttatgtgtattctttgtttaaatcaactctctctctttttttaatctcctggtttttatggtgtttttgaattttttattttgagatttaatttagaatttttttttctcttccatgtcagggtttggcaaaccaaggtcggtaggccaaatctggtgtgctgcagatttacgtaaacaatgttttatcaaaatacaactctacccagttatttgtgtattatgtttgtttgcttttgcactacagttgcagaaaggaatagttgtgatagagactgtcctgcaaagcataaaatgctatctagtcctttatgtaaaaaaagttttaccaattcctttcttgtagtatatttgtataacctgggttgtggatgtatctacaagggccatttacatctgcttttacaatatctatggggctttttctgttttcagagcaggtttgtattaatattttacttggtggtttattcaccaaatatatgatgtgaatttaagattgccatataagcctgacatatactttaagttcccacaagttatgtttttctttcataaacatatcccaggggacttaaaattcttttctgctttttgtagagcttgtgatgtgttttaatacctttttcatagatagtgtctccagttgataggatcattttatgaacatggttcagtttagcttgcttcctttaggatgccaagaattatatcctcttggtctgctggattttggaacccatgcctcctagttcttattcgtctattccacgtatagtaaaatttggtcgctagctcaaatttagctttactattcttattttgaatctctgcttcatttctagcatctgataattcccatttcttttaaagtggtatatgtgttgaaaaatgctttgggtaaatttttgtcttaaatttctgtgtatatttttaaaatttattaagattgtcacaaagatatttttaaatgttgcgcatctgttgcagagtaactatttttcaaaactatgtacttatttgcatatcaaatgctgagttgtcattatattttattttgatttttttctgtttgtgtgtccataaatgaggagccatctggagtggttttaaaatttagagaaaatagaatggatgacttctctttagttttattcatattccatagctactgagatattagatgatattagaacctttcaagcaacaatgtaaacctcaacactcttatgtgcaagctgacattacctgtcgatctaacactcttttggtagtggggaatagaacataaccataggcttactaatataccattttcttgttatttgatacagccattatgcctgggtccccttttctgtaatatactttctcctttgccattgctaccatattagttataaggtgtgacaattaccagacttttttcagcagatattttttctgcaggtaggtctaaagtatactggctttctgcatcatatatagaccatgtcaggcttccttgatttatactttccaccagatggatgaaggaataccagtgatatgcttcttgactgccctatgactaacctttgttttcagaatttttcttattcaggaaaggagggttgagtggcattttgctagggaacttcttttatcatcaagaggtattatagattactaccttctagttttgttcatgtaggtcaccataatgcctatcattgctggtacatttacttattattttaccattaatctgtgagggagatgttagatatgagtgctaaatttagctgtcttattcagatgttaaaacttttttttttttaatgattcttccaaatggccagaaatttcatgaagttgttacagtaacccatttcttactttaaatcttctggtaagtctttacatgtagtgggcactcaataaattttgtttttacctgagtgaattaattagtggtgtcacagagtaaattttctatgaaacagtaccttgccagggcaactaggcaggagaaggaaataaacggtgttcaattaggaaaagaggaagtcaaattgtccctgtttgcagatgacatgattgtatatcgagaaaaccctattgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaaatacctaggaatccaacttaaagggacatgaaggaactcttcaaggagaactacaaaccactgctctaggaaataaaagaggatacaaacaaatggaagaacattccatgctcatgggtaggaagaatcaatatcatgaaaatggccatactgcccaaggtaatttacagattcagtgccatccccatcaagctaccaattactttcttcacagaattggaaaaaactactttaaagttcatatggaaccaaaaaagagcccacatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgctgcacatctacaactatctgatctttgacaaacctgagaaaaacaagcaatggggaaaggattccctatttaataaatggttctgggaaaactggctagccatatgtagaaagctgaaactggatcccttccttacaccttatacaaaaatcaattgaagatggattaaagacttaaacattaggcctaaaatcataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaagttttcgcaacctactcatctgacaaagggctaatatccagaatctacaatgaactcaaacaaatttacaagaaaaaaaacaaacaaccccatcaaaaagtgggcaaaggacatgaacagacacttctcaaaagaagacatttatgcagccaaaaaacacatgaaaaaatgctcaccatcactgaccatcagagaaatgcaaatcaaaaccacaatgagataccatctcacaccagtgagaatagcagtcattcaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaatgtggcacatatacaccatggaatactatgcagccataaaaaatgatgagttcatgtcctttgtagggatatggatgaaattggaaatcatcattctcagtaaactatcgcaagaataaaaaaccaaacaccgcatattctcactcataggtgggaattgaacaatgagaacacatggacacaggaaggggaacatcacactctggggactgttgtggggtggggggaagtggggagggatagcattgggagatatacctaatgctagatgacgagttagtgggtgcagcgcaccagcatggcacatgtatacatatgtaactaacctgcacattgtgcacatgtaccctaaaacttaaagtataataataataaaaaataatttaaaaaaaagaaacagtaccttaagcttttaaggataatgttataaaattaaagtttttaataacattattgtaaagataatattaatttattatagacaattggtaatacagaaaaatcttactttagtaagatacccatcagcttttccataaacgtatttatacatttcatcacaaaattgtcactatgttaaattgaaacaaaatatgcacatgtttcacacggttcaatgcgatgttttaatacaggtatatgttgtataatggtcgaatcatggtaattaacatatctattaccttaaacatttataatgtgtttgttgtgagaacattcagaatcctctcttctagctatttgaaatgcattattgttagctataatcaccttactactgttcttgtactctattgcatcataggtattcctcctatgtgtaatattgtatgcattaaccaacatgtccctatctccccctcctcctattctctccagtttcttgtaatcatcattatactcttaatgtctatgagatcttttttttaaagataccatatatgactgagatcatgtggtgattgtctttctgtgcctggcttatttcacttaagaaaatgtcatctaaactcatccgtgttgtcccaaatgatgggattttattttttatggacctttttcatggctgaaaaatatttcattgtgtgcatgtgtgtatgtgtatttatttgtttattcacactttctttatccattcatccatgtttggtatttaggttgatcctatattttggttattgtgtgtagtgctgcaatatattaatacattgaagtgctgatgtctcttcaacatactgattttatttcctttggatatacacccagtagtgagattgctggatcatatagtattatatttttattttttttgagaaacctccaactgtttttgatgtaccaatttacattcccataaaaaatgtatagagttcccctttctccacatacatgccagcatttgtttttttcactgtcaattttataatttacccatggctgtttaggagcatgttctttaatttctatctatttgtatagtgtttgaagttccttctcttttcttctagttttatttcattatggtcagaaaagatacttcatatgattttgatatatttaattcattaagacttttttcctaacatattagctaacctgaagaatgttgcatatgcatttgagaagaatgtgaattctgcagcttttggatggaatattttgtatatgtgaagtcatttttgtcataaattcagtttatgttcagtgtttccccatatattttctgccttgatgatctgtcgattgctgagagttgggtgttaacattcccctactactattgttttgctttctatacctccctttggatctattaatgtttgctttctatattaagttactccaatgtgcattccatataaattctcgattgttctatcctcttgtattgatccctttatcagtaagtattgacctcatttatctctttttatagtttttgacttgaagcctattttgtctaatagaagtatagttaatcctacttacttttccatttgcgtgcaatatgtttttgcatctcattactttaagtctatgcacattcttaaaggtgaattgaatcttttgttggcagtatgtagttgggtcttgtttctttattcattgactcactgtttgtcttttatttggagaatttaagccctttacattcaaggtaattattggaaggtaaggattttgtactgccatattgctacttgttttctagttgttttgtagaacatttctttctttcttctcttactgcctccctttgtgttaagtgattttctctagcaatatgatttgatttcttgctttttatttttagtgtatatattgtaggcttttgttttttgcttaccttgagcctatcaaaaacatcttattattttaaaaggctattttgaattgataagttaattttggtcggaagaaaaggaaaaacccactctattctttaacttcattactcttctacattttgcatttttgatgtcataatttacatcttatattgtttatcccttaaccaaatcattttagttgttgttatttttatttgctttgttttttaaccttcctaataaggatataattgtttcttgacccacgattaccatgttagagtattctgaatttgtttagatacttatttttacctgtcagttttatagttttgaactttttttgttacacattaggattattattttttctttttgttcgaacaactcctgaaagtattttttttgtaatgtagttctggttgcaagggttttcttcagcttttgtttatctgggaatgtctttagtctttatttctaattaataagtttgctctatacggtattcttggcaggcagttttgttgtctttgaatatgtcatcccgctctctcttggcctgtggggtttctcctggtaactctcctgtcaggcatattggaattcctttatgtgttatttgctttttttttttttttttttctcatgctgctttcagtgttctctgtctttgacttttgagaaagtggttatatatgtcttagggttatcttatttggattgaatctgttttgttacctttcacctttctgtacttgaatatttatatctttcttcaggtttggacattttctgttattttttttaaataagctttcttccccattttcattttttattcttttttgaacactaatgatacacagatttgctcttttgacactgtttcatagaacctctgtgtttttctcattgcttatctgttttcttctctgagtgtgtattttccaatagcttgtttttgaaatcagtgattcttctgctttgtcattctgctattgatgccctttattgcattttttttttttgagacggagtcttgctctgttgcctaggctggagtgcagtggtgcaatctcggctcactgcaacctccacctcctgggttcacgccattctcctgcctcagcctcccaagtagctgggactacaggcgcccgccaccaagcctggctaatttttttgtatttttagtagagatggggtttcaccatgttagccaggatcatctcaatctcctgaccttgtgatctgtctgcctcagcttcccagagtgctgggattataggcgtgagccaccgcaggtgtgaggcctgcatttttcctttcatttattattctttttagctcctggattactgtttgattttttaaattatttcaatttgtttgttgaatttctctaacaaattcctcatttgttcctctgtgttgtattgacattgctgatttttcttaaagcagctatattttaattctttgattgcctatgatttatgtgcatatgtttaggattagtaattggcaccttgttttgggcgtttcatgaggccatcttttccaagctaatcttatatcttctttacatgtgtctctgtatgtttattgacaaattaggtatttttttccagtctttgcagtctggatttgtttgtgactgctctgtttcggtgggcttgttgacatattctgagcatactgactcttgtatttcattttagtgctagaaggtgctctgagcccagctttgacatgattgtctaatgcaggatccaaactcattgtgatcatgggagatccatattgggtgcccaggccatgtaagagatcagggtcagaccctcacatatgaaggattgtagaccatccatctgacattgtggcactcataaacatcctctgtggtggggcatcctctctgccagggatggtaagccactgccaagttctctgtgctgcctgttactagccctactctttcttttttccataggtggcctcaggtggttcagccccattgtacttgtgatgctcttcatgggctgatgcagaagcaaatctcccatgaagggattcaggatggtagagaagcataatgcctatctccggcttcctcttttgagtgtagaatccctgagtcctggagacctttctgtgtatagtactctaagggcttggggatggggtattgtggtcacagaaaactgattctcttaccatccaaccatacttttactagtctgtagtctggagaggcttcacagccttacttgtgcattcaggttttttttagccctcgtgaaggcaattgtatgtgtgagtggttgttcaaattgatgtttcttcgtgggtataattgttggagaaacctattttgctgtttgctctgcttccttgaatttaacattgccatctttctaaatataatgctctgtattaattgcttctcttaatttgtcatgaacattattccttgctattaaattttctaattgtttcataatgtaatatggagtttaaaaacattataattattctcaatttcataaagaggatgatgagcattttttcataactgcatattctttctataatgtgttacaatagacttgcacctctaagaatttctgtaaagtatttggttttactcttttgtttgtctgtttcttcacatgctaattcattttgatgatcctatgctagcctcttgggaattcctctcactttcagattttctgaatataagaggcagttttacatgctatttaatatctgttttttttttacattcaatgttccatatacatatttgtttctgtcgttgattagctgtgtgactttgtgtagttgcttaacccagatttctccatcttagaatcagtcctgaacacagcaacttccacatagcattgttttgaagattaaataataaaattcatatgtacaatttggtcctctgtctggccaaggcatggtgtttacagtgtttaaaaattgatgcttatgtacacttaccaatcagaacagataccaactacaaacaattggcaccagcagaatattggctttcctcatggagtgagagagagctcagttaaatgctagttgctatcatagttgtaataagtaaaaataatcatgagggtgacaattaagatgatttttggccaagcagttaccagactaagttaattttatgtcccaaataggcacaaagagcatgagcctttcatacatgaactttattctgaaatttttatattctgctgtaatattaacatcgaaacatggaagtctcagttacacagatatataaacaatctcatactttatatttcattctgtttagttcaaacttaaatagactttcagttaaatcttgaagtttttcttacctaaagaagatacatatttatgcaaattaattcaaaagtacttttttttttttttttgagacggagtcttgctctgttgcccaggctggagtgcactggcacgatctcggctcactgcaacatctctctcccaggttcaagcgaattctcctgcctcagcctcccaagtagctaagattacaggcatgcaccaccatgcccagctaatttttttgtatttttagtagagacagggtttcaccaagttggccaggctggtctcaaactcctcacctcaagtgatctgcccacctcggcctcccaaagtgctgggattacaggtgtgagccaccacgcctggctcaaaagtactatttttattaattttactattagtttactttattctggttagaatctattgccacactattttctatattgattgactctttattatcatgtgttaatataattaagatgaattttagcattctttatcaaagttatagtatttagccttgtgtttatataacttaacagacataccattcttatgaatttttaaggattatgctaaagattattccctctttagctataacttttatgttccagttcatctttaaccatggcattgtaaagaggttaaggtaaaatttcaacacatgatttatggtacatactgtcttgcacaaaactttgagctatatgtgttattaatttttaaacaaaacttggaagatgctctttgggcacttttacaatccagctttttaagatacattctttgttttgatagctattatacttgatattatgttagatatttgtaatgctttttactgtttcctttagcttgccagtgtaatggacatagcacttgcatcaataataatgtgtgcgaacagtgtaaaaatctcaccacaggaaagcagtgtcaagattgtatgccaggttattatggagatccaaccaatggtggacagtgcacaggtaagtttcttttaagcaaattttggtgtatttttactaaggaaaagataattaagaaagcagcgcctgttgtggagaatatatactactacagaaaattttttactcagttttagtatgttttctaaagtaatacatattagaaactgtgaactataaaaattctgtaatatgcttgattcaaaaatattcctttttcttatttcaaaatgaatgcatgtttcttattgtaatttctcaaacacagataaataaaagaaaaaacacctactatctcactattcaaaaataatcattgctgatagtttttttaataagtaataatttattgttttgacttcagaaataataattaaaagttaaatgtgtttaacttacatcaggtaagatttttattgcacagggtggtagtatagagtagtatctaggagagtatgggtttggaaccaaatctgggctgaaatcccaactctgtcactgttcaaatgtatgaccttggttcattaacctctcagtgtcttatttttcccatatgtaaaatggagatgataataattcactgagttgttgtaaaggtcaaatgagattttatgtaatataggccttaggaattgaagcacataaaaaagagcattataaatgctagccataatcatcacattcttgtttactaaaccctactttcctccatcttcctctctattctgccacttctttctcctactttgtaaataatatttgttctttaaatataatttccttttaaagtagaatttaatagaaatccttcattatctctagattggaacttgtcttttaaatttttaatctaccgtctctaaatggagtttgcctacatagcacccacagaaatacgtttttggctgtgaagatgtgaggaatttgagggagtggagcctgactctggttagataatttttttttaacactagctgcatattagaaccagctggaaagcttttaaaaatatggctgtctgggccactttctaaaacaattaaatcattatcttggttgtggttgtagggtgattcttaggtaattgttctttttaaatgtttcccaagtgactaatatgcactcagagttgagacacatggggaatgatgaactgattcaacatttgagtcaacaaaattgtgcagctaatacagttgtaccttggtatccatgcggattaattccaagacctttcctgtgtaccaacatctgcagatggtgaagtcccttacatagtggtgtagtatttgcataaaactgatgcatatcctcctgtgtacttcaaatcatctttagttgtaattcctaatacaatgcctatatttcacttcattcacatggattcaaagtatacttggtgcatggcaaatataaattttacattttggaatttgggggattttttctgaatatttttgatctgctgttggttgagttcacagatgtggaacccatgggtaaggagggcctactgtagtatgttgggtgacaaataaagataggtgaatggaagttttgtgttatgcagtgctctgatccatttgaagctctaatacagatgcattggcccacatttaacattttttatatcctaggcaccgtactaatagctttattgtcattattttatattagctttacaaaactgtatggtattactttgatcctcattttacatgtggacacaaatatttaatgcacaaagaagttatctaaaatacccaagatcatattgctagttagagtaagaaaatgtctcattcctaaacctcgctcttaactgttaatgcaggagttatgttcatatggaccaggaagatccagttgttctcacctaaaagccacagcttagtgctctgtccagtggatacataagatgcagtaattatgggccaagtggaatccacaaaatttagggtctacatactagagtcatagtgttttttaattttatatttctaaaaagaccaaggttttcaagacaagctctttctaaagtgtttcagtactgaattttccatggccatacattttattggagaaagtgcatgtgtcagataggttatgtgtgttaatgtattgattgcataatttgaagaaaaaatatactatgagatgttttcattcacattacaatttgtgtgtctctgtaaactgtcgtgtatttaatataaaattgtggtatgttttattttacttttatgaaaattattttggatatattttccaacatattttcatgcccatatgtaattagttcattctgtaatttacttaatatatttctgttggcatttatataatgcttctaaccataactccaattcttgagaatgactttttagcaaagtgaaacccacataacagacacttaactatgtacagtgttgtgcaactgtctgatttttttttctttttttttttagacagagtctcgctgtgttgcccaggctggagtgcagtggtgtgatctcggctcactgcaacctctgtgtcctgggttcaagcaattctcctgcctcagcctcccaagtagctgggggggggggactacaggggcccgccaccatgcctagctaattttttttttttttgtatttttaatagagatggagtttcactatgttggccaggctggtcttaaactcctgacctcgtgatctgtctgcctcagcctcccaaagtgctgtggttacaggcgtgagccaccatgcctgggcattttttaaagtttttaattaaaaagaattcaatttttaattttgtgggtacatagtaggtgtatatatttatggggtacatgaaatatcttgatacaggcatgcaatgtgaaataatcacttcatggagaatagggtaacctgctcaagcatttatcctttgtgttacaaagaatctaattacactctttaagttatttcaagttattttaaaatgtacaattaagttgctactgactatagtcaccttattgtgctatcgaatagtaggtcttcttcattcttcctatttttttgcacctcttaactataccccctgccctccagccctctaactattgtttttgtacccattaatcatccctaccttctccccagcaccccattacccttcccagcctctggtaaccatccttttactgtctatgttcatgaattcaattgttttgctttttagattccgcaaataagtgagaacatgcaatgtttgtctttctgtgcctgtcttatttcacttaacatagtgatctccagttctatccatgttgttgcaaatgacaggatctcattcttttttatggatgaatgccataaaaaatatataccacattttctttatccattcatctgttaatacagcagtccccaacatttttggcatcagggagtagttttggggaagacaatttttccacggatggggtggtggtggggtatagtttgtggatgaaactattctacctcagatcatcaggcattagttagattctcataaggagtgcgtagtctagattcctcacatgtgtagttcacagtagggtttgagctcctatgagaatctgatgccaccacagatctgacaggaggcagagctctggcctgaatgctttttcacccgctgatcaccttctgctgtgcagccggttcctgacaggaaatagactggtaccagtccatacccaggggttggggacccctgtgtaatggacacttaggttgcttccaaattttatctattgtaaacattgttgcaacgtaggagcgcaggtatctctttgatataccagtgtcctatttttaaggtttatacccagccatggaattgctggatcatacggttgctcaatttttagtgttttgaggaaccttcaaacttttctccatagtacttgtactaatttacattctcaccaactgtgtacaagggttctgttttctccacatcctcacaaacatttgttattgcctgtctttggatataagccattttaactggggtgatattacagttctgatttgcatttctctgatgatccatgattttgagcacctttgcatatgcctgtttgtcatttgtatgtcttcttttgagaaatatctcttcaaatattttgcccactttttgattggattattagatttttttctgtggcattgtttcagcttcttatatatttgggttactagtcctttgttagatgggtagtttgcaaatattctctcccattctgtgggttttctcttcactttgttgattgtatcctttgctgtgcagaagctgtttaacttgttgtaatcccatttgtccgtttttgctttagttgcctgtgcttacagggtattgtccaagaaattttggcccagaccaatgtcctggagatttttccccaatgttttgttctggtagtttcatagtttgaggtcttagatttaagtctttataccatatgctttttatatatggcaagagataggctctagtttcattcttctgcatatggatctccagttttcccagcaccatttattgaagaatctgtcttttccccagtatatgttctggtcacctttgtcgaaaatgaattcactgtagctgtgtcgatttgtttctgagttctctgttctgttccattgaactatgtgtctgtttttatgccagtattatgctgctttgcttgctgtagctccttagtataccttgaagtcaggtaatgtcattccttcagttctttttgctttggatagctttggctattctgggtcttttgtggttccatatatattttaattttttttctgtttctgtgacaaatgttactgttattttgagagggattgcattgtatctgtagactgccttgggtaatatggacattttaacaatattgattcttccaatccatgaattgattcttccaatgcatttttggtatcctcttcaatttctttaattagtgttttatagtttccattatagagatctttcacttctttggttaattcccaggtatttaattttatgtgtggctattataaatgggattactttcttaatttcttttttatattgttcactattggcatatagaaatgctactgatttttgtatgttgattttgtatccttcaattttactgaatttatcagttctaagatttttatggagtctttaggtttttccaaatataagatcatattatctggaaacaaggataatttggcttcctcctttcctatttggatgccctttatatctttcttttttcttattgctctagctaggacgttcaggactgtgttcaataacagtggtgaaagtgggcatccttattgtgttccagattttagaagaaagcctctcaattttcccccttcagtatgatactagctgtgggtctgtcatatatggcttttattaggttgagttatgttccttcaatccccaattttttgagggtttttatcatgaagggatcttgaattttatcaaatgcgttttcactgtcaattgaaatgattagatcatttttatccttcattctagtgatatgatgtgtcacatggactgatttgcatatgttgaaccattcttgcattccagggggataaatcccacttggttatgaatgatctttctgatgtactgttgaattttgtttgctagtattttgcaccaacattcactagagatattggcctgtagttttctttgtttgtttttgacatggagtctcgctctgtcacccaggctggagtgcagtggcacgatctcagctcactgcaacctccacctcctgggttcaagtgattctcctgcctcagcctccaagtagctgggactgcaggtatgtgccaacaagcctggttaatttttggatttttagtagcgatggagtttcaccatgttagccaggatggtctagatctcctgaccttggcatctgacagccttggcctcccaaagtgctgggattacaggggtgagccaccacacccggctagttttctttctttttttttcttttcttttcttttctttttttttttttttggtgtgtgtgtctttgtctggttttaatatcagggtaatattggccttgtagaatgagtttggaagtatttccttctcctctatttttcagaatagtttgagtaggattggtattagttctgctttaaatgtttggtagaattcagctgtgaagccatcagaccccaggcttttctttattgggaaactttttattataccttcaataacattacttgttattggtctgttcaggttttggatttcttcccagttcaatctcggtaggttgtatctgtgtaggaattttttatttcttctagatgttccagtttattggcatgtagttgttcatagtagccactagtaatcctttgaatttttgcagtatcctttgaaatgtctccttttcctttctgattgaatttttttgtgtgtcttctctgttttttcttagtttgtctggctaaaggtttttctattttgtttaacctttcaaaaatcaaccttttgtttcatcagtcttttttttattgttttcttcatttcaattttattatttctgctttgatctttcttattttcttctattaattttggttttggtttgctcttccttttctagtttttaagatgcatcattagattatttgaagcttttcctctttttttgatgtaggcacttatagctagacacttcctcttagtattgctttgctgtatcccataggttttagtatgttgtgtttctattatcatgtttcaagaaaattttcagtttccttcttagtttcttcattgaccctctggtcattcaggagcatattgtttaatttccatgtatttgtaaattcctcttgttattaatttctagttttattccattgtggtcagagatgatgctttatattatttcagtttttttcaatgttttacaacttgctttgtgacctaacatatggtctatacttgagagtgatccatgtggtgaggaaaataatgtgtattctgcagctgttggatgaaattttctgtaactatctgatagatccatttggtctatagtgcagattaagtcccatgtttctttgttgattttcttcgaagaaagatctgttcatagctgaaagtgcagtgttgaaatctccagctattactttattggggcctatctctctctttacctctaataataatatttgctttatatatctagatgcttcattgttgggtgtatacatatgtttaaaactgttatatcttcttgctgaattgaccgctttatcattatagagtgaccttctttgtctattcttttgtttttcgtcttgaaatctgttttgtttgatgtaagtatagctactcctattcttttttggtttccatttgcatggaatatatttttccattcctttatcataggctacatgtgtctttatttgtaaaatatgtttattgtaggcaacagattattgagtattttttttccatccattcagccactctcttgattgaagagtttagtctatttacgttgaaagctattattgataagtaaggacttacttctgccattttattatttgttttctggttgttttgtgttcttctcttccttctttctttctgtcttgctttagtgaaggtgatatgattgagtttcttggtttttatttcttgtgtatcttgtttttttgttttgaggttaccgcgagacttgtaaatagtacattataacccattatttaagctgataacaacttgacactttttgtggtcctcttttccttctttctttccctcctgtcttcctttagtgaaggccttttttttcctggtgatatgatatagttttttagtttttattttttgtgtatccattgtatgttttttggtttgaggttaccatgaatcttgcaaaaactaccttatagcccattattttaacctaataacaacttgacactgtttgcataaacaaacaagcaaatgaaaactaataaaaactctataccttaacctcatccatctgctttttaacttgttattgtttgtatttatatcttattttactgtcaacatcttgaaaagttgttattatttttgagtggttcattgtttagtctttctatgtaggataagagtattttactcaccacagttacagtgttataatattctgtgtttttatgtgtactcactgttactggtgagttttgtgttttcaggtgattacttattgctgattaatgtcattttttttttctgtttggagtactccctttagcatttcttttaggacaggtctggtgctgatgaaatcactcagcttttgtttgtctgggaaagtctttatttctccttcatgtttgtaggatatatatacacttcaaatatatacattttaggatatatatacatttcaaatgtaaaagttgttttccttcagcactttaaatatgtcatgccattgtctcccggcccataaggtttccactgaacagtctgccgccagatgtattggagctccattgtatgtgatttgttgcttttcccttgctgcttttaggatcctttctttattcttgatctttgggagtttgattgattactaaatgccttgatgtagtcttctttgggtttaattctgtttggtgttctataaccttcttgtactttgatattgatatatttctctagtttgagaagtttcgtgttgttacccctttgaataaactttctacccttatctgtttcacttcttcctttttaagaccacgaactcttagattttcacttttgtagctattctctaaattctgtagatgtggttcattgtttttaatcttcttcttttgtcttttctgacagcgtattttcaaatagcctgtctttaagctcactaattttttcttctgcttgattaattctgctattaaaagactaatgcattcttccatatgcgaattacatctttcatctacagaatttctccttgataccttttaattatttcagtctctttgttacattcatctaatagaattctcaatttcttctttttgttatcttgcatttctttgagtttcgtgaacacaggtattttaaattctctgtttgaaaggtcacatatctctgtttctccaggattggtccctggtggcttatctatttcatttgatgaggtcatgttttcctggatggtgttgatgctaatagatgttcttcattatctgggcattgatcagttaggtatttattgtagcccccactgtctgggcttgttggtacctgtcctccttgggaagactttctagatgtttgaaaggacttgggacttggatgttatggtattagttgtatctgctataggggggaccctaagcccagtaatactttacttacaaactcatagagggactgccttgatggtcttggacaaggtctgggagaattctggattaccaggcagagactattgttctcttaccttattttctcccgaacaaacagaattcctctctctgttctgggccacttaaagctgggggtggagtgacaaaagtaccaccgtggccatcaccagtatgactgtgctggtcagacatgaagccagcacaacattggatcttgcctacagcctgctgtatgcactcactggttactgcctgtgttcgcctaaagtcctggggctctacaatcagcaggtggcaaagccagctaggcctgtgttcttcccttctggatgacgagttccctcaggcccctggtgggtccagaggtgctatacaggagttagggactagagttaaaaaccttagaagtctacttagtgttctattgtactttggctgagctggcactcaaaacgcaatatgcagtccttcccactcttccctcccttttccaaaggcagaagagcctcacctcatagccactgccatcaaaggccatggggagtactgccagactacagctgatgatcccttaaggcctaagggctcttaagtaagcttatggtgaatgctgcctggcctgggactcaccctttaggggagtgggctcccctctggcctagggtaggttcagaagtgccatccaagagttaagtcctaaaattggggatcccaagaccccacttggtgctccatccacctgtgactgtgttagttcctaaggtacaaggcaaagtaccatttacttttccctgtgcttttctctaacataagagttttgccctttagccactgcagctggtaatgtgctgtgtttcacctgaagccagcaagtctcagaggctcacctaagaccctcaacatagaacgtgggtattgctgctggttattcaggacccaagtactcttcagttaaccaggtgatgaatgcttccaggactgggtcctttccttcaagtcagtgggttcctttctggcccagtatgtgtctagaaatgtcgtctggaagctaagacctggaaggagggcctcatcattctgactggtgccaagacaaagtcctctccacttttcccacacctcttctcaggtggaagttaggggtctcttttggaaccacgatttgtgcagtctggggttagaggagaggcaatgccagtactcccttagtcaccccctctgctgtcccagcaggtcctgtgccctccagttcactgtttctgggcccagttcagcactaggacttgcctaagagttgtagtccttatggcccagactgcctttcaacttcatttaaagactcagagcattttagcccttggtggtgaggtcagtgggaactgaagttcagactgctaggattggcgattttcctttgtctagtgctggtttgtatgtgccttctgtaggcgggtgtcccctgagttttgttcagttctcctttctactatagcaggacagcagtgagttcagtccctcacgattattgttttctccctcctttagtgcctagagatactttcctccccgtatactgccactgcagggaggtgggagagggctgatgttggcaattggagaatttttaagaaatcacttcagtgcctctttcactgatagaagttaacaccaggtactatgagggctcacctgatttttggttttatgaaggtgttttttctgtttagatagttgttaaattgatgtccctgttggaggggacgattgatggaaccttctattctgctatcttgctctgtgtctctatcacctttatctatttcttaaacattttttatcatcccaaaaggaaactccgtactcatgaaggagtcaccccagcccctggcaaccactgctctgctatctgtctttacaaatttacttatattctagatatttcatataaatggaatcacagtatgtaacatcttgggatttccttctttcactaaatgttatgtttttgatgttcattctcattgtagcaagtaccagtacttaatacctttttacagctaaataatactgtggttttgatttccatttccttaatgattaaatattgaatatcttttgatgtgcttgctggcccttgtatcttagtttggagaaatacttattcaagtactttacctgtttaaagaaactttgttttcttaaattttggaaaaatatgcataatataaagtttaccattttaaacatttttaagtatacagtttagtggcattaaggacatgtgcattgttttgccaccatcattttcattcctctttaaaactttttaatcttgtaaatctgaaactctataaccattaaaaaatagctacccactcccccacctccttccagaccctaagaactgccattctactttctgtttctgtgaatttgatggctatagatacctcatgttaagtggaatcatgcagtttttgtcctttggtgactggcttatttctcttagcataagccttcatggttcattcgtatgatagcatgtatcagactgtctttcctttctaaggttgaataatgtttcattatgtattagtacattcacaatgttgtacaactgtcacctttatctagttcttacacacatcatattttatctatctatttattcattgatggacacttgagttgcttccaccttttggctgttgtaaataatgctgctaagaatatagcttacaaatatctttgtgagtatttgtgtcttttcatatgctttttagccatttctttatcttccttggagaaatgtctattcaaatcttttacttattttataattgggctttttttgctgttgaattgaaaaagttctatatatcttctagatatgaggctcgcatgagatatatgatttgtattttccaccattctgtaggttgtgttcacttttttgatggtatcctttaaaacgcaaaagtttcaattttgatagtttatctatttttttattttgttgcttatatttttggtgtcatatctacaaatccattgccatatgtaacatcacaatgattatttttttgccaacataggtaaaagtaatatatgaatggctctattagctccaaaatgttttaaattattatggtaagttttactattctaacaggcagagtgcttttaggaatatgttcccctttaaggataatacttctctgctaggttgaagacaagtttagttatttcacattaatttttgttactgacgtgatacatttgacaagccaaagtaaaggcaatgaaaaattaaatagagtgaataatagatgcctgttgtattcactgttatactttctccggtagtttatgaaatttttaaataattctttaagagtttccgtgtttcttaaagttggcaggaaatattttgctgtctatgacttttatatggtgatgtgatgggtaaaagtcatttttattttttggggccacattagctacctaataataaacaataagtcacatctgatgaattattttaatgtagtaatgtctaaaatcaatttataaagcatggaaagtaaacatttattactattctttcatttttagttcactttattgggaaaagctcatttttaaaactagtaaatatacttattaaaattcaaagtgcatgccgatattaagggaaagtaggaaataaatttatatttgactggcaaagctttaaatatactgcagcatatatattattttaaaaatccaacctaataaagccaatctaacattattgtcaattattattatattatggttagtcagttattataagttactcttaaaatgttttattaaaattttatttataatgttcaggaagattctctgattaaaaacttgctttggagatatgtatataaaatatttatgtgtgtatatgtatactatatatatatgtatatgtaatctttgtggctatggaaaaatataacaatgttaaatgcttgggctttggaatcataccacttgagtctacatgctggcaatgccactgtcaccttggataaattatttaacttttaacttaattttattttttgagatgcagtcttgctctgttgcccaggctggagtgcagtggtatgatctcagttcactgcaaccccagcctcccgggttcaagggattctcctgcctcagccttcctagtagctgggacgacaggcacgcgccactgcacccagctaatttttgtatttttagtagagatggggtttcacatgttggccaggctggtctcagactcctgacctcaggtgatccacctgccttgacctcccaaagtgctggaattacaggcatgaggcaccgcgcctggcctatttaactttttagtgtcttagttttctcatctgcaaaatgcagctaatttaatttatgttgtaatggtaagtcataaatgtggtactttatatgttgtataatatatgttcctggcaaatgttaactccctaatcctagctattattgtgatattattattactattcataacatcaataagtttagtattttgataaaaatatatgattcaaacttttatggcagtattatttttgtcatattatttccaatctgacttataaactgtagtaaaagaaactaaattaatatttagttgaatagaagaatggctcagtacattacacattatgttatttgcaatgaaggaatatccttgaactccataaatacttattgaatgcctaataaatgcaaggaacaatgttaggacttgaatttatatacattgtgtgggtgctattatagtgttatgaagaaattgagtgatagaattagtgacaaagagatgaattctcattgaagaatctggtcttggaaggtctttcatttcttcaatatttaaaaaaataattggatatataatagttgtacatatttaaggggtacatgtgatattttaatacaaatagataatgtgtaatgatcaaatctgggtaactgaaatatccatcacctcaaacatttatcatttctttgtgttgtgaatgctccaagtctactcttctggatcttttgaaatatacaataaattattttaaactatagtcactttattatgctgtggaacactagatcttattctttctttctaactgtatttttatacccattaaccatttctatttatcctcatctcctcactagtgttcacagcctctagtaaccaccatttcattcactacctccaggagatcaattgttttagctcccacatatgaatgagaacatgagacatttgtcttttgtacctggcttatttcacttaacataatgttctctagttccatcagtgtcattgcaaatgacaggatttcattctttttaatggtggaataatgttccatttgtgtatatataccacattttctttcattgttcatctgtcgatggacacctaggtggattccaaatcttgcctattgcaaataatgctgcaataatcatggatatgcagatatttctttgatatactgattttccttcttttggatataaccagtagtagaatttctggatcatacgtagttctgtttgtagtgttttgaggaacttccataaacctccatactgttttccatagtggttgtactaatttacatcttgaccaacagtgtgtgagagcatgcccctttttctgcatcctcaccagcatttgttatattctgtcttttggataaaagccattttaactgtggtgaggtgggttgcatttccctgattattactgatgttgaacattttttcataaacctgttggccatttataagtcttcttttgagaaatgtctcttcaggtctttagcccaatttttaattgtattattattattattttgctattgagttgtttgagctccttatgtgttctggttattaatcccttgtcatatgagctatttgcaaatactttctccccattctgtaggttttctctttactttgttgattgttagctgtgcagaagcattttagcttgatgtgatttcattttttcaatattactttggttacatgtgatttagaggtcttactcgaaatctttgcccagaccaatgttctgtagaatttcctcaatgttggctgggcacaatggctcacgcctgtaatcccagcactttgggaggctgaggtgggcagatcatgaggtcaagagattgagaccatcctggccaacatggtgaaaccccatctctactaaaaatacaaaaattagctgggtgtggtggtgtgcgcctgcagtcccagctacttgggaggctgaggcaggagaatcacttgaacccgggaggcggaggttgcagtgagccaagattgcgccactgcactccagcctggtgacagagcaagactctgtctcaaaaaaaaaaagaaaaaaaaaaaaaaaaaagaatttcctcaatgttttcttctagtggtttcaaagtttcaggtcttacatttaagttttaaatctattttgttttaatttatatatatcttgagagttagggggtctagttccattcttctgtatatacaggatataattttctgagcaccatttattgagagactattcttgccccagtgtatgttcttggcaccttctttgaaaatgagttgtttataagtgtgtgggtttatttctggcctctctattctattggactatttgtctttatgccagtatcatgctgttttgtttgctgtatagctgtataccataattcgaagtcaggtaatatgctgcctctagctttgttctttttggtcaagattgctttggctattctgagccttttatggttcaatatgaattttaggatttttttttccatttctgagaagaatgtcattggtattttgataaggagtgcatttaatctgtagatacctttgggttgtatggatattttaacaatatttgttcttccaacttatgaacatgatatatattttcttttttgtgtccttttcaatttctttcatcagtgttttatagttttaattatacagagcttttactactttgattccatttattttatttgtagctattttaaatgggattactttttgatttttcagattgttctctgttgccatacagaaatgctactgaatttatatgtcaattttgtatcctgcaggtctactgaatttatttattagttctaataggtttttggtggagtctttaggttttttgaagtataagatcatatcatctgtaaacaaggataattttactttctcctttcctgtttggatgctctttatttctttcttttgcctaattactctgggtgggacttccagtactatgtctaataaaagtggtgaaagtgggcgtctttgttgtattccagatcttagaggaaaggctttcagtgtttccctagtcagtatgatgccagtggtgggattgttttatatgacctttattgttttgagttatatttcttgtatccctagttttttgagagtttttttttaaatcattaagggacgttgaatttcattgaatgctttttcaaccattgaaataatttttgacctttattttgttatatgttatagcaaatatgctatattttgttaaatgcgctatgatgtatcacatttatcgatttgtatgttgaactatcttgcacccctgagatgaatcttacttcattacgatgaatgatctttttaatatgttgttgaaatcagtttgctgaattttgttacagatttttgcatcttgttcatgagtgatattggcctgtagttttcttttcttgtgttttgttttgttttgttttgttttgtttgtgtttttgtttttaattgtgtctttgtctagttttggtatcaggataatgctggccagtaggatgaatttgagagtgttctctcatccttgactttgtagaatataataagtagaatttgttagttcttctgtaaatgatttgtagaattcagcagtgaaactatctgatattgggcttttctttgatgggagtctttattattgtttctgtttcataacttgctattggtctgtttagtttttctgtttcttcatggttcaattttggtagtttgtatgtatttaggaatttatacttgtctcccaggctttacaatttattgggatatagttgcttatcatagtctctaatgattctttgaattcctgtggtatcaattgtagtgtctttttttcatttcttaattatgttcatcttctcactttttttcttagtgtagctaaaagtttataaattttagttattttttcccaaataacttctccttttgttgatcttttatatatattttttagtctataacttattcatttgtgctctagtctttattagttcttctcttctcctaagtttgggtttagtttgttctgcttttttattttctaagatgcactattaagtgttcttatttgaaatcttttttgatgtaggcaacattgtttttgtggtgtcccataggttttggtatgttgtgattctatttttatttgtttcaagccattttaaagttttattcttaatttcttaattgaaatttaatgttttcattccttcagcagcgtattgtttcatttccatatatttgtatagtttccaaagtgtcattattcatttctagttaattccactgttgttagaaaaaatacttgatactctctttgggaggccgaggcagctggatcacctgaggttgggagttcaagactagcctgatcaaaatggagaaaccctgtctgtactaaaaatacaaaaaaattagctgagggtggtggcacatgcctgtagtcccagctactcgggaggctgaggcaggagaatcacttaaacctgggaggtggaggttgtggtgagccgagattgtggtgccattgcactccagcctgggcaacaagagcaaaactctgtctttaaaaaaacaacaacaacaaaaaccaacttgatattattttgacatgtaatactttgttgagactatcttcctggcctaagagatggtctgtcctcaagaatattccatgtgctaatgagaagaatgtatatttttcacccgttgaatgaaatgttctcttattgatcattaggtccatctggtctgtagtgcatattaagtctaatggtgcattgttgattttctatttaaaatatatgttcagtgttgaaagtgggtgttgaagtccccaggcattattatattggagtctgtctttctctttaggtctagtaatgtttgctttatattatctggatgctccagtgttttgtgcaagaaatatttgcaattttaatattctttggctgaatttgaccattttattattatataatgaccttctttgactcttcttacagtttttgccttgaaatctattttatctgacataggtatagctattcttgttttttgtttccatttgcatggaatatttcatttcatttccttcatttttagtgtatgttgtttttatagctaaagtaaatttcttatgggcagcatatatttgagtcttgttttaatccattcagccactctctgtcttttatttgaagaatttagtccatttacattcagtgttattgttgaaaggttaggacttaactacttccagtttgtcatttttcttctgattgttttgtacattttctcttcctttcttcctctcttcctttttagattagtgatttcctctggctgtatgttttaattccttgctttttattttttcaatttctattataggtgtttgctttgtcattactgtgaggcttgcaaaaatattttatagctaacaacgttaaattgataaaaactctaatctcaaagaagagggaacaaaaggaaaacaagcaaagaaaaaactaaaaaattctgtactctaacttttcctctaactccctcctactttttgactttttgttgtctctatatcttttcatattgtctatctttcaaaaattgttgtagttattatttttgatagatttttcttttggtcctcatgctgaaaatgtaagtgatttacacaccacaattgttgcactagagcaagcttgtctaacccgcagcttgtgggccacatgcagcccaggacagctttgaatatggcccaacacaaatcagtaaactttcttaaaacattataatttttttttagctcatccactatcattagtgatagtgtgttttatacgtggcccatgacaattcttcttctaatgttggactcttctgttagagtattctgaatttgtctttgttcttaccttttccactgaatttcatgctttcagatgttttcttgttatatgttagcagcctttactttcagattgataaaatctcttcagcatttttttttgtaaaatctcttcagcattcatctggtgatgatgaatttactcagcttttgtttgtctgggaaagtctttatttctcctccatattgaaggatatctttcctgtatgcagtattctaggttggaagttttttccctttagcacttttaatatgctatcttgctcattctggtctataaactccccactgagaaggctgctgccagaaatatcagagctcctttatatgttatttacttttttcttcttgttgcttctaggatgattctttcatctttgacctttgatagtttgattattatatgtcttgtggtagtcttatttcagttgaatcttcttgatgttctttcaccttctttacctaaatgttcgtatctttttctaggtttgaaaagttctcttattactttctttgaataaactttctaccccggtctttttctttgtatcctctttaagaccagtgactcttagattttcccttttgaggctcttttttagatcctgtaatcatattttattcttttttattcttttaaatctattttcatatagtatgtcttgaactaaatatttccgtttttgcttgatcaattttgtttttgagagattctgatgaatttttcagtcagttgactttttcagctcgagtgattttttattgtttatttcagtgtctttgttaaatttctctgttttatcttgaaatgcatcatgttttctcaaaacaggtgtattgaattctttgtctgagaatatatgtatctgccactctagaattggtcatgggtgcctcatttactccgtgtgatgaggtaatgttttcctgaatgctcttgatgcttgtggacatttgatgatatatgagcgttaaaaatttaggtatttgttccagtctttccagtctggcattgtttatacctgtccttgagaaagttttctgagaattcaaatgggattgagtgttaaattacttatttctgtggtccttgcagttgttttagcactagagggagccctaagcccaggtatgctgtactcttgcagactctaggtacatagcctgggtagacttctgaaagtgaagggagaattccttttgttatcaggcaaagtccctttctgtcttttccagaagcataaggagcccttctctaccctgaactgtctggagttggggaacgggtggcatgggcactttttatgtacatatttgtttatccaattatttgtaaaacaaaagatgtactataagaaaaatatgtcttcaaatcatgaaatatacagacattaaaaaaaattccaatcctatataactaatagtttcctccatttaggtcttactcttttgggttaagtttattgcaaggtgcttaatgggttttgttggtattatgaatacatttttttcctttaatattacatttgtaattggtaatgtctgtttttatatctgttatgtttttagttcattttgttgatctttttataggtttttgaatagtaggcttatctgattttcttaatttctctctatattttaagtttttaacagtgataaactttaatttttcagttttggggaaaaaagagttctttcaacataatgacagttctatttttaccttatgtttctctttttggcatactgtgactatctgttcatagcagacttttacagacgtgtttaatactttaatacacacactaggatgtgacccaaacattctctgagactcaagggtagtaaaaaggaagatgaattacctttttttctctcttctaagatgaggaaatttttcattttaaaccattctcacacattgtagattattcagagaagcagaaaatttattaccaaatgaggttgagcatttcttaaaataagtgtaggaagcttaattctctcaaactaggaacattgaaaaatctcaagctgcagatacatgaaaatagcttgagatggaaatattggttctatttattcttttgacacaacaatgttaaaagtttgtattctctcagtacatactacgttctgtgttgcacaggaaagccaacttgagattttgaatattccaaagagaggccatccttttgagctgttttcattctttttgttttcataaaaggaatttcaaaggtgaggagaactgaggctatgaaaactgtttggccctgatgtcagatattttagcatgccttcattatgggttactggaatatgcagtttattacttatttctgttagatgcttttaaaaagaactatctgtgggctaattcccaaagttcccctggggaactttgccatggctttatcaaacctactcccttcctcaggatctcttcttctaatttttatttgtacaaagttttatgttctacctcttcaaactttgactaagcattacttcaacttttgctatttgaatagtgatttttaggcccttagatctgatgttatagaatatcttcacctctggtttacaagtttttgacaatgaagtgtgtcatttacttgctttcttttcaggaacaagtggactaatatatctctatgtaattttgaaaactattcaatagtttcagttctgtaggtagaatactatttatttggggccagagagaaactattattttgtctaagggttcaatatttctctttaattttatttgatgtgatgcttagcccctataatgtattgcttgaggtttgcattacaagaatatggcactatttggttttttaaaaagtgatataagatgttatgattgaacttaataataaaaatggttcttatgccaactcacaagtgttgtagaattcctactggcttgaaatgacaggcctagggtgaagaaaagataaatttaaagtggggcatagttctacttatattctaatacgtataaaacatttatttagtacagttcagaagattataggttaacctaagaaactttaaacatacttttggttttattctgatatttgtacaattttttcaaaaggcaaaaccaaactaaattccaatttggacacacacttttgcattgctcaaatagtgcatgaatactaattagtgatggtggagaagttaattatattttagtcatgcctacagcaggtgtaggaaagcttcagcataaatattgtttataaatatttcataaacacattaaaatcctccttaatatattatttaggaagaagtgcctttctctcaaagacccatttttatatgccataggacatggatccaaatatttacttttctcttagttacacatacttttatctatatcttttatcttacctttactttatggccaatttattgattttatagtaataatttatgtttttaggctttaaaggaagtatataaacatttaattatatatttgcttaacagtacagcctattttattaggcaatttaaaatttttaactttctgctgaacatttccaaagtcccactactatacaaattaattagttaagaaatggaattcattgtcgttattattttaaatatattctctctccatccctatcttagttaatgatactatcactcttttaggctcaatttcaaaagcatcttcttattccatcttttccctctgccagtatattcaattccaaactgatcctggctctgcactatctatgatatttattcccttcttggagttcattgcccttattagtttaggcctccatgatcctgcttctcttgtgttcttgttagatgttacagattacctgacatgatataagttctcattaaatatttgttgaattaatgcatgaatgctctcactatgtatttatagactctctccatttacaatccacctttatacttccttcataggaaaagaaaaaagagacaattttcttcctaaaatcattcaaaaaacttattttgttactatttctaaaatatttgttgcctgcaaattatctatgaagtacatttaaagctcctttataaggcttgtaaatccttttatactgagcccagataacttttcttgctttacgtcttaccatatttttcatattctatcatatctttatttttttattttttgcaatttacattttactcaataatacattttccttgtcagttaagctccaagcattatatctaaaaatgtggataatgtttattgattataccaggtacattgctaaaaagctaatctaaatgtttttcgattaattctaagcatttaataaagattttagtatacctattttagttattatttattatacctattttacaaatgagtaaaccaaggacataagcctaactcctttttgaaaggttaagtcattaagtgctagaatgagaattgaaaccttgaactacctgattctaacagtggtctaaaccagtatgttcttatattttctttgactctcacatgcaactagtggccagctcttatccattttaaggccataatattgcacatccattgtcctacttatgtctattattatttagccttgactgttacattagcttctaaacagatcttttaatcagtattttattcagtttccaagacttccacaatattatatagtttttacttcatatccaaccactcctccctataaacccaggtctttgcctatttaaatgggtgttatgtccctgcctttgaactcaaattactcatttttcaaatctcagctccaataaaattccagcctaaaaacttgtcataatatccccactaacttcaggcaggtttgtgcctccatgattattaccatcagtgttcttgttaagtcataatttacttgtctttttatctagcaggatgtgaacatctttatgagagaatttttgtctcatatgttttgtagttttttacattcttgtatgctcactattaggtagtactgtacttggtacatagttagaattttgctgtattaatattactacaaagtaacatttgtttcatctgttttaatcatttttatattatcgaaaagaaaatattatttagtcttcctagcaaacgagttttctagtttcaactaatttttactttacaggaagaggcaaaaagtagcttcctgtttttaaaattattgattattctgcttgcttttattttcagcaattgggccaacagtgaaataacactggcagttccaatgtatgtattatatttgctctgaatgagaattggttttaattattatagatgatttcccattctcataactcttattgagcaataatgcaatattttatatataaattttttcattgaagactggtaagagaagttatgtaaagctcaaataaggaagaaaatgcaatttatgtaactctcttcagtttctagtttttctagagaagataaatagaatcttgatatctgacttttcagagcttaactatcttacattttgactcactaacctattaattctggagtcattttagcagaatgtattattctatacaataagttactagataacttcaaagtactaatatttcactttaccataacatatgtattttatgtgatttttaacatacattttgtgcattcttctagctgtaagcgtccaacttctggaatttcaaagtagtataagactatgtaactcccattatttgtaacagaagatatttgagtaattattcacatatgatattttatatattttaaaaattaagcactagtgttttcttgacaaatggaataatcgtttatttcatatattcctaacaacatcccaatacccaaaaagaaaaaaataactacccttaatatatgtaggaaaaacaaagaactcttcaaataaagttgttacacataatgttattattgatttacaagtcaaaagaataaaaatgcattttattgtctatttctaagtgtagaaatgtttagtatttataaaatggaaaagttctatttaatttgtttgttttgacataagtccatgtgaaagagctataaagaaaatacaaacagttcccccaaattgcctttctctcttcatggctttcagttaaacattgtaaacttaaggtctctttaccccttaaatactttagtgcatatttcttaaaaactaggaattctcttaaccacagtataattattgaaatcagaaacttaacattgatgcatattgttattaaatatagattttattcagattgtgccaattgtctcaatgttgttttttaaagcaaaaaaaaaatccgattattagttgtgttcatttttgaggccttcttagtcttttttttttaaaaaaaaatttattttactttaagttccagatacatttgcagaatgtggaggaggtttgttacataggtaaacgtgtgccatggtggattcctgcacctgtcttagtctttaacctgggtaatttcccaactctttcattttgtttaatgtcatttgacattttttaggactacactatattatttttgtgtatggatagaatgtgctacaatttgtgtttgctatgtcttcatgattatgttctgattatgcacttttggcaggaatacctctgaagttatgttaaattcttaccaacgtatcaggagccacatgctgtcatcatgctcttaatagggatgctcacaatgaacctttggttacagtggtgtctgccagacttcatcactgtaaaggtgctattttatcctttacaatgaatgagaatcttatgggagatactttgagactatgtgcatgttgtgttagtcctcagtctttcacccgctagttctaacatatattgatagttcttctgtaatcaatgattattatgatttttaccaaatggtgattttctaatttctttattctttccacattgattagttggctttctactataatgagaagcttgcttttctctcttttgtctacctgtctatgtatgtatgtatgtatgtgtgtaatcctttcattctttgagcatttccttatagtttcggcatttatcttgtacttttccagccataactgtggaagctagcatttatcaagcagctttggtacttttagtgggctctgagcatcattgtttgtggatcacctcagcagacaaactagagaatacatgtatgtgtacagaaatgcttacataggtgtctactcacagacacatgtattttcatacatatgcacaacctcacctacatcaatattcatttcttccttcttcacaatcctttaaaaatgcaataacattcttagcttgagaatcatagaaaaattggacatgggctggatttggaccccatatcatagtttagtgacccttagaatatatggtttgagtttcctctcattttttaatgtggtatacaatgttggactgtaaaatgtaaattttatagcactcttggccctttgagtctccaatttataacttaaatttttgaaacagtgctattttctggaagattccagttacttaaggtttaaattattgtttatgatcatgttcacgtactggagcactgctttgaaaacattcagtaagtactggatcaaagaatgaattactttaccttttttatcgaagaaagaatcatttcttgttttcccactctttaatataggcaagtacaggtgcctaatatcctaaataaacaaagtaatctgattaagtcatatggccttttctaaattgcaagagctatcatgtatccaaaagaaaaaaaaatttacacttctcataacagcaggttaatatatggcaatggttgtaaatctagggcttttttgtgagaaaaatcagatagtgaagatattgatatcagcatttcatatttatttatataaaaaagaaacagctatattgttttcctttttcataaactataaattgatgaaaatttgggcttagagctataaataaaaatgtaagttaaaaaatagaatgaaaatttatttttcatatttttaattgaccagtgaaaattatgtatatttataatatacaacatcatgtttggtttatgaggatatattgtggaatgcttaaattaacttaacatatttatcacctaacatacttatgattttttgttatgagaacatttaaaatctgctcagcggtttacaagtatgcagtacattgtttttttttttttattatactttaagttttagggtacatgtgcacattgtgcaggttagttacatatgtatacatgtgccatgctggtgtgctgcacccactaactcgtcatctagcattaggtatatctcccaatgctatccctcccacctcctcccaccccaccacagtccccagagtgtgatattccccttcctgtgtccatgtgatctcattgttcaattcccaccaatgagtgagaatatgcagtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgatggacatttgggttggttccaagtctttgctattgtgaatagtgctgcaataaacatacgtgtgcatgtgtctttatagcagcatgatttacagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcgccattctaaatggtgtgagatggtatctcattgtggttttgatttgcatttctctggtcagtgatgatgagcattttttcatgtgtcttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcaaaaattttctcccattttgtaggttgcctgttcactctgatggtagtttcttttgctgtgcagaagctctttagtttaattagatcccatttgtcaattttgtcttttgttgccattgcttttggtgttttggacatgaagtccttgcccatgcctatgtcctgaatggtaatgcctaggttttcttctagggtttttatggttttaggtctaacgtttaagtctttagtccatcttcaattgatttttgtataaggtgtaaggaagggatccagtttcagctttctacatatggctagccagttttcccagaaccatttagtaaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagtgtgatgcctccagctttattcttttggcttaggattgacttggtgatgcgggctcttttttgattccatatgaactttaaagtagttttttccaattctgtgaagaaagtcattggtagcttgatggggatggcattgaatctgtaaattaccttgggcagtatgggcattttcacgatattgattcttcctacccgtgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatggggttttctagatatacaatcatatcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagttattgcccattcagtatgatattggctgtgggtttgtcatagatagctcttattattttgagatacatcccatcaatacctaatttattgagagtttttatcatgaagggttgttgaattttgtcaaaggctttttctgcatctattgagataataatgtggtttgtgtctttggctctgtttatatgctggattacatttattgatttgcgtatattgaaccagccttgcatcccagggatgaagcccacttgatcatggtggataagctttttgatgtgctgctggattcagtttgccagtattttattgaggatttttgcatcaaggttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactactgagtattgccacaatttcagctcccgttattggtctattcagagattcaaattcttcctggtttagtcttgggagagtgtatgtatcgaggaatttatccatttcttctagattttctagtttatttgcatagaggtgtttgtagtattctctgatggtagtttgtatttctgtgggatcggtggtgatatcccctttatcattttttattgtgtctatttgattcttctctctttttttctttattagtcttgctagcggtctatgaattttgttgatcctttcaaaaaaccagctcctggattcattaattttttgaagggttttttgtgtctctatttccttcaattctgctctgattttagttatttcttgccttctgctagctttagaatgtgtttgcccttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacagctttatttctgccttcatttcgttatgtatccagtagtcattcaggagcaggttgttcagtttccatgtagttgagcgattttgagtgagattcttaatcctgagttctagtttgattgcactgtggtctgagagatagtttgttataatctctgttcttttacatttgctgaggagagctttacttccaagtatgtggtcaattttagaataggtgtggtgtggtgctgaaaatgtatattctgttgatttggggtggagagttctgtagatgtctattaggtccacttggtgcagagctgagttcaattcctgggtatccttgttgactttctgtctcgttgatctgtctaatgttgacagtggggtgttaaagtctcccattattaatgtgtgggagtctgagtctctttgtaggtcactcaggacttgctttatgaatctaggtgctcctgtattgggtgcatatatatttaggatagttagctcttcttgttgaattgatccctttaccattatgtaatggccttctttgtctcttttgatctttgttggtttaaagtctgttttgtcagagactaggattgcaacccctgcctttttttgttttccatttgcttggtagatcttcctccatccttttattttgagcctatgtgtgtctctacacgtgagatgggtttcctgaatacagcacactgatgggtcttgactctttatccaatttgccagtctgtgtcttttaattggagcgtttagtccatttacatttaaacttaatattgttatgtgtgaatttgatcctgtcattatgatgttagctggtgattttgctcgttagttgatgcagtttcttcctagtctcgatggtctttacattttggcatgattttgcagcggctggtaccggttgttcctttccatgtttagtgcttccttcaggagctcttttagggcaggcctggtggtgacaaaatcggttagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatccactgttagtctgatgggcttccctttgtgggtaacccgacctttctctctggctgcccttaacattttttccttcatttcaactttggtgaatctgacaattatgtgtcttggagttgctcttctcgaggagtatctttgtggcgttctctgtatttcctgaatctgatcgttggcctgccttgctagattggggaagttctcctggatgatatcctgcagagtgttttccaacttggttccattctccccatcactttcaggtacaccaatcagacgtagatttggtcttttcacatagtcccatatttcttggaggctttgctcatttctttttattcttttttctctaaacttcccttctcgcttcatttcattcatttcatcttccatcgctgataccctttcttccagttgatcgcatcagctcctgaggcttctgcattcttcacgtagttctcgagccttggttttcagctccatcagctcctttaagcacttctccgtattggttattctagttatacattcttctaaatttttttcaaagttttcaacttctttgcctttggtttgaatgtcctcccatagctcagagtaatttgatcatctgaagccttcttctctcagctcgtcaaagtcattctccatccagctttgttccgttgctggtgaggaactgcgtccctttggaggaggagaggaactctgccttttagagtttccagtttttctgttctgttttttccccatctttgtggttttatctacttttggtcgtcgatgatggtgatgtacatatgggtttttggtgtggatgtcctttctgtttgttagttttccttctaacagacaggaccctcagctgcaggtctgttggaataccctgctgtgtgaggtgtcaagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcagttggagctccctggctgctttgtttacctaagcaagcctgggcaatggcgggcgcccctcccccaggctcgctgctgccttacagtttgatctcagactgctgtgctagcaatcagcgagactccgtgggcgtaggaccctctgagccaggtgcgggatataatctcgcggtgcgccgttttttaagccggtccgaaaagcgcaatattcgggtgggagtgacccgattttccaggtgcgtccgtcacccctttctttgactcggaaagggaactccctgacccttgcgcttcccaagtgaggcaaagcctcgccctgcttcggctcgcgcacggtgcacgcacccactgacctgcacccactgtatggcactccctagtgagatgaacccagtacctcagatggaaatgcagaaatcacccgtcttctgcgtcgctcacgctgggagctgtagaccagagctgttcctattcggccatcttggctcgcagtacattgtttttagctacagtcaccatggctgtagatctccagaaattattcttcctttctaacaaaaactttgtacattttgaccatctcctcatttcccatccccttttccacaccagctcctggtaaacatcattctaactctctgcttttgtatattcgattctatttttttttttttttgaggtgaattctcgctcttccgcccaggctggaatgcagtggtgtgatcttggttcactgcaaccaccgcctcctgggttcaagtgattctcctgcctgagcctcctgagtagctgagattacaggtgcccaccaccacgcctggctaatttttgtatatttagtagagacggggtttcaccatgttggtaaagctggtcttgaactcctgacctcaggtgatctgcctgccttggcctcccaaagtgctgggattacatgcataagccactgcgcccagccgtaaatttgagattttagatactgcatacgagtgaaatcatacagtattagtctttttttaacctggcttattttcacataaaataatatcctctaggttaatccatgttgttgtaaaacaccggatttgcttatttttaaggctgaataatatttcatttttaaatatatatattataaatactatgtatataatgtggagaaaatatgggggatggaggattctgtgatgaggataggggttgtgtgagggggatggggtaattctttgaaggggattggggttctgtgagggggaagggggttccatgaggggatgggggttctgtgaaggggataggattctgtgaaggcgatgggattccgtgagagggatgagggattctgtgagcgggattggggttttgtgagaggatgaggcttgaatgagttgatcacttttgtgtagtattcatccattgatggatatttaagttgattttgtatctttgctagtgtgaatactgctgcagtaaacatggggagtgcatatatctctttgaaaattgatttcattttccttggatatatatacacagtagtgggatttttggatcatatgaaaggtccattttcagttttctgagtaaactgcatactacattccataatggccttattaatttacattccccccaacaatgtacaaaggttccctttttttccacatcctctctaactcttgttatcttttgtcttcctgataacagccattctaacagatgtgaggtggtatctcactatggttttaatttgctattccctgatgataaatgatgtggaatatcttttcctatatttattgaccattttttaatcttttgagaagtgtcttttcatgtcctgatatggtttggccatgtccccacccaaatctcatcttgaattggagctgctgtaattgccaggtgttgtgggagggatctggtagaagataattgaatcacaggggtggatctttcccatgctattcttgtcatagtgaataagtctcccaagatctgatggttttataaaggggagtttccctgcacaaaatcttttatcttgtctgccaccatgtgagatgtgcctttcacattctgccatgattgtgaggcctccccagccatgtggaactgtaagtccattaaacctctttcttttataaattgcccagtctcagtatgtctttatcggctgtgtcaaaatggactaatacagtaaattagtaccagtagagtggggcacttctgaaaagatacctgaaaatgtggaagcaactttggaactggttacaggccaaggttggaacagtttggagggctcagaagaagacagggaaatgtgggaaagtgtggaactccctagagacttgttgaatggctttgactaaaatgctgataatgatatggacaatgaaatccaggctgaggtggtctcagatggagatgaggaacttgttgggaactggagcagaagtgactcttgttacgttttagcaaagagactggcggcattttgcccttgccctagagatttgtggaactttgaacttgagagagatgatttagggtatctggtggaagaaatttctaagcagcaaagaattcaagaagtgacttgggtgctattaaaggcattcagttttaaaagggaaacagcataaaagtttggaaaatgtgcagcctgacaatatgatagaaaagaacatcccatttttctgaggagaaattcaagccagctgcagaaatttgcataagtaatgaggagctgaatgctaatcaccaagacagtggggggaaatgtctccagggcatgtcagggaactttctggcaggctttccaaccacaggccaggaggcctaggaggaaaacattttttgtaggccaggcccagggtccctctgctgtgtccagtctagggacttggttccctgcatcctagccgctccagccatgaataaaaggggccaaggtacagcttgggccatgggttcagagagtgcaagccccaagctgtggcaactttcatgtggtattgagcctgtgggtacacagaagtcaagaattgaggtttgggaacctcttcctggatttcagaggatgtatagaaatgcctggatgtccaggcagaagttcacttcaggggtggggcactcatggagaacctctgctggggcagtgcagaagggaattgtggggtggtacccccacacagagtccccactaggtgtgatgcctagtggagctgtgagaagagccaccatcctccagaccccagaatggtagattcaccaacagctggcaccctgcatttggaaaagccacagacactcaatgctggcctgtgaaagcagccaggagggaagctgtaccctgtaaagccacaggagcagagctgctcaagaccatgggaacacacctcttgcatcagcgtaacctggatgtgagacatggagtcaaaggagatcattttggagctttaaaatttgactgtcttgctggattttggagttacatggggcctgtagcccctttgttttggccaatttatccaatttggaacaactatatttaccgaatgcctgtacccccattgtatctaggaagtaactaacttacttttgattttacagtctcatagacagaagggactctccttgtctcggatgagactgtggacttttcagttaatgctgaaatgagttatgacttgggggaatgttgggaagacatgattggttttggaatgtgaagacatttgatttggtaggggccaggggcagaatgttatggtttggctgtgtccccacccaagtctcatcttgaattgtagcccccgtaattcccatgtgttgtggaaaggacctggtgggagatagtggaatcatggggacaggtcctttccatgctatttgagatagtgaataagtctcacgagatctgatggtttgaaaaaggggagtttctctgcacaagctctcttcttttgtctgttgccatgtgagacatacctttcaccttctgccgtgattgtgtggcctccccagccatgtggaactgtgagtccattaaacctctttcttttgtaaattgctcccagtcttgagtatgtctttatcagtagcgtggaaacggactaatacatgttctttgtccattttaaaaatcaggttacttgttttcttgctattgagttgtttgagttccttttatattttttgatattaacccctcatccaggtatatgatttgaaaatattttctgcaatttcctaagcgtatcttcactgtgtggattgcttctttggctctgcagaagcttcttaattggaaacaatcccatttgtctatattttttttgtctatttttaagctttaattatctgtgcttttgggaccatgttcaaaatatttttgccaagagtaatgtcaagaaggcttcctatgtttttctctaagaattttcagggattacctttaagtcgttaatccattttgaggttatttttgaatatggtataagataaaatttcattttcattcttatgcatgtaaatatccagtgttcctaacagtagtcattgaagaggctatcctttccttattgtgtgttcttgccacctttgttgaagatcaatagactctatggttatggatttatttccagtctttctattttatttcatcaatcatatgtctgcttttgtgctggtatcatggtgttctgattactatggctttgtagtttattttgagataagatagtgtgatgcctccagcttcgttctttttgctcattattgctatggctatatgagctattttgtggttccataattttagggttgtgttttctgtttctgctaaaatgccattggcattttgatagggattgcattataccagtagatcactttgcgtaatatggacatcctgagaaaatgaattcttttagtccatgaatacaggatattgttccatttatttgtgtcctgttcaacttttttcatcaatgttttataattttcagtatataggtcattcacttctttgattaaatttattcctaagtattttatttttcatagctattataaatgagattatttcttgattttgtttttagatagttcactgttagtgtatagaaatgctgctgatttttgtatgttcattttgtatcctggaacattcatgaatttgtttgttatttctaatgggtttttggtggagtctttgcagttttctgtaagaacttgtcatctgcaaacagggacaattttacttatttctttaaaatttggatagcttttatttctttctcttttctaatttttgtggctaggacttccagtattatgttgaatagaagtggtgagtgtcggaaaccttgtcttatttattgttctagaagaaatgcttttgacttttcactaatgagtatgatgttagccatgggtttttatctaacttctttattatgttgaagtacattcaatacttaatttgttgagcattttttcaatcatggaagaatgttgtattctgtcaaatagttgttctacatctactgatattacgtgatttttatttttcattctcttaatgtagtatataacagttgttgatctacatatgttggaccattcttgcatccctaggataaatcttacttgatcttgatgaatgattttttttcattaaaggattattgaaatgattgagtttgtttcataatattttgttgatttttttcatctatgtttattagagatattgactggtaatttcttttatcttagtgttcttttctggctttagggttagggtaatgctggccatataaaaatgagtttggaaacatttcctattttaatgtttttggaaaagtttcagaagcattaatatttattcttctttaaacatttggcagaattcagcagggaagccatcaggatctgagcttttctttgatggtagacttttcaatatttatttaatcttctaaattgtttgattctgtttatattttctatttcttcatgattcagttttggtagattgtatgtttctagaaacttactcatttcttataagtgattctatttgttgatataaaattgtgcatagtagtctcataatcttctatgatattagttgtaacacttctttaattttctttatatgaatcttttttgtgttttcttagtttagttaatggtttgtcaattttgtttatcttttcaaaggaaaaaactcttagtttcattgatcttttttatttttttctagttcctatttcatttatttatttatttattttgctgtgatttttattatttctgcctcccttctgctcactttggactcaactttcttttccttctcattctccttctccttctccttccttcctttccttccttccttccttccttccttccttccttctttccttcctttcttcctccttcttccttctttctttttttctttctttctctttcttcttctttgtttcttgagatctaaagttaggctgtttatttgagaacgttcttcttttttgaagtaaccattaattgcataaattttcctattagtattgttttgttcaacccataacttttggtaggttgtgattccatgtttatttttgtcaagacatatttaagtttctcatttgaattattctttttgtttaggaacagatagtttaatttccacatctttgtgaattttcaatttttcctcctgttactgatttctaatttactaccattgtggttggcaaagatgcttgatatgatttcagtcttcttgaatttttaagacttgttttgtggtctagcatattatctatcctgaagaaagttccttgtgtgtttgagaagaatgtgtatgctgttgttgttgaatggaatgttttttatatgtcttttaggttcattgatataaagtgtaggtcaaatccaatgttgttttttttttaatagacattttatctggatgatctgttcaatgttgaaagcaagggtattcaagtcccttactattattttattgtagtctatctgtcttttcagatctattaatattttctttatatatataggtactctgattttggtgcatatatatttataattgttatatccatttaatgatttgatcttgtttttattacctaatgaccttctttttgtctactgatacattagattaaggtctgttttgtctgatatagccacccctgatctcatttggttattctttgcatggaatatcattttccatcccttcactttctatgtatgcctttaatattaaagtttgtctcttatagggagtctattgtttgatcactaaaaaaagtccagttagctaatctgtgtctttttatttgaaaatttaatccatgtaagtttaaagtaattactgataaatatttaatcttgctattttgttaattgtttggtgattgttttgtagttcttttgtttctttcctccaaccttgctttttactttgtgttttgttgtatttttatagtggtatgctctcattcttttttctttatcttttgtgcatgtactagaggtttttatttcatgattaccattaagcataaaatataatattctgatttaagctaataataacttgaatttaatcacctacaaaaactatgctttttcacctttccattacattttatgtaattgatgtcaacttattttttatattgtttttagaaaatgtattatgactatagatacttcattacttttttcttttaaattttatactacagctaaaagtgatttatataccactgttactgtattactgtattctgaatttgactatagatttacatttactagtgagttttatattttcatatttttaatgttgttacttatcatactttcatttcaaattgaagaatttcctttagtatttattgtaaatcaggtcaagtggtggtggactctcttagctttttgtgtgtcttgaaatgtgtttctctctatttcacttctgaaggacacctttgctgatgtaaaagtcttggtggtgtttttttcctgtaagcaatttgaatacatcatccttcttcctcctgttttataaggttgttgttttttttaaagggggtagggatttccattaatagcctaatggagattccttgatatgtgatgattctgttatctcttactgctgaagattctctgcctttgactttatttatttatttatttttgagacaggatcttgctttgttgcccaggctagagtgcagtggtgtgatcatagctcattgtaacttcaaattctaggtcaagcaatcctcctgccttggcctccccaagtagctaggactacagatgcatgctaccacatccagttaatttttttagtttttgaagatatggggtctggtagctaggactacggatgcatgctaccacatccagttaatttttttagtttttgaagatatggggtctcgctatgttgcccagactgatcttgaactcctggtctcaagtgatccttctgcctcagcctttcaaagtgctgtgattataggcatgaaccacccagtcctgtttttgacttttgacaattttattatattttgtcacagagtattttttggattcatcttacttgagatttttttaagtttggaaatctggatgtctgtaaccttcccaatatttgggaagttttcagccagtatttctataagtaaactttttctccctttgtcacatcttctggtgatcccataattcatatgtttttatgtttgatggtgtcacatagattccttatgctttcttcattttaaaaagaatcattttttgtttttctaactggttaatttcaaatgatctatctctgagtttgctaatttttttcttgtgtatgattgagtctgctgtttaaactctctattgtgattttcatttctgtcatattttgtagctcttggatttctattttgttctttttattgtttacattttcttattaagcttctcattttgttcatgcattatttttataattttatttaattgttggtatggtttggctgtgtccctacccaaatctcatcttaaattgtagctcccataatttctcatgttgtgggagggacccagtgggagataactgaatcacgacggcagtttttcccatactgttcttgtggtagtgaataagtctcacgaggtctgatggtaccccattcacttggctctccttctgtcttgctgacaccttgtaaaaagtgccattcaccttccaccatgataatgaggcctcccccgccatgtggaactgtaagtccattaaacctattcttcttcgcagtcttgggtatgtctttatcagcagtgtgaaaatggactaatacggttgtctatctatgtttccttgcatctcataaagcatctttagcatcattattttgaattctttttcaggcaatttgtatttctccacttttgggcgttagttactggagcttttgtggtatcatatttttctgactttttcttaactatatagccttgcaccagtatctgtgcagctgaggagcaaacacctcttccagtccttacaaaatttgacagtctgtatatgtctttataagtccttctcctgttgggtccttgggctgatggaattgcctctgaaattatggttgaatggaattggagttggctcatgtggctgatgctgtttctgtggtagggtctgaagatgatgacactgctactggggctctagcaagtatgaattctctccatttcctaggtggactgcactctctccaggaccttggttggtagggcttacactgagatgagggttcagagttaacagacatttggtctgtggccacatatatggactactgtggcttcttctgcattcttgtaagggctgccactggatttctgggtgggtcctttagcagacagacagcacttccctggtctgtatccgagatggactgggactgagtcacagagctgcttcagggtctacacctgaggccaaggtcttcatatctgtctctgggatatcatacgtgtgtgtttactagcacgttctttggtgggtacacctgctctcagattgtagttgacaggggatacaactgatttatagggctgtttcaagatccacagtgggactaatgtcagcaggttagcctgtaggggcagtaacagacacgcccatctgtaggtccctgggaaggcagaactgatttcaggctgcagtcaagatgagccaggcccaagatccagggccatttcaggttctactgtggaactaaagttgataagcctgtcctggggactcagatgggcttgtttcccagtggtgccctgactaggcagaactgttttacaactgtaaataagagatactgggaccaagatccaaggctgtaccaggatgtgctgttggactgagtctgacaagcttctcacagtggcagaggagttagtctcccagcagttccctgtgtgtgtgtgattgtttctaggccacagcagagaggggctggagctgagattggggacctgttcaggatctgctttgggataagaccaacaagcctgtcacagtggcacagatcagcaagtctcccagtgtttttgaagcatagaattttaaattatagggtatttgaacttttgtctttgttagaattcttactatatttgaaatctaatctataacatatctattaaatttctttaagtataattatgctgtaaggatacaaagaaaattaaatttacatgatatcctaacctctaggggttgttacaagtatatgacagttgatgatgatgcaagcaaggaaataatgatatagcaagggatgggcataggaacataaactgattttgaagcaggtactaccattggctactctttggttttatgtttctaaagtgtttttttttataaacaacttctttcaataactttttttgcatctttttttatccttattgtttggttttgcttataagttgatactgcaactttatattctagggggcagaaatatgttggcctcattatgttcctttagtgtatatctagaatataaaatcatcatcatatataaaattttaaacaaaggccactgtataatgccttcataggtgctggttcagcataaaaggatagccacaaatgctgacaacaacagaataatttcagcactgtcatgaagtataaattttaaacaattgaatttaaaatgcatttgtgctattttactctgaaatacagtgccacaagggaattctctcacaatgagctcacaaaaagttagcgtcttagaaattattgaatttactgtacaatggtaattcttttaagaaatgtggcaagcataactagtatccagttttgccataacagataaatgaaaggtttatccatattttaagatattaatatacatcgttttagtgtaactctgaatatgacagtattaatatgaaactttgcagattaatattaaaagacatcatgatatattcattatttttgaagttacatattactaatatatcacggtgtgtctttactacttgatgacagtttcctttattccctgcagctctctgccttgtgtttcactctgtaattctcacatcttatgttcccacagctaattctacaaacttaatgaaaaaactgtgtaggtttatttaaatattctttatgaagtaaactttatacctttttttcttttgagacggagtcttgctctgtggcccaggctggaatgcagtggcgtgatctcagctcattgcaagctccacctcccgggttcacacccttctctcgcctcagcctccctagtagctgggactacgggtgcccaccaccatgcccagctaattttgtttttgtatttttagtagagacggggtttcaccctggtagccaggatggtctcgatctgctgactttgtgatccgcccgcctcagcctcccaaagtgctgggattacagtcgtgagccgccgcgcctggccaactttatatatacctttatgtaaaaatgtcttctagtagaaaaacaggttcttagaaacctttctagtaccaaaagtaattttatgtatgcatatggagatgtgtgtatttattttaatcatctgttttttcaaaggtaataatcataagcaattagcaagaaacttagtgttctacagtatttcataatacggcaagtactgatgatttttcaaacatctctgttaaaatataattcatacatttaaaaaattacaatttgaaagtatacaattcagttgtttttactgtattcaccgggtcatgcaaacataattataatctacctttaaaatgttttcatcacccccctctaaaaagccctcagtcattagcagccattccccttcctcccttgtcccccagccctgcctctggtagccctgggcaatcaataatctacttcctatttctataggttttattcttctggaaatttcatataagtgaaattatcaaatatgtgatctttcatgactgacttttttcatgtagtgtaataaaggttcatccatgttgtattatgtaccaggactgtactaatttttattgccagacaaaattcaattataatatccaattcaaatatggctatatcatattttgtttcttcgttagttgatggacttttgacctatttccattctttggctattatgaataatgctgctatgaacattccgtgtatgttttattgtggacatttaaaaaaatcctctttggtatatatttctagaagtagatttgctgggttatatgtaaattttatgtttaatattttcatggactaccaaattgtttccaagaatagctgcatcattatacatcttgaccagcagttcatgtgtgtttctatttctccatattccacaaactcttatcattatctgtcttttttgttatagccctcccagtatgtgtgaagtgatctcattggagttttgatttgcatttccctaaggagtaatgattttaaatatctttttctgtgcttatcagtcatttgtaaatctctttggaataatcttctttggaatattcagatatttttctggactttttttagttgggtatttatctttgttttttgtttatttttattattactattttttgagacagagtctcactctgtcgcccaggctggagtgcagtggcacaatctcgactcactgcaacttctgcctcccaggttcaagcaattctcctgcctcagcctcctgggtagctgggactacaggcacatgccaccatacctggcaatttttttttttttttttagtagacatggggtttcttcaccatgttggccaggctggtctcaaactcctgacctcaggtgatccgcccgtctcggccttccaaagtgctgggattacaggtgcaagtcaccgtgccaggccatgtttttattatttaatagaagagttctttatattctggatacaaataagaaatacaaattgcaaaaattttattccattctttattgtcctcttatttttttgatggtatcatttgtagcacaatatttttaaagactgatccagtccaatttatatttttgttttttgtgtgctcctagtactaaaacaattacctaactcaaggtcacaacgttttattcatacatttttctggagagctttataattttaactcttatatttaggtgtcttatgtattttgagtgatgtttagggcatggtctgatgtgtaggagtccaagtctattttttttaaacatgcatatctagttgtcctgccatcatttgttgaaatggctgttcttcccccatttacttattttggcacccttgacaagaatcaattggccataagtgtaatggtttatttttggactttcaattttcttccatttatacacaatttatatttataccagtattatgtagttttaatattgttgctttgtagtaatgtttgaaattgggatggctgagtctccaactttattcttcttttaaaaatgttttggctgtttgagactccttgtaattatatgtgtattttagaatcagcttgtcattttctacaaagaagacagctcagattctggtaaggattacatgaaatctatagagtaaatttatatatcatcttaccaatattaattcttcttatccatgaacatgggctgtctttcaatttatttataccatctttaatttttaaacattttataattttttacagtacatcttgtacttcttttattaaattatttcgtgagaattttattttaatactattttatatgaaattatttttttaatttcattttcacattgtttattgctagtgtatagaagcacaatagacttttatacattgattttatatcctgcttacacattgatttggtatccttgcttaattaatctattagttctaatagactttttgtggattatttaggctatccaagatcatgtcatatgtgagtcgtaatagcttcacttcttcctttccagtctggatacttttaattctgttctttgctttttttttttttttttaatagctacttggtttgataagaatctccagtacaagcataaaaataagtggcaagagcaggcatccatgtctcattcctgattgcagtgggagaaaagattctgttttttactgttaaacatgttagatgtgagtttttaaaaaaatgcccacactatttatcaagtacccgtatttgtgcacccttgtcaagagtcaattgtccataaatgtaatggtttgttttgggactcttaatttcattccattgatatgcattgtatatttatgccagtatcatgtgggtttaatagaaatagagaggaagttctttttatttctagttgagtatttttaatgatgaaagaacattggatttttcaaaataatttttctgtatttattcggttatttttgtttgtttttctttttttttttctctctctactggtctttttccttttagtgtggtacattgcatttactgatttttgtatgtgaaaccaactttattttcctaggataaagcccactggatcatggtgggaatctgttaatgtttgcctaaatttgctttgctaatattttgttgaagatttctgtaaagttggtagtgatgtctccctttcattcctgattaaaacatatgttttaaaaaatgataattatgaccgggtgagaaaatcttcatatctttgtgggtctgtatggtttgtgtctgtatgtaatttcagaaaagtaacatgcatgctagattaactatgtgtatagttagatatttgtatatgtgtataagacttgcagacattttcccttactgcgtttatgtttgtaagtttatatttataaaattgaatataatatcaatgaaaaatttccagttgtgctattggcataagattgatacctttccaaatcaagggtcccataagaaaattgcaaaattcagcatcgaatatatcatacttggtgctgcttccaaaaatatacaaatattcagaaatatattttaaattggatatgtgaggcacctatcacaaaatgtcatttataacaaattatgctactttacaaattaagataataaatatttgttgacaaaataaatgaagtaaagacagcatgatgtatgttcaaatactgtaaaatttagttaccttttccaaatacagactcagaaaaaatgcagttttgtttattttatgtaagttttactttctttgatgccctttaagtaattgcacttgagctgacttgatatcaactgagaagcaaggaaaatatcaaaaagtaacattatttaaaatatattattttgcgtttataaataggcacaatttaacagtacagatcttaaaattaaaattatttaattagtattatcttcatttcatatttgaaaaagtgtgagtttgtgtcattaaagcactaaaagatgcaaaacctatgcaaacaaatgaaagtaaatatattaacttttctcaattccctaccaaggaacatcatgttgtcataactatatgtattttatcttcatagaattagttataagtagtaaatgcatgttctttaaaagtgcccttagataaatgttgtcaaattctctatatccaagaaatcactaccacaatcaagataaacattttttttcaccccaaaagtttccactgtatctcctccccatcacttcctcacctgccccaaggtgcagccaaatactactttttaatttcttttggtcacaaatataagggtttttttttcttttaagaaaatattttatgctttatgggccattcggtctgtgtgcagcagctcaactctgcttctataaaatgaaagcagtcatgtatactatctaaacaaatgaatgtggctgtattccagtagaacttatttcatatacacttaaatttgaatttcatgaaattttcatgttatgcattttttcttcatttttttttcttcaaccattaaacattttaaaaatctaccctaagctcatgggtcatacaaaagtaaaagacaagctagatttggctcatgggctatagtttgatgatccttgctgcagactgtatttgttatttctaaagttttgcatacataaaattaaatagaactttcgtttctgatttctttcactcagcatttttaatttctctttttttttttgctgagtagtattttattgtctggatataccacattttgtttattccatcacacctggtttttttctagtttgtaaggagcaatattatttgttaatattgttacttacaatattagtgttaatatttatgtgtttatatttatgtgtaagtgtatgtgtgcatgtcttgcatttctcttgggtaaatactttagagtggaattgctttttgtgctatcataaatttgtaaacgtatgtgtcaccttataggaaattgtcaaactgtttttcaaagtaattgtatcattgcatatttctgtcagaaatttatgaggattttagtgtttcattttattgtcaacatttagtgtcgtcaacctttttacattttagccattatagtatgtgtttgatggtatgtcttgttgatttacaattatatttgtctgttggctaaggacattaaatatcttttcatgtgtttattagcaagttgtctatcttttctgcttgtgcgtatgaagtatctattcagatcttttgtccacttttaaaaactgggctatttttcttctttctgttaaattttaagaagtcttataatatttcacatagaagatctccctcagatatatggattgcgaatatttccctcagcctatgacttcacttttcattttattaagagtatcttcttataaaacgaagatgttttaaagtagataaattatatgtttttttctttgatattttatactttttgtatcacgtacgtgaaatctttacctaccccaaggatgcaaatattttttctctgtttttttcttccagaaattgtatagtgttaactcttacatggaaatttgtgattaattctgagtaaaatttgtgtgtaatgtgaagttgtgatactggttccttttttctcttccagatgtccagttgttctagcaccatttgttgaaatggcaattcttttctcattgaattactttagtacatttgttgaaaactaaattgatggaatatgtgtaggattgtttctgtcttctctattctggtccattgatcactctctttggcctaatgtcattaccaaactttcttaattgctatggttttaaagcacatcttgaaattatgtcttttaagtcttctgtcttcgtcttttttaaatgctttttttttcttcatgttttaagatgtatataagttttagaagtagcttgcaagtctctacaaaaatagccggctggaattgtattgaaattttataaaatttgttgtataaattttgggagaaatgatactttaccaatacgtaattttctaattcatgtgcatggcatatctatttatttagatatttaaaaatcctttcagtagatatggttgtcggtgtatagagcttgctcatattttgttaaatttgtctctaaatatttcacaacctgttgctaataaatgatattaatgtttgcggcagcgctcctttcacgggggcaccagctgcggggggtctgtcccttgcagatccttgacctggcgacggatgaataatgtatacttgacccacagatattctgctttgccaatccagttgagggtgttcaagctgcttacagactccccactgagtgctgtaaacagttgtgactgccttgatcagctagtgagactcgcatttattcagtaagactgattaacaaaggcttgagtcaacaccagtagaaggtaactgacattgtggacttctcctccagtaaaaagcacttaagcacccaaggtacatcaaaggttagtcttttttttttatttttattttattattattatactttaagttttaggatacatgtgcacaatgtgcaggttagttacatatgtatacatgtgccatgctggtgtgctgtacccattaactcgtcatttagcattaggtatatctcctaatgctatccctcccccctccccccaccccacaacagtccccagagtgtgatgttccccttcctgtgtccatgtgttctcattgttcaattcccacctatgagtgagaacatgcggtgtttggttttttgtccttgctataaatcatgctgctataaagacacatgcacacgtatgtttattgcggcactattcacaatagcaaagacttggaaccaacccaaatgtccaacaatgatagactggattaagaaaatgtggcacatatacaccatggaatactatgaagccataaaaaatgatgtcctttgtagggacatcatgtcctttgtagggacatggatgaaattggaaatcatcattctcagtaaactatcgcaaggacaaaaggttagtcttaagatcagatgagtaaacaagctagctaggtaaactactatgccgtcctttgttgctgctttaatttgtttaaaggtaaagggaccaggctgcctttagccagttctattaccgaagctatgcaaacttctcggcctttcaagatttgtgtgtctctataactatctctgatatttttcctaccagcctgattgaacccctacaaatgttaatttcaatttctagttgcatgttattactctattaatataattgttttctattgaggtacaattcaggtaacacaaaattattatgaaatccacaatccagtggcatttaggacattcacagtgttgtgcagccaacacctgtatcaatttccagccatttccatcactgcaaaagaaaacccataaccattaaacaacccagccctgggcagctacaaatctgctttcagactttatggatttacctgttataaatagctcctataaattgaatcatgtaatatgtaatcttttgtgtttggctttttttcactgcatatttttttaagattcatctatgtagcatgtattagtactttatttcttttcattgctgaattatattccattgtatggatattttatcatttataagttgatgggcctttgggttgtttccacttatggctattgtgaatctgatcactcgtatcactactgtaaatctactacttatgttatgatatatagtatcgtcatcatcacttttgaaggaaatttgtgtttattataaatttttagttttattgtgtgattaagtgttgttaccactttgtgtaaggtactgatgttttcctgtgacataatgcatgattatgttttgtgaatgttttatgtgtagtgggaagaaggcgtattctttagtatcaaggcataagcctggaatctattcagctatcttgttataatatctaacttagtgattattttctttaggccttttacagtttttcatattttatatctactgttttgtactaagagtggtgtgctggtttctactaggtgtggtgtgctaaagtctttctatttgtctccttactccttatgtcttctgtgattttgctttgtaaacatagttgctttgttatttgtcactgaaatattcataactgttatatattcatgatgacttttagctttggtactaaaaaggtctttgtcatatttaatgcttttttggtttaagttttattttaatttaattgataccaggtttgtaatctctgcattcttattgtttccatttgcctggtaaaccttctctatctcttatttttagtttttctgagtcacttggttctaaatgtggctctactttagcgcatgtagttggttgtgctttatgagacaaaatagataagttaagcctattcatcttcattgttattattgataggttattttttctcatttatgttatatatacacattatttataatgtgtatcatattatatttgttgtgcttatttctctgtgatgtgtttctctgctctttaattaaaaaataatatttacattcatggagatttgtaattttgttccattactcacctttgtttttatttatgttttgaattttatttttaattttaattgacaaataataattatatgtattatatgtttgtggggtaaaatgtggcatttacattttgatatatgttttcattttggaaggatgaaactaagctaattatttttgtgttaataacatttaaaatctactcttagtaattttgaaatatatattctgtccagtagattactaaagcttattcctcctaaccgaaattttgtactctttgatcaacctttcttctttccccttccatcgctcctaaccctggcttgtggtaatcatcattctactttcttcttctatgaatttgatattttttagatcccacatataattgagatcatgtagtagttgtctttttgtgcctggtttatttcatttagcattaattcatcttgtctttttaaaagctgaggccgggtgcggtggctcacacctataataccagcactttgggaggccgcggatggcggatcatgaggtcagaagttcgagaccagcctgcccaacatagtgaaaccccatctctactaaatatacaaaaattagccaggcgggcattagtggtggtgggtgcttgtaatcccagctactcgggaggctgaggcaggagaattgcttggacctgggaggtggaggttgcagtgagccaagattgcgccattgcacttcagcccgagactccgtctcaaaaaaaaaaaaagctgaatagtattcaaatgtgtatgtgtatatatatatatatatatatatatatatatatatatatatatatatatatttcatccaatgatggacacctaggttgcatctatattgtagctattgtgaataatgctgcagtgaacacaggagtacgactatctctttggcatacttatttcatttcctttggctatatacccagaacaggagttactggacgatatggtaattgtaattttacttttcagatgacactccaaactcttttcataatgactattattttaaattttcaccaacagtacacatggttcctttttctgctcatccctgccagcatttgttaaatttcatcattttgataatagccacttaaacacgtgtgaggtgataactcattgtcattttaatttacattttcctaatgattagtgatagtgaacagtttttcatatacctattggccatttgtatgtctgcttttaaaaaaaatttatttaggtcctttgtccattttaaaattgtgttctttcttttcttgctattgagttgcttgaatttcttatgtattttgaatattagcctcttaccagatgtatgggttgtgaatattttctcccggtatgtggattgtctctttactctattgattatttcctttattgtgcttaagatttttagtttgatgcagtctcatttgtttatttttgcttttgttttgcatgtgcttttgggaaaaccaagaaatttttgcccagatcaatgtcatgtagcatttcccttgttttcttctacagttttgggacttacctttaagtctttagtgcattttgagttgagttttgtgtattgaataaggttctaatctcattattttgcatgtgaatatctagttttccctgcataatttattcaagagactatcttttctccattgtgtgttcttgacacttttgtcaaaaatcagtagattgtcagtgcttgagtttattgctgggctctatattctgttcctttggttgatgtttctttttctttatgttggcactatgctgttttgtttaatataggtttgtagtatattttgagatcaaatagtttgatgccttcagttttattcttgctcattaatttccatatgaattttaaaattgctttttctctttcagtgaaaaatgccattggcattttgtcagaaattgcattgacttagtatattacttttggtagcatgggcattttaacaatactaattatcccaatccatgaacatgggctacctttccatttatataagtcactcgctatttctttccttaatgttttgtggttttcagtatttagagcttttaagtccttggttaaatttacttccaagtattttttatgctatcatgaatgggattgatgtcttaatttctttttcagttagttcattgttagtgtgaagggatgttattgatttttgtatgttgattttgtattcttcaactttactgaacttctgtatcagttctaacatatttttgggggaatctttagggttttctgtagacaagatcatgtcatcagcaaacagaaacaatttaactttttaattaactttttaatttcctatttggatgccctttatttcttcttcctttctgtctgtttgctgtggctagaacttttagtactacattgaacagaagtggtaaaggtggacatccttgtcttctttttgattatagaaaaaagctaaactttttacctttcagtatgatgttagctgtgggtatatcataggttgatgcagaagtaattgtggaatatatgacctttattgtgttgaggcctggagcctgacaatgcagggactagtctggtagtgggatgggtctggattctgatactgcagtggccagcatggagcttgggactgtggggtcatgcttgaccttgggttcagtgaggcagatctggtgttgcagtccaatgaaaagttgagtgcttatttcattcttccttgacttaggggtatcttgctcagtgttgtgctgcttgggcttgtgggaggggtaatatggataatattaaactggcttttctacactattcaatgcatttttttttttctttcggactgcagtaaggtggtataatctcttgtctggattccttagctgttgggaaggtattatgatgcatggatagtttttcaaatgaatgtttctatgagagatgaacactagaaagtcttattccactatcttcctaacatcactcctctagagttttttttttaatccagatatatgggggttttagtagagttttatttgtttattattcatttttgacttaattgtattgtcatcaggactcattgtatgatactatttttaggaatttgttgcagttatcttcatttgctaatggcaagttaaatattataaatgatttatatatgctggtttttaaaaacaggaattgataaacataaaatttagggtagtggttacttctggtgggaagaggcagtaagaaaggttaagggagcaacacacagatcgatacaagtagtagcattagaaatctagtccttaaattagatagtttaattatcccattatataaattactaacagttttacaagcagaaaatgtacatgctatttaaaatcaccaccataatcttttgtcttcacaaaataataagcagtactttttttcagattttttcttatatagatgtaatttatatcattcccaagcaagacatagagtataatcaaaatacagtagttttctctgtcactgaccctttaaaatatattcagtgcaatacatttttcccttgatcttgtatgaaatctcagactcactcttagttaatataaggaactcctgagaatttaatttgcaaacacgtgtgtaagtaaataattaaacttgtctagatcagataaaagtaagaactctgaacatattttgaagccaaattttctcttctcctctattccatatgttctttcattcttagcctagtattttcctcctttcctggctcaataatttttttgatctttctaggggagaggagaaaattatagtcttatgtgtgaagaatagttgtcatatttagttaaggtcctctgtgtgagagatgcacaatggctgatccattctcacataaatgtctttgggggctcttctgagtcttgacctttctagatgcaattctcgtgatctgtgggagacacatactttcttcctgttctggcaacttttacttcagttttcagttgaagtcctccagcacttccaggcaatcctgttggtcagaatattaagtagatgctggctagctggaagaaacatactttctttttcttgacttcagtgttagtacaaatatttcctaaaagtaactgtttctatttgtccttccacctcagttaaatagccatagctggtcacacctaattcagaatttcctctaatatgccacctagattttaaggggacccacagcagactcttcaaaaacttctgtgaagtcccactcattaggcttgtgtaagaggacagacaaccactcccttggcaggcagaagactggattactaacactgaaatgggcttttctgataatccccatccaatctttccccctttcactctttttgccccttttattgactctatctggttcaaagattactggttttgaacttttgttttagtctcttcttttgaaaatgttcatattggtcttatatttcacttaggtatacagtatctattttctttcagagactcaattgaactagcaatatgattatctggttacatttgtttgcatttattaattcattaacatatatgttagagttactattgatactggaagaaaaataatgaaaaagttgaacattgggaaattttgactcattcacttaattttatatggctctacaattcaggaaaagaccatatcatttcatttttgtcaatagaatggtttagctaactggtagtgtacaagaacagcagtagttctcattaggtgtttttgaaagagttagtgacaccatcagccttgtctgtttagaatgtgttattggattggagaattaattgtaacctggaaatactgaaggcaaagatatctgctatgtgattatattgttgtcagtaagagaaagtggatgacaatactttgtggtggctgttagaatgaaaaggaggggtcagatacaagaaagattatacatgtagaaattaaaatctaccaattgactggatgttggacataattaagtgtgaggtttatgtcctaaataattgaacagtgctctttaagaaaggattgcaaagtaagaaaaggagacaagtttatatgaaccaaattaatcatgcaacttttacaaaatggaaagtttcgtctagtactctaaaaggatgatctaaaaagatctaaaaggatactctaaaaggatgaggatgatctcagaaacttaaaagggtgaatttagaggaaataaatagatgttcttttttaaaacacaatctgcagctatgtttttattattcttaccagtagtaataacagtggaagtaatatctgccaattattaagtgctcaatatgtgttatgtgtcttaaattacattacctcatttaattttcacatcaatcctggaagctaagtgctgttattcttcttttgcaaatgaagaaattaagcataaacaggttaagtaaattgtccaaggtcatatagtgattttagatgtaaattttgaacccaagctgtttgagtacaaagctctggcactaacgctttgaaactcactttattaaagaaatataccaaagtgaaaatggagagaagcccaaagaagaattagataacagttatatccacagtagacttcaggatatcccccaaagactttaaggaatttcacaaaattttcagaaaagtgaatttacttccctttaattaaaaataatttatactatctggtaaccttagtttttggatggcaagaggaagttacaggacataaaaataaggtaataataatacttgaaatgtgaaatgtgcatgtttgtgatgtagaatattcaatatcattttggttttgacttacagcttgtacatgcagtggccatgcaaatatctgtcatctgcacacaggaaaatgtttctgcacaactaaaggaataaaaggtgaccaatgccaattgtaagtaagaatgactttttagaactttcgtggattgaatttgtgttgttgaagtaatttttatgttttactttttaatttagtgttgtgctagttaggcatacctttattacaatttttaacttttattttagatttgagggtacatgtgcaggtttttaacatgggtgtattgcatgatgctgaggtttgggatatgattgatcccattatccagatactgtgcatagtacccaatagataattttaaagtactttttccccttcctgcctctctctctctagcagttcccagtgtctgttgttcccatctttgtgtccctgtgtaccaatatttagctcccatttataagcaaaaacatgtggcatttggatttctgttcctatgttaatttgcttaggataatgtatccatgtggcagaggatatgatttcattttttatggctgtgtagtattccatggtgtatgtggaccacattttctttatccagtccagtgttgatgggcatttaggttgattccatgtccttgctattctgaatactgctgcagtgaacatataggtgcatgtgtctttttggtagaatgatttatttttctttgagaatttacttgcacctaatgaattctctttaaaaattaaaccttttaaagaacaattttgtagaggctttaaaacaaccccatagaacatgttatcttttgcatttctagaaaaagatgcattcttaatcttatgtatcaaatctacattatctttacacttttctttcatattatacctaatataatgtctctatgccgttcttttttcagtcatttattattaattctgataattaattccaattcttgtcctttaaccctttcagctggttccttatattcatcttcttctcttttctctgttctttcagtatgcaggaaccctctactgctactctcctctctgtactttcatgaatgatttttgtcttagcatttagtttttattctaaaattttattttccttcaaaaattaactttaaaaggcagcattttaggctatttaaattgttttttattctttttcttgtttatctatattattaaaatcaaatttttatggttttgaattatatatgtacaaatacatgtttatattaggtatatatgtactgtatttgacacaaataataaattccaaccataataattacagaaacatagggaaagtttaataaagaattcttcaaaactataaatatataaaaatttatacctaaagtctattaagcatggaaaatgatccttttatttttatttaaaataaatatattacttgttgcagagttatcctaaatgtttcaagttaggtgattatgtctttgcttagccacctaagtattacagattttcaaattcagacaaggtaagcacaatcagtttttattccttctctatagtctgaagttaaatacaagttcacagcaaaagatcttgggggaattcctattaaggaaggccattttggtcttaaaaccaacggaattaaatcattgtcttctgttctaagatcaaggatgcctctaatactttgcaacactaaagcttgattataagtaaggccaacttcatgggcacgtggcctgtgaatttatacaggttcccacacttacaagggcagcacacttggtttagtgctctgctatcatcatcttgaaattcttaataacttttaaataagaactctacattcttcttttgcacaatgttctcctattccctgcaattatgtataatagcatgttctggttataagtaatgtttctcttgattaacttctattaaatatgttggttggatagcagtgtgcagcaatgaaaatattttctgtagaccatagtggcagtattacagataaaaataatatatgagattctaccatgatagtaaacactgtcaatcttcttagtatagttttacttaaatagtatagccatataactatccataataaatagttctttgatacagtattgcagtaacatatttttgtttacagacaaaagaaagcagaattttaattcattgaaatagtgagcttgtaagcttagctaaaatagagttataagatttggcatatgtgcaaaatattagaaaatcaatcatatagttcttaatgataaaagtacattttccccgttctcatttatggctttttatgaagaggataataatggaatactaatttgtaaagagtattttgtaggtggtatttgtacacagaattccattcatttacttttttgtttatttagcttttgagtatggagcaataaagaataggctcattatttttagagcaattaattgctataatctgcttatacctgaaaaaaatggtttgttaggaaggagagctactccttcaaatcagtaaacaattattaagtgagtacttgatactactaatgaagatgaataacatatggtttttgttgaaagtatctcagactagcagtgaagacactgaccaaaatacagtataccaatttcttacattagtgatttaatatgcttatgaaccccttccacttcttaggataatttctgtttggttttaagtatttagtcagatatcatatcttatatattcttaataaccatcctaaactgaaatcggttctcttcatatctgttaatttcttttcttgcattatttgtgtacttgtctgtgtcctttactagagtgaacttttggggggaccattgcaacaataccacaatgtaagtgttcaataaatttgtttaatagaatggaatgaagaaagtattgatggagcactgaaaagggaagtattaatttattttggttggataagaaaaatttaagtagaggatgtttgaactagaacctgaaggagtaataaaatcaactttctgggaaaagaaaataggaaacaaggggaaatgcatcaataaaagcaaagaagtagaaatgaacatgatcatagcatttccggtctttgctcaagaatgttgagagctggaaaaatattgcttctacccttacaatgaaaggggaaaaagctggataaactgtaaattcatgagttttcttgaaaccattggagaactgagaaaacagggtaatcaaatgaccacaaatctaaagagagacaagagactgcagagagatgagacatgaacattggcttacctggagcaaaatcatctggaaactgataagaagagatcagctagggtagttgatatttggcggggattaggtatacactgtcaatagtgtgaagctcctgggagccacagaaattggtagagtatggagagcatactctttgtagagttttcaagccacctactgtggctgccattcccttccaccagttgctcaggtaaaaaaaatgaacattttaagagagcattccttgtattgtaccttgtggaagggattggcagccgcagtgggcagggcatcagtagtacagtcaaaatattcatttagatgagcaccaaatgattcattttgctgtagtaatgacagttttcagtctttttttggcccaaaacacagctgatcgtcaaaaattgtaacttaaaaatgaatttccatttgtgtcatctctgatttttttgtgcagtggtttttagttttccttgtagagatctttctcttgcctgggtgttttcctaggcacacataattgtgtggcagttatgaatggaagttctttcctgatttggctctcagcttgactgttattagtgtataggaatgctattgatttttgcacattgtatcctgatactttgctgaagttgtttatcagctgaagaagcttttgggccgagactatggggttttctagatgtaggatcatgttgtctgcaagcagggatagtttgacttcccttctttttatttagatgcctttgtttatttcttttgcctgactgccctggtgagaacttcagatactatgttgaatggaagtggtgagagagggcgtccttgtcttgtgctggttttcaaggggaatgcttccagcttttgtgcattcagtatgatgttggctgtgggtttgttatagatggctcttaatattttgaagtatgttccttcagtacctaatttgctgagagtttttaacatgagtggatgttgaattttatagaaacccctttctgcatctattgagataatcatgtgctttttgtgtttagttctgtttatattatgaatcacatttgctgatttgcttatgttgaaccaaccttgcatcccagggataaagcctacttgatcatggtggataagctttttgatatgctgctgaattgtttgccagtgttttgttgaggatttttgcatcaatgttcatccaggatatccacctgtaattttctttttttgttgtgtctctgccaggttttagtatcaagatgaggctggcctcatagattgagttagggaggagtcccttttcctcaattttttattgaggagagtatatctggtagaattcatctgtgaactcatcatgtcctgggtttctttggttggtaggctattactgcctcaatttcagagctgattattggtctgttcaggaattctgtttcatcctggttcagtcttgggagggtttatgcgtccagaaatttatcctttttttattttctagtttatgtgcatggaggttttcataatgttctctcatggttgttcatatttctgtggggtcagtggtaatacccttcttgttgtttctgattgcgtttatttgaatcttctctttttcctttgttagtctagctagtggtctagcaattttattattttcttcaaaaaccagctcctggatgcattgatctttttatcttttgtgtgtgtgtgtgtctttatctccttcatttcatctatgattttgtttatttcttgtcttctgctagctctgggatttgtttgctcttggttctgtagttcttttagttatggtgttaggttgttaacttgagagctttctaactttttgatgtggacatttagtgctataaatttctctcttaagacttcctggaagacaacctaggcaatgccgtttaggacataggcatggacaaatatttcatgatgaaggcaccgaaagcaattgtaacaaaagcaaaaattggcaaatgggatctaattaaagagcttctgcacagcaaaataaagcattaacagagtaaacagcctacagaattggagaagatttttgcaaactatacatctgacaaaagtctaatttctatcatctataaggaatttaaacaaatttacaagaaaaaaccaaccccataaaaagtgggcaaaggacacgaacagacacttttcaaaagaagacatatatgtggccaaaactcatatgaaaaaagttctacatcactgatcattagagagaattaaaactggacctcttccttacactgttaatgcaaaaattaactcaagttggattaaagacttaaatgtaaaactatataatttgattgtgctgtggtccaagagactgtaatgatttcagttcttttgcatttcttgaaaagtgttttaattctaattatgtgattgattttagagtatatgccatgcagtgatgagatgaatgtatattgtgttctttttgagtggagagttctgcctgtatctatgagatccatttgatccagtgctgaattcaggtcctgaatatctttgttaattttctgtctcagtgatctgtctaatattgtcagtggtgtgttaatgtctcccactatgattgtataggagcttaagtctctttgaagatctctgagaacttgctttatgaatctggattctcctgtataggtgcatatatatttaagatagttagattttcttactgaattgaaccctttaccattatgtaatgctgttctttgcctttttgatttttgtgaatttaaagtctgttttgtcagaaactaggattacaactcctgcttttttctctttttcatttggtaggtagatttttctccattccttagttttgaggctatgtgtgtcattgcatgtgaaatgggtttcttgaagacagcataccaacgggtcttggatctttattcggtttgcctttctatgtcttttaattgggggcatttaacccatttacatttaaggttaccataaaatatttaatttccaacagaatttaacaaagacattgttatgtcttatatgcagtaagtgtactaactaaatgtattttggttggaaaaagataaacattgatttattaggttaatggttcttggtggagatggaatagcaccccctagaacttcataggttttcataattaattattctaataattggggagtgctactggcataagaggatgaatagtcacagcctcttattagaatgggcacttacagagaccaggaaataaataaaatctaagtccaaatatgtttcattgagtacagtagatctacaaactcactctgtagtcattttccctgttccttagttcataattaaaatggatgtatgtagcagccagcagatgtctcatattggcttcctgacctgtggagaaagagccagtaaggtagagaagggccaagagaaagaaacccttgaaactaattccattcattctggacccagtcaagatggcaaatcagagatctcatgtcaagacaaatagcaggctgctgaaatggagaaaatgagggattatgatattctcaaatatgagctggatcctatttataagtgtagtgccaaaataattccctagcttaaaatgtggacagaattgtgataaaatctaacagaaaatatattttctttcttgaaatcctaccacatgtcaatgtatacattctgtttctggtatgtaaaaagactgtagagactatatcatgtcttaggaaacgggacatatttgaaaaggaaatagtaatataagagccagtcaagtcatgttgtagacctctggaacattatcagagtcccctgtttaaaaacaattgcaatctcccccacagtaattttaccatgtagtttctaccgcatacattttatattatagcactatgaaattttaacaaatgcataggacaggaataatatgataattttagttcctatattatgaaattcagtagtactcataatttggcaccaatttaatatgtttttgtttttatctcttaagaggtatctcaaatattctccagacacattgtatactcacagatgtgtgtgagcaggatagctattggtgatgagattttcttaaatgaatatctcttggtcaaattctgaataatattataaaaggtatattttcaatttacatgatagttgcagttgtagaaaattcaatatgtgttataaatatgcaaaactactttgtgtttatatgtaaaatggagttagattccaggctgaaatatttatgagcacatttttcacctacttaaacatctgccatgttattctaaaattatatgagattttgatcccttttttattttgtggaattactttgtatttttgtaggatgtctgcacccctggtttctctttcattccattcagtaaattccagtggaactccataattatggaaataatgaattgttactcacaaatttatccccactcacaaccatgtgccttaaaaattagtgttttcccttatctagccaaaaaaagtttattgtttcactgtttaatataagagctcagatcattttattgatttctggtgaaaagtacatataaatggcactcttagatattttgttggtagattagtcaaaattgatgagttgattcaaaattgttttactctctgttcacagtaaattgaagataaacttctcaaaggcatttggaattaaaaataccatttcctaagatatatggcaatattactaatcaggatcttaattgtgctaattaacttataactggctccccttttctgttccttatacctttcccatttactgatcttacaacttcttcatagctacttacttcaggcttaagaccctggttctcagaattagggcacagaagaatctcctgggatatggtgactaaactcctgggatgggagccaaaattctactttactaatagtaaattgtgaaataaaaattcttgatacattttgagaaatgttgccgtaggaggatcttcctgaacattttttttcctccttggcttacctttaggccagtaatatctaagattattacccatttttctctatcttgttttatcaagtctcttttgtttgtttgttttgtgaaattgccttaatgatgatgccaatgaattcctttccgttttaggaagatcaaagttgtgccttcttttctagaacagattctggcacatactagggactttagatttttaaaaataatgtatcttggatctttatttttcctaattactctcatctttttttttttttttttttagtctgctatatggggaaaagtacatcttttctctatgtgacttaatctacattgttataatagagactacagaggaagaataattttctgtacagcctgcctgcacataggttatcacctttataaacacaattggataagtaactagtgactatggtcttcaaatactgacactaactttttttttgtttgttttgagacaaagtctagctctgtcccccagactggagtgcaatggcacaatcttggctcactgcaacctccactctctgggttcaagcgattctcatgcctcagcctcctgagtagctggactacaggcactcgccaccgcacccggctaatttttgtatttttatgagagatggggtttcatgttggccaagctggtctcaaactcctgacctcaagtgatccgtccaccttggcctaccaaagtcctgggattacaggcatgagccagtgcacccagcctccaacactaaatattgttaagatttttctaggttgttttgttgctgtatttgcaactgcagataagactaatggtttctttgtgataatgagttaagcagccttgatgtctaatatataagatacttgaggaactcttatgcttgctttattctgtaaacatttattcactgagaggctatgagacagtaccaaaagcatacatctgaaaatatcagttcagaacgcatgttactcatgttaaggttggccagtatgaaaccatatatggttttgtccgatttctacccttgaggaatatgttttggtaacaagtctaacttgagcatataacttcctatgtcaggtaaatgtttgagttcttttggagtatgacttaatgaatttaaagctcttggattttaggaatgtactttcaaagttaaatgttagttctcccatcagtctttctataccaacaccttgtccctcaaaactatactagattgaatgtcatttaatcgccaattttgaaaacattctgaacacaactcagctgtatttcgcagcctccattgcagttaggttggaagtcatgttattgggctctgtccggtagacagaagtaacacccaccacttctaggcctggctcttaaaaacctcatgtgccatacaccctctgtttcctcattcagcagttcaatggagaggaagatgaggatctgaaagattgcagaggctaggaatagcccagatcctggaagactgcatggaccaagaccttttctccaaatccattccacactggacagtgtcttcaagctggaatcaaacttattgtatagaactgctgagattttaaggttgcttgctagagttagcatattcttccatgagtaattagtattcccttagcatctagcttgacatccttaattactgtactttcatttaaataaccttaagggtcctgttcattaagtgtgactgctggagtaggttagtgaacagtgtggtggtatttaggtttaatttgttctttaatccccattcatctcttaaaacttgcaaaaacctcccagctttttttttttttttttaaatcaaagctgttctcatttaaagctattgtttgggagactagtatagtccatgatttccaacttgattattacattcacataaggcataaaagttaaatggctttatttaactctagatggtcagaatggttcccaatacatgatagaattgttggaattgctaataaaaaagaaaagtgcacagtaaagaacagagtatcaagttaagatttaggatatactacctacaagttggaagaaattagaaaaagaaacaaatgtgtatgtcaaagaaagagacagcactttaagcatttattttactttgatcagtcttctatatatttattattaagttatcttgaaatatcaggggatgaaataaatagcctagtatgtcccaacttaacattgtatgaagaaataaagttttaacatttaaatgtagaaaatatatctggtatatgtgtaggtgttttatcaaaatatggactctcatgtcaaatgcatgtgtgttataggatgaactactgctatacactagtatgtccttttgatttatttctggagctccagtgtagtggctatgttgtatagtttagcacttctggttttatggaaaaatggtaagtgactgaacatatttcagtgtaatctctttttataacaattttcttttttgtcttgttttggcaatttgccggtgcaaatatgatatcctttctttattgttaataatgtttgtcctctcacctcaacataatgttttgagatttatccaagttgctgcattcagatagctgtaatgtgatcctattcaatgttgtagagtatttcattatataattataacacacttcattcatttgcctgttttctttttttttttaattatactttaagttttagggtatacgtgcacaacgtgcaggttagttacatatgtatacatgtgccatattggtgtgctgcacccagtaactcgtcatttaacattaggtatatctccaaatgctatccctcccccctccccccaccccacaacaggccccagtttgtgatgtcccccttcctgtgtccatgtattctcattgttcagttcccacctatgagtgagaacatgcggtgtttgtttttttgtccttgcaatagtttgctgagaatgatggtttctagcttcatccatgtccctacaaaggacataaactcatcattttttacggctgcatagtattccatggtgtatatgtgccacattttcttaatccagtctatcattgttggacatttgggttagttccaagtctttgctattgtgagtagtgccgcaataaacatacatgtgcatgtgtctttatagcagcatgatttataatcctttgggtatatacccagtaatgggatggctgggtcaaatggtatttctagttctagatccctgaggaatcgccacactgacttccacaatggttgttttctttttttgataattccagttttgtttttcctttttcaccattactgttaatgttttatcagtattcttatatgtttcctggcttacaaatgcatacattttgttgagtgtgtattcattattcatattttcaactttggaaaattaactgttttgtaaagtgattatattaaattatacccattccaagtctttatgaattttattaatgctccacatctttgctgatagttggtattccaaggcattttaattttgacacttctgatagatgtgtaattgctatgttcttaagcttaaaaaattccttagttcttaaaagtttattatgtttaatctttaaaagtttcatctctttaatcaccggtggaattttctctttttatgatgtagtattatctcaagtttcttgtgatttttctgctggattctccttaatcatttttagtaatattttatacatgctatgtacacgtcttttgttggtgatatgtttagtaaatgtcactctgtggttggactttcatgccaatttgtatgtctataatgagacattcttaattttaatataatccagtatatccatcttttccctatggttagtgcttttttgggttctgtttaaaaattctttctgttctccattatcaagtagtattcagatagccagttggtcatggaatttatttttggcctgaaggttttaactttcatccaatttctttaaaagagataaactattcagatttttgtttcttctagtgtctgttttgttcttttcctttaaaatattttcatttatttatttaaattggattttatttttaaattgacacgataatggtacatatttatggtgttcataatgatgtttcagtacatgcagtgcataatgatcagatagggcaatcagcatttataatctgtttgtgttaggaacattaacacaaattatctttccagcgatttgagctatataatgtattattgttaactatagtcctcttaaagtagtatagaacattagaacttattcctcctatctagttgtaatgtaatatgctttaacaaatctctccttatttctctttccctacacccttcccagccactagtaccttctgttctactttttacttctatgagatcaactttttttttttagcttccacatgtctaaagacatgcagtgtttaactttctattcctggcttatttcacttcatgtaatgtcttccagttccatccatgttgccacgaacgacaggatttccttctttttaatggctgaataatattccattgtgtatatatcctacatttcctttattcatctattgatgtacacttaggttgattacatatctttgctattgcaaatagcattgcaataaatatgacgatgcaagtatgcctttgacatactaatttattttcctttgtataaatacccagtagtgggaagtctgcatcatatgtatggtagttctatttttagtattttgagaaatttccatactgttttccatactggctgtactagtttacattcttatcaacaatgtataagagttcctttttaccacatccccaccggcatcttatatttttgtcttaaaaagacacagccattttaacacagccattttaactggggtcagatgatatctctttgtggttttgatttgcatttctttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagccgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctgatttgcatttcttgatgattagtgatgttggccattttttcataggtttgctggtgattttgtatgtcttgttttgagaaatgtctgttcagattatttgcccattttacaattagatcgtttgttttcttgctgttgcaatgtttgagttccttatgtattctggctcttaatatcctgtcagatgaatagtttgcaacccattctgtggattgtctttttactctgttgattgtttcctttgctgtgcagaagttttttatcttgatatagttatatttgttaatttttgcctttgttgcctgtgcttttgaagtcttattcataaaatcttttcccagatccatgtcctgaagcattcccctggcgtttttttctagtagttttattgtttctggccttacatttaggtatttgatccatttttccgttgttttttgtatagggcaagaggtgaggggtctagtttaattctaatgcatatggatatccagttttcccagaaccgtttattgaagaggttattttttctccaagtcatctttgttcttggcatctttgtcaaaaatcagttggctgtagatatgtaatttctgtgttctccattatgtttcattgatctatgtgtctgtttttatgccagtacctgtcattttggttagtactactttgtggtatattttgaagtctggtagtgtgatacctccagctttgttcttttttgctcaggattgctctgactactaaaggtcttctgaggttctatacaaattttattttattacttttttctatttctgtgaacaatgtcattggtagtttgaaaggaattgcattcaatctgtatagctttgtgtaatatggccattttaacaatattaattgtgattcgtgggcatgagatgtctttttatttgtttgcattctcctcaattttatcagtttattttgtagttttccttgtagagttctttcacctccttggttatatttatttctaggtacttttttgttagttattctagatgagatttgcctcttgatttctttttcagctactttgttgtttgtatattgaaatgctactgattttttaatgttgattttgtaacctacaagtttagtgaattcattcagcagttctattaaataatagtgttttgggagattctttaggattttctgtacacaagatcatgtgatctgcaaacaggacaatttcacttcctcttttccaatttggatgccttttatgtctttttcttgcccaattgctctggctgggactttcaacactatgttggataagcatggtgagagtggtaatttttgtcttgttttagttcttactgaaaaacaaacaaacaaaaaaacaaaaaccaagagcatgatagtaaaacaggagtagattaaccctgataccaaaaccagacaaggatacaacaacaaaaagaaaactataggctaatatccctgatgaacatgtatgcaaaaatcctgaacaaaacaaaagtgttcagcttttccctattcaaattagtgtttggtgtggtttgtcatgtatggcctgtattgtgttgaggtactttccttctatacctaatttatggggagttttttttatcatggagagatgttgaattttgtcaaatgctctttctgcatcttttgagattatcatatggcttttttccttcattttgttgatgtgatgtgtcacatttattgatttgcattgtgttgaaccatccttacattccagggataaaccccacttgatcttagtgtattatctttttatatattgttggatttgatttgcagtattctgttcaggagttttgaaaatgtccatcagtgatattagcctatagttttctttttgttgttgtgtccttatctggttttggtatcagggttaacctagtcctgttttactatgatgctcttgtttactgctattttttcatttatcagtttggagatttcagaaagtttagccatttctctttaaaaattgctacttttttttttttttaacagagtcttgctctgtcactagactggagtgcagtggcacaatcttggctcactggaaactctgcctctcgggttcaagtgattctcctgcctcagcctcccgagtagctgggactacaggtgtgcaccacacacccagctaatttttgtatttttagtagagatgcagtttcaccatgttggccaggatggtctcgatctcttgacctcatgatctgcccgccttggccttccaaagtgctgggattacaggcatgagccaccgcacctggcctctctctctctgttttaaaaatattatatgatagcattttggtgggtttctttagggaaaaaaagagaaaaataagtgtgttttaccttttatatctttatatcttcatttaaaaagaaatattttattttcagagacagagtctcactcaacttgtcatccaggctggggttcagtgatgcgatcttggctcactgcaacctctgcctcgtgggttcaagtgattcttctgtctcagcctcctgagtagctgggattacaggtgtgcgccaccatgccctgctaatttttgtatgtttagtagagacagggttttaccatgttggccaggctggtctcaaactcctgacctcgtgatccacccacctcggcatcccaaagtactgggactacaggcatgagtcatcatgcttggcctaccccttcatatttaatcataaaaatgcaaaattatttagcagattttcagctgttttaaataatctgtaatattttaaaattatggctgttacatgccccttattttagtctctgagtaaaaaaattatgtatcttgacaaggtatatgtatatatttaaacatttgaatatatatttaatatatttaatatctaagtgttcgtattataaattcaaatatttaaataaattaaatatttaaatttaaaattttaatttaaacatttaaattaaaaatactttaaaacttataaatgtagaattattttatattttgttttatacaaaatgtgtataacaatgttagcgtttacataaatgataatcattatttaggtgacatttaatgagattatttacttcttcaaagtctgtaatacatagttcagcctaaatctgttttccatgaaagtccagctgcttgattagtttgcttagtggaaaaggagtatgattatctctttgcttagacacagaaaccctttgaaattacatttttaattaagccattacagaagacttctaaaggcttttaatgtttttatcagtcttgaagggttctgagtttttaaaatattatttagctcaaatatcagaaatattaacatgatttatgttgtaaagtatcaatttgtttaaggaattattatttatatttaaatgttttacattttatttacctgttgtaatctgaagttgaacttgctaaaataatttatgtctcaatttgcttttttattatgtgaattagattagtggttcatgttcatacctcaagtaaatatattgaaatattttatattataaaattctatctataacaaaaattttatgttgggcagctcctatattgaccattaattatctatgacttctggtattcataccattgtgtagttccatttccttccttgagtgtgggcaggacctgtgcttgcttctaaaccagaaaataatgcaaagttaatgggatattactcctattattttgttacattacatggtaaaagtgatggttttcacttctgtgaatatgctgtgaagtctatgcttcctagaaaacttgctctagtgattttttcttttgctggctctgagaaaaatgtagctgagagtatcctctagcagctgaggatagccaccagccaatagcaagtgaaaaaccaaggccctcggtcctatagtggtaaggaaataaattttgccaaaaacctgagggaaaatagaagcaggcatatgcctagttagtcctctgattaaaaccagtcccagctgacacctgattgcaggattacagtggaccctaggtgcagccaacgtcttgattgcagtctgctgtgactctgaatcagagaacctggttatgccatgctcagactcctgatccacggaaacagtgatataataaatgtgtgttgattatagttaccaaatttatgtatttttattgagcaatagataactagtacaaatattatatccaagtactctgatattttatttactgaattatacaactctacattagatatttttgtaatatattccttaagtgttttcagactaggaaggagatttctagtctttggtagatattttcttgaatggggaaaataatttcaacaatgcagattaagacttttcctagaacagagcatttctgaagaaattttacctttgtgtaaataaacacagtagactgttacagaataaatgagttaaactattttaattgatctgagtaatttacattttatatctgcaaaattgccttaataaggtatttgtaattttgttatattgttttcttcttatgttgaaaatagttagatcctccattctgatttcttaatttgcatttctttgggggatctacaatgaaattgatggattatgataatcttgattccagatcatattattattaggttacatcataatccataacggatatgccaaacattttaatatcacctatttataacaggttagcacagttttatcaatttatttttggcatgtgaggaatgaggtggggagtcattggtttgcatagcattgcattgtgtataagtaatattttatacatttgtttgggatttcatctgttttatcctttgtaatgagatattttcccatgagtggtgactctgctattagaatcaatttgctagcctgtgaggatcttggattttgagtggaagtataacaagtaagcctgcattcttttttctcttttgtcttttttaagtgaattaaacgtggaacaaatttatctgataggacgtgacattaatgaaaataaaaatttgtttattcttgcctaatcttaatttttatgatgatgtttaccaactcctatggtagactccttcacatttaccagacagacctcaacatttttctataaacaagacccttcctttcttgtcccatttatttatctatttattattggaatggactcatgaattcctgtttttttcccaatgatttataattcactaatgtttttaaccactttggtgctcacattgtccaagatttggccagtaggagaggcttcaagctagctcttttgtttatgtgacacacctatcattttgtgaatacttccttactttctggtataagaagatatttcaggctcatcttattcctcttctgcctcagttgtggaatcagctgtatatccttttggagctctagttccttgtaatggaatatcatattagagaccaagatcttggtgctaggtatgctttttgctctttgaggtatctttacttagtgggttgtttggtgaacaaagttaggaaataataatttatttatgtgcacatataaatatacatatgtgcacatacatgcatacatatgcatgtatatacacacatataaatattttagaaagcatttcttcataccaaaacttccaattcggatctatttctgcaaggcttttgtaccttctccggctcagtatttgttccttcttctacagtaaatgaacactgacttccaatgacatcaacatatttacttgtttgctcaattctatattgtaatctaaaatagtttcagatttactttgcttatatcacttcagtaagaaaacctacataaaagattctggaatctgatttcaagcttccctcctccaccttgccctgcaccaattcggagtatgtagtcaaattttgggttcctaagttactttgaaccttccttccctccctcttctcttactccctcccttcctttcttctttcattccttttttccctcttctcttcttccccttacctctcctcctatttccctccttttttactttctttttccatcaatatagagataggattcacttgaagtttattaggctcttatttctacttacttctaattttatgaattttttcctttcccattcttattgtattaaaataattaattaaatatgttgaacattaataacctgaaactacttccagtatactcagagagattattgttcatttctttctccctcttccagtaggtaaccaattttattgttttctggtttatccttcccatctttcctttcataaaagtaaagctgtatgagctgtgtgtgtttctgtctatgtgcgtatcttatatttatatatatagttattatttcaccttcttacacaaaagctgacatattattagatgtattttagatactcttttgagttttacattttttttcttctttataatacttcctggagctcagttaatatcagctcataaaaatgttcatttttttgttctgttttgtttagagatgtatagtattccattatgcatatgtaccataggttaacaaatctattcggggacatttagacatttttctggtattttgcaattaaaattacgctacactgaataaactcgtatgtatgtagttttataatattggaggtttttcttaagagcaaattcctttcaatgggattgttgggtcgaagaatacatgcatatgtagttttttagatattgtcaagttgtcctccatatgaattttctcattttctattcctactagcccacatgggatggcctattcatctacagactcataagcaggatatattgctatgcatctgaaattttgccagtcttgtggagaataatttgtgtagttttaatttatatttccattattataagtgaagttgaatatttttcatgtggttaagagccatttttatatcacttttgtgaattgtctcttcatgtattttgccagtttttctataaaattattagtttcccccttatttttaaagagttctttatgaattagggattatagctctttttcagtgagacataagttgcacatatttcctcccagtttgtcatatgtttcttgacagtactaattgcactttttttttttgctatgcagctttcttaaggtagtcatatttcttagtcttttaaaaattacatttggaattttattcatggttaggaagccttttattttgtaattaattatgtaattaacttgtcctttattatgtaaaggttttattatgtaattaacatcctttttttactatatcgaaaattttattttttacgtttagatttatgcttcatttagagttttattttgtttatggtatgaggattggatctgatttgatagttttacaatagctatcaagttgtcttaatttattatgaggactgtcttactccagtcatttaagacaacttttatcatttactagatttttagcatgtgatagttgagcctgtttctggaatttctattgtacacatttggtctatttatgtgctagtaccatactatttaattatagagactttgagtatattttatatcttttaggtctacctctcttcaaagctcatctttttcagtgtttttctaattattcttgtatgtttacttttgtccctaagcattgagatcaacttttctagctcctataaaatctcattggagttttcattgaatcacattaaagttaaagattatctttgaaattaattgctattctgatgatgttgaggtgtcctacaaaagaataaataatgtctttccacttatttacatctacttttgtctttttcaagctgagtttcatacccaaaatcatattgttatgtttttatagaaagtatttatttcattagctttttggaggtacctgtgtttccttaaatgacacatggaattaaactaccaaaaattggtgtttaaatttaactcataaaatttgaaaaccattttaatacattcaaaattatttcaaaaattattatttgttaatataaaccactttagataatatatgtttctaatttgcttttttgagctataaatatttaatagagaatgtagttcttgtattggacaccttccagaattctgcaaagtctttcagtttgattcttaacaaggtggtgttggtttgttttttctgttaattttctgtgcttgactattgaaaacttagaattgggatgccaaagttacttcctacacaagaacatatagtttcatccttccaagaaatttgtagtttagagaaaataaaatttcaaccattcctttgtaaaacttatactgtgttgaaggtaaatatattatagtaattttcagttcaatatatgattatgtaatttgaataaaccaaatattgttaacaaaaaagaaaatgttataactttcatattagagaaatgagtttgtatccttgagctttttaagtcaatatctcagtattatcactttgaaaacacttgagggagagtgataccagcaagatggcagaataggagataacctactaatatttcttcacaacaacaagaactctgcacttatctactgacaaaagtcactggcaggagcctcaggagtcaggtaggagggtgtgaaagcccactggagcccaaggcccaaagagggttgttttgagaatgcagactggcacccaggtaatagatgcattaattttgcttccaggttcaagcccagaaatggccctgatccccaagggatttgactacagccctgtttggccttgagcctgcaactaaaatcatcttctaaggggtctaggagcaatcatgtgtactagtgtaagagacttgtttgcccactgatatcagtctctgcagtgaacctagaagtagtcctgtggctcgactccagccctctacagttgagttcccagcacagaactgctcacacaaaaccccagagggagacttgcccatatcctgcagattgtgagtctgagcctccttgataggcttgccaaacttatctttcagtagtacccaggttgtcatctcacagcacatcctgagggatccagtctgacccccagctccccccactgtagtcaggtaactatcatatctgtgcagggacctgctaggagatgtgcaaccatctgaggaattgaggtgggctatccaacctttgtcccacagtagatcctgaggggacccagcctcagatttggcccctcctgctgcagttggtgacatatctctcacctgttcagagacctcctgggaggcatgattgtctggggcactgggatagtcttctgggctaggtttcctggccagctttcccacacagcccagttaccctccttggatcttccctaggtccatctgccctgcagagccctgccaaccttggagccctcctgagacttgtggcagatatgggcttagactgccctctagtgtttagggagttgcagtggtcatgggctcagagaacacaacagtcagtccccttagaaactctggaaggccctctgaagaaggatgagcaaaaacaaaactagactaggaagactggaataaacacctgatctctcagtgcacacacattgttgcatgtccataagcatcaagatcattcagggaaatctgatctcaccaaacagacaaaataaggtgccagagactggccctaaggtgatggagacatgtggtctttcagacaaagaattcaaaatagctgtttttagaaagttcaataaatttactgaagctcaaacttcagtaaaattcagagaagcaatcagaaatacatgaacaaaacttaagagattgaaatattaataataaaaacaaatggaaatcctggaggtgaatgaaatgaatgagtgaaatgaaatacaatgaatgaaataaaaatggaatagagagcatcatcagcacaatagatcaaacaaaagaaagaattagtgagttcaaaggtaggctatttgagaacatagtcagaggtgaaagaaccaaaagaatgaaaagggccaaagaaagcttaccagatctgtgggacaacatcaaaataacacatttgtgttattagaattcaagaaggagttgagagacaaaggggccaaaaacttattaaaaataataacagaaaacttttcaagcctggggaaagatgtgaatgcccaattatagcaaagtcaaaggtcaccagattcaatcccaataagaataccacaaggcatgtcacaattaaactcacaaagatcaatgactaagagagggtctagaaagaagtgagaaaaaagaagcaaataacatttaagagagatctaatataactggcagcatatttctcagcagaaacctttcagggcaggagggaatgtgacaatatattcagaatgtggaaggaaactacctgccaaccaagaatactataggcagaaaaggtgtattttaaaaatgaaggagagaaggacttctgcagacaaacaaaagctgagggaattaatggccaccagaccaattctgcaaaaaatgctgaagagagctcttcaaacttaaagaaaagaatacttacattgattgttaggctaatactgtaattttgttgtataaaccacatttatctttgtataaagaatgaacgacaaaactataaaaaactacaataatttgttaagagatagacaatatgaaaaatataagctgtgacatcaaaattcaaaatatggaaggataatgagttaaaatgtaccatttttgttgttttcttctttcctttgcgatcaaaattaagtttttattggtttaaaataacttattatgactataagatgtttttgtgagtctcatggtaatgaaaaagctaaaagctataatagataacactaaaaaagtaaggaataaaacacattactagagtgaatcacataaccacaaaggaagcctttaagagaggaaaaaaggaaaaaatatctagacaactaaaaaagaagttacacaatcgtgatagtcatcccttacctatcaataactaccttgaatgtaaatggttgaaattattcagttaaaagagaggctgaacggatagaaaaatatgaccaaactatgctgcctacaggagacttactttacgtataaaacaacatgcatagattgaaagtaaatggatgggaaaagctatttcatggaaatggaaccccaaaaagaacagaagtagctgtaattatatgaacaaaatagactttaagttaaaaactgtaaaaagagacaaggccattatataataatagcaggggtcaatgcagcaagcagatacaattataaacatatatgtgcccactagcagaggacctatgtatataaagcaaatattaatagatttaaagggagagatagactgtaacacaataatagtaggggacttcaacactccactttcagcaatgtgcagatcgtccagacagaaaatcaacaaagaaacttcagtgtcagacaacactcttgaccaaatggacctaacagacatttacagagcattcggtctaacagctgcagaaggcacagtcttctcaacagcacatgtaacattgtttaagatagattatatgtaagggcacaaaacatgtcttaacaatttttttttttttttttttttgagacagagtctcactgttgtcacccaggctggaatgcaatggtgctatctcggcttagtgcaacctccgcctcccaggttccagcaattctcctgccttggcttcctgagttgctgtgattacaggtgcctgccaccatgcctggctaatttttgtatttttagtagagacggggtttcaccatgttagccaggctggtctcgaactcctgaccttaggtgatccacctgcctcggcctcccaaagtgctgggattacaggcatgagccatggcggcctggcctcaaatttttaaaaatcaaagtcatatcaagtattttttttctgaccactgtggaataaaactaaaaccaataacaggaggaactttggaaactgtatacgtacatggaaattaaacaagtcaatgaagaaattaaaaaggaatttaaaacatttcttgagaaaaatcagaatggaaatacaacataccaaaacttatgggatatagcaaaaacagtttttagaggaaagtttatagcaataatcacctatttgaaaaagtagaaatatctcaaataaacagcctaatgttgtacctcaaagacctagaaaacaagaatgatctaagtccaaaattatgagaaggaaagaaataataaagaacagagaagaaataaaggaaatagagactaaaaatacaaagcatcaagaaaatgaagagttggtttttgaaataagaaacgaaattgacaaagctttagctagcctaagaaaaaaagaggaatgattcaaatgaataaaatcaaagatgaaaaaggagacatcgcaactgataccacagcaatacaaaggatcattagagactataatgagcaatgatagaccaataaatttgaaaactttgaagaaatgaataaatttcttatagcttatcttaccaagattggatcatgaagaaatagaaaacctgggcagaccaataatgagaaacaagattgaatcagtaaaacaaagactcctatcaaaaaaagttcaggacctgacagcttcattgctaaattctagcaaatatttaaaaatgaactcataccaattactatcaaactattccaaaaaattgaagtagagggcattcttccaaactcattctatgaggccagcattaccctgataacaaaaccagacaaagataaaagtataaaataaaactacaggccaatatccctgatggatatagatgcaaaaacccataatacagtactagcaaactgaatccaacaacatattataaggtcattgaccatgatttagtgaaattcatcccagtaatgcaagtacagttcaaaccacaaaaattaataaatgtgttacattgcattactaggatgaaggacaaaaaccataggatcatctcaatagatgctaaaaaaagaatttgataaaatttaacattcctccatgataaaaccgctgaaaaattaggtgtagagggaacacacctcaacatatgtgcacatatatgcatccacagctaacatcataccaaacagggaaaagttgaaagctttccctttgaatgctgaagcaaatgccatagtatgatggcattcctatcaaactatgacattctttacataattagaaaaaattattttaaaattcatatggaatcaaaaaagagctcgagtagccaaggtaatcataaacagaaagaataaagctggggataccatgttaattgacttcaaactatattacaaggctgtggtaaccaaaacaggatggtacttatacaaagacagacacatagaccaatggatcagaatagagagccaagaaataattctgcataggtacaactatctagtcttcaatgaagctgacaaaaacaagtagtgatgaaaggactccctattcaataaatggtgctgtaatacctggctagccatatgcagaagttgaaactggacccctttcttacaccatatacaaaagtcaactcaaaatggattaaagacttaaatgtacgacccaaaactataaaaaccctgaaggataacctagataccattctggatgtaggacctggcaaagatttcatgacgaatatgccaagagtaattgcaacaacaaagaaaattgacaaatggcgcctaattaaactgaagagcttctgcatggcaaacaaaactaccagcagagtaaacagacaccttacaaaataggagaaaatatttgcaaactatgcatcccacaaggatctaatatctagaatctatatggaacttaaatcaacaagcaaaaaacgaacaaccgcattaaaaagtgagcaaagtacatgaacacacacttttcagaagaagacatacatgtgtccaacaagtatgtgaaaaaatgctcaacatcactaaccattagagaaatgcaaatcagaaccacaatatgataccgtctcacaccagtcagaatgggaattatttaaaaaaataacagatgctggcaaggttgcagagaaaaggggaccttatacattgctggtgggattgtaaattagtttagccactgtggaaagcagtttagcaatttctaaaagaactcagagcagagttaccatttgacccagcaatggaacacttgcagctataaaaaaagaacaagatcatgtttttggcagcaacatggatggagctggaggccattatcttaagtgaactaacactgaaggagaaaaccaagtactacatgttctcactttttagttggagctaaacattttgtacatacgaacataaagaagggaacaacagacaccagaacctactggagaggtggaggaagggaggagggtaaagttagaaacaacacctatcaagtattatgcttattacctgggtggtgaaattatctgtaccccaaacctctgtgacacacaatttacctatgtaacaaacctgtgcatgtacctctagtataacctaaaataaaagttaagaaaaatgataggaaaacaataatttattgtacattttaaaataaaacagtgtaattggaaagtttgtgacacaaagaaatgataaatccgtgaggtgatggatgtccttcttaccctgatgtcattattatacaatgtatgcctgtatcaaaatatctatgtaccccataaataagcacacttactatgtacccataaacattaaaaggtaaaaattggccaggtgcggtggctcaaactgtaatcccagcactttgggaggctgaggtgagtgaattgcttgagtccaggagttggagaccagcctggccaacacggcaaaaccctgtcttaagaaaaatacaaaaagctagccaggtgtgatggtgtgtagacccagctactagggaggctgaggtgggagaatcacctgagcacaggagatgaaggctgcagtgagctgagattgcaccactgtattccagcctgggcaaccgagtgagactgtgtctcagaaacaaacaagcaaatgaacaaacaaacaaacaagttaaaaatttaaaaagacacacaaactaatgaaacagaataaagaacccagaaataaatacacgcatgtataccatctgatttttggcaaaaatgccaagaatacacgttagggagataatattttctttaataagtgatgctgggaaaaagtttcattaagaagaatgaaactagaccccatctgtcaccacttaaaaaaaaatcaaaatggattaaagatttaaatgtaagtcctcaaaatgtgagactactggaagagaacacggaggtaacactttattacatttctctggggaaggtttttgtttgtttgttttggaaaacacctcaaaagcacaggcaacaaaagcaaaaatagagaaatgggattacatcaaaacaaaagcttctgtgcagcaaaggaaataatcagcagagcaaagagacaacctatagaatgggagaaaatatttgcaaactatgcatctgataagggattaatatccagatatgttaggaacccaaagaactcaatagcaaaaaaccccacaagtagtaaagagtggacaaaagatctgaatagacatttctcaaaagaagacatacgaatggctcactgatataagaagaagaaactcaacgtcactcatcattaggaaaatgcaaatcaaaatcatgatgagataccacctcacactagttagaatggctgttatgaaaaagacaaaaaaataacaaatactggcgaggttgtggagaaagaggatcttctatccaccgttggtggaaatgcacattaatacagctgtttgtggacaacagtatggaagtttctccaaaaattaaaaacagaatgaaaatatgtttcagtaatctcactactggatatttatccgaaggaattgaaattcgtattttgaagatacatctgtactcttacttttattgcagcactatgtacagtagccaagatatggaatcaatctaagtctgtatcaagagatgaatggataaaaatatgtcatatatttttggaatgtattttatccataaaaataatgaaatcctgtcatttgggacacaacatggatgaacctagaggacattatattatgtgaaataagcacagaagaaaaatactgcatgatctcacttatatgtagactctaaaaagactgatctcatacaagttgagagtagaattgtggttatgagaattgtggttgtgagaagctgtggaggattttgaaaggcttgggagggtatgaggagggtggaatggggagagattggtcaatttatacaaagttacagttagataggaatcacactttgtggtgctctattgcatatttctaaaactagaaaactaccatcaatgacaaaatcttaaaagtggtgtttggaaatgtcacagaaaacctaacacccaaagttcctttgtttcacagagtccttttcttccaagttagtgttttaaaggattatcatattttgactttaattttataattaatatacagtaaaatttactcttcaactcatttttttccatgaatataaaaactagctagcacatggctgaaaaatgcattgggaatgtaatctgattatttagcctctaatttttcactatttgactcttcattatatatatgtattctactattcctctgttcttatgaatgcttctgaaaaactaaagacattttagactcttttacctctttaaacttttaactagagttgaaatatatgtaatatatttatataaaatatgtatgtaataattacttaaaccatatgcaaatataatttttagtatttaaatattaagtcactttattaagttaccctggtgcataaattttataataatttattttggaggacgttccaagaaatgttatgcaaaaccatgctatatctctattagacattgtcaattttatttggcaaacaaggttttgtgaacttgaaaaattttgaaaatacttatgattttctcccactgctgtagttaactatatttttatgtattaaatataagagtacatgagtatggatgcgcatatgttctttcactttttaaaaatctgtttatgtgaattcaaagtttgagctcctgaatttaatctatattagtcaattttgtttgggttagagaaacctttttttccaattatttaccggaggagatctgtttttaaaaatacagattaattggtgtagaaactggtgtagaaaatttttttaactggtgtagaaaatatgttaatttcaaacaataccacaagtgtgaaaataatgtggatttatgaattccctgaattttcttctacctaaaaatatctctgtatcttatttcagactttcacttcttctgtttattaaggcaggatacatatcccaaagctcataattatatttcatctgccttttaacattccttatatgcctatcatgtatgtttattttctttttcttcactatttcatctctcactttttctcatatataaagctttctacaattaattcaaatttcaaacacatctttcaaagatgtgtttttgaaatttcaaataatggtatagttttaaatatgttttgatgtagaatataaatacttttttgcttgaagaaaaacatgaggcttttgaattgcattgtttaatagtaaatgagtttttgtgtttctgcagatgtgactctgaaaatcgctatgttggtaatccacttagaggaacatgttattgtaagtatatgtgtattcttcattttaaataattggtgcatactattagtttcaaataataaaggtcatcttgaataactaaaattgtcatgaatatcttgcaatttctatttcttaaattttataatacaactttacgtatattgctaagaaatatattctcttaattatatttggtacattttttctactctgagcagtaaaatagcaatagattttgttgtgaacatagaacaaagtatagaacttgagtaaactcatgtgattttaatgtagtccttttcattatgatggatttttgaagaacttgaattttataatagatattttgcagaattttgggcattactaaaaggctgcactgattttgtaccaacagatgctttcattgggtactgattatatggtaggtatatatttaacttttgttttgttttctgagatggagtcttgctcttgtcgcccaggctggagtgcaacggcacaatctcagttcactgcaacccctgcctcccaggttcaagtgattctccagcctcagcctcccaagtagctgggattacatgtgcccaccaccacgcccagctaatttttgtattttttgtagagttggggttttgccacgttggtcaggctggtcttgaactcctgacctcatgatccgcccaccttggcctcccaaagtgctgtgattacaggcgtgagccactgcacctagcttatctttaacttttaaagaaacagccaaatgctgtttccccaaatggttgtaccattttacattcccaccagcagtgtatgagagtttcagttcttccacatttcagaaacttttttagagttagtccaagttttagccattctaataggtgtgtaatggtatctaactctcattttaatttgcactttcctaattactaatgatgttcagcatcttttcataggattgtttgccatctgtatattttattcgatgaagggtctgttgaaatcctttgcccactttttagattgtttttatattaacaaattttccacatacttcattctagatacaagtcctttatcagatatatgacttgcaaatattttttactagtggtaacttgtctttttatcttattaacactattttcttgaagaacagattttaatttagatgaagcttgacttatcagtttgttcttttgtgaaatcttagcctaacaggtcactgtgattttccccaggttttggtagaaatattatatttttaagttttctatttaagtatatggtccattttgaattaatatttgcatatatagtaggtgatggattgaagttctttttttctccatgtaaatatttaaatgttcaagcacactttatgtgaagactatactttaatcaatgaatttctgtgcacctttgctgaaaaacacttgtctgtaaatgtgtgggtctgtttctggactcttttctgtttctttaatctatttgcttatttttatgctaacgtagcacatttataattaatgtgattttataagtcctgaaatcggttagtatttattctccaactttgttcttccttttcaaacttgttttgactactctttttttttttgcatttgcaagtgaattttagaatctgcctttcaattttcaaaaaaattgctataatttgttttgtgattttgtttaacttatagatgaatttggggagaattggcatgttaactatagtgagtctttggaattattgtattttttattttttctcaattctttaatttttactattaatattttatagttataactgtacacatatttcacatttttgtcagatttatccctgtatattttaaatttgtgatgctattgataatgttagcttaaaatatttcattcctgatttcctgattgtttctggcatttataattgattttatattggttttacatcctgtagctttgcaaaagtcacattttacttctactaccattttttgttgactctcagaatttctacacatacaatgtttcctgcaaataatagcagttggatttcttttcctctcttgatggttttctttcttttttctgccttattgctatagctagcacctttaataatgtgttgaaaagatgtgaacatgaaagtattattgtcttgtttctgatctaagagggaaagcattcagtcttttatcattaaatatgatgtaggtttttgctaactgcctttatcagattaaggaaattgccttctattcctactttgctgtacattttttatcagaaatggttgtttatgtccaatgcatttcctgcattaatttatatgattatcagaaatttctattttactttgttaatatagtgattttagtatttttaatttaatgaacggtatacagtataagaatatactaccatttttgtccattcataagttcatggacattgggatttttttctaggttttgtcattaagaaaaatgctgcagtgaatgaacattcatatggtctttatgtgaacatatgtttttattttccttgggtagattcctagcaatgtatagtttggttgtatgataagcttttgcttaactactttagaaactgccaaatggttttccagaatgttggtaacattttttaatttattctagaaaattttgatactagaaatttcattccttgacatcctcatcaatacaacattgtctctttgatcatagacattctagagtgtgtatagtggcattttgtggttttgttttgtatttctttaatgactaatagtgttgaacttgattttatgtgttgatgccttgaaaatgatttgctgggtgtgtaaaatttatccttttttcagtttttgttgctgttttaaattgtatttttcaaaattttgttttctactcttgtttgatatataaaaataaaattcgttttagtatattgatcttatattcattaactttggtgaacgcttactaaattctgtttgtagatttgcttggatttttaaatgcagttaattatattacatgaaaataagcacaattttcttcctttttcaatattttttacccttattgggatgttgagacctctatttctgggctgaatcacagtgatgataatagatatccttatcaggtaggatgtttattataatttatggaatattccttgtatcacattaagcaaattcctatcttattttgtgacaaggttatatcatgaataactttcttttaccttattaaatactaagttaaattaatagattttctcacattaaacatcttttcattctgggctaaaccatacttagtcatggcatattagtatttggatactgctaaatattagttgtttatattttaatttagaatatttttagtatgaaagaagacgatctcttttttgaatgttattttttctgactaaatgacctatgactgcagtttttaaaaattattttctggccgggcgctgtggctcacacctgtaatcccagcactttgggaggccacaaagggcgaatcacgaggtcaggagatcgagaccatcctggctaacgcgttgaaaccccgtctctactaaaaatacaaaaacaaaattagccgggcgtggtggcgggcgcctgtagtcccagctactccggagactgagatgggagaatgtcatgaacccgggaggcggagcttgcagtgagccgagatcgcgccactgcactccagcctgggtggcagagtgagactctgtctcaaaaaacaacaacaaaaaagttttccattctatatatctgcaattgtggtaaaagcttttaaaaatgaatttggaacaattgctatcttcttttaaaacaggaatagttaaaactttaaataaaaattaggtatttcaacaaaaatttttgggtctagtgctttttaattggtagttattttatttttttattttttgctatttcatagcattagcttttggttttatttatcttttctgtggatcttgttttttagttcatcaatttcagattttgtctttaataatttccttctcatatactgtttgttgttgttttgcctatatttgctatagtattttaaaattatcatttttttacagaatttatgaattccttttttatctttaaaaacgtaattattttcttagttcctttcttaagtgattcttattttttaacttttattttaggctcagggctgcatgtgctgcctgttatataggtaaattgcatgttgtgggggtttggtatacagattatttcatctcccaggtaataagtgcagtacttgataggtagtttttagatcctcaccctcctccaatccacaaaacatttgttaactatttttaattttttaaaaatgttactgagaatgtggcatataaaatcccaaattttgttaaggtatttttgccctttatgacacatttgatagggtatggaggcaattttgtttgtcacaacaggggagtgggacgtgggtgccgtgggcatctcatgggtagaggctagggatgctggtaaacatcctgcaatgaaaaggtcaacctccccagaacaaaaaatcatgtggccaaaaatatcaatagtatttaggttgagaaatcctgatttagaggcttaatcaaatttatatctgattttggagaaaataataattgtagatggtttggttttctttgtctagaagagtcatatcatgtctgttagtgtctcttatgttcttggcacacactgacgctcaatgtttagattttaattgatcaagattgaaaagatataatattctgccaggcacagtggctcacgcctgtaatgccaacactttgggaggccgaggcgggcgaatcacctgaggtagggagttcgagaccagcctgaccaacatggagaaacccgtctctactaaaaatacaaaattagctgggcgtggtggtgtgcgcctgtaatcccagctatgtgggaggctgaggcaggagaatcgcttgaacctgggaggtggtggaggttgcggagaactgagattgtgccattgcactcgcacctgggcaacaagagtgaaactaaaaaaaaaaaaaaaaaagaaaagaaaagatataatattccaatttcttcttcatgttttggtttgaatacttcggtaaaaacaaattttcgctcatcagctgtttggttgcttattgctacagttcgcatagggaaggcatgataaatgttacagtttttccctgtattttttatttattccctttactacttttatgtatgtatttatttatttaaaattaaaagttagctcaatatctttcaaaaatgacagtttttgtcactaatgaacttatagatccatacatgttttaatccgtgtgcaattattattcctactgatgctcagactgtccaattactgtgtcatttaaattatctttattctctagcttttccacatcatttttgtttttcttatttcaaatatcctggatttattttatagggatttttttctttggttttttaaaattagaaattcctctttttttgagcctttagtttcttttatctgccaaaggagtaactagttaccattatgaacacattatgtaatctctgtttattacaaatatactaatgtttaacccttttataaaaactagcataatttttcttctatgtcaatgttgtccaatacaaatatgatgtgagcctcatatgtaatttaaaattttctagtagcttcctttaaaaagtaaaagaaaatgagtaaaattaatgttaataaaaccttttttagcttaacacatctaaaattttttcattttaatgtgtaatcagttttaaaagtcattaagtcattaatgagatatcttactttttttgtactagtgtttgaaacaaagtttacattccatacttacatcacattttaattcaaatcagttacttttcaactagtcaatagccacatatggctagtggtgaccttattggacaactcttctctagattacataggatccctgcgttcttttagaaatatcagaagcataatggtaaagcactaggtggcactcttggtattgctgtgagacgtttaaagcttaatatttgaaaagaagtgatgcttaaaaaagaaaaggacaataactcttgtaataatgttaatagaaactattctaattttcaagattagatcgaaatttaagatgcaagtccacactgtaacttaaagcaattgagtgcaatgtggtattaacttaattgaaagtgatatgtcagcagttgtaatctatttacttagtagtttttcaaagttcattttaaaaccaaaaaccaaatatattataaagcatgcctcacaaaggagggaaaacgttcaaacagtgttaactaattttattggcccttgtaaacattgaattactcaatatatttttagtaaatacaaaaagtagtagtcacaaagtatcacaaagtagtatagtttttttttcttaaatgctttcttttaattgtaataacaattttaacaaagaaaaccttaaaaatgaaagactaggctgtagaaatgctatatagatgatatatttcaaaaagtagaatgagagtacataaagtcactttctgcagtcatttactttatttcactattgtgctaattctttaaatacatgtaatttgcaatgctcacacccctaattattgtgttttaatatacttccaagtaattgaacacattttatttcatcttttactctttaaaaaattactgttttatgttgaatttcttttattagagtttcttttatttagagttcatggtggaattttgtagtaataataaactacctattttgagagtaggaaatttaagttgaaaaagatgacttaaaatagtatgtcagtttaattacttaaaatagtatgtcatagaaaacaatgaaaccaattaatacttgaattgacccttatatttaatggaattatcctggtttttgttctaaaactgaataaaataattttcctgttttaaactgaacattttgttagtgaatgttttatatgactttttaactattggctataaattgctatttaagtaggatctggctgtttcatttgcacatggggcagagtgatcttaataaacaccaataatctaaattcttatatttaccagattgcagacatgatggattgaacagtatctgacaagacataaatgagtcacatttttggcattttaaccttgttctttgattcctcagtatttttattaaattttctgaagtctgtatccctgtacttttagatttttatttcagaactatttactcctttagcatagtccaaaatgatggataataaacatgattataagaaaatttaaaatagctaaaaggaaaaaaattgctattaagttaatgtagaagaaggatgaaaatttatttgacttatatattttacaataaaagtgttacattattattttcatgtaaaatcatagactcactgtaaaaaataataaaaaagtttaaggaaggaaataaaaatgtccataaaccttccaccaggtcccccaagttgagttgtgtagtatgtatcctttgtaagggtactcagctgagtggaagattgagagctgatatgctgtacttacctttctcactaagccatgtaccctagtgtggggctgtgtctgccttgagccagaggtatatagttctttatttgtgtgtaaaatgttgaatggtctactgaagggactgcctgccttctaaataaatctctgcatcatgtcctgagaatgattttatgtcatagaggtcataacatgcataatattattgtgaatgtttttcttatagatatatagctcattattagcatttagtaaataaaacatagtttttcccaaactggaaaagaacaaccacctgactttaaaataatgatcatactagttaacatttattgagaacttactatactagactgttctcagctttttatatgtattagcttatgtaatactcaaatgggaagggtatgcttattattcccattttatagataagaaaacagagatagagaaagctgaactaatttgtataagatcacacaggaaatagtaaaggcaggtttcaaccctcttaaccattaaagaagtggaaatcagtggtatatgtaagcaaaaagtttttatatgagtgaaataaaaacattatgctgaaggaaataagaggatctaaataattaaaaaatcatatgccattttttcaaataagaaatattcatccaaagatatcataacttcccaaaattgatataaaaattttatgtaattccattatagaatttcattcaattttttctgaaaggcatgcattccaataaattaccttaaggttcaagttaaataatacacttttagaatatccagttagattacaaacaggaagaatagtaagaaattcctactttaatagatatccaaacaaactgtaactctaactgcatccactggctcccaaacttgtattagaatatgccactaaatcaatgaacaagttggagtataagattaagttcctgataatttgggaatttatatggtactatggtttgaatgtttgttgcctccaaaattcatgctgaagtttaattgacattttaacagtattaaaacctgggactttttttttttttttttttgtgacggagtcttgctctgtcgcccaggctggagtgtggtggcccaatctgcaagctccgcctcctgggttcatgccattctcctgcctcctgagtagttgggattacaggcacccaccaccatgcctggctaattttgtttttgtatttttagtagagacggggtttcaccgtgttagccaggatggtcttgatctcctgacctcatgatccgcccttctcggcctcccaaagtgctgggattgggacctttaagaggtgactaggccatgaaaactccaccctcataggtggaatttgtgctgttattgaaaggcaacttcagttccttcttgttctctcttgccctttggccttctgccatgggatgacacagcaagaaggccctcaccagatgccagctgtttggtcttctactttccagccttcagaactgtgagcccataaatttatatttattataaattacccagtatgtggtattttgtggtattctgttatagcagcacaaaacaggctaagacatatggcaagtcattttatttgtatgtctttaatgacttaatttgcttgttcttagatatctcaaactttacgaagattatggctttcgcatttactacttttctctctcaagtactctatccccagctaatattccaaacctaacaaaaatgactcttccagatatcacaaaccttttgtttccatcctaacacttacatagtataaaattatctcagttgatttctgtttttaacttgaatttaggtttttaagtaaaatgaaattttactagaatcaaattctgtgaacactgtaccttgttttattggatctccatacttagaaatctgtatgactcataacagaccttcagttatgtttaatggtagtagactcatataagttattaatacataagtgaatatacatttattttagctgtatgagcaagcatttttattgttggggtacttgagcaaaaatgtccagagatcatattgtagattatcaagtaaaagttgctttaagtttattacggacatagggtaatactattatatcactgaaaaactttaagtatcagtcttttatttaaagaaaaaatgaatttcaaggtttgttttcttcattgaacatttctttcaaatgaaactaaatagatgaccattcatcattgcaggataattgaaagtttagtgattttgagctattatgaagtaaaaaaaggtggcttctgaataggtcatggcatattattaaaaatcccataaattagaaaaattaatgtatggcattggtgataatcatccattcttatgtatttaaaaaatttatttgtaagactgaatgaatttaaatgtatatcttaggtcatacaattagtagttttcagagtttggattataactgtgttttttctatgatatgatatctagcaaatgctgaacctacaaaacttgtgcaacagattttacttttgaaattgttctaaatgttccagattcagtagaaattcttaataattttcagcatggatagtacagttgagcaaacaaggaaaaactagtatttattaaatatttatgtacaaaacaattttatattaataatttcagtattcccaagggtgacatattttttctcattaaattactttctggaggattcgactgttagagcttggagagactgtcatttacttgcgtttactgacttgtgtttattcattctacatttacttattgactagctactttgttagactccatggataacaaagtgaacaaaatgttttttcctctattgaagcttatacactactagagaaaatagatattaaaccagttatatgattttcataggtgtgattttcgtaagagctctgaatgagaattatagagttttgggaatgtatttccaaactttatagagctttgggaatacattacaagagggcctgacctaatttgtgggatagggagtaggtgaggtaagggaatgattgagctttgatttgaagaaatgacttgataagatgtgatagtgtgagggtagataggaagaagtggaaccaaaaaggacagcatgtacaaaggttcgtgactagaaagaacatgcaatgtttgagttactaaaagaaaaccaatactgaaacacatagaatatacagagcaaaaataggaagcttatgagatctgcaagatccaaacaatgctatgctttatagaacatgtaagatacggtctttatcataagaaagataggacgccattgaagggtatttagaggagagaaaaatgttacattttgcttttaaaataatcagtctgctttcagtatgtaaaacagcttagtggcggcaatagagcatgaaatagaccatttttggtttattttttgaggcatcttcctggagctatctgtaaaatatcattacagcacattgagactgttaaaatacttgtacttttattcacatgggtttttatcatttactaaacaattgtctaagtttgcaaatagttgtatttataatcgtaccattgtttaaatgtttttggactctcgatattgttgtcaaagtctgtatgtatcctttatagactcctcaggatggctgactataagatcataaacatatgtttattaacaaacatatgaatataaataaacatacatatgggaatctgacttttgaaatccttcagaattcattcagaaataactacagtgaataaggcagtgaaataactttatcgaatgcctttattttatcagacagtcttctctaaggcaaatacatactcacacaattacatttaattcacagagcagtcctatgacataggcggttttatccctgttgtaccattgggtctcattaagcttagttaacttgtataaaataacctagttgttatatgggagattacaaccaagatctccttaaatggtatagatgatgctaaattaaaactgaaacgcaatattaactgaatcattaactcagtggaaaagcaaattattaagctgcagtttgtttctcaaaaaattcacatataaaatttcagaaacaattcaaaatttatatctaagaattcttcttcccaaataagttgaaatttacatgagcagtgccattgatacagcatatgcaaatcaggcttatttttatttgtcatcctaacatgcctgccatcttgcatctcagatataaagatatttccagtatacaccttgatgattttttttatcactggttactatcttcttaaaaaatacattatttcctgcagattttgttgcaagagtaaagcaaatcttaaatattcactacttgctcttcatcatcccaagcatgtaatgtactcagaaactttcttcttagtttctctttcaaaatgtctttttatgcatatacattttagtcatcactttccacctaatcattagtttttaatatctgacttctttaaacatcttgtatacgttaaaagccttttctctttatatatttttgcttaaactcctttttcatgcaatgtgttttactcatcagcttcatttagtatataatttgttcttgtagtaaatagaaaacacttttttgcactacggctgctagaccagtattgactaaataaccttaaaaaaatcaacttctgcatgttgaaacttaatcctgggcatattccagtcatataagactaggatgagagactgattatcttgtatgtttttgttagcctatatctaagaagtttgtgtattaagaatgaaatatgccatttttggagagaaacataactacagttgacccttgaaccccctgaggtatagaggcaccaaccccgcatgtagtcgaaaatctgcgtatatctttttactctccctgaacttaactactaataggatactgttggccagaaaccttaccaataacataaacagttgattcacatatattttgtatgttatatacattatatattgtattcttgacagtaaagtaagctagagaaaagaaaatgtattaagaaaataataaggaagagaaaatatatttagtattcattaagtagaagtggaaatggatcgtcataaaggtcttcattctcaacgtcatcatgttgagtagactgaggatgaggaagaggaggggttggtcttcctgtctcagaggtggcacaggtagaaaaaaattcacatatgagtggacttgcatagctcaaacctgtgttgtatagggtcatctgtatatcaatctaattatttaatatgtaagtatacatcatgtgaaaaacatgttgaagatcaaggattaaaacaaagaaactctctgaacattggtttacattttttttggcccaatagtggaaatactgcatgttcattctagaaaagagataaataaaaataaaaataaaaattactaatttttctacctagagaaaattgttgctaaattgtactagttttccagtcatttatttatgtattgatactctgtgttagggtgagtaatgcaccccgaaagatgtctacatcctccccagaacctgtgatacatacttaccttaaatgataagaaggagttacatatgcttaaactaaggattttcagagagactattctggactatcctggtatactcagtgtaataacaagtattcttatgaaagggaagcggaggaaatttgactacagtagtaggagatgtgatgatggaagcaagtggagagatgtgaaggaagggaccatgagccaacaaatgaggacaggctttggaagctggaaaaggcaacttttaccatacattgattattcttatatgaaagaattattattaatgtgtttaccaaatgatgattttctatttcatcatttgttttacattattaactgtaagggagagctgttccttctccttcctcattaatttgtttaattatttatttatatcggtatgaactcatggatatctatttaattttatgatttataagaaattactgtcgttatttattttgtagctgaaattgttccagatctggtcattaagatccccctcaatttggcttctgtgttttttaacataactccatcatttgttgagtgcatccttattttctagcactacaagatatttcgggcttaccttgtactttccctcttccatccctgaaatcaactagttcccatttccccaagatgccatggtttcttatattggagaataatatttagaaaccaaaactggggattatatatgctcattggttctggggttttattctttctttcttttaaaaattttatgggtttcctgacccatgcactagggtataacaatggtattacccgataccttgtcattaataacatcacctatgaaataccaaattcaaatatcttacacctttagtccttcttgctcactaagtaccaatgccataattattcaaactcattgaaatttgtaattcattaaccctacttgttttctcattttcaccctttcctagtgccctgctgtcttcttttatacccttaaccatgtgaggttttatgccattatagttatcagtccttagctaaaactgcatattttcttcccactcctgtttcttctatctacttgtgtagcaaaatccaaactggttaatccaactcttcactactctgtgtctgaactttcttcaccctcacgttgctggggggaaaaaaaaatcatatagctgtgttgactgtttggtcttgagctttatcaaaggaaaatgcaaaactacctggtgtttttcctgcatttcctttataatactctccaaataagtgttttaaaacttcatctctattctcaaacctttatctgcaccagctaataattttacctcctacttcattgagaaaatataagcaaatagatgcgaatgttcccatttttttttaccaccacaatcaccaaacttttttgcacctatacttattttctctgcctttagtttattatcgaggaaagaataactctgttcctaacaaaagcctatttttcaatttgttttgctctaaattttatacctttaactctttaagggactttgctcttccatttctgctttatcaacagttgcttagactctactggaccaatttccttagcacacatatacatgttttaatatatcttatgttaaaaataaaatttttctactccccttatacttctccaactattgcaccatttctgtattttctttcagatcaacccttctcaaaatagttgcctaaacttgtcaccaaatccttaccacccatttcctcttcaatccccacaactccatagacattgcttttctaaggaaacataccacagagtcgaacagttgaaacagtctatttcttgactttcctatcatactttccaatttttcctactctgtcactgactgcacctttttagtcttttttacttttttttccacttgaccttatcagttcccatagttttaagaagcatctaaattttgatgttccaaaacttgtagttttgatcacttttctgagctgcaaactgatttctctgactttctgtttgatatcatcatttagatattttattagaaagtcatattcagtattttcaaaacagaactctaagtttttcctcattttataaaacttcattctttactcagacttcctcatttcagtaaatgtacataatgcctatatacttgcttttgtcaaatatctgaaagccttctttgattcctgattccaaagacttctttgagcccccctctctgatacctttcctttctcaacccttactttgtgagggtgtttagtacttcagttggatttccttatacaatatatcccaaagatatatatctttctctcttctacttctcccaccctgtccaaggcactgtcattttgactctggtcctttttagaagcttccttgtgtagttttcccattttcagttttaattttcttcagacattctccaatcggccaccagggtgacatttaaaaattaaaaatcagaccatctcactacccagcttgagatctttcatggttttccatgatgtggcccttacctgctttctgactttatctcttacaaccctccacaaatcattctaagcacagtggaattatttttttttcctcaaacagcgcagcttcattttcatttgtgtttgctctctctctctctctctctctctctctctctctgtgtgtatgtgtgtgtgtaaacaatcaggaactttttcactgtaaacaatcaggaactttttcactgattgtttacatgatttgcttctcatttttcatttatcatttcagatgttgtttccttttgtgtgccttttgtaaagcaatcttctctgaacctgtaatagggattggtaagcttttgctgtaaagggccaaataatagatattttaggcatgacaggccagatggtctctgttgttcctactaaactctgccactgtagtagacaagcaaccatagacaatatgtaaatgattggttgcggctgtgttatcataaactatctacagaaacaggctgtggaccagatttggtctgtgggcagtaatttgtaacacctattccaaaacattaccttgcgatcttcatagcatatatcactctcttaaaatgtcttgtttatttgtgtgattatttttggctttctcttctattaatagaatgcaaactccataggaacaaggcctttgattcctcacttctatctgtctataattctgattggaattttattaatttaaaagattaatctgaggagaacatatatatattttcttaagtattaaaatttagaatgctccttagcagtctatttatcatgtatagttacatcttcttttatgacctaaaatagattttgtagttttgtaaattaaattttttgtagttttgtaaattaatatttagtttatttctgggatttcatttggtttggagatttttattagtttgctattcagaatggaatttttaaaccattacattttctgttgaatgtaaaacctctattgatgtaaaagaaaagctattgatgattatatgtgtttaaatttttgcatttttttggtgatttgatatcatcaaattattctgttgatgatttatagtgatgccattaatgacaaatttttggtctcaaagtctataattgaaataaatgtaattacacctgtttcttttgattagcatttgcctgatgtgtctcccttcatcctttcagtctgtgggctctctttttataggcatatctcttaaaaatagaagactttgattttgctgttttctaatctgtacatttttgtgattaatgatgagttgaatccatttatttttggtgttattattcatatctgaatctatttataccattttaattttttattttgtatttttactttttatatatttgtttttaagccttttatagcttttttggaaggggaaacatactgatatccccctcctataagataaggattttagcattctgtaactttttttgaaattcttttataaaaccacagtgttttgatattctctagactttctattcttggttattatggatacgcatgtttctttggacatcgcaatttttacaaagataacaaattcaccaaggtattttatcagccccatctccgtatcccttgatatattttttgctacacattctgtatttatctcttctctttttaagtctttaatcaaaaattgttttaacggaagtctgcatgtcaaagcttctgaattctctatgcctcagagtatttattattccttcctatttgagtgtatgcaactaataaagtagacttaatatgtggagcaaaaattgattaaactacaataaaaaattaaacatacctctttagagtatttctagatcaagcagacaaaattcagaaagaatatcaaagatctgaagaacacagttaatagaaatatgaattatagccataaagatttaaaagaggatttaaatttgcatttattttacagatgatataattgtttccataagaaatcgaagtgtctacaggcaaattattagaaataacaggaatgtttgtcaggttgttggatacaaaattaatattaaattgccttcttagacatgttcctctaccagctgttagggctaactagatagttacagtaattaaggcagtgtagagttgtttttcttttgttttttggtgcagggataggcatagtcactgaagtaataagataatctccaaataaaaggtataggtatttatatattaatatttaagtcatatctggctacattactgaattgtttattatttaatagctttttagttgttttatattaatttcttggtaaactgattctaggcagaaaaagacaactttgttttctttttaaaaatattcatatttctgtataattatatttttgtaatttacctctgtcatctattcaccttttttctttgccatttttgtatttgtatttgtctcttagttgtaatgtgtgtgtgagttgattttttttttcaaaactgatatgtagattatgtccttttaggacacctgtttacctgaaattattttattttattttattttatttttgaggtggatagagcaagatatttatatcttgctctgtcacccaggaaggaatacagtggtgccatcttggctcattgcaacttccgcctctcgggttcatgcgattctcctgcctcagcctcctgagaagctgggattacaggtgtgcgccaccacgccagcctatttttgtatttttagtagagatggggtttcaccatgttggccaggctggtctcgaactcctgacctcaggtgatctgcccgccttggcctcccaaagtgctgggattacaggcttgagccactgcacccgaccctgaaattattattatattgttcttgaatggggacagcattgctgagtatatattttccataaatattacttcttttttttattttgacatttatttctgcttaagagcacttggctgctgggcaaaatggcttatgcctgtaatcctagcactttgggagactgagacgggtagatcacctgaggtcaggagtttgagaccagcctggccaacatggcaaaaccccatctctactaaaaatacaaaaacaattagcaggatgtgggggcacacgcctgtaatcccagttactcaggagctgaggcacaagaattgcttgaacctgggaggcagaggctgcagtgagccaagagtgtgccactgcactccagcctgggtgacagagtgagatttcgcctcaaaaaaaaaaaaaaaaaaaaaaaaaaaaagccttggcatgttgcctaatcctactctgtaaataactcatttgtccgtgtgtgtgtgtgtgtgtgtgtgtgtgtgtgtgtgtgtgtgtgtgtacacttacctacatggacatgcctggatgtctgtaattttttttaacaataacttcatagagatatattcacaaaccataaaagtcaccattttaaagtgtacaattcagtagcttttagtatattatacacagttgtgcaacgatctgcaccatctaattttggaacatttttatcgctccagaaagaaagctgtacatgtcagcagtcacttatcattcttttttcaccagctagtggctaccatttatcttctttttgtctgtatggatttgtctattttggacataacaaaataaatcagtcttttgtgactgatttctttcattagcacagtatttttgaagtttattcatgttatagcagaaatcattactttatttctttttatgacaaaataatattttattgtgtgaacatatcacattttgtttaccattcagttgaggtacatgggttgtttttacattttggctaatttgaataatattggtgtaatataatatgctttttatatttatacaagatacttcctttaaatatttaggttttcttcatcaacagatttttttctttatttaatatatgtgctacccttcaactcattatgatctctgctttaactacattagtcatgcatacactgaatttttctgtgtatcatttctcttgagtgattttcatctctatttctattttgggaggctttttcgtatttgacctacatagcactatttcagtcttatgttgtattaattattctgttttctgattctcgtattaactttttaaattttgccattacattattacttttttgttcttccttttgtaatttatttagctctctttttattgtaatctttggtgttattatctcatctttcatctttaattttgtggagtcagtgttttttagattttattttctcttgacatgttccccatgggtattttaaatagctaaaaaaactctgtatttatattaattgtatctacttcatctgttgttgtcaaattgagattttgctctttttctcttcttaccattgcaagtcaaaataatgtaagaaaagcaaaaatgtttactacttttcctatgtttttgtttttatgatttaaaaaacatatgcaattggaatttggagcctgaagtatgaatggttttgtattctcctgaagctctacgaagctcatacaaaaagtgagaagtgtaaataagagaggtctttctttatatctattttacctatttttataaactatttttatataaaattgggaaattaattgtggatctccgattttcttggatttatgagaggtggtttgcttggatttatgaaaggtggtttgctgattgttcgccaaaatatttaaaagcagatacatatatcatttaaagtggttctaacctctgggctcagtctttaaaatcaaaaggttgatttatagatacttacagctttgattcttcaagccttgaaatacagctatttagtatttttttctattaacaaagttttccaaaaggtgttcctagcatatttaaacataaagaatagtttatctttttttaagttatggaaatttaaaatgtgttaaaaagtatagtatatatacttctattcatgtagtatatatatttcatagtatatagaatatacttaaaaattgtgtacctgttaccaagctttaataaagcttaacgccttgctctatttgctttggattttttaaaaagaaagtaaacatcacagatagagttgattttttttgtgtctttttttagatagagccaccaaactgtattttgttttgtccttattatgctaatgttatttgtttgcaatatatataataatcaatatttattgagtactttatatatgtcaaacagttataagtacctttaatttgttagctcacttaatcatccataaaaattaatactataccacattatttaaaatatataaaaattacatactctgtgaatcctacaaattgcttttatgtgcaacatatttgagatttatcaatgctaatatatgcagccatagtgcatttattttagttatgtagaatatttctacaggtataacatttatttccccattctccttttgatgcacatctaagttgtacttaatttttcaaaataatatataattctggaattaaaatccttacacatttctacttgaactggaagttctttgagatatacaagtagaagtggaattgtagatttattagatttttccaaattacactgcaaatatttatattaatttatgctccatcatggtatacaataattttcttccacttcctcaccaacattttatgtttttagtctctttaatatttgccaatctgatggttttgaaatactatcttgtttttacttgcattttctttatgactaattgaaacaatatcattttacatatttattgtgtatttaagtttctcttctttgaattgttgctcttattctttgtctttttcttattttgtagtttgtctttttcatattgttggcattttcttattgatttatactagttttaatgtaataaattctggatattaattttttgttcattattgatacagcaaatatcttctcatagtctatgacttggctcttgatctttgttaaaaatgacatttatacattcttctctttgctacatggcacctaccctaaactcgaatatcaaccacataattggatataaaacaatcctcagcaaatgcaaaagaactgaaatcataacaaacacactcttggaccatgtgaaaatagcagtcaggacaaagaaaattgctcaagaaattaaataacgtgctctggaatgacttttggataaataatgaaattaagggagaaatcaagaagttctttgaaaataatgagaacaaagctaaaacataccagaatctctgggatatagctaaggcagtgttaagagggaaattcaaagggctaaatgcccacatcaaaaagttagaaagatctcaaattaacaacataacatcacaactgaaataattagagaagcaagaacaaatcaaccccaaagttagcagaagacaagaaataaccgaaattagagctgaactgaaggaaatcaagacgcacacaaaaaaaaaacatttaaaagataaacaaatctaggagttggttttttgaaaatattaataagatatgttgcaagctagacttatttttgcagttgaaagtaatggcaaaaactgcaattacttttgctccaatgtaatagcgtgccaaccaacaacaacaacaacaacaacaacaacaacaacaacaagcataggtcctgatgaattcacagatgaattcaaccaagtgtacaaagaagagctggtactattcctacggaaactattccaaaaagttgaggagaagggacccctccccatattattctatgatactcatatggacaggaggcagggaaacactgggtagaagagggcagtccctgggagggccccaccctcaagcctggaacagtagcccaaagggagaaatttctatcaccatatttctgctcgaatgttgccttttccaaaatcgccctggcccaccccactcccctgattctgtacccataaaaaccacaggctccactggcagaggtgctgcagaaaaggagagaagagaagaagcagccagacattggagagaagcagcttgacttcagagggatggcttgacggggaatatcagaggagagcttggctggggagagcaagactccggggaaagaccaccttctcacctcatattctttccacctccccttcccactgcaagccactttcattggcaataaaatcctccatattcaccaccctccaatttgttcatgcaacctgattcttcctggatgctgaacaagagctcaggagccatgggtatggacacttgagctatttaacacttaagccttccgtggatggcaaagctaagaagacactgtaacacatgccctctggggcttcaggggttgtgggtaccccccagacactgccatggggctgcacagagttttgcttctgccggcacccagaagcattcatcccagttgctgcacctgctcacttgcatgctcctcctcccacaaggggttatttaagagctgtgggctgagtaagtgaggcaccccttttgtgagacccatgaagggtcagggaaaatgttctgtttcaatgccagcatcatcctcataccaaaacctggcagagacacaacaaaaaaagaaaacttcaggccaatatcttggatgaacatagatgcaaaaatccccaacaaaatacttgcagaccaaatccagcagcacatcaaaaagctaatacaccacaatcaagtaagtaagtaggcttcatccccaggatgcaagattggtttgacacaagcaaatcaataaatgtgattcatcacaaaaacagaactaaagacagaaacaacatgattatctcaataggtgcagaaaaggctttctataattaaaaactataacttaggtattaaaggaacatacctcaaaataataagagccatatatgacaaacccacagccaataacatactgaacagacaatacctggaatcattccccttgaaaactggcacaagacaaggatgccctctctcaccagtcttattcaacatagtattagaagtcctagccagagcaatcaggcaagagaaagaaataaagagcatccaaataggaagagaggaagtcaaactatccctctttccagaagacatgatcctatatgtagaaaatcctatagtctgagtccaaaggctccttcaacttttaaacagcttcagcaaagttgtcagatacaaaatcactgtacaaaagttactagtgttcctatgcaccaacaatagccaagctgaaagccaaatcagaaaggcaatcccattcacaattgctacaaaaagaataaaataccttagaatacagctaaccagggaggtgaaagatctctataatgagaattacaaaccactgctcaaagagaagacacagacaaatggaaaaacatccagactcatggataggaactgtcagtatcattaaaattgctatactgcccaaagcaatttacagattcaatgctattcccataaaactaccagcagcattcttcacagaactagaacaaaactattttaaacttcatatggaacccaaatagagcctgaatagccaaggcaatttgaagcaaaaagaataaagctggaggcttcacgttacccagcttcaaactatattacagggctacagtaaccaaaacagcatgatactggtacaaaaacaggcacatagaccaatggaacaaagtggagagccaggaattaggctacacacctataaccatctgatcttcaataaagctcacaaaaacaagcaatgaagactcccttttcaatcagtggtgctgggataactggctatccatatgcagaagattgaagctggaccccttccttacaccatatacaaaagttaactcaagatggattaaaaacttaaatgtaaaacacaaaactataaaaatcctggaagacaaactaggcaatgccatcctggacaaaggaactggcaaagatttcatgacaaagacaccaaaagcaattgcaacaaaagcaaaaattgacaagttggatctaattaaagagcttctgcacaacaaagaaactatcaacagaaactatcaactatcctgtagaatgggagaaaatatttgcaaactatgcgtctatcaaagatctaatatccagcatatatatggaacttaaattttcaagaaagaaacaagcaacctcattaaaaagtgggcaaaggacatgaacagaaactttcaaaaaaagacatacatgtggccaagaagcatatgaaacaaagctcagtatcgttgattgtagagaaatgcaaatcaaaaccacattgagataccatctcatgccagtcagaatggatattattaaaaagtaaaaaaataacagatgctggtgaggttgtggagaaaagggagcactcatacactgttggtgggagtgtaaattagttcacccattgtggaaagcagtatggcaattcctcaaagagccaaaagcagaactaccattcaacccagcattcccattacttggaatatacccagaggagtataaatcattctaccataaagacacgtgcacacaaatgtccactgcagcactgttcacaatagcaaaaacatggaatcaacccaaatgcccatcagtgacagatcagataaagaaaatgtggtatgcataaaccatggaatactatgtagccataaaaaatgagatcatatattttgtgggaatatggatagggctagagactattatccttagcaaaccaatgcaggtacagaaaaccaaatactgcatgttctcacttacaagtggtagctaaatgatgagaactaaagaacacaaagaaggatacaacagacacgggggtctacttgagtgtggagaatgggaagcgggagagacagctattggatactgggtttaatacctgggtgatgaaaaaatctgtatgacaaatccctgtgacctaagtttacctatgtaataaatcttcacatatacttctgaacctaaaattaaagttttttaaaatcaatatttattgtggaggggttttcaactttattaattttttcctttatgattgagatcttaatgacatgcttttttaaggtcataacagatgctctcttgtatttttgaaaagctataaagttttgcttttaatatttaggtctttaattagctgaaattgatttttatgtttgatataggatataaatccatactgtagtttttcttttttattgtttgttcctgtgccatttattgcagtctccctttcaccacagatttttctaaagtactttattgagatacaattggcatagaaaaactgtacacaataaatatccacaatttgataaattaggaaataattatacatctatgaaaccatcagcacaatcaagactataaatatatccatccaacaccttaagttatttaattaattttcttaaaacttaatataagacctaacttgttagcaaattttaaaaatatacaatacagtattgttaactataagtactatcctgtatagtagatcatcagagcttaatcattttgcataactgaagctttgtaccctttgagtaacccttccccttttctttctccctatcccagcacctggtaaccacctttctattctctgcatgtatgaatttgattattttagatttcttataaatgtgggataatacaatatttgttcttctggtcaggcttatttcacttagcatcatgttctccaggtctatctatgttgttgcaaatggcagaatttccatcctttttaatgctgaacaatatttaattgtatgtatatactacagtttctttatctgtcatctgtcaacaaacactaaggttgcttccatgtcttgtctattgagaataatgctataaggaacatagaagtctagatatcactttgagatcctgagtttagtttcttttgatctgtatatacctaaaagtgggattgctggaacagatggtagttctatttttaattttttgagaagacaccgtactgtttttcataatggcagcaccaatttgcattcccataaacagtatacaagagttttttagagaaatgtctattcagtctctttgcccagttttaattgggttgtttacctgatatatagttgtttgatttccttttatgttttggatatttaccccttgtccaatgtatgatttgcaaatattttctctcattttgtaccattttcttttgttgattgttgcctttgctgtttgatgtaatttcaactttttagtttgatgtaatttcagttgtcaatgtttgcttttgttgcctgtgcttttggtagtatgttcaagaaatcattgtgtactatgcagccataaaaaatgatgagttcatgtcctttgtagggacatggatgaaattggaaatcatcattctcagtaaactatcgcgaggacaaaaaaccaaacactgcatgttctcactcataggtgggaattgaacaatgagaacacatggacacaggaaggggaacatcacactctggggactgttgtggggttgggggaggggggagggatagcattaggagatatacctaatgctaaatgatgagttaatgggtgcagcacaccagcatggcacatgtatacatatgtaactaacctgcacattgtgcacatgtaccctaaaacttaaagtataataataataaaaaagaaaaaaaaagaaatccattgtgaagttctctgttgataagcatttcttctgtttccttataagagtttgatggtttcaggttttacatgtaagtctttaatccactttgaattgatttctgtgtatggtataagggtctaatttcattctttttcatgtgaatatgcagttttcccaacaccatttaatgaagagactatcccttccccattgtgttcttggcatccttgttgaagatcagttaactctacatgcatgggtttatttctgggttctttaccccgttacatttatctatatatcttttttcatgccagtaccaaactattttgattattatagccttgtaatatattttgaaatcaggggtatgatacctccagccttttttcttcttggtcagaatcgttttgactatttgggttatttggtggttccatatgaattttaggagttttttctttctatttatgtaaaaaaaggcactgagattttgacaggatttgcaatgaatctgtagatcacttttagtagcatggacattttaaccatattaatttttccaatccatgaatatgggatgtcatattatttatttgtgtttaatttcttttgtcaatgttttatagtttttaatgttcaagtctttattctctttggttaagtttatttataagtattttatttcttttgatgccattgtaagaatgttttctttaatttctttttcagatagttcattgctagtgtatagcaatgcaacagatttttgtatgttgattttgtatcctgcaacactgttgaatttatttgttctaacagatttttgtgtttgtgtgtgtgtatgtgtggagcctttagtattttatctacataatatatcatcagcaaacagagattactttttctttctgatttagataccttttctttttcttgcctaattgctctggaccttacttccaatactgtcttgaatagaaatggtgagagtggacatcccttccttgttctggaacatagaaggaatacttacagctttttatcattgcatatggtattagctgtgggctattcacatatgatctctgttgtgttaattttctcctatacctagttgttcagtattttttatcatgaaagggtgttgaactttgccagatgtttttctgcatctattgatgataacataatttttatccttcattctgttaatgtagtgtatcacatttattgatttgtatatgttgaaccatccttgtatctcagagataaagcctacttgatcatggggtgtggtccttttaatgtgttgttgaacttggcttggtagaccaatggaacagaacagaggcctcagaaataataccacacgtctacaaccatctgatctttgacaaacctgacagaaacaagcaatgaggaaaggattccctatgtaataaatggtgttggggaaactggctagccatatgcagaaaactgaaactggaccccttccttacaccttatgcaaaaattaactcaagaaggattaaatatttaaagtaagacctataaccataaaatccctagaagaaaacctaggcaataccattcaggacataggcatgggcaacgagttcatgactaaaacaccaaaagcaattgcaacaaaagccaaaattgactaatgggatctaattaaaccaaagagcttctgcacagcaaaagaaactatcaccagagtgaacaggcagcctacagaatgggagaaaatttttgcaatctatccatctgacaaagggctaatatccagaatctacaaggaatttaaacaaatttacaagaaaaaatcaaacaaccccatcaaaaagtgggcaaaggatatgaacagacacttctcacagaagatgtttctgtggccaacaaaaatatgaaaaaaagctcatcatcactggtgattagagaaatgcaaatcaaaaccacaatgagacaccatctcacaccagttagaatgatgatcattaaaaagtcaggaaacaacagatgctggagaggatgtggagaaataggaatgcttttgcattgttggtgggagtgtaaattagttcaaccattgtgaaagacagtgtggcaattcctcaaggatctaaatctagaaataccatttgacctagcaatcccattactgggtatataacctcaaaagtataaatcatactactataaagacacatgcacacatgtgtttattgcagcattattcacaatagcaaaggcttggaaccaacccaaattcccattatgttagactggacaaagaagatgtggcacatatacaccatggaatattatgcagccataataaagaatgagttcatgccctttgcaggtacatggatgaagctggaaaccatcattcttagcaaactaacacaagaacagaaaaccaaacaccgcatgttctcactcataagtgggagttgaacaatgagaacatatgggcacagggaggggaacatcacacaccagggcctgtcatggggtgacgggtaaggtgaagaatagcgttaggagaaatacctaatacagatgacaggttgatggatgcagcaaactaccatggcacatgtatacctatgttacaaacctgcacattctgtacatgtatcccagaacttaaagtataataataaaaaaataaatttttgaatagtaatatatgtaatactctctaatgaatatattctcaacttcgttgccctgtctttacttcatcctctatccacagacaaaactctaatacagtatcaactaatttctaagctttttttgaacactctgctgtagaaaaacatacgaatatactgatcagtctcacttcagatgcatgctcaccaatctcatactgtttcagcttcttcattcctgtagttcagcaagtgggagggagtggcatccagtggcttttttgctcccgttgttcggtgagcaggaaggaatggtgtgcaatgacttttttgctcccattgttcagcaagtggaatgaagtgttacagctcttttgttcctaccatctgcagcttggtgaatgggagggttacaggtcttttgtttccaccacccacagcttagtgagttctgagttcttttctcgtgaccatgaggaataaggtacgtggacaccggagagtgagtaaggcagaaaataattttgttgagcaacagaaggaaagctctcaagctctcagtggagagagggaccctgaaagtgggtagccctctgtgaggctgagtctggggtttttatgggcttaaaatgggggcaggctggtacttgctaattggtccataggtggtcttggaaaaagcagcattcaattagttaaaaggcatcatacaccaggaaccaatcgagagagtgggtgggttggcgatagaagttctcactctggttgtggactctatccagaactggcagttcaatttttcaggctttaggctgtctttggcttgaaggttggctttcaccggggacctgtccctgtccacctaggaatttgtctgtctcctgtcactacaaatactatatttcctcagtctatttactttccctctttttaatgactattttagatcttttctctgcccgcacatttcccaacccctcatcctccattctctttctcagctgatggcctttctgattttattgagaaaatggaagcaatataaagggagcttccaaatgatcccgccaccacatgtccctccctgctctctgttcagtatgatctcctccctgcatgttgtgtatattcagtctttatgtttttttcacaagatctcatcaccttttacctacctcagggaatagttccaaattcctcctccctctcctctctttgcaatttttccttttctaataatttttttccaattggcataaaatgtgttatttccccaatctaaaactgaagttttcttatgtgtcttgatcatacttattcttcatgctaatttttcatttctctgtatttatcaataaagcaataaattatttgaattgatttatagtcaatcatgttgtaatttctttataccataatagagtagttcattaatgcagcataaaaatttattttcaagttatgtacatttatggataaactagagacatgttttaaattttaaagttttatatcctgtaccctacttagctaagaagttcagagcatatttcagcattaagttacatgtttaagtgccaggtaaattttccattcataaccaaacacaccatcatgatttttgaaattctgaggagaaatatatctcctagttaagtggaaaattgtgcagttggtttctggagtactttcattctaagcagctttaaaaggaaacattttgtgtagaagtctaaattttctttctttatagtagtgcacattcattcattggtattcttattagacacttgaattgattaatactcctactaattttgttctagatctcagctttgtatttttagcctgattgacattaggattgatcattaccatacacaagatacttcatactgatctagtattttcaactctattaaatataagaagagagaaaatcatgcttgaatgcctggccaagaatgtggttgggcatatttgtggcagatgctggagtccatatagacagaaaaatgtctgtaggtctggggcattacagcctttactcaggactgtccagggtctgaagtctcccagttcctacctccaaaagggcatttatttcctggcttattaatgcttagttgcagtcttgaaaaaagaaagatgcttgagcagacaaatttgtggaaatagttttgaagtgcttgcttttccttcgtgatatttttttcttcattctaaatagatattctctttctcaagactgcagccctactttttgttgtgggaagtcagggaccccaaatggagggaccggctgaagccatggcagaagaatatggattgtgaagatttaatggacatttattagttccccaaattaatacttttgtaatttcttatgcctgtctttactgcaatctctaaacataaattgtaaagatttcatggacacttatcacttccccagtcaatacccttgtgatttcctatgcttgtctttgctttaatctcttaatcctgtcagctgagaaggatgtgtatcatctcaggaccctgtaataattgcgttaactacacaaattgtacagcatgtgtgtttgagcaatatgaaatgtgggcaccctgaaaaaagaacagaataacagcaattgttcagggaatacgagagataaccttaaactctgaccgctagttagccgggcagaacagagccatatttctcttctttcaaaagcaaatgggagaaatatcactgaattctttttctcagcatggaaagtccctgagaaagagaatgcgcacctaggggtaggtctctgaactggccctcctggggcgtacctgtctcttatggttgagattgcagaggtgaaataaactccagtctcccatagcgctcccaggcttattaggaagaggaaattcccacctaataaattttggtcagactggttgatctcaccctgtctcctgataagatgttatcaatgacagtggtgcccaaaacttcattagcaattttaatttcgccttggtcctgtggtcctgtgatctcgccctgcctccacttgccttgtgatattctattacgctgttaagtacttgatgtctgtcacccacacctattcgtatactccctccccttttgaaactccctaataaaaacttgctggtttttgtggctcatggggcatcacggatcctaccaacgtgtgatgtctcccccagacacccagctttaaaatttctctcttttgtactctgtccctttatttctcaagccagccgacgcttaggaaaatagaaaagaacctaagtgattatcggggcaggtcccctgataacttttgaatctcactcagctgcatttgtccaaggtgatcactactcagtcttttaaacattgtatttacttgatgtctatagcactaaattctgggtttctttttctctcctgagtagccatttctcagtctcctttgccagtttctcttcaggctctgattatttaacattggtctgcctcagggctaatctcttggacctcttgtctatctacgaagacaatttcctgccttcctggctttcaatcctatgtaatttctgataacttacaaattgttatctactacgcatgctcctgagcttgacttaacatctggctattcaataaatttctctaacttaatatctttaaaattaagctcctaattatttccccaagttccatcgcagtcaaacctattctccatttaagttaatggtgatttttgcttggtcttaggaaaaaattaaaaaaaaaaataaaactttgcctttctttcttaaaaaggctgcattcttttatagctaatcctgtttgctgtaccttcaaaatacattccctgtatttgaccacttcctgtggccttcactgctgttaccctggcctccattacctccttgcctgtattactggcacaggctttacgagaatcacagttaaggcttgcttttgctttgaggtttctgtacttgtcctctctgcctggaatatttttttctggtaaactccatggcttattctcttactagctcaattctctaaatgtttcttctgaaagctggaagcatactcctacctaacagtatctccctcctcttcactggtttattcttctccaaaagactgatgttcattcagtagagtattacttgcaagaggacagaaatttttatttttttattgtatctctagggcctagaacactggcacattgaattttcctctgcaattttttggcagtcagatgaaaattggaactatgacctactgcataattctcattatcagatataaggatacctataaattcttatacaaaatattgccttacactaaattatacaataaatatataggttgaatcttataaagtatacaagtaagcatacgaataatgccttaatagttttaaaaataaattcagttaatgtaatttaatctgtatgttctatattaataatttttaatggttaagggtataatatgaaaggtatgtatccaaaagacagaagtaatctatatttatttaaaataattggaaataatttttataaaagtagcagtttaatgttattagcaatacatcaccttcatgtaatatgcatagccactcatgacttatgacatttaaatgtttcaccttggttccagcattatgtatggacaaaattaaaaatatcttttcccagaattccttgtatcattgtgaataaaggtcatatctgtaaaatgatgtttatcatagaatcattttaaaattactaaaagtagaagtgaacacaatggaaaaacaaataaatacattatatgagaaatattatttagctatcaaacttcatgttttcaaagaattttgagtttgtgaaagttacaaagttttatgaaaatgtctatctttacagctacagaattctaactggaataaaatgcaccaaaatgttaactgtatttccttctagttataaaattatagataatttttattttattcacttacttttgtatagtttccagaatgtctataatgttttaactttgtaatagcatcagaaataataaataaaatttttaaggaattagtacttcttccataactatgttttgctttttgttgattgaggacaaagatttgtattttgttatacttaaatataccactagtatttaacaataatcatttttaatatcagtgtacaatatattgtaacctaaattttgctttttagacagtttttaaagtacatatcaggattgtactttttttcctccctacagacagccttttgattgattatcaatttaccttcagcttattacaggaagatgatcgccaccatactgccataaactttatagcaaacccagaacaggtgaggaaaaattgttatcttttaaagtataattattggacacaatttttttttcatatttcatttgattttacctcttctcagaattatcacattgtagggcctttgtagaaactactaatcctattaattttttctctcttcgtgattcaataatttgtgaatttgatatttcagattttgcaaatagccctatattttaaattaaatataatttgtcaccttatatatcttgtgacaaaatttatgcctataattatacaagcacggactgttcttatttaaaaataaaactcgttcgggcgcagtggctcatgcctgtaatcccagcactttgggaggccaaggcgggcagatcatgatgcccagagatcgagaccatcctggccaatgtggtgaatccccatctctactaaaaatacaaaaattagctaggcatgatggtgcgcgcctatagtcccagctactgaggaggctgaggcaggagatttgcttgaacccaggaggtggaggttgcagtgagccgagatcacgccactgcactccagcctggcgacagagtgagactccatctcaaaaaataaataaataaataaaactaatgaattcaaagcatactatattaaatgtattttactttcctttataccattccacagtaatatgatttgtcttttttctcagtcagtagtttatctgagttatatgaatgatggctcctttaatgaaattaccacatcactgatatattgtataagcttttgaagtttaaatatatgaaagattcattgtgaattttaatttcaatccatcaattcaggtaaagactcttaggttgtgtcgaaataacacacatattttgctatccatctgagactttattaatttgaaaatcctgagaatggaaatatcaaccatagggtttattcgggttgaattttagttcttttaaaactaacactcatacatttgaaatgaagttatgttaaatatatatattattattatgaattcatccatattgttaaatgatatgttaaatccatatcatatatttaatggtttttcaagtaggtgaaatgtctaaatatattaatactatgacattttgcaacttctttccttttaacgtagttcactggacttgctgacaactaatataatttcttaaatttttcttttccagtaaaatagcattctgtctcccccatcaccaaaaaaaagaacagttcattttacattttatgttactctttattccctagactttatgaatgactgtattcttggggaatacatttaaagttttgacttttaaataatgattttaaagatattttgtttcaaatacaagccgtccttcactgattatctgtttctacatagatatattaacaatctcagaaactacatttatcaatgtgataaagtttttatacctgcattataattaccattgactttttattgtagtaaaatagacataaaataacatttatttaaataattttaggtatgtaattcaatggcattaagtatatttacagtgtggtgcaatcatcaccatcatccacattttcattatccctaacagaaactctgtgattattaaacaataatgcctcattccacacttctctgcagcccctggtatctttattctactctctgcctgtattaattggcttactctaggtacctcatataaatgtaatcatttgtccttttttatctggcttatttcatttagcatagtgtttccaaggttcatccatgttgtagcatgtatcggaggtcattctttacctttagcttcttgattaatagtaattccaaacctgtggggttctttgaagatctaagaaatttgatgtaagagagatatctgactcaaaatgtgagagtgaataatattcctccacagtattgtccatagtgtcatatacttatgtccagattagccacaattctagtttgcttgtctttttgccattttctccttcaatttccagcaatcccaagtgctttccaatgtcccagctttgttttactttctactatcttgtccagttgaagccaagaaaccagaaaagtgttctgtgaagcttaacgatgcataactgtcatgagaggcatcgctaagaattcttataatatcattttgtgtaaccctctttaattaaagatatattcacctgggaataatctctgaaattattatgtattattggccaaggcttcttattctataagaaaataataataaaaagtagataattatttatacatttcctacattttgaaaaacagatttaattttaactcgctatccatcacttctagccagtgctttcatgtgaacaatttctgaataggtttctgtataacattattttgccaaacttatccatatctaacaaacaatgttctaaatcactgattttatcacttactggaataactacagtgtcactttttcagtacagctttttaaatcctaaatgctttttatatggctttagttatggtaccatataattcagcattgcctaaacttggaattgatagagaatgaactaaaaattcaaaaagagttttataggttttttaaatatcaattggaaattttgtgtgaccttttagcgacaacagttatgctcatattaatctcatccagcataaggtacatgtaattaagagacaatttcaaaagaaaataaagatttaagcctccttaagggtacgctgatttcaccatcctttactttcataaaaaagtgactttttggatccgtttcattaatagtaaaaaaatccactcctcagagcatgtcctttttttgagttcccagtcctctgggtgaagatgaagatgaagaaagagaagaaaaagaatataccctgtcactatacctaataacgataacactacaattataagcactatgggctgaaaccaaagttttttttccagaaattatttcatttaacgctcacaagagcttcttgagggaagtaattacatccccattttagagattagaaaaatgatttttggaaaggaaaagtaatttccccctaatcaatcagtctgtacattaaagacctgaaatttcaatctaaggttatctgactcttcactaattcttttcattgcttcatgaaaatgatttactgtatatgaaactgttattggattcaagtctggttactttattatgatgacataaatcaacatttgctaccagatatctacctttgatatctggattttccttaggactacattgtgtatatttggaagtatattttgtataccacaactgaacaacataatctattgaatagtccctgtctgcatgctgacataaaagtattctgcatttattgctacagtcaaagagttgctcagttatttttctggccttccattgaatttatgcccactctgtgttcacttatatcttaaaagaaataggaaaatctcaatatgtttgacagttttgtggcatgtactgcagaagggttcttaacagcttgtcaatagaattcagtattaattgataatcaatagaaaataagaaggaagttaacttccttcttatattcatgggcatttatgaatatcactatgatgcataatataatagccttctgatttactctatgtatttaaaatccaaggttttatttttctttgactacttcaaattctcagatgctttctccacaatattactatgtactactctaaaaatatgcatgacaatcactcaaccttattataacaaattttattttacatgctctttcaagatgatcattctttttgaaatcttatttgcctcctggaaactgtgacaatatcatttgatggatatggaacactgttaagagttcttcatagagaataagctgttcttccatgtagggaaatcattaagagtagatgttatttggaggtataagattggggcttatacgtctgtcaaatggtatggccatcacacatcatccagcagcctttgctttttatgatgttccttatttctcctgctattcatcagggaaaggccattttccttgtcagttttcccctaagactgttatatcagaaaaggggaatttagttgcttccatatttactttctcctaagagccacttagaaaattgggaatatattttctattggcttacctgctttatcatatttagaaaaatagtaaaacgaaggaattaatatattctctatctctcttactccgtttcactagctagatcttagcagtatagaattttctacaagtctttgtagagaatatttaaaataaagcataatacactcagtatctgaagctaaacttacccattatgactatcattctttgcctttccacaggaacaaatagttgtaaatatacctactttctgcttcttacgtcttggagtaagaaaatcacaaaaaacatttaaagaaatctcttagtcatatttccctgaaattaaatgtaaagagtctgtactccactaatgaatgacaagaagcgggttgaatggcataaaattaaattctcagtgttcctctctataactgtgtaaacaatgtgatctgctgtttttttggagtaggttcatcatttttacctgaaagttttaggttatgttatttttcccactagaaaatatgggtttaataataaaaatgtacacctaagaagaagtcttttaaaaaaataatcttatattgttataaaattgcttgggactaatccaaacctgtttcatttaaacctagcaaaaagaatcaaaatacaaatatcaaatttaaactaagtttagtctacagctaagcaaagagaatccaaataaaaatattaaattacaggagcctctggcttacatacaaaagaccaaattataatagagaagataaatgaggaacttgatatctacctttgaatttattacacattttcttcattaaaatgtataaatggcatctacatatattcagttgaatatttacaaaatctatagagtttaaggaataaaacagacataattaaatcagtagactaaatcatatatatctagtgtaattttcgttttttaaccttaatattttcttttctggtagtcgaacaaaaatctggatatatcaattaatgcatcaaacaactttaatctcaacattacgtggtctgtcggttcaacaggtaaaaaaatgttgatgtcatatctcttttacatgtgttcctatctggaagttgttctaacatgatctactgttaattaaatgtttgaaattttaaaaatgttatatgacaggattattttgctgttactggtaaaaataataagtagaaaaatgaatagagcttcattattttgttaactttctcctttattcaattaaaattagattggtaacaaatattatacactaaattaaatttttaagtggcagtgttataaaatgtgattttaattaagataaattgcttctttaatgactaaagagactgaaatttcaattatttgattcactattaaaactataaatttaattattaaccttaatatttatataaaacaatgaaattcttctgtacatgctgattacagtaaacatctattattgtcaagcttagaaaatataacccctcttgtcagcttcagtgctcagaggagttaaaaaactgatacataatatgtctttcataataaggttaataaatttaaattactgacttaaaaagtatatctgagaagctgttcagatttttatgttgaattatgaaatgtattcttactttaattttagttttacttttattctaaaaattttattggtatctattttctgtatcaaaggtatactgttgcataaatgtgctggaaattgtttcttttttatagaaaatttatggattcttagaaatttatatttgatttctgaaaattaaatcattatgctattttaatatgtagaatattatggatacatagaattcaagaattaagagctcttttgcaattcccaaatttatatattacattcaaaaaatgaaaattcaggcaaataggcattttgttactattagtgccaaacatacagtaaaatgttggcactatgggtttcattaaggaaaaattcgtaataacttgtactgttaatttgatagttatttctgaccagtaagaaaactgtaagggtttaaaaatgtgtctacaaaaatgtctataatacatttctaatcactttagaacaataattttagtatgcaagacatcacgtgttctttcagattcccagaccaaatctcagaaatttttatttatcagatttggagatgaagtcatggaatctgcatttaataaatgtacacaaggtgattatggaataagtggttagttaaaaattcaattacgcagtatactaattctaattatttttactattgattaaggtgaaagtattgctaagattgttggaaatgctttgttctattttattaacttcagtaaatatttattcagcactctatgtgtttaaccaattgagcatttagctcatgttttaaattgtggcctccacccaatttatttaaagcagtgatggttcaatttgtggtaagacaaataaattgattttttcccattttttaattggattgagacacacgaaaatatggtctgatttctttttaaatgctctgtggcattgtaaacagaatgagctcagtttctagagccacatatacctgagttccaactgcttagtagctataaacttggggcaaatgctttaatctttctgaggcttaggttgaaatctgaaaaatggaggtgataatacttctgggatattattggttttaaaaaagaatataaagtctctaagctagtgcctagtacatagcacttaatcagtggtagcatttttaaaaataatttttatactaaatttatttccattatatttatggcaaacttattttccttcattcaaaattataaacagtatattttgataattatttttataagagcaattataaaaaactataatatgcatttttaaattcataaagatatttcctaatattaattatttaaattatttacattttagctggaacaatatctggggaagagacttctatagtttccaagaataatataaaggaatacagagatagtttttcctatgaaaaatttaactttagaagcaatcctaacattacattctatgtgtacgtcagcaacttttcctggcctattaaaatacaggtaagtgttaagagtatttacttctaatgaccataatatcattaagaaaagaatggtgcttttgtccaaagtgatgatatatgtacatttcctgacttgactaatacaaaaacatgcattgacctttgataaataaaggtctgcgaatgtctgtgatgatgaatttctctgtaaaaaccctcatggaaccaacaaactctatacttaaatttttcagtgattattatgtactaagcaatgtagccaactgaaatgttttggttttctgattaattatatactttaactgagggttaaataaatactgttctcatataaccccacttgaaattattttccgtttgagtagtcttatttttactttagcacattctgaaaataatctgatctttcattaaagattttgagttagcagtatttcagttacctctttaagtaattacctctcatcattaatttcctaatctgtactacatgtgtgttttacatttcatttttgttatagttagaggtagtctacttaagacgtcagatttacttctaggaaagaattggaatattctttctatcttatagtcaaggtttgtgttcttaatttatgttttcctgaaagaaaagcctatctattgggatgctgggatttgttcattcctttacaactgattgattagattgaatttacattagttattcgaatagcttatatatatcaatccttgttcatggcttttatgttttaaaatcttttaaagattttcagatcatcccttccctatatattagtaaattatagcatatgctctgtaactagaaatgtttgcaggttttatttatattaatttctatgtgatttgtggaaagaatgagtgatttttaaaatcatatgtttactggaaaaaatttttcttcttatttttaaggttgatgtaacacttaaattatggaaattattcaactgttcaggaaatatgaggataaattactattcagttcacttttgagaattaatttgagaaatttacttcttcattgtatagtgattgatttagatgctggtactgtcagaaaaatgccataaatatttgtttttaaaattttaacattaaggatgtgtaactttatttcctaagattcatagagaaatatttatcaaatttcacttcatttattcaattatgattgaaagggaaaagggttcatctatagcacttagtaattagttattaaaattgatatgattatattttaaattgcttcctatccttatttcttgtttatatacttttgaaaaaaaattacatagttattttagaatgtttttgaatacttaatggttaggaattaactttctaaattgggtttttttgagaacttactcttttggaagcaaaatcaaaatttgtgtaacgaggttgaaatactccactctcaaaataatacagtgtggaaaataattgagatggacaagatacgtaggcctaatttctcctctttattaaactcattatgcctatggaatatgttatattaaagcatggaagtattaatatatgtgtttatttataagactagaataaactttaaattataatattatacaaaacacagtaaaattattttaattatgattttaaatactggcagccatcattgtattccctttcaataagttcataagttttttagattccacctataagtgatatcatgcaatatttgtctttttgtgactgacttgtttatttagcatcatgtccttcagtttcttctatgttgtcacaaatagcaagatttcctgctttttaaaggcttaataatattccattgttatgtgtgtgtatgtacgtatataaatatatacatattatgaatatgaaacatatagatataaatcacgatttctttatgctttcatctatccatggacacagcttgcttctgtatcttggctattggaaataacgttgtaaagaatgtgagagtgcagctgtatctctgagatactgatttcacttgctttgaatatatccccagtggtgggattgctggatcattggtagttttatttttaatttttgggggaatcttcatacggctttacatgatggctataccagtttacattccaccaattgtgtgtaagaatttcccttgctccacatccattctaacacttgttatcttttgtatttttgataatggccatcataacagctatgaggtgatatcttattgtggttttgatttgcatttatttgatgattagcaatgctgagcaccatttcatatacctattggtcatttgtgtgtcttctgtggagaaatgtataatcaggtcctttgcccattgtttccattgagtttttgttttcttgctattgcgtttcatgagttccttacatattttggatattaacttcttattgaatagatcatttgcaaatttattttctattctgtaggttgccttttcagtttgttgattgtttcctttgctgtgccaggaagctttttttagtttgatgcagtcccacttgtttatttttgcttttgttgcctgaacttttggtattatatccaaaaaaatcattgataaagccaatgtcaaggagcttagtccctttattctgtttaggatttttataattacaggtcttatatttacatctttaatccattttgagttgatttttgtgtatggtataaagtaagaatccaatttcatcttctgcatattgatatcccagtgttaccaataccatttattgaagagactgtgtttcctttactatttattcctggcactgagtcaaagatcagttgacgctgtctatgggtttatttctagcctctctattctgctccattggtattagtgtatttttatgccagcaacttcctgttttgattactatagattcataatatagtttgaaatcagtaagtatgatgcctccagctttgttcttcttttataaaatttctttgactatttgcagtcttttgtggttccttttgaatttaaaaatttttttttctatatctgtgaaaaatgtaattggaattttgaaagcaattgtattgactctgtagaacactttgggtagtgtggccatttaaacaatgttaattcttccaatcaatgaacataggatattttccatttattattgatgttttgaatttctttcatcaatgctttataattttcagtgtacaggcctttcatttccttggttaaacttattcttaagtattttattctttttgatgctccagtaaatatgatttgtttacttaacttctgatttggagagttcattgttaatgtatagaattcaactgatttttgtatgttggttttgtatcctgcaacttgactgagttttttattctttttaacagtttattggtggactgtctagggtttcttgtgtatgagaacatgtcatctgcaaacagagacaggttttcttcttcttttccaatttggatgccttttacttttccttgtctaattgctttttctaggactaccagtcctatgttgaatagaagtagtgaaactgggcatttttgtttctttgctaaaattagaggaaaaaccttctgcatcttgccattgtgtaggatgttagctattggcttgttgtatgtgttctttattgtgttgaggtacattccgcttaaacctaatttgttggaagtttttatcatgaaacagtgttaataaactttgtcaaatgctttttcagcatctattgagatgatcatataatttttgtccttcattctgttaatgtggtatatcacattttgattcatgtatgttgaaccatccatgcattcctgggataaatcccacttgatcatgttttatgatacttataatgtgctgttgaatcaaatgtggttggctagcattttgttgaggatatttgcatttacatttatcaaggatgttggcctgtaatttttcttttttttccttatgttccctatggtaagctgtggtacaatagtattcatttttatttatttgttttccctcttactgttgctattatatttattttttaaagaacagaatacagcattattaactatagtcaccatgttgtacaatagaaattttcaacttagtccatctatttaactaaaattttgtgtccttttaccaatgtctctgaaatgccattgattttcttttcttgtagtctccttgcctgacttgggtgtcagggaaatgcttgccttacagcataagttcggaagtgttcactctacttcatctttttggaagagtttgagatggcttggtgttaatgctttaaatgtttgttagaattcaccagtgaagtcatcgattcctgagcttttctttgttggaaagctttttataattgattcaatcaccttagttatttttgatgtgaccaagttttctattttcacatgattcagtcttggaaagatgtatttttctaggaatttattcattcttttctaagttatttaatttgttggcatacaattccccacagtcatttcttatgaccttttggtatctatgatgtcagttgtaatgtctccttatacatttataatttgtttaagtcatgtctcttttttcttggttagtcctgtgcaaggtttgtcaatttttaaaattgttttaaaaaccaactgtttatcttttctattgtttttctattctgtatttcatttatttccaccatgatctttattatttccttccatctgctaactttgggcttcacagtttaacaattctattgccatttattgtaaggtagacctagtagtcatgaagttcttcagcttttgtttgtcagcttttatgtctccttcatttctgaagggcaacattgccaggtaaggtattcttggttggtagtacttttcttttagcactttaaatatatcatctcactcctcacctgtgaggtttctgctgagaaatctgttgatatccttagaagtattctcttatatgtgatgggtcacttttatcttcttctgcaattttctttttgagtttttacgattggattatgatgtgtcctagtgaagtcctttttagattgaatctgtttggtgatgttcagcttcatggatctagacatctgaatctctcataagatttgggaagttttgagccattattttcaagttaatagatgcctcgagtttagggactgttgtgggtgaaatagagcagggatggaagggagatatagaggtttttaaagagtatcaccagggatcttggtggtgttaggactcttcactgtcttgagtctggtggtggatgaatacatttttaaagcatccactaagtaaaatcaagtgttatataaacacaaagtaattatggatagttttcagcaaattttgacaaacaatgaaatttaaatttggtgatacaaacaagaatttctaaaatagccctttttgaataattacaaagtaaacagttcttcaataccctgctatcaaagtatggactgactaaccaaaggcattgacatcacccaggagcgtgtcagaaatgtagaattttagccctgtcgccactgaatgagatcctgctttttacccaaatccccctaggtgataatgtgcacagatgcttgcaagccattgtctaatagaaaaacaacaccaccaaaatcactccatttccttaatttgggaattgtctatagtattttcagttatgtctgtgaagatatgaaattgtttggaatttgaggattggcttaaattatggttcacagcataactcaatgaaatatttagtgttctttttccacttgcatctagattagtagagatatgatgtttttaatgtttttttcattttaatgaattttggagatgattgaaattagttaatatcatagtgaataatccttgtcttgttaaactactattttaattatgcatgaaatgctgctatcatttatatgcattatgtaatgtattttgataattaggcagctaatatgtagcaaaacacctttatacctatcagtttgtcagttatgatgtcagtaatgatgttctagttgttatcaatggaagtaatccagtgtcaatggattgcttcttaatcgttatagtatttaattctctgtggcatatctcacttatttctccatttggaataactgtttcttcaatttctgttgcatttgtctttcccatatttgtggtttcaatcaagttattcattcctctgagcttcaattacccaatctataaaatgaagattactagtggtacttaattatagggttatcatgatgattatgtgagatagttatgtgaaacaaaaccttacctattgcattgtaataattgttctaaattgtaaatagatgatcatcattttctttttcttcatcatcaccgtcaacgtcattggtatttaagagagctttttaatcttcttatcatttacctcacctttttaaaacctttggtgatttcccataatatttaagataaatttattcctttatcttttacttatctatattaggttgattacttctactacaagtcatacaaaaattataactgctcatcataacaaagacaaaatatttagtttaattcactcttgttttacatctttctatgttgagagtttaaatcgttgattttagaacttttcttttttctgatatatactctacagctataaattaacctgtatgcagtgctttgaccacattttacacattttggtatgttgtattttcatttttatttagtccaaaatatttcctgatttttcctgtgatattttctttgatgcataagttattccaaaatgttatttaattcatttcagggatatttcaggtgtctcctttttattaatttccaatttagttttcgctatggtcagagaaaaactatggttttaatcctttttaactttattaaggcttgtttttggcatattttttattttgcagaaaattcatgtgcttaaaaagcaaagtgccttctgctcttgttattcttttaatgtcagttggatatttatttgattcttattcaatgtctgagattattgctgattttctttctactttttctatcaattactgagaatattttggaaatttccagctatttttggtgttgtgtttctttttttaatattgtcagattttcttcttgttttttgaaattgtagtttttgtacatatacatttacataaaaggtccctttactgacccttttatttttatgaaatgttcttttttgtctttattaaatctgcatgccaaactactttcagctctccaaatatctatcctctgtcatttatttcattttgctgcttatttttacattctgtatttttatcttgcaaatgacctttctggccttaaccttttttttaactcttgcttagcttttgtctaattgtgaatataacctccccttatacctaactactagaaattactcttttcttacaactggcatattctttaacttatcacagtttatttatatttattgcttcacttatttatccattattagccctcaaactcctttacagagaaactacatatttttttgtatttttagtacttagctgaggtagctaaaggaatagtttttaaattgagagatgagtaatatatttctctggagaaaggaatgtacagataaaatatgctttcttatactcttaaaaaagttttaacatgcaatatagatagtttatgagtacaataaaagatttctcccttatatttacaaaaatcacatgggtttcttatttaataataacccaaattctttcttctcccaaaatgaaattttatagtaagttgttttgttaattaagattttgtgtaagaaacagaaatcgtgcatgactaacaaacagaagaaaatgtattgttagcataaggtgttgctaacaatatgaaagggaagaataaatcatcaggttttcaataagcagaaagctttcattccaacagttttcagtcatgtgcattagttgacattcttaactgggcatgcctgctatactgaatgaaatctcatgatttctccaacccatcctataaatattcactcaggatctaaaaatcttaagtgaatgagtccaactggcaaatttaggacacctgtctaacttcctcctgacccataatggtgcaagaaaaaaaattgtcctgggaagtagttttttggcttctctgctcgaagatatgggacttggattcacaaccccaataaggaaaaaaatatctgaagaaataattctttgtttggtcaggagatatttggtgatcaaaagtcaacaaatactcgttatcatggataaccttgatagaagcatattaatatctaataagactatccttctgaaatcagcatttccttattctaggaaaataatatgactataaaataatgtaattgttattaaagaaggcttcagttattgtgattcttaaaaatatttaattaatctgctgcaaagtgaattatatgtaacattttcatcaatgccaattctaatgtagatattcttatcttgcttccaggttacaattgcttgctttctcattgtcagtaagcagtaggtattaagaacacgggttctaagtcaaactactacctcaatttgaaattcttaaattacaagtgataggattgagaggaaggttttttgtttgttttttaagtcacagtctttccatttcttcctctgtcaaatgggagatgataatattgcctacctttattagtttttcttgctgtgtagcaaattatcacaagcttatcaggttaaaacaaggaccgtttattattttatactgtctgttggtcaggaatctgggcatgagttaactgccctttgttaaaccctgtactcagggcttcacaaggctgaagttatggtctgttgagctgccgtctcatctgaggcagaaggacttcttccaaggtcactagttgttggcagagttcagtatattgaagttgtaggtcttaggtttttctagttactgttagccaggggctcttcttagcctctagaagatggccgctgttccctgccacatggccctctctacaacatgacactgtgcttcttttaggccagttatacaatctcttttcctttaaatctctttcttcagtctgttataatggagactgataaaattcaataatcataggagtgactattctaccacctttggcatataatgtaacgtaatcaagggagtgaattttccattgtattcacagattccacctatacttaagggaaaggctttaacatatattgtattaaaatattagaaatgtgtatatgtttatcttttgaattagggtaaaaaaatggaaagttatttaaagtatatgaaaatagagtaaagatattgactgaaataatagtattatagttttgtcaaaatagttctttttatatcaaatatattttattacaatttatgttatcaaatatgttttcactcctactatctcctgtcctttcttctgtaaacccattagattttaattttacttttattaatttattctgtaaaacatttttatgtgaattacatgccaatcaagcaattattatggtataaagacttcatgtgggtaaagacagtgataataactgtttatttaaaaggcaggttttatcttttcagtctactagcatcattgttggcaaaattcactggttctattttcctttataattataaagatgtttgaggaatagatatctttgttaaggatttttggtatttacttgttaatactgtaccaaatttttgataactaattagaagttttttcttttactgttcctaaattatatgtgttgtaaaagtttcttgtagtaccatagtcttatatctatgaatggaattctagaaatcgagaaatgttttaaaatgtcaaatgcacaatatacttactagagtaggaaattttaagttggtggctatttgtacagaattaatcagacattaatttagccattgagatcctctgccatttaaacatattatttgattaatttatgtactttggaaagctgttttaatctaatgtaaatcaaacaaaagttttcttcattgtcttcaaactttaatagggtgttttatgttttaggttgccaatctctttagcatttaaatatccttaagatcctttagaaattctagtgactgtgagacatatagcagtgttatgtgataaatattccaataatatagtaattaaacagggaaaaaatctttttgttttgaaatgctgggaatcatgccattgagttcatttgcatgtttgtaatatgagattttattttggtagcacttgttcttcatgatttataatgtcatgcaattaaatcttgataataaaaaatagaaaaaagtactactgtagcggtagtgctaataacttcaaaaaaagtgtattgaacttaagtactttgtattctacaatagtgctgttcatcaacatttatatatcacagtttaaattaaattagattgactctcaattacctgtttctgagcaaactggctttgacaattcactattatatcaatctgcaaagtgatgtcataatttagattagattttttaatgagaatgatgctaggaattattcttcactttgcaattctaatttccattctatactggttaatttccttactagcattggttaagttatacagaacaaaatagaagaagaagtgaatcctagtgctgatgtctatacaattttatcacaaataaattagcattttcaacatagatgagtcatttgaacacacacacacacacacacacacacacaaaacagaaaactactggttaagtagatattaaagaggatgttttaacttatacatatgatttgaaaagtggctatcataaaaatgtgctgatggagttgcccttgtatatatatattttttaaattgacacagaacacttttcgttatttgtggttcttgtcttttaaattgttatatgcttgaagaagttatcatatatattttcaaatacacttttttcttttttaaaaaagtttcaattctttttgtcatttaaccaaccaaggtaacataaattcaaaaggtagtattagaaattgttaattttatcagttaaagatgtattaactatactaattagaaatataaatgtgaatgatataacaaatatgtaagaaacacatatagaggagaatggaagattttctaatagctataaaataatactggctatgataggtacaaatgttctcaaaattctcacaaggaagatatattacatttacactacattgacagaattgagtagtgaaaccagagaccatattgcccacaaagctgaaaatatttactgtctggttctttacagaaaaagttcgttgactttttatgcaaaatgctcttatctaatcccttatccagagctattctttacaaggaataaaattgtttgaattaggtgagatggtataaatgtaaaatctgcttttctaagaaaatttcttatgacaaacattttcaacttttccagtggtaaaataaatttgagtaaagaagatttttcatttctttatattataaatttttataaagtcattaattatattttgaaatctaatgaaactcttctaaaaattttaatgcggttttgttaaatattcataataatcccatagatatttttagatggttgcccttgtaatatagtattcttttataaactaccctggtttttatataacatattgtaaacaattttagttttaatataatattaattaatgtttttaatactataagaattttttcagatcatatacttccatagtctgttactggaaatttggagttatttttgttttaaaaaagagcaaggtgatgaatatctttgtgtgcattcatcttctattttagaaaattatttcttttgcacatatgtccccaaattaaattattgggttaaagtatataaacaaatttatgattgtatattatgcactaggcattattcaaggtattgtatatgatttagtgctgttattcctaacttataaaatatttttatctaaatttttataaatgaacaaaataacttgttgaatttcatacagtaggcaattgaattgagatatgagactggtcaatttgacaccagatcccattctaccactattaactcacacttctttattttactatcattttattagtattaatattaaggctgaacatttttctatttataaaatatttactgagaagaatttataaacaaacatatttataatcttatatttatatctcaggacagcttcctgaggatattttgttttagctctagacacgcttccattttaaacctaaactggaagtgtgtaaaagttagtcatttgaaaaaaatataactatacttgatttgtttgcaattacaattaagtattacctcttggggtttgttaagaacttctacttcagaaattgtttaaaaaatgacttaatttttggcaaaggtattaaagtatgagtactatattttgggtttgatttgtgagctactgatacctttaagaattcatcaatatccataatctcagaaggcagtatatttacaataatggatcaaatgaaatattaatatataatgacttagcatagcaaatatttcagaatctctcaatagataataaaggtatatgtgacttaagattatacttctacttggactcgtgtttcatattgttatataatgttactagaatcactaaataaatattgaattaatgcagaatagaggattacagcaattctttaaatattgccttacaaatgaatattcagcacgcagtgggttctatgtgtaaatctgtaggttgaaatttagaatttttactaatgtctttatttttgtaattgctctacaagagttgcttattcaaatggcaaagtaaacacttatgtaagataatgtaaattgtggtagtttcaaaatttccatgttcttttaacttttatgtaatttgacgagaataaaaatgcttcttttattaatatatttataatactgaatcatatgtttctccttattttgtactttgatgattggataaacaaatataataatttttaattaattatgtagtaatgaatttcttcattaataagcatttattgagttattcactttgagtagtctaataaattacagtaaaaacacatataaaaatagaattaataaagtttgaatcagtcccaagaattagagctttatttaagaatcattatttgttgcttcatataggaagctcagagaattgtaaagtagaatccaaaatttatacaaaagcggactttattctgtactgaatgttgttagtaactaaaatttaggcataaaagaagttagaggtgaaggtcttaaatattctttgttttagcatatacctagatattgaataattcgtttacatattctttgcttaggttcccagttctgtactaaccgtaaggtaagaaagagtaggggataatctgtttgctaatagaagagtatatattttatttgttaagtaaataaaatggtatgttttaacatttctggacagtttttgcttttcctaaaacattttggtcctatcaaattataaatgaaaattattatttgtaattattaatttaccaacccctgtgctaatggaaaaagaaacttattgcatgttgatctcctatggaaagacatctgctcttacaagtcagatatgaaattagttccatcatttatttcatatgccttcataaatcaacaatagtttatataatgaaagaagtcaccagaaacttgtattgcgtaaagaactgttctcaaactttcacgctgggaaaaaaattgtttagaaagagagggcatcttgactgaagctttaagcaaatttaggaaattataatgatgttgtctaataattactagagatatagcaaatatagattttcattgcttatattttatttaattctttcattccttcaactttcagcatacattttattggtcatttgtgcatatacaattttggcttattgccaaatatatttaatataatttgatgtaacaacaaaatataccacatgactatatgtacagacctaatttacaaattgtaactcagttatttctttagatttatcaattttattatacttaattttcataaaatctagatgttagaagaaatcgtgtaattatatgtatatgttgttttaattatttacacatggtactttaaagttaatgcaaatgtgattaaatgtgagtgttatgattccattttacttatgatttttaaagcattttatatgctaggtcaatgtttttgatagagtctacatgaaataaacttattgaaatattcattatttttgcacactctaagaaggaatcaatctcatatttgcccatgtttttagagtttgacatgcttttaggctaattgtttgtgagactgtaagaagcagagagagggccactactcaagtgaaatattcaggaagcatttgtaagaatttgtaagaatacagttgaataaacctacactaggtctctcaaaagcagagtgccttatactccctttcttgggataatggtaataattttgaaatgcaattgaagagactctgtttctgattatctttttttttttcagtaaatgtcaaatcttagatctttttcatatcttttaaaattctaaatctatatctcattgatattaggttatgaagtattctgcaaattaccaaatgctgttattaaatattatgttttttcattttgttttatcatattttgaataatcttccaattcactctctacttacagattatgctattttatattttaattttgagattttatctcaggtcttgtttgtgttcactcttttacagttaaaaaaaccaagaatcagtgtattaatatatatcaaatgcagtggcagaatatttaatttatcttaaataaattaaataggataaggtatcaagttacagtcttcatacttttattatatacagtatactttttaggactgtgtgtatttaaataagtcatacaatttttaagggtcatcttattttcccaatgagtgcttctttaacaccactcattgggcaaatgccttctttgaattcccatagcatcttagcttatatttattcttatagtatttgaacataaactctacacttaatatttgaatatataatatgtgaattgcctgtagttgtcttctgaggaatactacaaatttctctcagagttaaccatattttacagttcaaaaatctttccgtttttagactattcaaataatatgtttgttttagtgctttaaatttgctctatctatgctaattatgtgggggagactaagaagaaatgtaagatgtttattgacctaaagaatttaaattaggtaaaaatcaggagcatgcaatagggagaagattaattatgaaattgagagaaggagttggcaagaatcactatgtgagcgaaaatgagtgtaagctattaatgagccatcacttgatcatggtctgtttttttgtgtggtgttgctagtatttagtaggtgtgcattgatattaataagtgatattgataacttttttcctgtactgtctatgtcagatgtggcatttgtgttataatttcttcataaaaagaattaaaaagtgttccttcatttttattgttttataaaaatatatataacatttaaactacctggtctttgaaaccatagtagaatttccctatgaaacctctggtactggtattttttgtagagtaatttctttataacttcctctatttcatctacagaatcttttccatttaagctacttttttctaaatttatttatttctaattaacagataaaattgtatttataatgtaaacatgatgttttgaggtatatatacattttggaatggttaaatctagctaattaaaatatgcattacctcacatagttgtcatttctgtggtgcaaatgtttaacatccagtctctcaacattttttgagaatacaacatattatcattaaccttagtgaccattctatacaataaatctgttaagtgtattcttcctatgtgactaattttgtatcctttaaccagtgtccctccaaaccccctcctcaatcacccaacgtctttattttttttaagtttataaattattttattgtaagcattgctacaattatttgaatcttctagtgttacacattacaaatgaagatctttctttttttattatactttaatttctggggtacatgtgcagaatgtgcaggtttgttacataggtatacacgtgccatggtggtttgctgcacccatcaacctgttatctacattaggtatttctcgtaacgctatccctaccacagccccccaccccccaataggccctggtttgtgatccccgcccccactcctgtcaatgtgttctcactgttcaactcccacttatgagtgagaacatgcggtgcttggttttctgttcttgtgttgctttcctgagaatgatggtttccagcttcatccatgtccctgcaaaggacatgaactcatcattttttatggctgcatagtattcgatggtgtatatgtgccacattttctttgtccagtctatcattgatgagcatttgggttggttccaagtctttgctattgtgaacagtgccgcaataaacatctgtgtgcatgtgtctctataatagaatgatttataatcctttgggtatatacccagtaatgagattgctgggtcaaatagtatttctagttgcagttccttgaggaatcaccacactgtcttccacaatggttgaactaatttacactcccatcaacagtgtaaaaagtgtccctatttctccacatcctctccagcatctgtcgtttcctgactttttaatgatcaccattctaactgccatgagatggtatctcattgtggttttgatttgcatttctctaatcaccggtgatgatgagctttttttcatatttttgttggccacagaaatgtcttcttttgagaagtgtctgttcatatcctttgcccactttttgatggggttgtttttttcttgtaaatttgtttaaattccttgtagtctggatattagccctttgtcagatggatagagtgcaaaaattttctcccattctgtaggttgcctgttcactctgataatagtttcttttgctgtgcagaagctctttagtttagtttcccatttgtcagttttggcttttgttgcaattgctttttatgttttagtcatgagtctttgcccatgcctatgtcctgaatggtattgcccaggttttcttctagggtttttatggttttaggtcttacatttaagtctttaatctacctttagttaatttttgtataaggtgtaaggaagggatccagtttcagctttctgtatatggctagccagttttcccaataacatttattaaacagggaatccttcccccattgcttgttttttgtcaggtttgtcaaagatcagatggttgtagatgtgtggtattatttctgagtcttctgttctgttccattggtctatatatctgttttggtaccagtaccatgctgttttggtaccatagccttgtagtatagtttgaagtcaggttacgtgatgcctccaactctgttcgttttgcttaggactatctgggatatgcaggctcttttttagtcccatatgaaatttaaagtagtttttttttccagttctgtgaagaaagtcaatggtagattgatggggatagcattgactctataaattactttgagcagtatgtccattatcacaagactgattcttcctatcaatgaccatggaatgtttttccatttgtttgtgtcctgtcttatttccttcagcagtggtttgtagttctccttgaggaggtccttcacatcccttgtaagttgtattcctaggtattttattctctttgtagtaattgtgaatgggagttcattcatgatttgactgttattggtgtataggaatgcttatgttttttgcacattgattttgtattcggacactttgctgaagttgcttgtcagcttaaggagtttttggacggagatgatggggttttctaaatatacaatcatgtcctctgcaaacagagacaatttgacttcctcttttcctatttgaataccctttatttctttctcttgcctgattgccctggccagaacttccaatactatgttgaataggagtgatgagagagggcatccttgtcttgtggctgttttcaaagggattgcttccagtttttgcccattcagtatgatattggctgtgcatttgtcataaatagctcttattattttgagatatgtttcatcctagtttattgagagtttttagtatgaaaggctgttgaattttgttgaaggcctttcctgcatctattgagataatcgtgttttttgtcattggttctgtttatgcgatggactagtttattgatttgcgtatgttgaaccagtcttgcatctcagggatgaagctgacttgattgtggtggataagctttttgatgtgctgctggattcaatttgccggtattttactgaggatttttgcatcgatgttcatcagggatattggcctgaaatttttccttttgctgtgtctctaccaggttttggtgtcaggatgatgctggcctcttaaaatgagttagggaggattccttctttttctattgtttggaatagtttcagaaggaatggtaccagttcctcttggtacctctggtagaattcggctgtgaatccatctggtagtggactttttttggttggtacgctattaatcaatgcctcaatttcagaacttgttattggtctatttagggattcaacttattcctggtttaatcttgggagtgtgtatgtgtccaggaatttatccatttcttctagattttctagtttatttgcatagaagtgtttatagtattttctgatggaagtttgtatttctgtgggatcggtggtgatatcccctttatcattttttattgtatctatttgatccttctctcttttcttcttcttagtctggctggctagcggtctatgtattttgtggatcttttcaaaaaaccagctcctggattcatggattttttgaagggtttttcgtgtctctatctcctttagttctgccctgatcttagttatttcttgtcttctgctcactttttagtttgtttgttcttgcttctctagttcttttacttgtgatgttagggtgtcaattttagatctttcctgctttctgttgtgggcatttagtgctataaatatccctctacacactgctttaaatgtgtcccagagattctggtatgttgtgtctttgttctcattggtttcaaagaccatctttctttctatcttaattttgtcatttacccagtagtcattcaggagcaggtttttcagtttccatgtagttgtgtggttttgagtgagtttcttaatcttgagttctaatttgattgcactgtgtctgagagactgtttcttatgatttccgttcttttgcatttgctgaagagtattttacttacaatcatgtggtcaattttagaattaagtgcaatgtggtgctgagaagaatgtatattctgttgatttggggtggagagttctgtggatgtctattaggtccacttggtccagagctgagttcaaatcctggatatccttgttaattttctgtctccttgatctgtctaatattgacagtggggtgttaaagtctcccattattattgtgtgggagtctaagtctctttgtgggcctctaaggacttgctttatgaatctgggtgctcctgtattgggtgcatatatatttaggatagtcagctcttcttgttgaactgatccctttaccattatgtaatggccttctttgtctcttttgatctttgttggtttaaagtctgttttatcagagactagggttgcaacctctgccccttttttgctttccatttgcttggtaaatatttttccatccctttattttgagcctgtgtgtgtctttgcacatgagatgggtctcctgaatacagcacactgatgggtcttgactctatccaatttgccagtctgtgtcttttaattggggcatttagcccatttacagttaaggttaatattgttacatgtgaatttgatcttgtcattatgatgctagctggttattttgcctgttagttgatgcagtttcttcatagcattgatggtctttgcaatttggtatgtttttgcagtggccggtaccagtcattcctttccatgtttagtgcttccttcaggagctcttgtaaggcaggcctgttggtgacagtctctcagcatttgtttgcctgtaaaggattttattttctccttctcttttgaagcttagtttggctgtatatgaaattctgggttgaaaattcttttctttaagaatgttaaatattagcccccagtctcttctggctcgtagggtgtctgccaacatatccactgttagtctgatgggcttccctttgtgggtaacccgacctttctctctggctgcccttaacatttttttccttcatttgaacattggtgaatctgatgattatgtgtcttggggttcctcttctcgaggagtatctttgtggtgttctctgtatttcctgaatttgaatgttggcctgcattgctaggtcggggcagttctcctggataatatcctgaagaatttttcccagcatggttccattctccttgtcactttctgctataccaatcaaatgtagatttggtcttttctcataatcccttatttcttggaggctttgtttctttttactcttttttctctaatcttgtcttctggctttatttctttgagttgatcttcaatctctgatatcctttcttccccttgattgattcagctattgatagatgtgtatgcctcacgaagttcttgtgctgtgtttttcagctccatcaggtcatttatgtttttctctaaattggttattctagttagcaattcatctaaccttttttcaaggttcttatcttccttgcattgagttatgctcctccatgctcctttagcttggaggaattagttattacccaccttctaaagcctacttctgtcagtttgtcaaactcattctccatccagttttgttcccttgctggtgaggagttgtgatcctttggaggagaagaggtgttctgttttttggaattttcagcctttttgggctggtttctccccatcttcgtgtatttatctacctttggtctttgacgttggtgaccttcagatggggtctctgagtggacatcctttttgttgatgttgatactattcctttctgtttgttagtttttccttctaacagtcaggcccctctgctgcaggtctcctggaatttgctggatgtccactccagactctttttgcctggttatcaccagcggagccagcaaaacagcaaagattgctgcctgttcctttctcagcaagcttcgttccagaggggcacctgccaaatgccagccagagctctcctgtatgaggggtctgtcagcccctactgcaaggtgtctcccagtcatgatacactgggggtcagggacccacttgaggacccacttgaggccgtctgttccttatcagagcttgaacgctctgctgggagatctgctactctcttcagagctgtcaggcagtgatgtttaagtctgctgaagctgcccccacagctgccccttcctgcaggtgctctgtcccagggagatgggggttttatctttaagtccctgacttgggctgctgccttttttttttcagagatgtcctgcacagagtggaggaatctagagaggcagtctggccgcagtagccttgctgagctgcagtgggctcagctctgtttgaacttcccagtggctttgtttacactgtgagggcaaaatcacctactcaagcctcagcagtggtggacgccactccccccaccaagctggagcatcccagttcaacctcagactgctgtgctggcagcgagaatttcaagccagtggatcttagcttgctggggtctgtccgggtaggaccagctgagccagatcacttggctccctggcttcagccccctttccaggagagtgaatggttcttcctggctggcgttccaggtgccactgggatatgaaaaagaactcttgcagctagctcagtgtctgcccaaatggctgcccagttttgtgcttgaaacctagggccctggtggcatagacaccagagggaatctcctggtctgctggttgcgtagactgtgggaaacgcacagtatttggcctggagtgcgctgttcctcctgtctctcatggcttcccttggctaggggagggaaatcctctgacctcttggcttcccaggtaaggcgatgccctatcctgcttcagctcaccctctgtgggctgtacccactgcccaaccagtcccggtgagatgaacggtgtacttcagttggaaatacagacatcactcaccttctgtgtcaatctcgctgggagctgcagcctggagcagttcctatatggccatcttgctagcaaatcgtcaagctctttatttttaacaggatttctgaggtttttgtttagaagtctgcaaagtgatccctcattctattaacttgtattgtttcaatggttatttctttttttggaggtgggcattcgtccttgccttcttgatcattataactgacaatttacttacattgctaatgttttgaaaaattagagtttgatttaattaggtctctcattcttcatattcttgcatcattaatgcttactttcatctttgttatagtatttccttttttggctttctattagtttactttgaggttccttttatcatttctagagctttatatttcatttattttagatattttatgtgtatattttatatttatatttcatttactttatatattatatatattataattcatttcttttaattctttcatttttactaaagtgatttttttttttttttttgagatggggtctcactctgttgcctaggctggagtgtagtggcacaatcttggcccactgcaagctccgcctcccgggttcacaccattctcctgcctcagcctcctgagtatctgggactacaggcgcctgccaccatgccctgctaattttttatatttttagtagagacggggtttcaccatgttagccaggatagtctcagtctcctgaccttgtgatccacccgtctcagcctcccaaagtacagggattacaggcgtgagtcaccgcgcctggccttactaaagtattttttgatggaaatgttcattagcttcattttgtcattcatatgtatatgtaaaacaacatcactttgtactccataaatatatagaattataacttgacaatttacaataaaataaaaaataatctttttttttgctttgtgaaattgttatttatttcttatcaacttttattttagatttagtggtagacatgccagtttgctacatgggtaaactgtgttttgtggggatgtggtgtacagattatttcattgcccaggtaatgagcatagtacacaataggtagttttcaatcctcaccctcctcttactctccatcctcagataggcccttgtgtatattgttcccttcttcatgtctatgtgtactctatgtttagcaccttctcataagtgagaacatgcaatatttggttttctgctcctgcattatttcgcttaggatattgaccttcagctccattcatgttgctacagaggacatgattttgttctttttatggctgtatagtattctatagtgtatacgtaccactttttctttatccagcccaccactgatgaccatctaggtttattatgtgtcttttctattgtgaatactgctgtgataaacatacacatgcatgtttctttatggtagaacgatttatattcctttgggtacatacccaataatgggattgctgggttgaatggtagttctgtttaatgttctttgagaaattgccaaactgctttccacactggccaaacaaatttacatttccaccaacactgtataagttttctcttttctctgcaaccttactagcttctgttattatttgactttttaatagtagatattctgactagtgtgaaatggtattattgtagctttgatttgcaattctttaataattagtgatgtttagcatttttttcttatgcttcttggccacatgtatatcttcttttgaaatgtgtcagtttgtgttctttgcccacattttaatggggttatgttttttttggttgttaatttttaagttccttataaattctggttataaatccttagaccattgttggatgcatagtttgcaaatattttctcttattctataggctgcttaatatgctgatagtttcttttgttggaagctcttcagtttaatttttgtcaaaaattttgtcaatttttgtttttgttgcaattgcttttggcatcttcatcatgattttgtatcctgaaactttgctgatgttgtttatcagatctaggagcttttggtcagacactatgaggttttctacatatacaatcatataatttgtgaagagagatagtttgacttcctctcatcctgtttggatgcatttcattcctttctcttgcctgattgctgtggccaggacttccagtactgtgtcgaacaggagtggtgagagtaggcatccttgttttgtcccagttctccaggggaatgctgctattaatagcttttgcccattcagcatgacgttggctgtgggtttgtccttgatggctcttgttatttcaaggtatgttccttcaatgcctagtttgttgaaggtgttaacatgaaggaatgtttggtttaattgaaagctttttcttcatatattcagatgattatgtggtttttgtttttagctctgtttatgtgataaatcacatttattgatctaggtatgttgaaccaaccttgcatcccaaagataaagcctacttaattgtggtggattggatttttgatatgctgctcaattcactttgctagtatttttttgagaattcttgcatcaatgttcatcaaggatattagcctgaagtttccttttttcattgtgtctttgccagattttggtttcagaatgacactggccttgtagaatgagttagagaggagtccctccttctaaaattttggaatggtttcagtaggaatggtgccagctctttatacaaatgatatattttgtctgtgaatctgtctggtcttgggttttttctggtaggtagactttttatttctgattccattttggaactcattatttgtctgttcagcaatcaatttcttcctcgttcaatcttgggtcgttgtatgtttcaaggaatttatttcttctaggttttctagtttgtgtatatagaggtgttcatagtagtctctgtgggtgttttgtatttctgtgggaatggttgtagtgttatgtttgtcatttatgattgtatttatttggatcttttttctttagtagtatagctagtggtctatgagtcttatttatatttcaaagaatgaagtgggtttgttaattttttgtatgattttgtgtctcactatccttcagttgagttctgattttggttacttcttatcttctgctagctttgggttttgtatgcccttgtatatctagttcctctaggtgtgatgttaggttgttaatttgagatcattctaactttttgatgtggacgtttagcactaaaaactttcctcttaacactgctttaactgtgctccagagattctggtgttttgcatctttgttctcattaatttcaaagaattttctgatttctgacttaatatcattgattaccccgaagtcattcaggagtaggctgtttaacttccatgtgattttatagtttcgagtgatcttctaagtattgatttttatttttattgcactactgtctgagaatgcagttggtatgatttcagttttttttttttaatttgctgagaattgttttatggccagttgtgtggtcaatatcagagtatgtgctatttgcagatgagaagaatatattcttttgtttttgagtggagagttctgtagatgtatgttaggtccacttgatcaaatgtcgagttcaggttcggaatatttttgttagttttctgccttgatgatctgtctaatattgccattgggatgttgacatcacccactattattgtgtggttatgtacatctgtttatatgtctctaagaacttgttttatgaattgggtatttttgtgttgggtgcatatctatttaggatagttagttgttctttaattgtaaccactaccattgtataatacccatctttgtcttttttgatcattactggcttagtgtttgttttgtctgcaactataatagcaacccttgctgttttctgtttttcatttgctcggtaggtttttctccatccttttactttgagcctatgggtgtcattgcacgtaagatgggtcagcatgtaagctggttattatgcagacttgtttgtgcagtttctttatagtttcagttatctatgtacttaagtgtctttttgtggtggaaagtaatggtcttttttctccagatttagcactccttaaggatcttttataaggcaggtaatgaattccgttatttgcttgtgtgaaaagtatcttattttcccttcacttatgaagcttatgaaggaatatttggtttaattgaaagctttttctctatatattcagatgattatgtggtttttgtttttagctctgtttatgtgataaatcacatttattgctagatttttctccatccttttactttgagcctattggtgtgatgtgaggttgttaatttgagatcattctaacttttcgatgtggacgtttagcactataaactttcctcttaagtttggttggaaatgaagtttttgatttgagtttttattctttaaaattgctgagtatcagctcccagtctgttctggcttataaggcctctgctcaaaggtccactgttagcctgatggggttccctttgtagatgacctgccccttctctctagctccatttaacattttttctttcatttctaccttggagaatatgttgactatagtcttagggatggtcttcttgtgaggtatctcttggggttccctgcatttcctgaagttgaatgtggcctctctagcaaggctaggggagaaagttgctggctttctctccctgtctttcagcgacaccagtgagttgtagatttggtttctttacataatcccatatttctcagaggatttgttcatttttttaattctttaaaaaacattttttttctgattgagtttgtttggagaaccagtctaaaagctctaagatgtgttcctcagcgtggtccattctactgtgaatacttgtgcttgcattatgaaatttttgtagtgtgttttgcaactctatcagatcagtttggttctttcttataacggccattttatctatcggctcctgcattattttattgaaatccgtaaattctatggatgggtttcatctttctcctgaatctcctgaatctttatgatcttcataggggatctaagtgcagagtgcaaaaagcctgtggcagatatgtgagtccatggggactatcactcacttatcatttccccatggtggaggacatcccttggctcaatgccacttttgggcgggcaatagttctgtctcactcttttctgttctccatgggtcacattttttccttgatgaatcccaatgtgttcacctagatgttctagttgaagggctagtgttgctcaccactctcttctctccatgaaagtggtgcacactaattggttctaatcagccatcttgtaaagtctcagtgtaagttaagtttactcttttttttcttttttttttgagatggagtcttgctctgttgccatgctggagtgcagtggcgcaatctcggctcaccgcaacctctgactccctggctcaagcaattctcctgcttcagcctcccgagtagctgtgattaggggcatgtgccaccatgtccagctaatttttgtatttttagtagagacggggtttcgccatgttgtccaggatggtgtcgatctcctgacctcatgatccacccgcctaggcctcccgcagtgctgagattacaggcgtgaggcattacacctggcctactgcactttttaaaaatcatcaaagcatgaaattatctatgagtgagtgaaaactcattagaaagagtcttctcaaagaataaattactttatgccattaaattgataccaaatctgaatttgactagtgctcagcaacatcttatttcccacattagatttaatttaaatatagtaattacccatgacttaagaaaataatattttaaataccatagtaaaatatatgtccgatatttattttctttgcctattattattattttgcctaatatactctggtataaaaggccttccaaataccacagggtagaaaagatttttaaagttacaaataaattcctataaactatatatggcattacatgattttcaactttgtttttagctatattggataatcataagatttcattttttaaaaaattgaaaagccatgatctctcaacttgggttttaaaatttatcatgttttgattataatgagtcttaagctctatgatgccatttttttatgtagttaattaatggaaacctatgcttatcagggaaagacatcagcaattgtggggtacctaataaatcacctttgtaagatttttcttctggaaagcacctcactgttactacattctgtttcattagtctaacagtgaaaacagaatagcaactatctcttaaaaattagatactttctatatataagtatatactttaatatacaaaatataaatatggatatcaatattttaaaattttagtcgttttgtttccttaactattaatgtatttttataatgcaaatgttttattactcatttaataggaatatatatgcattaaaaaattaatgttttgggtagtagaacatgctttactcttagactgttggaaatacttgctactttcagcttttagacataacccaaatttctaaagttttaaagataagactgaatgataaagtcaatttagtgcatttcctttacaaaatgagtacctttggttacttaacacagtatgcagaaaaagataggttatgaaaaaattataatttctataaaatggtgttaaaagcaaaaattgctattatgaatctttgatttgtgaattgaaatctgagaatcttcaagaaatctcataaatatgcaaatactataattaaatacaggtatcattataattactaatttttatcttgtcattttaaaggttccgttttgttttctaacatttataacaatatttttttgacaaaaataggttttaacttcaagaaattatactcttcaagaaactaactgaagagattgggctcaattttaatgtagatataaaattctacatattttaactggtataatctttgtgaaaaagtaatgcttgttttctagtacagcttgacctttagctaaaatgaaactattttaagagtttttactttgaacattgagtgtgtgaacaccgaaaagatgagacaggtgtcagttaatttagaaagcttatttgccaaggttgaggacatgcacctgtgacacagcctcagaaggttttgatgacatgtgcccaaggtggttagagcacagtctggttttatacattttagggagacataagacattaacatatgtaagatgaacattgattcagtctggaaaggcaggacagctggaagcaaagatgggaagacttgaaggagggagagggttctaggttataggcagataagagacaaatagttgcattcatttgagtttctgattaacctctccaaaggaggcaatcagatatgcatttatcttagtgagccgagggatgacgttgaatgaactgggaggctggttggccctaagcagttcccagcttgatttttccctgtagcttagtgatttggaggcatcaaggtttattttcctttcacgtttactcctttttccttttaatcatcttttggagaaagcatttcagaagaaaataagtttctggtctcaggttttgtctgatcttttatggctaggatgctttattcctagacaggtaggtcccaagttattaggaaagctcattttttgcaggtgttgaagacttatgtttatgaagagaaaatagggggaggaagggagaaaaacaaccacaaacaaaggaacaatcctggataattgacgtaggccacagtactttgaagtccatccatcagtaggcatgtatgaatgtggcttatgtatgtaaatagattgctgttacattttctgaagtttaagttgtttagctttagtttgcagggcttcacgaaagcacagcttagttttcagtgactccaaattaggaaatatggggaaaaaataaggaaaacaaattgaaaacattagtttgcagatttgtagtcaagaaaaattagaatttggtccaaaccttagaaaataataaaaattgaaaaacattaggcaagactagaatctaacatcaggtgtcctatagtttttgaaatttttttttctccagtttcccgtgtttattaaagacaaatcatggtaggactgatttgttttattatacttgacctcattatttgtatatagtgcagcaagaataattttttttttgaaatggagttttgctcttgttgcccaggctggagtgcaatggtgtgatctcagctcattgcaacctctgcctccggattcaagcaattcccagccccagcctcctgagtagctgggattataggcatgtgccaccacgcctggctaattttgtatttttagtggagatggggtttctccatgttggtcaggctggtctcgaactcccgacctcaggtgatccgcctgcctcggcgtcccagagagctgggattacaggtgtgaaccaccacgcctggcccaaataattattttttttatgtaggcttttaaattggctttgatggaactttgtttcatagcagaaatttcaggtaagactttttttttttttttttttttttttgagatagagtttcgttcttgtcgcccaggctggagtgcaatggtgcgagctccacttactgcaacctctgcctcctggattcaagcaattctccttcctgccttagcctcccaagtagctgagattacaggcacccaccaccatgcctggcttatttttgtattgtttggtagagacagggtttcaccatgtttgccaggctagtcttgaactcctaacctcaggtgatccacctgttttagcctcccaaagtgctgggattacaggcgtgagccactgcgtctggcccaggtgagacttttttaaagctgtgcccagccatggatttgtaccattaaatacctatgagttgggtgaattcctcttctcttgaggtttcaggataaacttggggctcatgggcctattagaaagtgacattattttacttaccacaggttatgaaccctgttacagggactgtagacaaggtataaggccagtttttccatggggctgttattggctccataagttgtttgattccttaaaagaaagtacatcattcctgttaatgctttggtaaaaataacccatttcttcagtcatgtactgttacaaattaaaacagattcttattgcacattccatagttatatggaaataactatattgccataagttaagaatactaacaagtagtttttaaattctgtagaaatcaggtagagagaaacaaatgttgtttataggagtatactaaattattagaagctattaatagctttaaagaaaagttttcttgacattgaaaaaacaaaacaaaggattagcaatgttttaagcaaaaagttaaaaagagtactgtagtcatctattagttcagtccatgcagttaattcctgttctgcttgacatttatgaacatatcagctctccctgtgtcctgaaattttttcctctatttacatatcaaaatcttcaaagttatcagagattgcattcaagagcacctgttagagttttatagctgattataaaacccccttctaaagaggactaaaagaagacaacaattgtccttggattacaaaagttttaagatagccaaagtttaagacacaattaagtaaatttgttatgtctgtggcacacaataatttaacataacaattacaattattactgataatgtatactaagttatatcagaattatgggagttttccataattttggaatacatatcaataatgtatttatacaaatacagctcaaagaaaaccacgtgccattttgtacttgacaatgcttcttgtataatttttataccaattaagccaaattatgttttttttggactctagggaccctaatatcttaaaggattaattaggttagaaaaagacataatttataatttgattttggaaagtttgttaaatatcaaaggtttaaaacacttgatatagcaggttattgtaaaataagttattcattcaaccaaagtgataactcaaggatttttaaaaagaggcaaaaacccttattttttgagagaggagacttaattttacaaacaagaagccctagtaaaaatagcatgaagccaattaatttttttttaattttataaacaatttataaaattttaatcctgaccataggatataacttccataatcctcttataacctttattaaggagtcggttaatgctttaagaaaaccttgttaatctgacacagctgtacatatgctggtattgccttaatgtgcctttgacattaatgattgatttatagataaactgaactgattttatctttaaaaatggccctatagcattaggagaaatatcaaatgtagatgatgggttgatgagtgcagcaaatcaccatggcacgtgtatacctatgtaacaaaactgcatgttctgcatatgttccccagaacttaaagtataattttaaaaaaaggccctaacagtctcacatccccacctcctctgcgatagtttttgggccttgaggagttgaatagctttaatttctggccctgtatgtctcaggaatacagtttattttgactggcatcttttaccgggcctgaagataaggctgtaactgcttttagtgtttatgctttagcaggacttggtgtcctttttagactcaggatttaaaaccatgtaacttaatattacaaggactttaaaagcacatgaagaaggatacacatatgtaataaccttaattaaaaaaattaattttagttattttcctaagcaaaccaaaacttaataataatggcataggaattgtttcgataaactgtaaaatcttttaggccagttaccaaagggaaaagaaaaggccttttgcactgtacacaatattatgatggaagaaaatattttctttagagctttaagaaaatattgttagtctcaggcaataacaaacaggacatgaggaaaaaaaattatatgagctgaaaatgtgttgaaggagaagttttgctattttacacccttaaaaggggagagaaaacctaaaacggtgagatgcaatacaagttgaacattgtgttaaaaacaaattaaaatctcatataatttattgagtaaatcaatcccttaagaaaatttcattgttttaaccaattatgtagtgtatgagtgtttttgtatatatcaagcccagtctttaaaaagaccattacaatttccctttaattatagacaactttattatgtaaaagtttttatttttatttttttaataaattctcttcttgtgacttacccagactgttcatgacatgcttggactttctggtttgtcctgaacatcactttttcttaaacaaccagttattttattataggactaaatctaccctacaagattttttttcatattaaattatttttctttaagcttttttaccaaaaaaccctttttatttttacaacttcctttacatctttcttatttcctggttccttttaccttcttgtaatataacctttaaattagctttgaattagacaaaatttgttcaccttttcaaaaaggacacactttttttcaagaaagaatgtttttatacaaatatattattattggaaaatgcccaaataatgaaatatctattatttaatttaactttagattttaaattataacacttttgtttacaagtatttatcccattacatttacctaattattttctttttatcatttacctagattgtgtatgaaaactgaaatagtcattatttaaagttattgaactgccattgcaaaattgtacctgagacagtaaaaaagatttgatctaactgacttcatcttgattcttgttcattcctcggtattggctgaacaaactaaattaggaggaatttagtttatagtttagctttgaatcaaagatgaagataacattcccttcccaaaacaaaccgtattgcctgtggactagtccacctaaagccacagaattagaagttatggtaatcttactaaatttaagatgtatctatttttattaaactcatgttaatgtcttatttactaaagattatggaagcaaagattattttctcttgggctgggtttaaagtttatagccaaattttgacactgtatagtatttgaaaggaataagtatgaaattacttgaataataaatacaaagaatgtatgctggcaattcttaacacatttttaatattactttaccaataattttaaagctggcttatttattaaagattttacttaagttaaataaacttgaaaaagcatttgactagccttttcttttttcatgataaagtatttgatttaagcacttttattttcttaagccaattagagatcttttatatattttcagtagtgaaacattgtgtacacaacacaaaaatacatagatgtattaggcatgcctatagaagtacatctttagatttatagatttataaagacctttttttctatcttagacttttagattcttaataacatgttttataacccagagcagttttcagctaaatagccttaaatttgcatattaaaggagacaactcaggtgaaaatcaaattacaaaatttacataataaggtactgagacaaaaagtctggtggtgctagagggagattaaagatggatgccaaattaaacataaaattatagaaatctgtcatagaattgtataaggagaccaattttatttagatacagactacatatattttaactggatctttgagctctgggcagagcccacactgaatcctgggtctccaaaaagggagaataatcatgatcttagactagcatggcatccatgcttttacagtgcacttaaaataattctttttaaacaaagatatttctaagtgtttgaactgcatgcttccttaaaacccaaaagtagcctctgttgtaataggtattttagttaaaaaaatcaggttacaaaatacgaaagcaagcagtttatttaagagctgagacaaacttgtctgtatattcttttggtattccataaaaagcaaacaaacaaacaaaaaacagaagttcctccccaaaagggagctaggtaccttctttgatttctttaaggacccccaagatattttaaactattttaggtcccacatgtagtagatggtgcaagagaaaggagagagagtagatgtaaatggagaaaacagaattcagttaactgagaagaaaaaatattttgctcaaaaaaaggcaaggttctaggagagaaaaaaaaacatgaacgccttttaaatacaaacaggcacacaggcacacatacacacacacacgtcttggataatgacttttaattaagcttaaccactgagctcctttaaaaatttttttaaatctcattatcatatttcagctaggagaaattgctgctatttcagaagtaccaagtatcaaaccagaaagggctggattcaggaaccaaacccagggtgtcctggtggaagaaaaaaaaaaaaagaaggcagaaccttagctgttgaactccagcatgggtggacagccattgttctttcagtttggcctggctagtaaaaaggtggccttgttatgtaaataaagcccctttagtagttaaaattaaaaaaaaaattcatttctttttcccttttgctgtccattttctcccccactacaccacctttgtgtgcatgtgttgtggcagggtgtcaggggtggtggtggggaatttagccacttcagaggccttgttccccataatttggaattttccttcaaattttatcaagtctgatagagttggttaaacccaatgggaaaaagactgaaggaacaataaaaataggaacaaacatacaacaacaacaaaaacagttaaacaaacaaacgacagcaaacaaacacattatgtgattactgaatattgtaatggtaaggagaaattaagaccagctggttcttaaacttagccaagacaaaaccccaatttagctacttacctagggatgggtctcaggctgaagaccgtactctaccagcctagaagctggaaaaaaaactaaaaaacaaaaacctgaactcatcttccctgctgcaaatgagctcaaactccataaaggagttatctgcctttcatcatcatggaaacagaaaatcttgccttccttgttggaagcaagtaaaactccaaaaaagggaagttgtacggcaaaataaactttagatctcgaccaaattttgggagatcagggattctctggacggtatgctcccagacctcagcaaattgtcctattggagccataatgtttgcttatgctgatatcaagcaccaataggagatttgtgaaaggtcagaggcatctccagtcagaattgccttgtggttaccaaaatgtgaacccccaaaatctgagacaggtctcagttaatttagaaagtttatttgccaaggttgaggacatgtgcctgtgacacagcctcaggaagttttgatgacatgtgcccaaagtgattagaacacagtttagttttatacattttagggagacatgagacattaattaacatacataagatgaacattggttcagtctggaaagtcaggacagcttgaagcaaagatgggaagacttgaagcagggagggggcttccaggttataggtagataagagacaaatggttgcattcctttgagtttctgattaatttctccaaaggaggaaatcagatatgcatttatcttagtgagcagaggggcgactttgaatgaaatgggaagcaggttggctctaggcagttcccagcttcatttttccctttagcttagtgatttgggggcccccagatttattttcctttctcaagtgttacatctctagtagatactgcaattcaataagtaaaaatgctaggattttttgctagttactaggaatataataatcaaatgcgtgattgcaaatattataaagtcacatgaagaaaaaggacaggtaacctaataatgatagtacacactgtgactaattgttgttaggaaagtgtagtacttaagaactagagtcagaatgcactgattttcatttcagcttcactacttattgactgggtaaccttctaagccttgatttatcatctataaaatgaaattaataacattacctaattgatgaggtaattcggagtattaagtcagttaatgtacgaaaagtaattagcacagtgcctgggaaatagtaagcactttatgaatatcagctctttttagtagtagtattgtagaagtatatgtagagaaatcaggagtaaaatgaggattgccattcacacaaaatccagaactggtaggcaatgattctagaataagagttacccatgggtggaaggtataagggatgagggaaaagtttgtgccaaacagggttacagaggtttgctaatgtatgtcaagtttttgaaactgctggtataggcataccttgttgtattttacttcgcattattgcacttcagagatgttgtagtttttttactaattgaagttttgtggtaaccataggttaagcaagtctgttcgtgcaatttttccaatatcatgtactcactttgtgtctctgcaccacattttggttatttttaaaatatttttatttttaaaattattactatatagattatggcaatttgtgatcagtgctcctcgatgttacttttgtaattgttttggggtgccaaaaactgtacctatataaaacaagtcagcttaattaatgtggtgtttgttctgagtgctccattgactggaagttctgtctccatctccttaggcctccttttcattgagacacagcaatattgaaatcaagctgtttaataatgctacaattgcttcccagtgttcaaatgaaaagaattgttgcatgtcttgtcactttaaatcaaatgctacatgtgattaagcttagtgaggagggcatgttgaatgccaatacggccgaaatctaggcctcttgtccgaagaattagctgaattgtgaatgcaaaggaaaaattcttgaaggaaatgaatgctactttagtgaacacacaaatcataagaaaatgaaatagcctttttaatgatatggagaaagttttagttgtccgaatataagatcaaaaccactataacattcccgtaaacctaagcttaatttagagtagagcctaactttcttcaattctacaaagtctgagagaggtgaggaagatgcagaagaaaatttggaagccagaagaaggtggtttatgaggtttaagtaaggaagccatcttcataacaaaagtgcgaggtgaagcagtaagtgctgatatagaagatacatgtctaacttaattgatgcagtagctacactaaataacagattctcaatgtatatgaaacagctttctaaaagaagataccacctaggaattttatagcaaagaagacatgtaaatgcttgacatcaaaattcaaaagacaggatgactttcttgttaggagctaatgcatctggtgattatgagccttggtaatgagccagtgctcatttacccttctgaaaatcctacggtccttaagaattatgctaaacatgttctgcctatgttctataaatggaacaataaagccagcatgacagcatatctatttacagcatggtttactgaatattttaagcccactgttgaggcctactgcttagaaaaaaaagacttctttcaaaatagtacagctcattcacagtatacctagtcactcaagagctttgaaggtgatgtgtaaggagattaatgctgtttcatgcctgctaacacaataactgatacggtttgggtggtgtccccaccaaaatctcatgttcagttgtaatccccagtgttggaggtgggggcctggtgggaggtgattggatcatggggatggatccctcatgaatggtttagcaccatccccttcatgctgttctcttggtgctgatagtgagtgagttcttgagagatctggttgtttaaaattgtgtagtaccccctcttcactctctcattcctgctcctgtgcctgctccgccttcacctttcaccatgattctaagtttactgaggcttccccagaagccttgcagatgccagcatcatgtttcctgtacaacctgtgggtctatgagccaattaagccccttttctttataaattacctggtcttgggtatttctttatagtaatgcaagaatggtctaagtacaataaccatttggcagcctgtggatcaaggagtaattttgattttttgtactatttttattaaaatacattttgtaaggctatagctgacataggtgatgattcctctgatgaatctaggcaaagaaaaatctctggaaagaattcatcattctaattgcctttgataacattcatgattcatgggagtagatcaagatatcaacattaacttgagtttggaagaagttgattcccaccctcatagatgactttgaggggttctagatattagtggaagaagtaactgcacttgtggtagagatagcatgagtaatattgatagaattataagtggagtttggagatgtacggaattgctgcaatgtaatgataaaactttattaatgagatgttggtttttatggatgagtaaataaagtagtttctggagatggaaacttttcctggtgaagatgctgtgaacattgttgaaatgacaatgagttggaatatcacataaacttgataaagaagcagctggatttgaggattgactccaattgcaaaagttctgttagtaaatttttatgaaacagcattgcatgctgcagagaaatctttcctgaaaggtgcagtcagtcattgtggcaaatatcattgttgtcttattttaagaaattgccacaatcactccaaccctcaggaaccattaccctgatcaggcagcagctgtcaacactgaggcaagaccctccaccagcaaaaagaaaacatgctaaaggctcagatgatcattagcagtttttagccataaagtattttatatatattttcttctagacataatattattgcacatttaataggctacagcattgtgtaaatgttactgttatatgcactgggaaaccaaaaaaattttgtgacccactttattgcgatattaactttattgcagtagtctgtaactaaacttgcaacatctccaacatatgcctgtactgttatttgactgcagtgttaatgctattagcagagaaagaagcaaggctaagtttctaagattggtatatgatatgttaatgtgattggacgtcataaaagtgagggagaaacactgaggaaatttaagcaagggaattaagaagtgtttggaggagaatcacagaaacctcttttggggttaaagagagcactttgtcagttaagtttgtgtattaaaccatgaggaaagttatgagtgccttcattcattaggcatgtgtttgctatagaaagaacttaaactatttaatgtttataaacaatatccaaggatttatcatcagaataatatgctataatacttatgcagagctgtctggtatatttattcctcatgttttattccagaaatatgttttattttgtcttttacaattgtctattttctgtgtaaccatatttttaaaaatattaccttgtctgaattatatacattattattgtattaattatctgttgaaagtttatatggaatagatttcatcgtggatcttagtaacagctaatttaatctccaatttgaatttatttatattttttaaaagaacaagtaagaatataacctaataagatctcaagttgtttgcctgaaacagcccgattgtctttaagatatgactagttaactagcatcctttatgtaactatgcttttaaatccaaatagtggtttgcaagaccctctctttcccttcagttcgttagatgaacttgataattttagcacattcttttatattacattttccttttttgtttatctgaaatattatatcagagtttattatgtctggcaagctgacgttttgcacaaacacatcaatttatctttcataaaataagaaattttctcccacaaattttgacattttgtagtaaatatcaagctattaatctacttctctgtccaaatgcatttaatgcaacttttttataaaatcataaaatttaaaatattgatcattattattaattcattaaaaatatagcatatcttaaattcaagttttagattttggacatgttttcagtatgaatttacatttacatttgaattgacaaaatgtattatcagggttactgtagtttcagctaacttaatttttagcatgttgtcttatcaattattttgggggttttttaaacagatggggaagatgagaatatgaaattgtgtcactaatcagtctttattttgattattgtttgaataatcactgtataatgaataaaattattaccgaagacagaattacaaaggtgcatttatactggcttaagttttaaaactaactttaaatgtaacttgtgtaaacatgtcatatttttcatgggaataccacagaactaaatggaaaacgttatttgcaagagtcatgttctagccatggcatcaacaaataggaatcttcctaattagaacataatagattttacagtcataaatatcccataccctgagaagatatactttcatagaaaatacaaatttagaatattgttgccgttattgtctcactgttttttaaaagcagttggctaaataatcattcttttaagatggtatcatttttaatacattaagaaataatatttcatgtaatgccacctaattgagacacaataacatctgtaccttcttcctttcatagcttttaataaggatatttgaagtcctaagaatactcctgtgctaaatcttgctattgaatctatttattctataaatttcttgaagttatttatttatatttataaatatttctaaattacattcatttatttataataatttatttatttattcagtagttttattgagtgctttctatatactgtctaccaactactgttctagtcattggaagagtgctgtgaacaatatgaacaaggctactgttctcgaggagcttacattttagtggggaaaagacattttaactaatgatcaaccagtaaaataaaataattttagattgtagtttgaaaagcatagttttatacaatactatagagtaagggggtggtaaattactttacatgagtgtctttaagaagtgcaatatttacggtgagacctacatgatacagagcaagccatgtgaagaccagttgccctacatcacttaagaatgattctcctttgtgcttattccttttcctagaaaccaggcttgtccaacttgcagcccatgggccacatgcagcccaggacagctttgaatgcagtgcaacacaaatttgtaaactttcttaaaacattatgagatttttttgcgatttgtttttttgtttttagctcatcagctatcgttagtgtgttttacgtatggcctaagacaattctttttcttccactgtggcccagggaagccaaaagattgggcacccctgcagtttccagttttattagaaggggcctggaactgctgtatgctattgtagacagagaaaaactgagaatagccagatacacttgaacctaatgctgtgcttcatttctttctgctctctgtatcaaattttcctgtttgatctcagcacttctgcatatttttagatgttaaaaagcgatttcttgtcccacccacgtgagtagtagaagacaggatatttttcatgttcttttttctcatagcacttactgagttccaacatattatataatttattattatcgccatttattatctgctctcccactaagaattttttcactgctagcttttatttttaactgatacatccaagtacctggtacaatgcccagaatataatagatacttagtgatttatttgatatatgcataaatgtataccccttaaggagggaatcttgaaagagaatctgattgagttagtgtctgcttggcattgcttactaattttacaaaatcatccttgtatctgccttccatttccataattaattatatcttatttttaaagtatatacctgacaatggactgcaacagtattttccataggcaatttcctgtggaattttctatggaaagtctcgggtggaggaacattttgaaatatttgtacaacaaattgtagtgctgactcttctgttgaatagccagtatggaatatattcaacctgagcctgtagcctccagctgggactccaagtacaaaaactgcttgtgctgagtctacatttactcttgagtgccatttattttaacagatttgttactctgagtgtcccttgcatcagtttttaagaaagtctgtatttcagatggtactttttatagagactttacccatacacttcatcccaccattaatactcattattgtaaaaggtaggagagtattatctgtagcaggagttggttgaggtcttcaatcagtactttacttaatgttcaagtatcatgtgtaacctaatttgaactgcagctgttatttttgataattttaaaaacagtgttaattttgggaggtccaagtgtctcatcacccccaagaagtggtatttcagcttattctctgaaaacaagctggaatcaaaatagcattcatatttcttatgaaaacttttacatttgtctttattatgtttattaataggtaaagatagataatgtaattatttcaagttttagaatgttttggttctttacttcctgacttttacttgaagaagtagtcagtttcctctggctactttatttattcaaatattctttgggcagatgtaaaaaaaatatatagagatgtttcatgtgtgcctatgtcttgcttacttgcctgaaattatgatctttcttataaggtacttagttatatggacccacagatggcaggtaaaccataataaaattctgcagttccagcctgaatcatgtgcttcatcaatttaagtatattgttagtctgttggttactcccactacttatacaccatttaaattaaagaaatgccaaatcctttatatgttaaagaatggcagatatttgggagtgataatgagttaaatagggattgcacaaggggattagtgaagactcatatttgaatattatatattttaataatcaatgcttttttcccctaaaaatgtgccacttgctctttgaaaattttccatctcagttcctttccccacttttgttggaccttctttgttttgtctatatttattttattctgcttaatttcgattttcacttttagcagtttctcctcattatgagaccagtcctggaatagagatttgactggttgcttttgaaagttcatgtactccaactgttccaggcttctttagaacttcctcaggatcccttcaactaacctagtcttgtattgagcaactctacacttctgttttcacttccttattcaagttggcctggcctagttccagttaatacctttttgaaacttttgagttttcctattgattccctctttttcctgcctcatagacactggtaccttccacagcttgagtttgtcatttacccgtaccagtttatgttttgacatttaaggggatagatagtctgccacttacttttgttagaatagttgttctttttttttttttttttggcttttcaatttagctgctatatattttaatattggaagtcaaggatatcaaaaactatcctgctacgcccactgcccactcagaactctgtcccttggattgcatttgttaatttctaagtagttaagcttgttttggccatatgtgaaattatagttttaattttattttattggaatatgttaatgtaccttataaaagctaccatttagatttttaaaatactttctctgtacaatgtttattgtcttctttttaaaatgttctatggattaaaaatatattttaaatcatctgtgttcttgatgatttctgctctgttttgtaacataacttcttgaaagttcagcctgtagtttgtttctactttgtaatgttccacattctccttatattattctgtttatattaacatccccaccactctgttggaagttcatttgtttaaattactcatgaagttcatgttgtcaaatccagtagccatattttcatcctcgtcttaaccaacaaaatcaaccactactttcttcttgcaacatttctgttctttgatcatcttggcacaaccctttcctggtttcctcccacctacctttccacttcttttttttaagctctaatgatggggtggccctgaatatcctcttagagataatttctcctgcatctattctgtctcctagggactatcaaacaagtacatgatttaagatgacatttatgttcctttgatttccaaatttttaaatctaacctttcctgtgagcttcaagctagtagttactgtctactcttgaacatttaataggtatttcacatttaacatattctaagtaagtttttctttccttatttctcccttgatcctcatggcacttttctattctcaataagtagaaatatcatctttccacttgttcttgtgagagcaaactacaatagtcatgactgattcttctccttcattcacctgtcatatctaatctttcttcattcacctgtcaaatctaatccttcagcacgtctcctcacttctctctctaaattatgtacctaactacttatttttgtcttgatgactactacccttgtgcaagctactattgccttatgactagaaaaatcaaatatcctcttctcttatcttctggatttccccaattatttctttctcacccaacagccagaatgatatttttcttgagagttagatcatgtcattcccatagctcaaaactttccatgggttcccattgcccttataatatattccgaactctttgtcatggccaacgacctatgtgacttgctttttgctttctaatctgaatttatttacaactactctgtcctttgctcacaatactccagatcttatgacttttcataaacatgtctaacctaatcatcatctttacacttgagaaacctctaccaacagatatttgtgtgtttttaaacttcttatttggatataagctcatatatcacccctttagtgaggccagcagctctaaccaccggatccaaattagccgcaaatcctcctagctcatatcatctttgtttttttccactcaaaacaccactgtcaacaattgtgatatccccctacaagttcacctggttattttctccctcctgctattagaacataaaagccaaaataataggagctttgtcttattacaatggtgtagaacagagcttgtttagtgactatttcttgaatatttttacatgatttaaatgatttaagtagatcaattttgtgtctctttgatcagataacttttaaaagagatatgcatgttaataatttcttccaaaattttgccattatcaaattccccttatatgtccagagattgtgtttttacttacttggcctgtatttttggtgcatattgttttattattgttatgttttctttgtctcagtgttttatttgatcaggttttgcctttgaatttcactttgctattaatattggtttatatgttttattgtttttaagtgcctattatatcttcttacagtattttatattttagataaaaatgtgtcactgttctatatgtgttttctgctaaaaacgtaaagctgaattgtatctttactgcaaaaatctctgtctttcaatgtggattcaccctgttgacatttactgcaattgcactgtatcttattcagttaattttatgttatgtttattattttatttgttatttcatctgttctctttttttatatatttgctaatttattcaagcctttgttcaaggtccttatgcccccttttcatttaggtatttatcaacattgcgtaaggtttcctcctattccaatttgtcttaaataaactaattttctttattatgatttcaaaatattatcattttgaagatttttcctgttcttaattattgtttccagaattctgttaccatggatttaagttcttgttgacaatattctttgataagcttcctttctatgatattctatggacaaagacctgggaagaaaattcattcttttaaactttaaaagatgttttttctttaatcttttataatattttcacctataaccaatctcctatgccaattatctttcttcagcctttgtataagtgtttcataattcaatagcttagaagcttgtaggaaatgaatattactatatttaagcttacatgtacatgccaaagaatcattttctcaacttactgtaattctttacataagaaatactgacatcccttattttagaatgccatttaaattccttagtgttctttccttgcactggaagctgggacaattataggattaatttcctttgtttttcttcactcagggatcataatctctggccagttgtccaatgcctgaaattggttgtttcagatacttcacctagttttccagttgtttacagcaggagggaaaactcattccttttagtccattttcagtagaaattctattatgtttttgcaacattttcataaaatattattaaaagaaaaagagattttaatacctgaatggtttagcttcagcaatgtgggaaaactcacttatattgacatctcatttatacatgatacaaaagtttaataatgtttatattgtaacttttacatgccagaaattatggtaaacattaaatttctattcagttagattttctataacattataaggtagatgcttttattattaccattcgcatatgggaaaactgagaaatagactagtttttcaaaatatacagggctagtaattgaaaaaccacattacacaatcagttattctctatccagatgctatattgttgattgatatactataatacacttcctcaggacagatgttacagtatgatctctataatgttaacagaaatggagaacgacttcaactttttggctagtttcaccttttaaaattaacttcttattaacattaacaagttttaaaatgatgtgacatattttattatttgaatggtgtgtaacaaaacatttgtatatatatatgaagcttccccagatgaagttatatagggagaaaattccctgttttcttagctgagttgaaatgtgggtgttttggttaggcatatttaatctgtcatagtatttcacatgaaactcttagcgtgcatccttaaagtaattatataatagtttttaaaatatttaatgtcgtattctacactatgaccatcattagcagttggatatattaggtattctagatgaaattttcattccatcacatatttgatttataatatcatgatccaaatgtcttggtgatttagaaaaactgtatttacaaatgtcatgaaatatcaccacaggttttagagaagaacatactttcaattttttttattttgatttttcagattgcattctcacaacacaatacaatcatggaccttgtgcagttttttgtcaccttcttcaggtaaaagtttgctttgactgactttgaacttttcaagcctgtattctgatatatgtcctgtcaatctgttagataatcgaccaattctaaaaccttaaagtatcatagagtatgtcttgaatagctttatatgcttaaatatatcccacagaggagaggtaacatagctgaaatgtacttgtgcaagattattttgctgttatactatttaatagccaatggattcagtggaaagaggataactttgtgtcccccatcacataaataattatagcctgttttaattaatgaaattaacaatgcatgcaccacatggattagttacatctacaagaactaaaccaatttgtttatttcttagttaattttgttaattgtgtgacatattcgttgtaggttcataaaaagggctccacagtgaagcagctttgtaaaatgctacatgtcctaaagttaaatagtgctcttttggttggttttcaactggcattacttctcaaagcttttaaaatgctaatttgcaatatgtcattctacaagagaggttatagtttgtagcatttctcaaaacatgaaaactgttttcagggaacatttattttcatttccatgggatgtaaatgtagagactctgggttaggagtttaagttataaaatatctgtgttatgagatcgtagatcctctggattggaagagatcttatttttgttaacattattattcacgtgtgaagtttatgctggtcatttgggtgcctttgtacaaattagacaaatatgacttctccttctggcagatacagccccacatcatggcacacaaatttggaaatagtgcagtatgaattttaaccaacactcaccaacttggctgggctgccatacagtaaagacctgcacaactcaatccttagcacagatgatgtatttggaacttgtctaaacacaaagtaaccatcatctttttgattgtcttgtccagatatccataaagtatttgaatttctaataccttcttcactggagtcagcaaacattttccattaagggccagatagtaaatatttcaagatttgtgggctgtatggtcttcatcgcatctatgcaacttttctgctatagtgttaaagcagacaaagccaatatggaaacaaatgggagtggctgtgttccaataaaactttattataaaaacagctggtggattgaattcagcctgtggacataatttgcccaaccactgatcagttttatgcctgaatgcctttaatgacaggaagctcactagctcctcagatggcattttctatcatcagataacaaattgttctttataactgagctgaaatctgcctccctatgatatctctcctaattcctccatgtgggcccatatataacaatttcaatttctcatttccatttacagcccttcagatttgtaaagtattttctacggtttacacattccttgttcatttttctacttctcttgataagagaaacctttgccatattggtcagtttactctgaaaacaatcatgttcatccatgcaccttaaaatattataatttctataatgtatttctataaacatatttatcactaatatgtgtaaaaagtgcattcgtactttaaattgttccttaaaatgaaatttgaggaaacatcttaaatatgtttaatattttacaactttgtacttcagaaaacaaatgaattttaaggctattaacaaagttacagtatggttttagaaagtactagaaattacagttgaacaagcattattgaatgcattaaaacaacttttgttgttgttgttgttgttgttgttgttgttgttgagacagggtctcaccctgtcacccaggctggagcagtggcgctatttcggctcactgcaaccttcacctcccgggttcaagcatttctcctgcctcagctcctgagtagctgggattacaggcacgtgccaccacgcccagctaatttttgtatttttagtagatacggggtttcaccacattggccagggtggtctcgatctcctgacctcagatgatctgcccacctcggcctcccaaagtgctgggattacaagtgtgagccaccatgcctggtctaaaaaaaactttttgatgcagaatagtctggaagaaaattcactgaaagtttggttaagtgaaaaatttcacaaagttgaatatgtatgtaaattatttgaatcttgaggttttttattttaagcttttgaatttgtgtgcatatttaaattcaatagctcttttgttaagtaaaagaaaattactgttaatgtgtaccatgtcttagagatgatcctatttattatgttgtcatcatggacaatgtaaaataaaatattctaatctttgggtgtgataaaatatatttgatgggttttttgtcatttaaattcttccagtagtgaaatgtaaattagatcacttaaaaaactgggtcattgttaagaaaaatatggacaggatattttgaagcttatcaattattaagttttataaagctactgctaaactttaggagattttaaaacaggttaacatttatggagacccctcaatcaggccatttttactgttattgctgttattttggtaacagagctgagtgcgtcagctttgcagtttagccattgttctgtaggggctggttctcaaactctttgttagattttacctctatattgtgtgtagttctgatggtaaacataattgggccagtactagggagatcacttacagacataccctggctctgttcttaatgttttatgccatcttaagtaggtcactattttagtttgtttgtattgctgaaaaggaatacctaaggctgggtaatttataaaaagaggtttatttggctcacagttgtgctggctgtacaagaagtagggtgccagcatgtgcatctggtgagggtatcaaactgcttccactcatggcagaagaggaagcggagctggcatgtgtagcaatcacatggggagagaagaggtgacagccagagactcctttaaacagccagctctcttgggaactaatagagtgagaactcatttgctaccataaggacaccaccaagtcattcacagggagtctgcccctgcaactcaaacacctttcattaggctcaatctccaacgatgggtatcaaatttcaatatgtgctttggagggtcaaatattaaaactatagcattctatccctggcccctcaaatccctggtgttcttctcacatacaaaatataatcatttaatcccaatacttcccagaagtcttaacttgtttcagcatcaactcagaagtccagagtccaaagtctcatctgagactcaaagcaagttcctttcagctttgagcctgtaaaatcaaaatcaaattatttatctccaagatacaatggtggaacaaatattgagtaaacatctcattccaaaagggagaaactggtcaaaatatagtgataacatgctgcatgaaaatccaaaatatagcggggaagacattaaatcttaaagctccaaaattatctcccttggttccatgtcctgcaccctgggaacatggatgcaccatagccctgctctactaggcaatccctggtgggtactctcttcagggcctccaaccgcatatttctgctcagcattgcctcactagcatctgtctgcagggtctccacccctatggcaggcttctgcctgggcactcaggcttttcaatacatcccctgaaatctcagtggaagccgacaagcctctagtactcatactttctagcctccttcagtggcagtaggcacaatacctggggccatttgagcagcgagatgtggggagcactttctagagatggggcatggcaatgttgtcccaagcctgtcatccaaaaccataccatcttccttgggctcttggtctgtgatgggaagcccagaagcctgccagatttgtgaaatgccttcagggtctttcccccattgtctttactaatagtacctggctccttttattcatgctactttctttaacaagtgtttgctaccccagcactcttctgaaaacactctttccttctctgccacatggccaggctgaggattctacaaattgttatcccctgctttccttttgattatacattccaactctaggttatttatttgctcctgcatgtgaacataagctgttaaaagcagccacattacttcttgagcactttgctgcttgtcatggacacaatgtagcaaagttctttgacagggcataacaaaggttatctttgcttcagttccagtgatttcctcatttcagtctgagaccctcaacatggcctttactgtctatatttcaatcagcattttggtcacagccacttaaccaatttctaagatgttccaaactttccctcatttttctatcttatgagcactccagttctaaagccacttttacatttttaggtgtctttatagcaacataccacttcctggcaccaattttctgtcttagtccatttgcattgctgtaaaagaatacctgaggctgagtaatacataaaggaaagaggtttacttggctcatggttctgcaggttgtgcaagaagtatggtgttggcatttgcatctggtgagggcctcaagctgtttccattcatggtggaagaggaaggggagctggtatgtgtagagatcgagatcacatggtgagaaagtaggcaagagagaagacagaagttccagactcttttaaataaccagctgtcatgggaacatgagacacaacgatggcacaaatccatttatgatggatctacccctgtgacccaaacacctcccattaagccccacctctaacattgagtatcaaattttaacatttgatttggaggatcaaatatccaaactatagcagtcacctagcttctctaaatctcagtcctttcatatattgaactaaaggtttttttttcttgttgttgctgtgaaataatatagtaaataattcaaaaattgaaaagaataattttttaaataaactcttcttgtgtgtaaaatggaaaagtagatgtatctgagtcagaaaagtctgaattatttattttaaagaactaaattaaatggaaatttggtagagactactatccctgtgttagacttttagtggtggcattaattttctatatcattggatgacattatattttgtatttattaacttgtccagttgggagtagtttcagagattaccagttggtcttttccactatgactgatcttatcctataagccagggacacagtgtagaggttattccagctaccttgtacatcagttctatttatacacttaaagagtggggaaatgaccaatgggtggatccattgacatagtgggcacactgtgagcaagaatttagtcagaatttgttatgtgcccccaccccatgaacaccccaactctaataagaggacatgatgatattttgaatgcttggctatctgtgtctaatgggagtcaattaggccctcatgtctaatggtagtcaaaatgtctgcttattcctcctgtactgtatatatatcctcatgcatataccaatgtatataatcaagtttatggtgtaggtattttcagggatcattttacccacttttcaaaatgtttcagggaccttccttctatggactcagtcacctgattagttaatcggttttggattttaaaattagctgaaatctgggaactgtgaagagaaacatggccctccattgaagcaacaaccctcagtctcctgttccttcattcttacttaaaatgaaaccagatgttaaatagtaccactgttggctgcccacctattttcccttcagaataccatgccttattaataatccctacaactctttgtgagccaacccccttggcagttcgtccaatcttgttgatctaattatggtaattgtggtttctggattctggcagttaagcgctgacacctgtcgtctattacattgggtctccatctttttatggcaattaacaaacctagccctgtgactatctctcgtattttcgggactgctctgaagaggagagccagctctaagcctccttataatactggtgcctctcttatcagcatattcataacagccttaatgcatagtttgtcctctgagtcctcccatggaacacaacctggtagttcttctggcctcctataatataaaccattccagcatatccccttctctcagtgtttttataactttctcttccataagccaggacaacccaggcatttcaatttcacttgtactggacattgcatttttcaggcttctacgagtcactctagcaacaagtttgctccattccctggaatcctcagtagggtattacatctctgtggtcctgaaaatatgcaccaaaaccaatgagtttttatttatccagtcttaacatttcgttgccctttatcaaatatttaaatctggtcatacttccatggctcctgccagtacgtgctccctaaatcttgcatccgtatcaattgtgtaatccattttctttcgtatcaggctcagttgggtcatgctgtgatttaatccccctaatcagtctggcagccaagaaaagaagtggtgacagtttgtgagggggcacctgttacctaagagagaagagagctctttagtgtcttccagcataacgaaatgctaggtattgctagggaagcggttggtaaaaccaacatcctcagaagcattcattcatatattcctattccatatttcaggttcctaggtctcctgaaccatggccctttttgcataacacaacttctttggcttagcattctgtcatctctggagctctgcaactctacaacaattagatcatcatcctgctggtcattcatgttggcatttctgctatcagtcatcagggcctcatttaaagctatgaaagagacccactggctcttttatttagccagtaaatggtttgttaatggccttcagtctctcattatccctctgcaggtatcaatacaacataatgataatcattctactccactctcttttgaaggtgttttccccatcttccaagcacctgaattgctgtaccttcaagtattttctctatcagtgcattttctcaggtcaccactggtgaaatccagcaatttaagtcttctgccaggaactgtgttccacccaccaacatggatgttgtcctcttagcctgccaatcagtgagtgaatcagttcctcatctccatcttaccttctgtttacttggaccataagtcctctgagacacagaagccaagatgggattagataagcaataaacgtgttaggggaacttctgtgaggggaaattgggagaagggaggggagataatgggagaatttgagaccacaatgcctacctgcctttgtgagggagagaagcaagaaagggaaggtgagtgaaagagcctgagaatgcagggcacttctaagaatgtttaacaccagtggtgtagccttgagcaaaagttacccatcaaaggagtcttccatctcccaggaacaggcccgccttggtatttctgccatgtttagtccttgactaaggacagcccttgggaagcatgggctcagtgtgaataaaatgatggatttcagagtgcagtagctggggccactagtcagttatgctctctgccatcagggatcagagaggcacttttttttttttttcccccccgagatagggtctcactctgcctcccaggctggagtgtagtggcacaatctcagttcactcaacctctgcctcccaggctcaagcgatcctcccacctcagcctcctgagtagctgggaccacaggagcttgccatcacagctgactaagttttttgtatttttggtagagatggggtttcaccgtgttgcccaggctggtctcaggctcctgagctcaagtgatccgctcacctcggccttccaaagtgctgagattacaggcatgagccactgtccccagccagagaagtatatcttagtggttggcacaatggagttatttgttgtgtgatggttgatagaactgacctataaaacctgtaaaaaatgattttggtaatgtgtttgtatttatttttgtgtagtttatatttttgagggtagatttttaaatttgactaagtttcagtaatatttgtgtctatggaggtttttaattttttcctgacctagttggtaattggctttttaatggaagttgtactctttgtttcattttataaattcattgacatatttacaatattaatactctgaagtttgttctatattagaattgtgcctacccttttattgagaattttgcctatttttccttccttccctccctccctccctccttccctccctcccttccttccttccttcctcccttcctccctccctccttccttatccttccttccttctttccttccctccctccctccttccctcccttccttccttccttccttcctcccttcctccctccttccttctccttccttccttctttccttccctccctccctccttccctccctccctccctccctcccttccttccttccttccttccttccttccctccttcctttcttccttccttccttccttccttccttccttcctttcccttctcatttctaaaaataatctgcttcagctgcattctgtagacattaatatgtagtatgctggtctcatagaatgatttaggaattgttccttccttttcactttttgggaaaagtttgagcattggtattagttattttttaaatgggtagaatttatcagtgaagccattgagttcagggcttctttgttgtggtatatttgattactgattcaatctccttactggttataaatctattccattttctattcctttatcattcaatcttggtaggttttatgtttctagggatttgtccatttcacctagcttatccaatttattagtgtataattgttcatagtactctcctataatcatttttatttctgcagaattggcagtaatgacccgacttttcatttctaaattttgtaatttcagttttctttctcttttctttttttttggtcagtctaactaaaggtttgccaattttgttgctctttttcaagaatcaacttttggtattgttgattttctctattgtttttctattttctctattgtttatcttgctctaatatttataatttccttcattctgctacctttgaatttagtttgttctttttctagttcaagttgtaaagttaagttgcgtatttgagatctttcttcttttttagtatgtttataactaaatttcccttttatccactgctttacagtgttccatgagttttggtatgttgtgttttaattttcacatttctctaaatattttctaatttcattgtgattttgtctttcaaccattgatcaaatgtgtgttggtaatttccacatactttttaatgttcaagtttttcttctgtttttgatttctaactttatcccactgtgggtggtgaagatactttgcacatttatcttttaaaatctaccgagatataatttgttacctaacatatattctgtcctggagaatgtcttctgtgcccatcaggagaatatgtattctgttgtttttaggtagaatatcctgtatatatctattagatcttggtggtttattgcattgctctagacctctgtttcctttattatcttctgtctgattgttctatcctttactgagaatggagttgaattattgttttaatcatttggatttctctctgttcctattgttactttttgtcttaaagaacatttttaacttaaatatagtatttctttattagaatttgtctatgtctttttgcatatcttttaaaattttttctcttgttatattttgtgtatgtttcttttataccaaaaatatctggatattttggttttgttttaataatctgggaatctcttaattttatgtgacagggaaataaatggaaattttcttttttcttctcttctgatttttattaattgaatgagcttcttattaattgaatgagcttctaatgttcttttattttccttttagcagtttaagaattatagttttttttatttaatgattactcttaaattttaacaagcatatttccctaaccaacaataatattaatcagtatgtcttttatcctcctgaatcatataggagaactaaaaaacttcaaaacttttacttatcattgtctaatttttaaacgttttccaatttctaattttaatttgtgttttatttggtgatataattcacatataatacaattcaccaattgaaagtgcacagttattcttcaaccattattgcaatcaattttagaacatatcatcatccccaaaagaagccatgtactcatcagtagtcactccccccttttacatacccctagttctgaaaaatcactaatctactttctgtccatagatttgcctattctggacatcttatataaatggaatcgtacaatatgtgttcttttgtgactggttcctttcattagcacaatgtttcttatccgtaacgtagtatggatcagtactttgtttctttttattgctgaataatatttcatcttatgtgtataacacattttatttctctattagttgatggttatttgagttctttcttctttttcactgttgtgaataatactactatgcacatttgtgtgtaagtttttatgtggatatatattttcatttctcttaagtatataattaggagtagaattgttgatcacatggtaactctaggttaaacattgtgataaactgccaaacatttttttaaagaagatgtatcattttataatcttaccagcaaggatcagacatttattttttccacattcttactaaagtttgtattaactgcctttcttatagccatcttagtgggcataaagtggtaagagatgatgcatatttagaggaattaaaaatgaaagattaaaggaatctaaagaatacaacaggcaaagaaataataagagttaagcgcttgaaaaacaagaacaatcaaagatgactacatggaagcaagcatgcaagtgagcagaataatgcaaagttaagtatagtgttcatgatttgggaaaaataagactttttattattattattatactttaagttttagggtacacgtgcacaatgtgcaggttagttacatatgtatacatgtgccatgctggtgtgctgcacccattaactcgtcatttagcattaggtatatctcctcatgctatccctcccccctccccccaccccacaacagtccccagagtgtgatgttccccttcctgtgtccatgtgttctcattgttcaattcccacctatgagtgagaacatgtggtgtttggttttttgtccttgcgatagtttactgagaatgatgatttccaatttcatccatgtccctacaaagggcatgaactcatcatttttatggctgcatagtattccatggtgtatatgtgccacattttcttaatccagtctgtcattattggacatttgggttggttccaagtctttgctattgtgaatagtgccgcaataaacatatgtgtgcatgtgtctttatagcagcatgatttatagtcctttgggtatatacccagtaatgggatggctgggtcaaatggtatttctagttctagatccctgagtaatcgccacactgacttccacaatggttgaactagtttacagtcccaccaacagtgtaaaagtgttcctatttctccacatcctctccagcacccgttgtttcctgactttttaatggttgccattctgactggtgtgagatggtatctcattgtggttttgatttgcatttctctgatggccagtgatggtgagcattttttcatgtgttttttggctgcataaatgtcttcttttgagaagtgtctgttcataccctttggccactttttgatggggttgtttgtttttttcttgtaaatttgtttgagttcattgtagattctggatattagtcctttgtcagatgagtaggttgtgaaaattttctcccattttgtaggctgcctgttcactctgatggtagtttcttttgctgtgcagaagctcttgagtttaattagatcccatttgtcaattttggcttttgttgccattgcttttggtgttttagacatgaagtccttgcccatgcctatgtcctgaatggtaaagcctaggttttcttctagggtttttatggttttaggtctaacgtttaagtctttaatccatcttgaattaatttttgtataaggtgtaaggaagggatccagtttcagcattctacgtatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattcacttggcgatgcgggctcttttttggttccatatgaattttaaagtagttttttccaattctgtgaagaaagtcattggtagcttgatggggatgtcattgaatctataacttaccttgggcagtatggccattttcatgatattgattcttcctacccatgagcatggaatgttcttccatttctttgtgtcctcttttatttcatcgagtgctggtttgtagttctccttgaagaggtccttcacatcccttgtaagttggattcctaggtattttattctctttgaagtaattgtgaatgggagttcactcatgatttggctctctatctgttattagtgtataagaatgcttgtgatttttgtacattgattttgtatcctgagactttgctgaagttgcttatcagtttaaggagattttgggctgagacagtggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacatcccatcaatacctaatttattgagagtttttagcatgaagggttgttgaatcttttctgcatctattgatataatcatgtggtttttgtctttggttctgtttatatgctggattacatttattgatttgcgtatattgaaccagccttgcatcccagggatgaagcccacttgatcatggtggataagctttttgatgtgctgctggattcggtttgccagtattttattgaggatttttgcatcaaggatattggtctaaaattctcttttttggttgtgtctctgcccggctttggtatcaggatgatgctggcctcataatgagttagggaggattccctctttttctattgattggaatagtttcagaaggaatggtaccagttcctccttgtacctctggtagaattcggctgtgaatccatctggtcctggactctttttggttggtaagctattgattattgccacagtttcagatggtgttattggtctattcagagattcaacttcttcttggtttagtcttgggagagtgtatgtatcgaggaatttatccatttcttctagattttctagtttatttgcgtagaggtgtttgtagtattctctgatggtagtttgtatttctgtgggatcagtggtgatatctcctttatcattttttattgtgtctatttgattcttctctctttttttctttattagtcttgctagctgtctatcaattttgttgatcctttcaaaaaaccagctcctggattcattaattttttgaagggtttttttgtgtctctatttccttcagttctgctttgattttagttatttcttgccttctgctaggttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaaaaacatctttatttctgccttcatttcgttatgtacccagtagtcattcaggagcaggttgttcagtttccatgtagttgagcggttttgagtgagtttcttaatcctgagttctagtttgattgcactgtggtctgagagacagtttgttataatttctcttcttttacatttgctgaggagagctttacttccaagtatgtggtcaattttggaataggtgtggtgtggtgctgaaaaaaatgtatattctgtggatttgggatggagagttctgtagatgtctattaggtctgcttggtgcagagctgagttcaattcctgggtatccttgttgactttctgtctcgttgatctgtctaatgttgacagtggggtgttaaagtctcccattattattgtgtgggagtctaagtctccttgcaggtcactcaggacttgctttatgaatctgggtgctcctgtattgggtgcatatatatttaggatagttagctcttcttgttgaattgatccctttaccattatgtaatggccttctttgtctcttctgatctttgttggtttaaagtctgttttatcagagactaggattgcaacccctgcctttttttgttttccatttgcttggcagatcttcctccatcctttcattttgagcttatgtgtgtccctgcacatgagatgggtttcctgaatacagcacaactgtatgggtcttgactctttatccagtttgccagtctgtgtcttttaattggagcatttagtccatttacatttaaacttaatattgttatgtgtgaatttgatcctgtcattatggtgttagctggttattttgctggttagttgatgcagtttcttcctagtctcgatggtctttacattttggcatgattttgtagcagctggtaccggttgttcctttccatgtttagtgcttccttcaggagctcttttagggcaggcctggtggtgacaaaatctctcagcatttgcttgtctgtaaagtattttatttcttcttcacttatgaagcttagtttggctggatatgaaattctgggttgaaaattcttttctttaagaatgttgtcctattggcccccactctattctggcttgtagagtttctgctgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaatgttggcctgccttgctagattggggaagttctcctggataatatcctgcagagtgttttccaacttggctccattctccccgtcactttcaggtacaccgatcagacgtagatgtggtcttttcacataatcccatatttcttggaggctttgttcgtttctttttattcttttttctctaaacttcccttctcgcttcatttcattcatttcatcttccatcactgataccctttcttccagttgatcgcatcggctcctgaggcttctgcattcttcacgtagttctcaagccttggttttcagctccatcagctcctttaagcacttctctgtattggttattctagttatacattagtctaaatttttttcaaagttttcaacttctttgcctttggtttgaatatcctcctgtagctcggagcagtttgattgtctgaagccttcttctctcaactcatcagagtcattctccgtccagctttgttccgttgctggtgaggaactgcgttcgtttggaggaggggaggtgctctggtttttagagtttccagtttttctgctctgttttttccccatctttgtggttttatctacttttggtctatgatgatggtgatgtacagatgggttttcggtgtggatgtcctttctgtttgttagttttccttctagcagataggaccgtcagctgcaggtctgttggagtttgctagaggtccactccagaccctgtttgcctgggtatcagcagcggtgtctgcagaacagcagattttcgtgaaccacgaatgctgctgtctgatcgttcctctggaagttttgtctcagaggattacctggctgtgtgacgtgtcagtctgcccctactggggggagcctcccagttaggcttctcgggggtcaggggtcagggacccacttgaggaggcagtctgcccgttctcagatctccagctgcgtgctgggagaaccactgctctcttcgaagctgtcagacagggacatttaattctgcagaggttactgctgtgtttttgtttgtctgtgccctgcccccagaggtggagcctacagagacaggcagacctccttgagctgtggtgggctccacccagttcaagcttcccagattctttgtttacctaagcaagcctgggcaatggcgggcgcccctcccccagcctcgctgttgcctagcagtttgatctcagattgctgtgctagcaatcagtgagactccgtgggcgtaggaccctccgagccaggtgtgggatataatctcctggtgcgccattttttaagcccgtcggaaatgcgcagtattggggtgggcttgacctgattttccaggtgccgtctgtcacccctttctttgactaggtaagggaatttcctgacgccttgtgcttcccaagtgaggcaatgcctcgccctgcttcggctctcgcacggtgcgctgcacccactgtcctgcgcccactgtctggcactccctagtgagatgaacccggtacctcagatggaaatgcagaaatcacccgtcttctgcgtcgctcatgctgggagctgcagaccggagctgttcctattcagccatcttggctcctcccaaaaataagacatttaatcatgttgtacataaacatattttgaaagagaaaaaagaagaaaatgtaactccctgaagaaaaaaggtgaacctaatttagtcacaggatctctacatcaaagagatataatcctagaatatttgccaaaaagttttttaaacaatgtgtaaggacactgtgaagaattacaaatacaaaaaagtctctgtttaaaaaaataagattatgatgatggatatggtaatggaaatgacacctgaagatatggattttgctaagtagaaacaataaatgatttcttactgtactggaagttcacttaggaattttctccatggtttttttgtggaatacagtagatacttaggacctaactgttcttgtaaaccaaaatatttaatgcggtgggagtaaactagtgatggtacgttttcttgcaacttagttaaaccagtgctccccatctagtttacaaagctgaggtttatcgtactagacactgaaatagacttctccaagagtcatatcagtaacttcacactttgacttaaatattgctttacacctcaaacttaacatgctttaaattgaatttactgtactgggaaacagtctctttttttccagttttctgtagctcagttataggtatcactatttaactcacttgaatacttgggactcatttaaatcctctttccttaatgacctacatgaacatcagttctaacttctttgtatcaatatattatatgtaaattagccaaagtggtaatttaaacataaattattaactccactgtttaaaatcttccttttacatttataattcaaagtatgagtattctcatacttaaagtataccagtcactttttcattgttagagggggcagtggttaattacttgcctttttttccagcatttttttggtccttattgtttgttttttacttctgttggaagcattttaaaatttctgtgcagtaaaattccttttgcggggagtacagttgtgtgagttttaacacatgcatcatttattataattaccagctctcccaggatacagaacaatgccaaagccccagtgaatacctcatagagccttctttgcagtcagactttctccccacccctacacgctggcaaccattgacctgatctctgttcttgcagttttgccttttccagaatgtcattcaaatggcttctttcccttagtctactgcatttaagattcatccaaggtgcttttttgtatcaatagtccatttcatttcattgctaagtagtatttcattatatggatatatcacactttgtttatccattcacccattgagagatatggattgttacagtttttggtacttataaataatgctgctgtgatcaacatacatacaagttttacacaaacataagttttcatttctctagcataaataccaggaagtagggttgctgggtcacagggtggatgtatattcatctttataatagctgccactgtttttcagagtgactgtacaattctgtgctgcgaccagcaaagctcagggttccagttgttgcacattctcaccagtgcttggtcctgtcaacattttttattttagccattctgataaatgtgtagtggtatcttgtggtaattttaacttgcatttccttaatggctaatgacgttgaatatcttttcatgtgcttattagttatactttcattttctttggtgaagtatttttcaaatcttttgcctagttttaattgctttttagttttgctgtttatttttgaatattgaatgttttttgtatattctggatacaactcttttgccagatgtgatttgcaaatattttccctcagtctttgaattgtcttttcattctcttaacagtatcttttatggagtgaaaagttttagtttttataaaattcaatttaatgcatttttttaaaaacttgattatgcttttgacgtcatatccaaggactctccctaactcaagttaacatagatttctttctaacagttttatacagtcaatgcactacataacattttggtctatgacagaccacatatatgatggtacttataagattatattactatatgtttactgtaccttttctatgtttagatacacaaaaaccattgtgttataattacctacagtattcaatacagtaacatgctatataggtttgtaccctagtaacaataggctataccaatggctttcatgtgtagtagggtataccatcagtgtttgtttaagcaccctctatgatgtttgcacagggatgaaatttgtctaatgatgcatttcttagaacatatccccattagtaagtgacacatgactgtatttttacattgtacctttagatctgtgatccatttcagttattttttgtttatgttgaggtgtaattcaatgctgattatttcacatgtggatatcctgttgttacaccatgatttgttataaaggaaaaacctttccattttgaaatgcttttgcaactttgtcaaacattcaccatagggttccagttccaggtaagattgtgtaaacacacatctctttttctctaagtgaactcaaccatgaaacctggacaaaattcatgggcagctatttggtatatgatatcagcaggcagagcagagaagaacaccagaattcaaagtactggtgaaccatctagaagtttgccatttttcccctttagtgccccctgacctgaagtcaatgcaatttgaaacttggaagtaactactatagtttggacagggtaaagtcctctagttctggcccatgatgtggaaaagggaactcttaagctcagagagaatgagggagacctccctcccattttttctctttttcctgaattcactcacccataccccaggcagtctgaagcaggaacatgggcagcagcaaaatggctcacagtgggaagcagtaagaaccacaatcccaagggaagggaatattcctctaatcatagtggagctctggctacagagagccaagataaaccctgttgatttccttcttgtctgtcctcccagctcaaaacatggtacaataggaaaagtgtgtagtttctgaccacatgatggaaaagtagagcccacaaatccagaaaggacctaggagataatggagatagaaaagccttcccatcaaatgttatggggtggggggagggggagggctagcattaggagatatgcctaatgtaaatgatgagttaatgagtgcagcacaccaacatggcacacgtatacatatgtaacaaacctgcacattgtgcacatttaccctagaacttaaagtataataataataaataaataaataaataaatatatagtgctttataaacttctgggatctctcctgagctgcctgtgtgctgatctgatcctaattaacattatcatacgaaagaattggagaactgagctcatagatagaactctgctttgggcccggactgaacagtgggtagccctcccgctgcactgactcaagaagcacttcaaaagctttggatgcattgtgaccatagcctccagatggataaaacaaattatctctctagagaatatcaacattatttataaataatacctcaatccctttgtaaagtcaaggtagcacaagagagatggattaaagggtacagtggaggccgggcatggtggctcacacctgtaatcccagcactttgggaggctgaggcaggtggatcacgaggtcaggagttcgagaccagcctggccaagatagtgaaaccccatctctactaaaaatacaaaaattagtcaggagtggtagcacacgcctataatcctagctacttgggaggctgaggcagaattgcttgaacccaggaggcggaggttgcagtgaactaagatcatgccattgcactccagcctgggcaacaagagcaaaactccgtctaaaaaaaaaaaaaaaaggggggagggaacagggctctaatggaagtagtcattcttaagttaattaccaagtcaaggactatctctcaatgtttagtgctttaagaaaactttcatcaggtactagatctattacctatgcgtatgggaaaggtgacatttgatccctgctttgaatataaaataaattctaggaggaaaggtaaaaacaatgaaatatctagaaggtaatgtaggaattattcttcataacattagaatatagaatggattcttaaagaggacacataaaatactataacaaaattagactacaaaaaaacctaacactttttcttatcgaaagacaccattagcattatgacgagtcaagtcacacagtagtacgaaatatttgcaaactgtataaaagccaaaggccttatattcacactatgtaactcatataaatcaattaagaatagtctgaaaactcctttctccaaaaatgacaatagactgacatacacttcacaaaagaagacatccaagtgtccaacaaaatatgcaagagtgctcaacttaatttttatctgggaattcaaattaaaaccacaatgtaataccattatatacctactacagtggataaaaagaaaaagacaaataataccaaatgttggagaggatgcagaactattcatacttttagtacactagaaattgatgtaatggctttgaaaacaagttgacattatattctaaagttgaatttacatatactctgtggcccaacaattccaagtcatcaaagtcatgtgaaccatatttatagaagcatgttttacatgccccaaactgggaataatcaaaatacccaaaaataatagaatggaaaaatatactcatataatgtggagcaatgggaaaataaaacgattgccaaaggatcaaaataggtaacacgaacatagtgttgaatgatagagacagaaacaaaaaaaatactatagtgttatatttgtaaaaaatttagcaatagacaagactgaagtatggcattaaaaataaatgtgatagttccttttgagaaggagagaatgaattaagttctgtttcttcaagctggtggtttcaagggtatattgtctttgtgataatttattgagctatatacttagggtttctctattgtgttatacattaatgatttaggaaaggttttcaaaataattaaaatttttgtcctaactatatggttttaaaagatgtgcttcaaaaaacatttaatgtaggaagaaacactgtatacattgtcctttgtcactttttgttgcaagtttggaagaataaggtattatccaagtaggctacttgtaataggacttacccaggaagattttccttattagatattagtctttctaatatgccatcagatgaggcttgagactactccattttctgtagagttttaggaaaaaatttaagagtgactaaagatgctctgtagcctcaaaatctgttacagattttgaggttctgttacagaaccgtggcagggaggttaatttaggtactcttctataaatttttcataaatgatatctagtagattttattctttcccagccttcatttaactccctccacgtggctgtgtagcaaaccatccaatttaaatgggatttatctctcactagcttcatgattgtgccaatgccatttattgcatcgtcaatgtttggtaaggagtgggcatgtataatagtgtattatacaagccttggaactgctgcgttcatttttgttcctaagaattaaagaagcctgaaaataaagttggtgcgtagtgttatgcatagtccagagaatcataagaaaatgtagctaggaccctgatcagaccaaacctggaacttttcttcctttggactttgggaagtgtcttagtgtgcttgggctgccataacaaaataacacagactaagtgggttaaacaatagaaatgtattatctcccagttccagagggtagacagttcaagatcagggtaccagttgttggtttctggtaaaacctctcttcctggctctgcaaatggctgccttcacactgtgtactcacatggcctttcctccatgcatgcaggaagagagggagagtatgcaagttctttggtgtctctcctttaaggacattaattatatcagatcagaatcccatgtttataaacttcatttaaacctaattatgtcctaaaggccctgtcttcaaatacagccacactggggggttagggctttaacatatgaatttgagaacacaattcagttcataccagggagtgtaaacttcatgtagatctcttctttataccagtttgagttaggttttctgttacttgcatttgaaataatcttaactaatagtgctcctaaggtacagtaactcttgcttaacaaccctcagaagtttgaccaatttattctatgcgtgtattatttaccacattcagccactgggcttttgatttttcatctttttcaaactgatgacttgaacatataagcaattttttctttttaatattcatatttttattgcattttaagttagaagtgtattctgttaatatgttcgtttgtaagaaaaaatcctttaaatgtcatgaaggtataaaattgaaagatagtttgtggaataacagttattaggaggtaaatttcttcatttcaacacaatttccctgtttctaacatttttcagtgaaatataataatatgcccaaaccatcttttaaaatatgtacttaagacttgacatttatgatcagttaacctcaaattgctataaaatagcgacaatattatctctttttacaattggccaactagattaccaccagagggtatttatttgtcacagcaacctgcattacaatgtaacgttatagcacactatgttacttatattgaattcttttaattttccctaaatgagattacctaataagttccatttttttacattaagaatcctttcaaaatgaccattttatgaataataaaatcaagttattgaaatatctctccctaagtttttatgcttcccttttttattcctgtagctgatatacttgctttttaatgtttgttttctttctttctttctttgttctttttactccctatttcctttgggtggattgtactgaggggtgttgaacctttcagatcttttgatattattatcgtacagcatatttttttttgaaaaagaaagcccaattattcccccatcaatatctatatcatggagcataaaagcttttgcataatgtgataggaaaagaagacctgaaagaaagcagtagatacttattttttctgtgacaaatttgccacagtaccaaattaaaacatactagtgttcaatgatacccattaaaccctttgatttaagagatagagaaaagctaactggaatacacaaacctacaaatatgtcacttaacataataaaagtttacaatgcttctgtgtcacatcaagtccagtgggcaaaaaaggagccagtggaaggtgtagtaggctgttcttgcaatgctataaaaaatatctgagtctggataaattataaagaaaagagtttaattggctcatggttctgcaggctttacaggaaggatggtgctggcatctgctcaacttctagagcagcctcaggaagtttacaatcatggtagaaggtgaagggggggcaggcttgtcacatggcgaaagcaggaacaagcaagagagttaaggaaggagaagtgccacacatttttaaatgaccagatcttaggagaactcactcactattgtgaagtcagcatcaagccatgaaggatcttttcccctgacccgaataccaggccccacctccaacactgggattacaattcaacctgagatttgagttgggacaaatatccaaactatatcagaagggatagcatggaatacaggacactgcttcacatggtcatttaagaaattcagatgatggaaattctgtcattcttcaggtgtccaagattgtcaataaagacggagactctctagtagtcaccaaaggaagaatataactttttaactatgctgaataaatatgacaaatatttattgtttgcctgtttgttttgctttttagcaaagcaagtgttcttaaactgttttttgtttgtatgtatattttttaagagaactgtcacttttgtttgcaatgtaatttattagaaatcaagaacatttataaagtattaccctatataaggataataatgccaaatgagacattcagtattagaaaaaatgatgttattcaaatcaatttaaaaaccaatttagggaggctgaggcaggagaatggcgtgaacccgggaggcggagcttgcactgagccaagatcacgccactgcactccagcctgggtgacagagcgagactccgtatcaaaaaaaaaaaaaaaaaaaaaaagaaaaatcatttatttagcaaaaatgtattgacacctactatctcccaagtagtaacatatattttactggatttttgatatttactggagattatgagaatattattttaaaaatattttcttacactgtttattgattttagtagccaagtttctacgtcacgttagctcttttactgctaacctaataggaattaccatagaaagcatctgacacaaacccttaaagtgtataactccttgtttcaagaaagtgagattatgaaaattgtatattttatgttgtccttatacatcattacaaaaacgataatcagttgagtcataaagtttagataagaaagaatttaagctcctcatgagaaattcaactagtattcccgtctcaaactgaatctttattatgtaactcttaaggaagaggaatgttgtgaattattaatcatataaaaatacattttggtatttaagttgtatctactgaatataagtaacttttctatatacactattatttgctacgacagattttctgaaagaaactgttgacaggatctggtatctggatgtaagggatgatataattgaaatgtaaattgtttttaacattttagctggaaagtaatggtgaaacagagaagtcaggggaaagggaagaacttgcaatttaatactttgaaccttagacagtttacttcaactctctgtgacttagctttcccatgttttaaatgaacacatgacagtatgcttgatctatcacctgtaattttaggaattaaacaggtaattcatgtaaaacactcagcatagtgcttggtacatattactcaatagatgttagttgcttttctaatcatgaacattattaatggttcagcttggacatggtaggtttgaggtgatattaatatttgtatcacagttcttaagggtatgatggtctgactgaaattcagaaaaatgaacccttagatcatatctaaagtgtccattctcagtaccatattttaagagttacattggccaggtgcggtggctcacacctgtaatcccagcactttgggaggctgaggagggcagatcatgaggtcaggagatcgagactatcctggccaacatggtgtaaccccgtctctactaaaaatacaaaacaaattaagtgggcgtggtggcgcacatctgtagtcccagctactcaggaggctgaggcaggagagttgcttgaacccgggaggcagaggctgcagtgaggctgagatcaccccactgcactccagcctgggcaacagagtgagactctgtctcaaaaaaaaaaaaaagttacactattattccaggtataacaagagaagtataaccactatgataataattcagactagagaagggttcctcaaccttggcaatattagcattctgggctaggaaaatgctgttggaagggcgacctatatattgtatgatatttaagtaacatcccactagatgcctgtcaagtgatgaaacccaaaaatgtctctagatacactgccagatatcgcctggagaacaaaaacattcctggttgagaaacactgtacttgaggcaatcctgcatacaagaaaacctgtatattctttaaatatataaagaagttttagcatacagcagactgattttgtttaacctagaaggcagacacagcactggttgataaaagttagaatattggccaggtgtggtggctcatgcctataatttcagcactttggaaggccgaggccggcagatcacctgaggtcatgagttcgagtgcagcctggccaacatggtgaaaccccatctctactaaaaatacaaaaaaattagctgaggtggtggcatgcacctgtaatcctagctactcaggaggctgaggtgggagaattgctgaaatctggaaggcagaggttgcagtgagccaagattgtgccactacacttcagcctgggtgacagagtgagactccatctcaaaaaaaaaatatatatatatatatataaatatatattttcaaaatttgaattaactagaaagagaatgcactaacttgtcagtcagcaacttctcagctacaatgagtatttaattaggtgctggatcactatcagagctgtactgggaatttccttcctgggagggacttgaaactaagaaatcttttatagccctttcaaggataagatgctctcattttgacaggtgtaaagatgcagatttggaaatcatttaaattgaggtcgtagttgaaatcaggaaaataactgagctttctctttgggggcaagagaaaagaagagcacaattgcatgaagtgaattttaaggaatatccgtaatttaaaagagggaatttggaatgtaacctatattcatttaacctatattaggttaggaagtattaaggaaaacaaaacaaaacaaaatgaaagaaagtattcaggagagagttttaaagaatgaatgattggtattgtcaattgagaagttaaagtctgataatagagaaagcaccagtttatacaatttctagaaaatcatggtgactttctgttgaaagcaaattctgagaaaagtgtcccctaaaatattgaatattacataaagggtgctatgttaaaaaatcacttgtatggttggaaaggttagtatcactgactttttaaaaaatagatttcctttgattctggaggcgggattagagaatggatatggaaacagagtgattatgggatggatagtgggcacacttagagctgccagcatatggaaaggaaaaaagtttgaggcttaagtagctggatttgtattttggtactacgacttagtccgtgtgggactataagcaattaacttcaaaatctctgaggactggattcctcttttctcaaataagaatagtatatactatcttgaaggatttctaagactaaatccaatcatcgatgtgacgtactagcacagcatctggaatgtgcgcagcactcaatggatagatgttaaaattgacattgttgttatcgttgtcattgaaggatattctaaggtcttctgcttcaaatgaggcataggcaaggagaaaaaatatattgaagacttgacaagagtggaaagtgtcaaaaattgccactgcttatgagtgacttaagtgatgaacacaatgattaaggatgagaaccaggtttttcttgtaatgtccagtgaccagcgaatttgtagtgtcccaggtctgttcacttctgggtcttctcatagcataatctatgaccacagagcaaagaaagggaaaataaacagtgatacagggttgagattgattaatgagattcatgtaaatctctgtcattttgagatttgtcaggcttgagttacttctaacaaagtaccctgcattatcatagtttattgcatatagtacctaatatattagaccacatgtatgaacattgtaactgacttatttcttaaagtaaacattagcatatgccagggtttctcagcctcggtactactgacattttgtattgctgatcctttgctgttggggacagtcttgtgcattgtagaattcttgcaacacccctgcactcctctcccagttctgacaaacaaaaatgtctctagacattgccaaatgattgccaaaagggttgggaaccaaaggttattttggttatttaatatgttcatacataaaggttatttaatatgttcatatataatatgttcagatgtaatttaatatgttcatatataaaggttatttaatatgttcatatataaaatagtgataaaaataatataaatgtacatgtgtgacgtttggatttataaaatttccatattttataactcataatagcaattctaaatagattttggttgtgatttctgttgcttcataagaccaatgtaattataaatttacattccttctgacagagaaaattctaaatattgaccataatctatagcaagaaatataaatattttttctacctgtacattttggttttgagagaacattttaagcattggaaatttatcatatttttgattgtttacctagacaaagttattacttatatatatatgtatttgagtctttcatgtactgttttttcattacatagttcaaataagttttgagcaaaaattatttgtgttttattttccagttgtttcctatccttattgctggtggctgctgtggtatggaagatcaaacaaacttgttgggcttctcgacggagagaggtatcagtaatattatttaatcttttgtttaaagatttaagcaaatatatggatctctattgtctgttaattaccatgctctcttggaatgcagaatttcaaatcatttttacatactaatattcaaaaatcactctagtattttttaagctgtagagcaaactttatcactgtaattttaagttagtatttgtaaaagcattggtttgttgcaaacagtttctaaaaatggtattggaatttatagtgaatacaattattatgtttaaaaaattttgtaatatatttaacaggcatttagttatgctataaagacatactttatttttcataagcgtctgttgaaatttaaaattctgagtgataaatatttatttttggtttttgaaaaatattttatctcctagaaatttattataacattctttttttgggaatcaaatcttttccattttctgattatctaataatccaactctgtttaaagagcacatccattggataaatttctgtattagaattatttttctcgtaatcctaaaattgatgaaaacaataatattcttacaaaataacaactgattatataaattgtgtatattcgttaatcgaaaggaacgaagaaacaaaatcatctgaggagcaaaagtatgcagtagatttattgttcatacctcatttattcaaaaaactagtttctgtttttatcagtattcttttattataatgtattctattgtattaatcttaatattttatttgctattgcatttctccatatatttctatatggatggtttttgtaacaatataaaacaacagtataattgcttaccttcttttttccacataaaaaatataatatttaaagacatgtaaaaataatccagagtgttctaagctatagaattagtgagtgatatgggttcttcttagtctatttttaagcacccatcaaagatcagtactatctataatatatttgcaaactggagtccctccctgtcttcaaataaatcattcatcttaatactctctgcctctctgattttctgtttatggccagtgcagcatcagtgagggtttacttggaatgactgtatgttaaaaagtaatcccatggaaaaagagcttattaaatataaatatataactattaggcaggaagtggaattctctgcagaggtaaacaatcttctagacatgttagatgatctattacagtaaaattatagattcaggaaggaaaaatcataattataggcaggtagtgtgaaggccttccttccctaatggaataaggcaagtgacaatttatgtccttaatcattagaagagaaggctgaatcaatcagggagcctctgttcccattgcatcctgaggagcactatttaaatatctgatctctaaaatttataaaatgcatctatgtaaatatagcattgtgaaaatatcaatttgtaagtaaaaaatatctgccattaactggcagctgaatgtaagtaagttgtctagttaaatttccttacctcttaaaagaaggatttgtaccctagagctaattctcagttgtggtctagtcttttgagccctataaatgtttacatgtagtagctaaagtttagaaatgatatttaatatttgttaaaactaatatgaatagtttagctataaaactttcatacttctcaaaatgacaaattgattttggctaatattgtattatctcagtgtagtaatgctgtttattacatactaatcaggtgctctggcaagttgatactacttcaatttttaaaatatagatataaatttatcttttggaagtcaaaatctttcaatatatgtggtagatgtggaaaggataaaagacaaatagtagaggggagctagattaggatcactttccagtttttatctgtattattaatattactgtgttctctggaaattcctttaatataatgcccttctttccaaaactcatccaggtagtgcttctttctattaaagtgtataatagtgtttgcatttaatttgctactgcttccgaaaaagaaaatgtatcttgagggtttatgttatgctatagcattacatgttaaaacatattttgaggaattttctgaaatttaattttactaaattcctttaaatgtaaaattctaaatgttatagaaactattcatatattgatgtccaaagtaaagatgacattgtctttgatgattattaaagatctgcaattagcaagtaattttaatattacaattgtccccccttatccatagtttcagttagtcaaagacaattgcagtccaaaactattaagatattttgagagaaagaaatggtgggggaggtgggaagtgacagagagagagagaccacattcacataaattttaggacagcatattattataattgttctatttcattattattgtggttaatctcttgctgtacctaatttataaattaaaatttatcattggtatgtatgtatagggaaaaacatagtatatatagggcttagtagtatccacagttttaggcatcctctgggtgtgttgaaacatatttaaaggggaactactgtgttaagaaattgtttttcattttggtcttaagagccctggagatttttaaccacactagttgtagttatgtgataattccatttatagactttatgtgagtggaggtaaaaatgtgtttatatctaatcctctctttattcagttttaaatattagattaactgtaatatttcccaaaggaaaagaacccactattatttctttatgtgaatgttactgtctcttcaaaacattgaagaaatcaattattgtaaagctcagaggacacctttgattagtaaaatgacagtttatctgttacagtaaatgaaagttacttaaaggattcttcttagaaattatgtagttttatttcagcagttatactagttgcttttctaaatgtaatgaaagtttaaaatgaaaataatctttggaaatgttttaatatattgtgttcattcaactagatgtgttactttttaaaccaaagttttgttttctcataaacatagatatactttttgtggcataattttaaattcagaggatagttagtcatgttatgacttttgaataacacccctgagaattcaggggctcttaaacacacattaaaaaaatgaaactacacacaaaaggcttcaattttgatatgaccccttcatacactaaccccaaacaaatttctgtggtgttaaaaagatgaaaactttcttttgggatgcgctaatgaatggaaacaataagtgtatattgataagtggaaatatttacactagaaagatgaattcatttatatagcttgtcctttttacagcggtattaaaaacatttagcttcaatggcacattcagttatagtcatcacattactgaaatatttgtcaggagcaagtatatgtaaaaaggagtctattgagctatttttatgcttgataatcttcattcttaatctgaaatttgaatattaataggtatcataaggcagaaaaatatgaagatattataattgttccctgcaatgaagatatttgatcatatatttggctatcgtgtgaaaatatgatgcatattttaatagttacaagaagttaatttttttccattttgagttgtttaaatgtagcatgtctctgtgaaactttaactgcaaaatctgtagaataatagatccataggcaaaggaagggttatttttacattaacttcatattactagtgagtctgagtatttgaataatctctacatttcatgtgatagcaatttttccatttttaattcttgtaaatttacagtttttttaagtttaaaaatattttaatgtagaactttaccacactactttttaatatttctcacatattacacttctcttctgcttcaaaatgaatacaggaaattttggaggataagacatgcccaatgagggattgaatttatgttcataataccctatctccctgcatattttgtaatcatgaagaataaaacttagatttgcattttttattatcaccctgaaatttgagttaaaaataataaaccaatacccacaagtagaattttagtagctttgagtaacaaactggttttccagaggcaaatacattagttctttccttctatacctgttttactggtacaaatccagacaaaagtaataatattaaactgtactttaataatgacattttatggtgtataaaccaattagttataaaatattctctgacgcagtgataaatagattctcatctaagtaatattaatgcaatgtagcagtgttttataaattaaactactcttttctccttagacactaaatatatttacagaaagaagattcggcacagaataaaaacattaaggaaaatgtgaaagtgttattttaggtggataaattcaaattaactgataaggtactgcctgcaaccttttgtagaatttcatagcacttcaaagttctgtattttgtaaatgtttaaacattttaacatatagataaagctttccattaaacacatgctttttaaaactcgttagtaaatatttcactcaaataaatgcctttgcagttaatggccacaatgtcaacttactgttgcttgtcatttgctttttattgaattgcaaactaaaatgattattattgtattaattttcttcctttatcctatgagactagaaattacaggtcttccgcatgcctattgcattatcatactttcaaaattttaacataaatttactttaaaataacttgagaagtcaaatatgtatgcagttaagatttgaaaaataactgatacttaccttgtaaacctgtttccaaagacttcatggtaaatatagtgctttcattttgctcagttcaacaaaggtgtatcaatttcttgctatattatagacaaattgataaatactgaggatataaagaaaaagatataggccccattattggggaatttgtagttttaaaacatttcaataaggcagacacacacacacacatacacgtgcaaagttcttaggggagcacctggatttactttattgtgatgtcatgcatagggagatagaatatatcgaaaagttttctggaagtcagattagtaatggaagtaaatgtgaactgtttcataattatacacaggattaatttcaaaaaaacccctaaacaaaaaaactttgggcactgtttttactgtatatacaatacaacaaatttgtctaaaatcactttttctttattatatgctattatctttatatttagacccagttacttagactaaaacattatattgatttattctaaaaaatgtagtctcgctaaccacaaaatcttatctgtattatatattcaaacgaatgtatatctcgatatatgtgtctgatgtttatgtgtgtatatgtgtttttatgctaaaaagttcattttttatctaaaatgcaaacttaaccaagtgttctgtattcttatttgctcaatctggcaaccctattttcaacacaaatgctcaccctggagctcaggggtgggttcaacctcataaaatccacaggaactcagagagaagtagaaaggaataattttctaaagttagaatcttgatttgttttcaaaataagggggagttatactgggcaagcaaaaataaaagatgtttactccgtatattatctatcaaaattaaaaactctttgactcaatggttagatttctgaaaatatatcttaaagatatatatctgcctagcttttcaaagtatactcatatatagacacttacagagagatttttgtatatcagaactatttcatatcattcaaaaagattcgagaaagaaattctgtgttcttacagtgggatattaggtaactgaaaaaaagaatgaggcatatttgtgttaatattaaattagtttattccttcaacaaatatttattgaacaactattgttgtttcaagcacatttttagacaaatacagcaatgaacaagccaaataaaatcccagccctcaaaaatgtttacagatcttaaaatctatattattaactggaaaatatatgacatagtttgtatgatgtttctatttgtataaatcacacatgcacaagcataatgtgcatggaaattgtgggtctgttggtatttgataaagaagattgactgtgttatttgataactataatataaacaaatagtcaaataatgggcaagttgagagaacatgatctaacattttaagttaggcacttaataaaaatagtatttaattttcacactaaaaatatatatatttgccctttacctatataaggaatttgtggagactagagtgcaatgctcaaagcttacaactagtaaaagaagaagctgtaacttaaaaccaagtctgtcagaccgaaccatacagagaactttagagatagcctgagtttgaacaagttggtttcataatggaccacttataatgtaacttatgcatctgtttgttgtactggaaatatgttatatttcatctgatattatgacacaatcattatttgatgtaccacttacgaagaaaacacagtacttattcaactattgcacaatgttcacttcccactcagaatatttattttctacttattgaaagagctcttatatgattatttagatataattttgtcatatgtcattcatatttatacagagaggaaaataaaagcaaaataaattgggtaaagttttgctacgacttattcaccttcatagtccaagtttttaaaaatcactttttgagttaagcaaaaatatattgtatgtttcacatagtatcattgactagaataatgaagtttatgtctgtgcagacaatgaaaactacatcacaactgtcatctggccagcagtgattatataatgtcattgattttaaaacacattagagtttagagatattaaaatgtgaaaaaatgtttcttagaatcaatcaaatatggtagaaccttctttataaggtgtttagtactaagcgaattaatgcatactaaggggttaccccactgcattttacctaacagacttcaataaatattagctgttattgatatgtaatataaagaatgatcagcattatacattaatattactaacaacaactcctgtatatcttggactcctcctccatttctactgtaatgcaatggttctcaatctagtaggcccttgagaatcacctgtggatctttaaaatgtgtgtgtgcgtgtgtgtatctgtgtgtatgtgtgtatttgcatgccattctactgttccatccccatcagatatacaaaatcagaatttctgtgagtgaggctcagccaagtgtgtttattattaaagccctcaaatgttctaatatgcactattggcctagaaacactgctttagcttctactctgacagagctgggaaactgtagaagggtttccaacaaacttgtaaagatatctgagttaaaaggatctgattttaagctgatcactgtgcttctgtgttcactccaagtaaaattggtttatggagaggagttaaatttttaatgttaagtttggtacatctactagacatctaattagatctatcgaagaggcaggagttgcatctggcatgaggaaacagagctgagtaggaagctaaatttgggaatctcagcacatagatggcatttgaaaccctgagcctagataaaattacccagagaggaggattaagccctgagacattcaaatttaagaagtcagagagaagacaagcacccagcatgaatactggaaagcagctaccaatgaaggtggagaaaaaccctgagcttctggaagccaaggaaacactgtataaaaaggaacagagttatcagttgtctaaaaaattctggtggttcaagtgaaataactgaaaattgaccattgtatttagccacttagaaatcattgctgaccccaacaacagcaattttagtggactgatggatgcaaaagtttgactgaagtttgatgagaaagaatggaacaagatgacttccagaatggcagcaagaggatcccctgagacctattctccagacaaacaacgctaactagtgaaaaaatctttaaaaaacaaacaaccgactgggcacagtggctcatgcctgtaatcccgacactttgagaggccgaggctggcggatcatgaggtcaagagatcgagaccatcctggcgaacatggtgaaaccccatctctgctaaaaatacaagaattagccgggtgtggtggtgcacgcctgtagtcccaagtacttgggaggctgaggcaggagaattgcttgaacccaggaggcagaggttgcagtgagccgagatcctgccactgcactccagcctggcgacagagcaagactccatctcaaaaacaaaaaaacaaaaaaacaaaaaaaaaaaaccatttaaaatacctggaaatagttttaagtgcatacggaaaacaaagaaacacttgttactggtggagggtcttgagtatgagttgcccgggtccttggagatttggacaaagtattgaacaaaatgcacaaagtagcagaggaatgaaatgcagcaaagaagcagcaaaagcagaaacttattaaagagagaaagcactccacagagtgggaggaggcctgagcaagctggtcaagggcctggatgcaaagttttctgggttttaagtacccaatttgaggttcttattggctaccccttatctggaagaaggttttgtctgtggctaaaggctgaggtgaattggcagcccatgcagataaagggatggtccctgctcggcctgtggcctatccaaggcactctccctttccatctgagatgtggcggaagggggagggctgtagggagagtagcttttgatcctttgttactcagcttggggagagggttctttttttctttttggtttagttttaggaagtttgtattaattggcctcaggttccctgcccccaaacctaggcgttttccttttgatccagctttgggaagtcagcatgaattggccctagattttctgcccccagaccttggtgttttctgttttagaaatttgctcaaattggccttaagttccctgtctgcagaccctattttcctgcctcaaacttatttaagaaaatctactaattctcagtaagaacagcaaatctatagcatttgagcctcaacttgctcccttcctacccccttctagctcactgtgactagcacttctcatccccccagctcccttttgcagatgctatattccagacaaaatcagctgaggcctgaggctctcttcttctaatgagccccacttgtatggcaagaagctcttctcaaggcatagcagcctgataataacagggacccagtctccctctctccaccttgcttatagggcagaaatttcatgactggcgagataatatgagaatataaaaaagtaacacctctgctcaacaccctgctcatgaagcaggaacattatttaagagagttatgggccactgtccccatcattagctctagagcttgcacaaactagcaaaatcaattcaaaaagataaaatctaaataaacctatagcaagcacagagattgcatttgttatttttaaatttccaattagatacatcaacattctgtttgcaacaagcacatctagcacccagatcttgttttctaatattagagaactctttccagtggttcctccattcctgacatactctcattcttggtgtttgtgtgtgtgtgtgtgtgtgtgtgtgtgtgcgcgcgcgcacgcacgcacatgcgcaacccttcttacgttttggtaccataagaaacttcaggtttagcttgtacacttcttgccccagtcctagaattagctatttctccaaggatctctggttccctttattttagcatacatattgcctagatcttgatttctaaataccattcaccaataaaaggagcttggatgcaaatcacatgagaatctcaatagatatagagaaagcatttgacaaagtccaacaaccttttaccataacaacacccaacaaattaggaatgaaaaggaaatcctcaacctgataaaaggcatctgccaataacccacatctggcatcatacttaactttttttaaatcacttatatcaggaacaagtcaaggatgtccactctctctaattctattcaacattttactgtatatagtagtcagagcagttaggcaaagaaatgacataagagccatctagattgggaagaaagaagtaaagctatctctatttgcaaataacatgttttgtaaataaaattctttagaaatccactaaaaaacctgttagaactaatacacaattttagcaaggttcaggatgccagagcaatataaaaatcagttgtatttctatacattagcaatgaaaaacctgaaagtaaaactaaaaacgaattcaattcaaaatagcatcaataagaataaaatacacaggaacaaacttaacaaaagcagtagaaaacatatgctatgtgtattagtccatattcacactgctaataaagacatacccaagactgggtaatttgtaaagaaaagaggcttaattgactctcagttccacatggctggggaggcctcacaatcatggcagaaggtgaatgaaacttattcactatcatgagaacagtatgggagagaccctccccatgattcagttaccttccactgggtccctgctatgacaggtgggaattatgggagctacaatgcaagatgagatttgggtggggacacagcaaaaccatatcactctgaaaactataaaacattgttgaaagaaattaaagaagacctaaataaatggaaagatactatatgttgatggattcaaagactttatgttgttaagatgacagtactcccaaacttatctacaaattcaacatgatacttatccaaatactaggtagtttatttgtagaaattgacaagtagatcctaaaatccacagggagaggcaaagggccctaaacagcaaaaacattcttgaaaaagaacaaagcttacacttcataaattcaaacttactatgcaagtatagtaatcaagatggtgtgatatggacataagactggacatttggatccatagaatgtaactgagaatctagaaataaactcttacatttatagttgattgatttttacaagggtaccaagacaattaaatggaagaaagattcatctttgcaacaaatggggctaggcaactgggtagccacaagcaaaagagtgaagttggacccattactcgtatcaccatacacaaataaagtcaataggaatcgatacaccaatatgtgacacctaaactataaaactcttagaagaaaatacagaagaaaatcttcttgatctttcagaatcttcttagacatgacatcaaaagaaaaggtgattaaagaaaaaaaaattggaattcattgaaattaaaaacttttgtgcttaaaagacaccatgaagaaaatgaaaatacaacctccagaatgggagaacacttttgcatatcatatatctgataagatatttgtatctacatatgcaaaggactcttccaagtcagtaatcaaaaggcaaattacccacttaaaaatgtataaagaatttgagtaggcatttctccatataatatatgcagtttgccctttgtattcatggtttccacatctgtggattcactcaaggattgaaaatattctgaaaaaatgttgaaaaatataacaataaatataaataaaaatacattataacaactatttacataacatttgcattgtattgggcactataagtaatctagaaatgatataaatgggaaaatgtgcataggttatatgccactatgacaccatttttaaacaatttacttgagcatctctggattttggtatccttgcggggatcctggaaccaatctcctgcagataccgagggacaactctgtgtgtgtgtgtgtgtgtgggtgtgtgtgtgtgggtgtgtgtgtgtgtgtgtgtttgtgtggtcagtaactcatgaaaatgaaaagatgctcaacaatgttagcattagcagaaatagaaatcaaacctacaataagataccactaaatgcttgtgatcgataataatgttattattattcaccaataatcatcaccaattatcaccaaaatgttggtgaggctgtggagaaattagattcctcacacattgttgttgaatatttaaaactgacactttgtagtgtaatacactctgacaattccttgcaatattaatgtttccatatgacccagcaattccactcttaggtgaatactgaagaaaaatgaaaacgtaggtctatataaaacttttacgttaatgtttatagcaccattattcattacagctttaaagtagaaatatcccaaatgcctaacaactgatgaatggacaaataaaaggtgatatatgtgtaaatggaatattattctacattaaaaaggaatgaagtactgatgcatgttataacaaagaaagatccttgaaaacattaggcaaatctaaagagacagtaagtaaattcacggttgccttgtgctgtgcttgggtatttgatggaatgtggggccagatggagaatgattgttaatgggtacatgggttctttctgggatgatgaaaatgttttaaaattagactgtggtaattgttgtacagctttatgaaaaatttaaatattattgaatcttatgctctaaatgggtgatttacaaatttctttgtagaaattgacaagcttctttgttgaaatggtttggctgtgtcccacccaaatttcatcttgaattgtagttcccataattcccccatgtcatgggagggacaagatagagataattgaatcatgagggccgtttcccccatcctgttctcatgatagtgagttagttctcttgagatcagatggttttataaggggattcccccttcactgggcactcattctctctcctgtccccatgtgaataaggatgtgttcagttccccttctgccatgattgtaagtttgctgagtcctcccagccatgctgacctgtgagtcaattaagccgctttaccagtctcaagtatgtcttgcacaaattgggcttaagttcataaccagtgtgagaatgggctaatacatttctagaaattgacaagtagattcaaaaacttacatggaaatgcaaaggaccctaaatagcagaaacatttttgaaaaagaacaaatttacagttcctgaattcaaacttactacaaaactatggtaatcaagatggtgttattatactacacagtatatttcttagttcttttgtgttgctatgaaagaacatacctgaggctgggtgatttataaaggaagaaggtttatttgcctcatggttccacaggctgtacaagaagcatgggaccagtatctgcttctggtgagcgcctgttaaagcaacagtgtaagattctttatattgcataaattactgtggaatgatagtaatatagtttccctgaattttgttgacaggatttgacatgttaaaagttgagtttgcaggtgataatgctacctgcattccatattaacttcattcatcattctgtaaattgttgcttaaaatatagaatttccttcatttaaagaattatgccataatttgcacatccgtgctgagcaattctcttcctaccaccacccacctccccttacaggggaatttgtttgctaggtatatactgttaacaggcatttatatacagatttaaacctaatacagaattcagcagtatgtattttatatataaagtttcttctcatgagcttttaaaatatattctactggttctaatttaaggaaaaaaaagctttaaacaaaataattttattgtgatttgaacatagttataatgctttattaattttctgaaaataaatttagtcatttaacaatacatagttgtcttagtaactattttgtattttatctcagaataaaaatatgtttgcaataatagcatcctgaataattggctttcacaataattcaaccacattgtaaggaacatggaaataggtaatatattgaatgacagatattgtgcatactccatcactagcagtggttcactataacagtgattctcaaccaaagaggatatcttaaaataatataattagaaaaaaaggcctagtctggttgattttgatatcctcattagataagtaattctgttctcctcatgtccaagaatcacatctgtactggaaatcatgctgaactggtgttcgacctgtactgtccttatctataaattacagggtattcctgctgcatagtatatttatttatttttaaattattttgatgccagcataattatggtctaatttagtttattgtcattcactgaaatgattcatgtactttaattgtgatatttaggtaaaccattattagagtatattgaatgaacatggtattagattcatgcatgaatgtaatattgaaaatgttaactattatagtatattaattatttccagtctgaaatccactgttactatattgtaacaattatgaagcattgtaaccagtactttgaacaagggcagtcaatcaaagcttgattctgtattcccacagcccattcaaactcattttctgtggccaatttgttctagttccttgagtagctagaattgaagataatttttttcttatatctctttttaatagatgtatgtttttcctttccttggcaatttggtattataaaattttattctattaatggaagagatttttagaagtcatctcctctttattggaaataaacatggaaagtttgctatcaaatcaagcattatttttataccttgtacatgttttcatatctatttttaataggtgatatgtctatatgtttcagagttcaacattgccaccagcattacccacccactcaattattctctcctctctatagccaatcagtgttatcagggcttttttgtgtgtgtatagttttctgaagttattttatacatacagaagcaatatgaatatacatctttttctacattacttacgctaataatagcatattctttataacctgtttttgtatatttttgcatgtaactgtaaagttctaataaattattataattctgaattattttgcaacataaaaaataatatttcacatctattgatgagaagtcaaaactgtacaaacttattttcattatagtcacattttgaacactttatatctttatttctctttactatttatttctacagtggagcatttctaatgcacttagaatattcttttagagagatatttttaagaattccaggataccaatccagctatgtaattctgagaaataatttttagaaccacactacagtggagtacctctcaaaaactacatggctctaactcaagtttataacagtaatataaggaaaatgactgagaatttcagtaggaaatttaagatgcagcaagctaaattacagtcttagagaattaaattaaaatgttggcaaactgctttagatcatgttataaattctatgaaatatgacaataatgtaaaataataaaaaaaggcttctgctactttttccttcatttaaatgaatgtgtgtgtgagtttgtgtgtgtgtgtaactgctttttatgttggtgtagaaagactatgtaattgcatggttattatgttatgcaagtatacatttgtaccatgttattgtgttgagtaatggtacagacttacggcattcaagttctggctttctacctatgcatttatagcaattaatatttattactttggtcctaatggcttgctttggaaattaacttagaatgacttagaagcacacactcatcaactactaatagcttatggtacaatagcatccaaatttcaaatctatacttggtaagtattttcaatcaaactatgtaagattataattaaaaactttaaaagtcgttatatattttgcaaatttaccatttgattatttttattatttattattgccatcctaaatttttctactagtataaaagtatattttgttcttaaaaatgccaagttattgccataaaataacattaatttccatagacgtacaggttagcaagattctactcagtctatttctctaaaattgtttgagtaaaagtgttagcttcttatttcttatttctattcatgctgaagtagtgacattgtgaactccaatgacatctataattggtaaattatctttgactttcagaaaacacataattgtttaaacaattctatacgatagctatagttttctttttttcattcttttttttattattattggagatggtgtcttgctgtatggcccaggctggtcttgaacacctaggcttaggcagtccttctacctcagcttcccaaattgttgggattacaggtgtgagtcattgcacctgggcaagagctgtagttttctaatcaaagtgcaagaaatatgctattcttagaagctggttttgtgttatatcatttaacatgaaacacgtatctcctgtagatgtggacaatttattattactttcagaatagttatttgcctaacagaagagctaacataaattaagcagtaaatcagttttgcttcctttagataattagtaatttacatataacctttggctattcttttatcttaggttattgatataagttgcataaaattgttttctatgtagaatgttctttgaaatgcaaaatctaattaaaatgcactattttaggacagttgagttgctaaatgatattacggagactattatgaatattttaggaatctgagtggagtatgtaagaaagctaaattataacctctatggactactttaggttactttatcagtcggctgaaacaaggaaaactgcccaggtacttagattattggatttttttacatatactatatttagaaataatgcaattatgactgtattatgatacctagacagtttcacattaagttacacattaatgtttgcaagatacactaaggttagtaaaggaggctaattgtggctgtagttattctgcccaggggctttcacatgcaccccaggaggctgctcaaaacaatgagtatcaacacatttataatcacttaatggcatacttattgatgaatcatattccaattactaacaaccgaaattcagttttgtggaaggcatggtaaatgatatacctgtttgtccagccaggacaaacaatgagtatttgtcaagagcctcctgtttgcttaacaaacattgtttagcaaggacccaatactgggtaaacaactgttgcatttagttttcaaactgaacatttcttaattttatagtgaagattgagtgtagaatcttatggtagctgtgaaatggtatgtagctaggtgattattatctagaatcttaatgtattaaatcacagtttagtgacgttaatattttacaaattaaagataatgcttttttagactgctgtccttcttttcctttaatatgtgtggtaaagtgaactactgtgttttaattactctttgatgtgtattgggataagtttttctaaatgaaaacatatctcattttgtcctgaagattaattcaaaattagagtttgcctaatgaaaacttttccatttaattttgcagatctattttatgcagaaatttatatcaattaaaagtacatatcacatgatttagccagggatggcatgcatgctagcaacctattaaaagatgaagaattgttaagattcatttcacttttgctgtctttgttgatagttttagtcttttactccaaaattttaatcatatactgattcaaattctatgttgatttgtaattttagaataatgcaggaactttttttaaattttgttaaaatgtacttattttgaatgtttcctaattagtgaattacctgctcattagtgaacaactaggaggtattttaatagcagttagtttaatgagaatggtgaaaaccaaatacattctccaaaaaatcttggcaaggagaataatgcataataagtaacagtcacaatgtctatgatctctttttgtttaacctttataaaacctgtatagttttgctacctgatgagtgaaatatttggtggtagcctgagtactgtcatcctttatctagttgttattctacttaatacgtctaattattgtgcttagaattacttattttttcttaatataaatgtttgttggatttcaaatgaaggtgactttgatgctgaaagctgacagttaatggtaacagtggaataacgttttatgaatgtaggtacgtagaatcatgcctggcagaagctattgtcatacatagtaagtggccagtgctcttttgttcaggctattaaatcatagtgatatgtgttatttcagctagaggaaaaagagaagtccttactcaatattgaaattcacaagatacagaataaattataattggtttcatcttttttatgttaaaaatttaatatttaaagttaatttaattatctgaatacaggaatgctaaacaatttaagtatatccattgaaaagaggatgcccaattactaaagctatgttctttttgctttattaaagattttaaagccagcaacatcactttggtagtgatattttcaggtaatattgatcataaagcatatatattcatgtctacatgaactggatattatcttaaatgtctttgccagaatttagattctaaatataaagctctcagcaagttcttaatgcttggaaaaaattcagcttttgtcttagcaagaatgtgaggtagtgcataaaaaacaaatgtaggttcttctatactagatttttaaaaacgaaatttgattttggagtgttaggttttatttcaatttaatttaatttttaaaataagtaatatattaacataattcaaatttaggaaaaaataaaaagttataaattaaaaagtttcacatttatctataacctagtccacactttccctccctgccttcatagataaacacttgtttattatctatccttccaggtttcctttatcaggatgttgcatattccaatatcaacatatgcaaatgtgtaaacatgtatccctcctttattatacaaaaataatatatttctgtatttcgttaaacctgagttcagacaatttgcacaacatttttgtgtaccaccaagaaagaaaaaatcttggcaattaaagggtgacagcattgattataaagaacattgcaatgttagaaatattagaatgtgaaaaacctcatctgttagagttgaagaaatatggtatgtaccctctactacatattactcttgtcacttatcaatataacttggatatctttccattgccaacctcttttgtttcttttattataaatgcattctattttgtagtatgattataccctaacttatttagtccctataaacagactcttgatgtttttctttttcattgttatgaactttgtacattgttcattttgtatgtgtgcaggtataattataggataaattccaaatgggattgcttgcttaatggaaattatatttgtaatttttatagctatgagcagattaccctctgtagggttttaccacattattttcctaccaactgcatgaagagtgttttgtcaaactttggatttttgctacctgctaagtgggaaatgatgttttaaagtggttctgatttgcacatcttgaagaaaagcaaagccaaaaatattatccagtgttcaagggtggtattttctttttctgcaaactattcatgtcctttactcatttttcaattagattgttaatctttttattctttatttctagaagctctttaaccttgagtaggataactgtttgtctctggtatgagttgaaaatattttttctctgtttaccatttaattctttaaatactttttttttttttttaacaatgtattactctgttaaagctgctgtaacaaaataccataaactgggtggcttataagaaacagaagtatatctcatacagctctggaggctgggacgtctaagatctaggcatcagcagatttggtgtctggcgaggggctatttcctgattcatagatggcaccatacagctgtatcttcacatggtgaaaggagctagctagctttctgctggagtgcagtggtgcgatctcagctcactgcaacctctgcctcccatgttcaagcaattcttctgcctcagcctcctgagtagctgggattacaggtgcacaccaccatgcccagctaatttttgtatttttttagtagagatggggttttgccatgttggccaggctgatctcaaactcctgaccttgtgctccaccagccgtggcttcccaaagtgctgggatttcagctatgagccaccacacctggcctctgccatctcttttattaaagcactaattccaatcatgagggctctgccctcataatctaaacacctccccaaagaccccacctcccaacaccatcaccctgggggttaagatttcagcatatgaaattttgaagtttacaaactttctgaccatagcaaacatgaagatatatttatgcttgatttcaaattttgtaaacttcttttatggtttctggaatttgagtcataggtagaaagactcagcttacttcaagtttacaaaggagtttacccagttatggcttcatttttacattttgtgtatactattagcttggtcaccccccagtgacctcagtatccagattttcatgcccatctgtactctctgtattgactgtagatgggggctatgaatgctttgaccagtcaactgtggttggagtgatgtgttggtagttttatgtttagcccttaattatactgacagttgtttttcttccctctttggagcttactaatgagatgctcctttttggaatctagctatcatgtataaaggcatcctcagggagaggcctatatccagagagctgacactgctagagagtgacctcaactgagccctcagttaggactccacgtgagctctcatttgagccttcagttgatttcagacatcccgagcaacccaagcatagggtttattcataatttgagcagagctcagctgggatagcttatctctccccaacatggcaccggctgggccagcttcactggggatggagaatcttccacccccattaactaagagttcagcacaggctgttggctaaggacctcaattttcctccatatgggcctatccatatagccgctggcttttcttataccatggcaattgttttaataggaggcagcttctagtccttttatagactagacctataatttccacagtgtcacctgcacctgtattatattggcaaaatcagtataggaccaggtcagacataaacgtgtggaaaaatggattgtcctgctttttcatggaaggaaggagtgatgaagaatttctatctttgatctgccacacatttaaatatttgcttcaacttaccgttttccagatagctgttaggtcattccaacactatctattaatacattctttacccccatattttgagatgctgttattactgcatgttatattcccatatacttttgggctttctgttagcttctgttgaattacccatccagacactactactacattgttgtaagtattgagaccttccaatgtattttctctctagtaggctggctgcttctcattttttgcttgtgtaattttgttatgtattattttgctataactattttgctaaatagattttataaagggtttgtgactttctggagaaaatagcttggtatatttattgttagagttaaaattataaattaatttgcagctattacctttatgatattgaaccttctaattcatattcatatattcctattactattcctaataaactaatatttctattataaatgttatttataaaattataaaatattcctattcatataagacatatttctgtgtcttaccgtctgttctacttttgtgtctttagggaatttaaaaatgttttccttaagtaggttttgtatattctctttcaagtttatatacacacatagaaaaagccatgtattgtatgatgtttatatgaaatgtgaagaaaaagggaaatataaagagactacctagagatggatgttggaatgaagaattattgcaaatggacagaagtttggttttgggggtgatggaaatgttctaaaattagattgtgtaatgacagttatattactctaaatatattacaattcatttaattgtacattacagtaaattttactatatatatagtattgcagtaaaaatgttaaaagaaagtcatagctctggctacagtatggagaatggattataggggaacaagggaagaggtagggagaacaatttggagcccagggtataagagaaaatagttgtttggactacataggtggtaatagaggtggagagacagaggaaaatttaggatttgtttttgaggtcaaatatattgtcactgctgatagattggatgcaacgggtggggaaaaaaaaagactaattctcactctacaatctagggttttaccttcaaaaactaggtacatggtggtaccttaacctaaaccataagaactgggagagacaaaaatgtgagggaagttagacagcagtcaagagcatcacttgaggtaaagtttgcaatgcctaaaagagattcaagaggggaaggttcacatagcagttggacataaagacatttggatatacaagtctgagattccagagagaggtctgggattccagagagagttctgggctgaatctataagtttcctaattaataccataaaatttatattcaagatccaagtcttgattaatgttaaatactgtttgtcaggggttgtttttgaaatgggagagttccctgattccccttgcaggacatatgattggggtgtggcttgcctgtttggttgccctgcagctcaaactgcttgagggagggggagcatgcagacgggcagatgcagaggccaggtgagcgctttgggctccaactccactgtagtgtctaggggtgagtgtctgcaaccccagttttgcaaagctctttcagctttgccttccgcagaaggcttgagtgttaatcagtttaatggaccttctgccttattgcaagggtaaagaaccagtgtgacagatttctgtatcctaagctcttgccaggcatcttggaagaattggatcacatgtgggctcaaagggtgagtgcaaggttttattgagtggtagaggtggctctcagtgatacggatggggagccggaagcagggatggagtgggaaggtgatcttcgtctggagttgggccacctagtggccggactctttcctgacttcccccagccaaattcttctcagtgttcagatgtccctcttcttctctctttctcccctacattgttccattgtctgtctgcttgcctcctcatcaatgtcctcacttgctggtctgctctggagcttggggttcagggtttacatgggggcaggatgggggcatggctgggggtaggatagggagtgtggcaggccaaaaggcagctttggggcacaaaaacagaaatacctgttctcatttagggccacaggtatccaggcttgagggtggggtctttgccggggaaccgccctcttctacccagtatttccctgtctcctgtctgtgttattttcagagcagaagtctcagtgtccttgggaatgttacaactcagtgagcaagataaataggtaacacaaagtgttaaattccaataccaggtgaaggcagatggttagaatagccttcaccaaataggtgccatttgagctatcaagaatatgtagccctttgcttgatagataaattggttaggatgttattaaaagtcagtatgggcacagagaaggtccttggaaaatactagcagttatgacagtaccattgctttcaaaatactgaataatcaaatgccaggtatgtaattaagaaaagagttgaaagacaaagctgaaaagatacttctgtgtccgattgtaggagaacctgtgacagacaggaaagaaatgggtaatctaaacttctgtaaaccacttaaagcagaaaattctttgggaagtagttatctcaattatttcttgcaaaatcatgattctgtttgtcttacttacgataaaaagcaaactagcaaactacagctgcagttttatatgtataagtacagccattatatataattgtatatataatacatatatatgtgtatctatatatacaaatataactacagcaatatatataactacagttatatatacataactacatatgtacatgtatatatctataactatgcagatatatatatctacatatgtacaagtagttttgtatatataaaactacatatatataaatgtatatatatatacacacatgaagcatgaatgaaactctttgagaaaaaagcctatagttgccaatgctattccactaaaactaattccttcaaatttacttcacttgtttttaggaacttatatcaaaagacagtaactagtatatcattatcaaaaatatttaatatcaaatctaccatgtatcttaatcttttatattttctgcaacttgtactgaatatttggctgaaattccttgctaaatgtgttaccatctacttcaatctcaatcacatttaaatcctatgttacttgggcaccagatgctccttagttgatttctgcatgctgatttcaggagccctagaaattctctggccattgctgataccaaagccagttaaggtttgctcagccctgttattgactaccaatttcctacacatagggtgctggcacaagactttccatctgtctgcctttttaattttaaacatagcctattttctttgtaaaatattagaaacatctcttaaacaaaattgctaatagacaaatgtaaatcatttggaaatggctataacttgtggaaattggttgagataatatttcaaaacaggttattgcattttaggtctgactcttaatgtgaataatatgatgtaactaaacttatagatattttaaaatagaatcttagtaaacattgttgctttttccttgcaccttttaaactcattgttatagtggaaagtgcttaaacactgtttatcccaagaatttataaaatatattattttaaaatatcagattttaaaaatgatttaagtagagcatgtgatatatattcatcttttaccacttaatgttgagttttagaaaatatgtgttgttaatggaccatcgactttcaagtcattttgtttactaagcttgaactgagatttgagcaattatgtgtgtagtaaaacctttaaaacagaatgcattgcattaaagaatgttcatgttcatttgcaatgaagcagagaatagtgtcagaactctgccctaactaggattaagttgagaagtaaactctgtatactttcttgcatttattatctgaatgtctgaaattttagtgttgttgacatctggagtgtttttcaacatgttttataatgtgttttactttcatttcattgttcatcacgtagtcatttgccgttcctgttagtgttttccaagtgttagaaacctttttctttctgcatgctaatgtcacctacttgccacaattgcatttttgcaaatattcttttttattttttatttatttttcattgcatgtgtttaaggtgtgcaagataatgttttgatatacatatacatagtgaaatgattattataagtaagctcttacctttttttgtggtaagagcacctgaaatctactctcttagcaaattttcaatatacaatacagtatttttagctatatccttctgctatacatcagatctctataattagtcatcctacctaacttcaagtttgtactttgatgaatatctctccttttgctctgcctctctgcccttgaaaaccactgttattctccctatttgtatgtatttgaacttgttttaggtatcacatatagatgagatcatgcagtacttttctttgtgtctggttcatttcacacagcataatatcctcctggctcatctatgttgccacaaatgccagtatctctttttttaagagtaaatatattccatggtatatacaccacaatttctttatccattcatgcgttgatggacacctgagttgtttccatatcctggctattgtggataatgctgcagtgaacatggatcacagctagctctgtgatgtgctgatttcgtttcctttggatgtacgtatacaaagcagagagatttctgagccataggataattctttttttcattttttgaggaatctcaatactgttttcaataatagccatgccaatttatgtttcaattaatagtgtacagggttcacttttctccaaatctttgccaacattttttatctcttttttgtaatagccatcataacatgtgtcaggtgatatctcattatggttttgatttgcatttccctgatgattagtgttgttgagcacttttccatatatccgttagccatttgtatgtcttatttggagaaatgtctatttacattctttcccctttttaaaattaggttatttgctattttactattgagctgtatgaatctcttacatgttttggatatgaaccccttacacgtacatggtttgcaaacgttttctcccaatccattaactgcccttttcttttgttgattgtttattttgctatgcggaagtaacttaatatgatatagtctcatttcttaattttggttttgttgcctgagcttttgctgtgatacccaaaaaaattatttcccaggtttatatcagagagcttttccttatattttcatctaagagtttttcagtttgaggtcttgtgtttaggtctttaattcattttaagttgatctttgtgaatggtgtaagataatgggcattttcatttcttttcatgttgacattcagttttcccaccaccatttatggaagagactatccattccctattgtgtcctcttggtggccttgtggaaaataacttactatatgtgcttgagtttatttctgaagctctcttttcggttctattggtctatgtgttttaatgccagtatcataatatttaattactctggttttgtaatataatttgaaatcagaaagtgatatgtttccaactttgtttttctttctgaagattgttgtggctatttagagtcttgtggttctattcaaattttaatattgttttttctatttctatgaaaaatatctttggaattttaatagggattatgttgaatctgcagagctctttgggtagtatggatagtttgacagtattaattcttcaatccattaacacagaactttccatttatttgtgccttcttcagtttctttaatcaatattttatagtttttattgctcagatattttactttcttggttaaatttattcctcagtagtttattctttttgatgacaatataaatggaatgttttcttaattgtgtatctaatagaccattgttgatacaaagaaatgcaactgatcttaccatgttgattttgtaccctactactttactgaatttatttgttctaacaggttgtgtgtgtgtgtgtgtgtgtgtgtgtgtgtgtgtgtgtgtgtagccttatagggtattttacatgtataatcattcagtctataagcagttataattttattcttccttttcaattttgatacctttaatttctttttcttgtctgattgctcctgctagtactatcagtactatgtttaacagaagcagagagagtagaaatccttacattgtaccatatattagaggcaaagctttcagttttttcccattgattatgatattggttttgggcttttcataaatgacctttattatgttcaagaaatttccttctgtacctgtttctttaatattaaaaaaaatcatgaacagatactgaactttgtcaaatgcttttactgtatctttgacttgatcctgtggtttttatctttcatccttttaatgtgttgtgtcacatatattgatttgtgtatgttaaagcaaacttgcttcccaagaataaatttcacttagtcatggtgaataatctttttgttgtgttgttgtatttagtttgcgagttttttgttgaagatgtttgcatgtatgtttagcagcaatattggcccatagttttcttttctcgtgatgtctctgtcagctttgatgtcagggtgatactagcttcataagatgagtttggaagtattccctctattttcattttttggaggtgtttaagaattacggatattaattcttcttttaataatttgcagaattctgctgtaaattcatctgatcctaggcttttgttgctgttaggaggattttgattaccacttcaatcactttttctgtcattggtcttttcaggctatttcttctctgttcagtctttatatgttgcatgtttccaggaatttatttcctctagattatccaatttcttggcatgtaattgttcataatattctttatgatccttttttatttctgaggtatcccttataatgtttcctctttcatatctaattttaatgtcatcttctctctttcttcttctagctaagggtttattggttttgtttatattttcaaaaaaattttagttttgttaatatttcctatagtttttctcttttctgtttgattcctatgctggtctttattagtttcttcattctgctaatttttgattcagtttgttctttttctagtttcttgaggtgaggtatgttgtttgagatctttcttctgttttaatgtagacatttttcactttaagctttcttgttagattgcttttgctgcatcctataagttttcttacgttgtatttccattttcatttctctcaagatagtttttgatttttttcttgatctcatttccaaagcatttggtttcattttcacatatttgtgaactttcccatttttctactcttattgatttctattttcataccattgttgtcagaaaagattcttgatatgattttgatcttcttaaatttgttaagaattgttttgtggtctaacgtgatctatcctagagactattacatgtgcacttaagaggaatgtgtattctattactgttgaatagaatgttctatatatgttgattaggtctaaggtacagcttaaatttaatgttcctttattgaattttcatctggatgatctatccattattgaaagtgtagtatcaaagttctctatcattattgctgtctatttctctctttagttgttaatgtttgctttatatgtttatattctctgatctaagatgcatatatatgtataattattatgtcgtcttgatagaataatctctttctcattatgttgaccttctaaaattatattgactttctgtgattatcgttgaccttctttgtcacttgttacagtttgtgacttagaacctattgtcagatattagcttagcttccctgctttcttttggtttccatttgcatgaaatgtctttttccatcccttcactttcagccaatgtgtgttcttgaatcaaaagtgagtatcttatagatgaatatagttgaatcttggatttttaaaattcatttagccagcctatatctttttattgggtagcttaaaccatttatatttaaagtgataattaacaaagaatgagttactattgccattttgttaactgttttctttttgtgttgtggttcttttgttcctctttttcttgcttcctgcctcttttttattgtttgtattgctagattttaattgctgttcctttttcttttgtgtaacttgtataggtattttctttgtggttatcaaggggcttaaatatctaatagttataacagtctctgcttagctgataacagcttaacttcacttgcatgccagaattcactgcttttacctttcctctcctcacattatacactgctgatgtcacaatttacaacttcttatattgcagaaccattcacacaatttagttatagttgtatttgaaacttttctcttttaccttttatagcaaattaccatgtatctatctaccactcttacagtaatacaatattctttctgttcctatatgtttacctttgctaatgagtttcatacttggtgttcattcatgttgctgtttggcatcctgctgtttcaacttcagtgacttcctacagcatttctcataagaaatgtctagtggtgataaacttcctcagcttttgtatgtctgtagaagtctttatcttccctttgtttttgaaaggctggtttgctgggtatagatggcaatttgtttcttttagcattttgaatatatttttctgcccccttctggcctgtaatgtttctactgaaaaatcaactgatagtctgatggcatttcctgagtaacaagcctttttttctcactgctttcaaaattctctcggtctttaacttttgtcaaatcaattacaatgtgtttcagtgtggaactctttggattcatattatttgatgtacctgaggtttgctgaatctggatttctgttttctttcccaggtttggaaagtgttcagccattatttctttaaatactctttttgtccctttttcttttttttctctttctcatcctcctataatgtatgtaattgttacccataagtcccataaagctgtcttcagtctttttcattattttttctacttagattaatttctaatgacctgtcttcagttttgctgatcaatagagtcctctattgattttttcaattcagtcattgtaatcttcaactctatgatttctgtttgatgcattttaatattttctatcattttgttgaaattctcagcttgtcatgcattgtttccctgaccgtggtgtgaacacccatatgactgtttctttgaattttctcttgggtaaatcacacagctttatttcactaaggctggtttctggagatttatcttggttttttattcggagcatatttctttgtttcctgacttttattgacactctgtgttggtttctgcacagtctgtaagacaactgtctctccctgtgttatcagactagtgtcttttaagaaatgtacctcactaatcaattcagcaagagattctaggtgccccaacttttatgcttatcttaatctcttttttttcagtgatccccaattagtatgtgccaagttttgtcagtgccccaagacagacaagatagaagccagtcccttgagatgcatctggaaaatttggcatgttagatatgtattgtcagggagaagctgaggatgggagtttacctcttactcaatctgcactaagccaggaagaggatctgtgggaaattcctgcactctcatttgaactacacactctgatctagatgcatagttattggaagtgcacccattcaaaaatcacatgcattaaaactcatagaaatgtaaaaattaaatattaaaagtctagtttgatatatgtaaattaaaatatatatgtgcatatgtataataatttcaaactattgtaaaaagatatagctaaagtagtggataataatcagatataagtcaggagagagattgatccaaggtaaacaggtcttccattcttacaaagttcggaagatatgtaaagaaaccatcgacactaaacttttttttttattatactttaagttttagggtacatgtgcacaatgtgcaggttagttacatatgtatacatgtgccatgctggtgcactgcacccactaactcgtcatctagcattaggtatacctcccattgctatccctcccccctccccccaccccacaacaggccccagagtgtgatgttccccttcctgtgtccatgtgatctcattgttcaattcccacctatgagtgagaatatgcggtgtttggttttttgttcttgcgatagtttactgagaatgatgatttccaatttcatccatatccctacaaaggacatgaactcatcattttttatggctgcatagtattccatggtgtatgtgtgccacattttcttaatccagtctatcattgttgggcatttgggttggttccaagtctttgctattgtaaatagtgccgcagtaaacatacgtgtgcacgtgtctttatagcagcatgatttatagtcctttgggtatatacccagtaatgggatgactgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctcttcatgtccttcgcccactttttgatgggtttgtttgtttttttcttgtaaatttgtttgagttcattgtagattctggatattagccctttgtcagatgagtaggttgtgaaaattttctcccattttgtaggctgcctgttcactctgatggtagtttcttttgctgtgcagaagctcttgagtttaattagatcccatttgtcaattttggcttttgttgccattgcttttggtgttttagacatgaagtccttgcccatgcctatgtcctgaatggtaaagcctaggttttcttctagagtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgctcgtttttctcaggtttgtcaaagatcagatagttgtacatatgtggcattatttctgagggctctgttctgttccattgatctatatctctgttttggtaccagtaccatgctgttttggttactgtatcctggtagtatagtttgaagtcaggtagtgtgatgcctccagctttgttcttttggcttaggattgacttggcgatgcgggctcttttttggttccatatgaactttaaggtagttttttccaattctgtgaagaaagtcattggtagcttgatggggatggcattgaatctatctgtaaattaccttgggcagtatggccattttcacgatattgattcttcctacccatgagcatggaatgttcttccatttgtttgtatcctcttttatttccttgagcagtggtttgtagttctccttgaagagatccgtcacatcccttgtaagttggattcctgggtattttattctctttgaagcaattgtgaatgggagttcactcatgatttggctttctgtttgtctgttgttgatgtataagaatgcttgtgatttttgtacattgattttgtatcctgaaacttcgctgaagttgcttatcagtttaaggagattttgggctgagacaatggggttttctagatatacaatcatgtcatctgcaaacggggacaatttgacttcctcttttcctaattgaataccctttatttccttctcctgtctaattgccctggccagaacttccaacactatgttgaataggagtggtgagagagggcatccctgtcttgtgccagttttcaaagggaatgcttccagtttttgcccattcagtatgatattggctgtgggtttgtcatagacagctcttattattttgagatacgtcccatcaatacctaatttattgagagtttttagcatgaagcattgttgaattttgtcaaaggcctttgctgcttctattgagatagtcatgtggtttttgtctttggttctgtttatatgctggattacatttattgatttgcgtgtattcaaccagccttgcatcccaggtatgaagcccactcgatcatggtggataagctttttgatgtgctgctggattcggtttgccagtattttattgaggatttttgcatcaatgttcatcaaggatattggtctaaaattctcttttttggttgtgtctctgcccggctttggtatcaggatgatgctggcctcataacgagttagggaggattccctctttttctattgattggaatagtttcagaaggaatggtaccagttcctccttgtacctctggtagaattcggctgtgaatccatctggtcctagactctttttggttggtaagctattgattattgccacaatttcagatggtgttattggtctattcagagattcaacttcttcttggtttagtcttgggagagtgtatgtatcgaggaatttatccatttcttctagattttctagtttatttgcatagaggtgtttgtagtattctctgatggtagtttgtatttctctgggatcggtggtgatatctcctttatcattttttattgcgtctatttgattcttctctctttttttctttattagtcttgctagctgtctatgaattttgttgatcctttcaaaaaaccagctcctggattcattaattttttgaaagctttttgtgtctctatttccttcagttttgctctgactttagttatttcttgccttctgctaggttttgaatgtgtttgctcttgcttttctagttcttttaattgtgatgttagggtgtcaattttggatctttcctgcttcctcttgtgggcatttagtgctataaatttccctctacacactgctttgaatgcgtcccagagattctggtatgttgtgtctttgttctcgttggtttcaaaaaacatctttatttctgccttcatttcgttatgtacccagtagtcattcaggagcaggttgttcagtttccatgtagttgagcggttttgagtgagtttcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaacgtatattctgttgatttggggtggagagttctgtagatgtctattaggtctgcttggtgcagagctgagttcaattcctgggtatccttgttgactttctgtctcgttgatctttctaatattgacagtggggtgttaaagtctcccattattaatgtgtgggagtctaagtctctttgtaggtcactcaggacttgctttatgaatctgcgtgctcctgtattgggtgcatatatatttaggatagttagctcttcttgttgaattgatccctttaccattatgtaatggccttctttgtctcttttgatctttgttgatttaaagtctgttttaacagagactaggattgcaacccctgtctttttttgttttccatttgcttggtagatcttccttcctccatccttttattttgagcctatgtgtgtctctgcacgtgagatgggtttcctgaatacagcacactgatgggtcttgactctttatccagtttgccagtctgtgtcttttaattggaggatttagtccatttacgtttaaagttaatattgttaggtgtgaatttgatcctgtcattatgatattagctggttattttgctggttagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaacattggcccccactatcttctggcttgtagagtttctgccgagagatccgctgttagtctgatgggcttccctttgagggcaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccccgtcactttcaggtacaccaatcagacgtggatttggtcttttcagatagtcccatatttcttggaggctttgttcgtttctttttattcttttttctctaaacttcctttctcacttcatttcattcatttcgtcttccatcactgataccctttcttccagttgttcgcatcggctcctgaggcttctgcattcttcacgtagttctcgagccttggttttcagctccatcagctcctttaagcacttctctgtattggttattctagttatacattcttctaaatttttttcagagttttcaacttctttgcctttggtttgaatgtcctcccatatctcagagtaatttgatcgtctgaagccttcttctctcagctcgtcaaagtcattctccgtccagctttgttccattgctggtgaggaactgcattcctttggaggaggagaggcgctctgctttttagagtttccagtttttctgctctgttttttccgcatctttgtggttttatctacttttggtctatgatgatggtaatgtacagatgggtttttggtgtggatgtcctttctgtttgttagttttccttctaacagacaggaccctcagctgcagctctgttggaatacctggccgtgtgaggtgtcagtctgcccctactggggggtgcctcccagttaggctgctcgggggtcaggggtcagggattcacttgaggaggcagtctgcccgttctcagatctccagctgcgtactgggagaaccactgctctcttcaaagctgtcagacagggacatttaaatctgcagaggttactgctgtctttttgtttgtctgtgccctgcccccagaggtggagcctacagagacaggcagccctccttgagctgtggtgggctccacccagttcagttggagctccctggctgctttgtttacctgaccaagccttggcaatggcgggcgcccctcccccagcctcgctgccgccttgcagtttgatctcagactgctgtgctagcaatcagtgagactccgtgggcataggaccctcccagccaggtgcggaatataatctcgtggtgtgccgttgttttagcccgtcggaaaagcgcagtattcaggtgggagtgacccgattttccaggtgccatctgtcacccctttcttcgactaggaaagggaactccctgaccccttgcgcttcccgagtgaggcaatgcctcgcccgcttcggctcgcgcatggtgcgtgcacccactgacctgcacccactgtctggcactccctagtgagatgaacctggtacctcagatggaaatgcagaaatcacccgtcttctgcctcactctcactgggagctgtagaccagagctgttcctattcggccatcttggcttctcctcccaacaagttcttttgacactaaacttttaaagtagatgtaaaaatatccattttaactattaaaataacaaagtttatcttccaaaccagtagagaaaacaaatagaacagaagtagtaatggagaaaggagaggagaggagtttattaattcaaattaaatgaaaaaaaggagaaagaaataagaaatgaaaatcaaattcaagtataatagtaaacatgataaatgcaaatggttcaaattcactaggttacacagggattatcagactggataataaatggaagttttcctttcttttttactaaaacacccctaaaacatgaagagacagtactgttgaaaatgaaaggatggaaaatgttaaacctgatatgtagcatcagtttggctctccggaatcattctagactgtcctcccttctcatccctctctcacccccaactctcacctcagctctatgccatggatggtgatttatgtatggactacataaatgagcctcttttgctgtgcagcttctgatggtctcaacctgtgggggacacaatctggagcttagagtgttggcagatagagaggtcagagcattgttctcctaagttccttcctgagagaccatagaatggcaatatgtgtgttcctctgtcaaaagccaaaactttagtaagatggccttccacagtattctgtggcctaggaagatttatgaatgcagagttctttctgctttcaaagctaagtgttttaagaaccaaaccctttgggaggaacaacaaaaattggggtgctttatgtgtggtctaagccctttgctactcatggaaaagctgggagtttggggttccttcccagtcattaggtgctgtccccaggtagggtttgtgtgtgagtgtgtcccagattttcctacccgtgttggtgtgggtatattcttattttcccagtgtgtacaagtctctcaactagtttctggttttctccaagagggattgatcaatgtgtagctgtttatttagtgcatctatggaaggagggaaaatcaagagcttcctattcttccatcttgcagatattaccactgcaaatgtccttgggacagaatggtagatataaaacaagtataagtaatttccttgcagtttttgcattttccatgtttagcattcttttcaaaggattagattgtgaattttcagtgctaaataagttatgactaacattccagctggtaatatattgatcagtagtggttgtgagaatggcaaatagataagacatagagatatgataagaaatataataaaaatgcatacctcaatggtttgtgatggtagatactggaaagaagaataatttaagatataattagactttgactataacgtattcagatatttttgaatattattaacaaacttatgatctgtaaaacattaacttctgccagtaattccagagaattatgtgcaatggttattagttgcataaagctggaggaatatttaaatgatctacttaaaattaattactctttgatcaataatcttggtcaaaaagagggcttcctatatcagtatggaaaatattatatttattcacattattttacaattatccttcctttttcattggattctcatttacttaatgaagaaaacacattaaattgttataggaactatatttcagtatctgttcctttgacagtaattgtattagagttccagacctcacacagcttaaattctcattgtacaaagtctactttcaaatgctttcaaaaagacaaaatttccctctcccccttattatttgagtgtaggatgatatattttcttggcctagatcatgatacatacttatgtctgtctttttagcaataatttttaacaaaaatttagcaaatctcattaattttgattgtaactttgaattatattgctttgatctaaaattatttatataacacataatttttcccaaaagtcttttggatcaaaaatgtcaaattgagtattaacgaaagattactctgttagtcttccacaagaaagatcaggagcccatcatggttagtaccagttttgtcagacagttccattgatgagaggccatcttcattgctcttctttattattttctgtgtaaaaccgaattctatctgacacagctttgtgttggttgtctgtaagttagctttaatatagcagtttgctttagcattgtcagattcacaatgtaaaatatactgtggcaaaataatacaatgttgtgttagttaaattaaaagcattgactcctccagccttaagaataaatctgaattgtagagcctgatcgttaaaagataatgatcatatactgccataggccacagaaatttaaaaggtcttagtgcttctttcagatagagatgcagagactaatttgaaatgaatacatagcctaacaagatgagtaggtttatttaagcacatgactgacttttgttcttcatgttgaagaggcttgaatctttagtgtcaccctgtttttaataatgatcttaaaagttcttttctttggcagtttgctttctttctgtgtattaacctttggttgtctaattattgtttcctttggtacatatttaatattttctgcttgtgctctttattatttgtgttctagatccattgcttgcccagtaagtaaatacatgaagaaaatatactaatactgtggagtagaggaagggaagaggaatatttatgaatattaatgaatattaataaaatctactacagtctattttatcatacatacttcccttccttttgtatataaaatatagtcacttcccacctgcctcctccaggaagaaactcaaaagtctcatctaattgtctaatcttaatagccttgaagtaaaaatgcaaattatctggctccccactcaccacattcaacattcaatgaggaaacagaacaagataatcataataaacacttccattgcaaatagaaagatggacacatatagtagtccctgaatactagcatttctgaactcctgttgatcagaggtttcaccatccctcttcctgtgtgagtggcaaatctttgctgaggttttctgggaacaactccctagttattgttcatgactcttggctctggcctctggcaaatccttctgtttcaatgatctcacttcgttatatctgaacagggcatttgagaatccgtcttttttggatctgagcactgagtctgaaactatgaaaggttctaggtaccactgtactagcacgtacaagatatgcatgtatacgtgtatatattaatacatacgtgtatacacactaacatgtgagtacacatacacaaaaatgcacacacacatagtagcaatatcttgagatctctggtttggagatagactctttactcacatagtaacctgtgtcacttccctatacctcaatttcccacaagataacatagtatcagatatatcctgcacagaaaatggggtttatgacacaggagagttactccaaaattatgaatcttggggcttatatagggtaattggcacatgtggcccttctgccctctggagactagagagggaagcttctctagaatgtaagcaaatcctctcggagaagatggagaggtctctacttcaccactctggaatgtaaataaaactctctgagggagatgtccataaattttcttggaaatttctatctttatcatacaagacttatttgatattcaatcatttttaacccatgttacttggaatttttgttcaggaagctctgaccatgcagaaacatgaaatattcgtggagcattgtctcctgacattgtgtagctttctcaacctttcttctacctataactttggtccaaagaaggtccaaaacgcgtatatactttggtgggaatctcacttatttcagccacatggaaagcagctgattactcaaagaacttacaactaccatttgatgattgggtatatatcccattactgcacatgtatccaaaagaaaataaattgttctaccaaaaagacacgtgcactcttattttcatcacagtactattcacaatagcaaagacatggtgtcaacctaggtgcccattgaaattggagtagttaaagaaaatgtagtacatgtacaacatggaatactatgcagccataaaagagaaaaaatcatgccctgtgcagcagcatgtatgtagctggtggccattttcctaagctaattagcacaggaacagaaaacaaatactggatggtctcacttctaagtgggagctaaacatttgatacacaaggtcgtaaagatggcaacggtaggtactggggactactaggggtggagtgagggatggagaggcaggatttgaaaaactattgggtactgtgctcactacctggatgatgggatcagtataccccaaaccttagcattgtgcaatatacccatataacaatcctgcacgtgtacctcctgtagagatctaaaagttgaaacaaacaagagatcgccagtgatggtgtttcttgaaatataattcatacaccatacattttatccatttagtgtatgattcagcagcttttactatagtcacaaaattctacaactctacaactgtcactccagttttagaacattttcatcatcctaaaaagaaacaacataaccattagcagacccacgcagctctaccttactccaccccgctaagtcctaggtagccacctctactttttgcctccatgagtttgcctattctggacatttcatgtaagtgaactcatataatatgtggtcctttatgactagcgtcattcacttggtgtaatattttcaacattcatccatgtacattttattgccaaataatactagaaatcatctgttttatttctctagcaatcagtttctatttatccaggatggtggcacttttaacagcagagcttcctcaaaacataattgcttttgttgttgaaactctatatatttgattatagtcagctacatgtgcctacttacaattctttttagggaatgtcagttcctgattctctgtttctctctgtccctctttcttatctaactatctgtctgtctgtctatctgtctatctatctatctatctagcttagtccattttgtgtcactataaccacagactgggtaatttgtaatgagtagaaatgtatttcttagagttctggagcctgaaaagttcaaggttgaggggcatgcatctagcaagggctttattgctgcatcatcccatggcagaaggcagaagggcaaaagaatgcaagagtaagggagccagaaggggctgaacttccttttataataagcccattctcatggcaactagcccactcccttgatatgaacatcaatccatttatggggtcagggacctcatgacgtaatcaccacaaaagatgctaaatagccaaagcaatcttgagcaaaaagagcaaagccgaggtatctcacatcctaatcccaaaatctatacaaaactacaataattaaaacagcatggtattggcacaaaagcagaaatatagaccaatggaacagaataaagatcccagaagtaaatctgcacatttatggctaactgatctttggcaaaggtgacaagaacacacaatgggggaaaggacagtctcttcactagttgatgctgagaaaactgtatgcccacatggagaagaatgaaactggactcttattttatcactttaccacaaatgcctacacttatatgtatgtacctcataatacattgttgagatcattgtatgtgtggaaattatagtatttttccaattaaaactatatcataaacattctcaatacatctctattttaatgatataattgaacaattgtatctaaaatttgcattgaaacaaaattggtgtagacacttccttgtaataattctgagatggttgtcaaatgggtagttttgttgtttaaattaaaattttgcttacacttattatcattatcctgttttaaaatgaaaatttaattatcttattttttctacaggtagtatacaattattttcttccaaatatatatactttatttaatctatttaaatgacccaagagagatgggttttcataccttgctagaaaataaactctaaaacatattattaggtcagtaagatttcagatatctttatatttgatctatttatatcagctgtgacataattcatatttcttttattgattcagaagaaataaaactatactttcgtatacctatgagtgatttagaattcttcttggaagagggagaaacacttagttattctttgatatccaaaagcaatagtacttcaagattctaagtactataatctatacatatatatgcatgatatcatatgtgaattctatattataaatacttaatattttatatttctcacatattacagattgtataattgatgtgtttttaagccaaaatttagcagattttatgagcttttcttttttaatctgggaaatttcatctttgctttaataaacttgctcaaggactcagaatttgagttaggtatagtgtgactatgggtgggtcttaatttgcatatcctaatgaggaactgtaggataagaaaataattcttcactaatacttgttttttgttttgttttgttttgagactgtgtctcactctttcacccaggctggagtgcagtggcgcgatcgtggctcaccgcaatctccgccttcagggttcaagtgattcttctgtatcagcctaccaagtagctgggattacagacatacacaactacctgcttaatttttgtgtttttaatggagatgaggtttcctcatgttggccaggctggtcttaaactcctgacttcaagtgatccacctgcctcagcctcccaaagtggtggaattacagatgtgagccaccatgccaggccagtaacattatttccactaaattctctaggtctctaaagagatcagcaggtggtttgtggctccaagtcaaacagagcttttagaggtacatgacatccttcttgagccttcttttcaagtctctagtcataagtttttcattagataaacattctattgaggtgtaatttgcatacagaacagtaaacaaatcagaaatatgtagcttgatgaattttcacagaatggacacttctgtgtaaccatcatccataaacattcatgtaaatcaatagaaacttgctggcaccacagaagatccactaagtctcctcccaatcacaggcctgtccaaaatgatagctgttctggcattttaattaaagtcatctatgggttactttgggtgtttgaatttttttctttccttcctcccttcctttcttccttcatattcttccttccttcccttttttcttacttctttttagctttaaaaggggtcaagtgtgagacactgatataatctatataaaattacgagttttcaactggaaaatatcaagcacacatgaattatatttctgctttgagtgtagactgccatgagatttgtaatattatatattaactagtgaaaatagttattaaaagctgttgtgctttcactttgaatttggtaatttattttccatttacatttttctgttaatatgttaaatttattaaggcagtagttaagagcttaattgttgtgcaaaaagaaaaacagggattttcatttccttgtttgctcttttattacactcccacttacttggagtggctggatctatttattatcttttccttttaagatctgagtgcacaataatatttgattcatttgagtctttttatacatgaaaatagcaatatggcagttgctcagttttttatatttatgactcagtattttatggattgattattattcacttgaaatgttacaatttggtctcaatttgaaaaggttagaattaattataatgaagcattagcgattaatcattagaacttaaaatcaaaatgtcagtatatttattgtgaaattgcttgaattggctgagaatttcactaatatatcagacaatcaccagtcctaactacttcatctcaagtcaaaagataacagcttttaaaggtttgttccaagttttcatctctgtggttttgtaactagaaaacaggtatgagctatagtaagtgttattcgtaaaagttacataatggtttgtatgtatattgtgttggtgttcggaaatgtgacgcccaaattatgtcattattcttttttttgagactgagttttgctcttgtcacccaagcagcagcgcaatgacatgatcttggctcactgcaacctccgcctcctgggttcaagcgattctcctgcctcagcctcctgagtagctgggattacaggcacctgccaccacacccagctaatttttgtacttttagtagatgcagggtttcaccatgttgtcaaggctggtcttgagctcccaacctcaagggatccacctgccttggcctcccaaagtgctgggattacaggcatgagccaccacgcccggcccgtcattattctcatttgaatcagttggtataaattatcatttaaataaatatatgactacatacaattttcaacttatggtaaacacaatgacattcatggattatcatgaagaagttaaagtagtcacaaatggaaaggaagatctttgtgcttttatcttagcaatttcacctgacatcttacagtagggaaaatgggcaaatgtcagtgagctgaagggcgtgtttagttggaactggctaaaaggtagagctaggacagtattggaaacccgtgacagtgagagtaattgacatttaacatgatagactatgggaagtttgtatgtagaaatatactttgttaagccttaaggtaatatgagagtattacttattgttataaatccatttatttttaagaatattagtttaagaatattattattcataaatgtgagacatcaatctttatcaaataggactagttattggtatcctaaaatcaagtgaaatttattgttactacaataattgatttataatgttacatttatttcctatttattttggttgccaataagtatgaacaacaaaaaaggttaaaaaaaatccttcactgtattgttaatttcctttggtattcacagctcacatctaacaaaatatttcagtcctaaatgagtttcttctagtttaaatagtctagtaaaacattttgattatatttactccaaaggatacatcattaaattattttaaatgtaaggtaataatttttctctatgtttactaaaattttttcctcagtagacgaatggttaccaaaatgatttgaggctctagtgaatcatgtaagttccataacacaaatattcatatgtaaatttaaaaactagttcaaattataatttattcataattacacaaaattattgttttatgaaaggttgagaaatgaagtaaatgtaatatacagtaatgtctatctatgtacctgcttatctatgttgatgacacaattttagaaaattgtatttttagatttactaaatatttatctgttgtgtgaattaaaatggcaatcgaatacaaatgtgggttaataatgatgaaatttcaattacaaaatatgagaaaaaactttgtaaacattacatgaaacaattcatttatgggagcttttttttttttttttttttggagacagagtcacactcttgtcacccaggctggcgtgcagtgtggggatctcagctcactgcaacctccgcatcctgggtcaagcaattctccattacaggcgcccactaccacgctcagctaatttttgtattttttagtagagatggggtttcaccatgttggccagactggacctcaggcgatctgcccacctcggcctcctaaagtgctgggattacaggcgtgagccaccgcgccgggcctctatgtgaactctttaaatttagacattttcaacaacattgctgttcatttctgtagtagattaaggtgtgttcatataactgaacttctaaactcgtgatatatagattatttttggcctaaacagtgttttaaaaatttaaaaagcttcacatacaaatccaggtatttagctgctattgaaagattgtaagacataagagcaatagacctaatttgaacatggtaagttaactagaggtgaatagttatataactgttgcatggtaggtgaggaaggaagaaatggggaagcaggctgaaagcaagcccaggcaagcgataaaacaatagcatcagcatattaacagcaatattcctttattcagtatagcagctctcagactgtttggtgtgagcatataactatagatatttactactttagaaatatagaaatttaaattgataaattgagaaatttactactttggaaatttaaattgagaacattttacattatttatttaaaaaaattatttatttatttatttatttatttattttgagacggaatctcgttctgtcgccctggctggggtgcagaggcgtgatctcggctcactgcaacctccgcctcccaggttgaagcaattctcctgcctcagcctcctgagtagccaggactacaggcacacaccaccacgcctggctaatttttgcatttttagtagagacggggtttcaccatgttgggcaggatggtctcaatctgctgaccttgtgatccacctgcctcagcctctcaaagtaaaaattatttttaaaataatgaaaaacccattcctattataataaataacatattctttataaaagtaactatgtcttttaaaaagtgagaagagtggctttgtttcactcttaataagtttctttaatacctgactcaatagaagtcagctaaattctcatacctgattcccatatttaatctgttttaatatgttcatcaggttgaggtgtataaagaaaatccagcctcacacagaaacatagttagaaaagagaggagtattttttaagtttttgcacgtagttgtgaatattttctgttatactttattgaaagttgacaactggtaatttcttgaagttggtttaaatatttttttacccatgcaagatttgctagcatcatgcattggtcctctggaaaatgttgattcactgagttatgcaggtcttctgaatattgacccatttcattttgtaataccaagaaatcaccaccaatataataagaacaagcttaaagtactgtattggaaagctatcaggctcacagtgtactataaaatttttcccaaactatgatttttgctttaccctcctattttatcattgccaacaaatacagtcagttattttccttcaagtgacagagttttttcatttttgtgaaaatatctgtaaaatatctaatgtgaatggtttgtgtgtcacttgtgctttcaacttaaaatggtgcttcatgaaaaaggcagctaaatgagcatgcaactcagtctcataagtgcatttccaggagacagttaattagttacagaaatgctgtatttgtacttcccatttgttatacttgagtcaagatttaataaaattaataattttactgatgcatcaaggatatttttaagtaaagtaaacccggattttttttgttattctacaagggcttggcagtgaaaaattcagtgactactagtagtttgctaacactgctttgatttgtgctaaggttccagcagttttacctatcattgctttttcaccatcactgcaaacatcagcactgtgcaaaaggcaaatggaaatttggaatgactaacaaaatagttttgacttagttgtatcctcaaaaagatgctttagaactcccaaacacccactgtctacactacgaaaactgtcactctataacaatgtgctaacttaaaaaatcaatattataaaaatataacatatacaataacgcaactgattttaactgtacagcttaatgaatttggacaaatgtatgtatccagttaaccaccaacacaatcaagataaagaacatttccataatctcaaaaggttccctcatgacccttttcattcactcctcactcccatctccaccccaggcaaccatgcgtgtgctttctatcactaaggattttattttgtctttcccagagtttcatttaaatagaattatgcagcatgtgtgtgtgtttttttcctgtcttccttctttgacccatcttaacaatgttgagatatatcagtaattttatgtattataccacttcgttcattgatttcaccaagttctattccaaaactgttatgaatgtttgtttagaagcttttgtgaaatttaaaaaaatttaacttgagtaaatgcctaatagtacaatttctggattttactgtaaatatgtttgattttattagaaaatgccaaaccctcttccaaaaggattgtataataccacatttcacctattccatgtgagagttccagtttctccgcatccttgccagcatgtagtattattggtatttttcattgtaactattctagtagttttactctagtacctcatagttataattttcagtttttgttggctaatggtattgaatatcttttcatctgtttctcttttgtcatgtgtgtcttcaattttttgctcatttttaaaattgacaaagtattcttattattgagatgtaaacggttcttatataatatgttctgggttataaatcctttgtcagttttatgcaatgcaagtattttccccaggtctataagcttgctttgtatatttttactacctttcaaagtgcaggtgttttaattttgatgaatttgataaaattttattctgcggtttgtgttttctttgttctacttaaggaaacgtccatttgatggttacaaaaatgtttctcccatttttttctaaatatttatggttttagcttttttatttgagtctatgattagttcaagttaatttcagagtctgatgtaaagtaaggattgaggttttttattttcttttttttttttttttttgccctgtatggatgtccacattttctagaaccattgtcgaaaacattatcctttccgcattgcatttcttacaatctgctctttttctgcttttgtagcatctcacaattttgatatgttgcattttcatttttttcatttcaaaataagttatatttgcccttttaatttcttctttggctcatgacttacttaaaagtattttgtataatttccaaatatttgacattgtttccaaatatatttctgcttttgaattctaattagttctgtattagacctcatatgtagaccacatacgtagaccatatacatatcattgtagtgctattggaaacttgttttatggctcagaatatgatctacattcatgcatgtcctatatatgttagaaaaaatcgtaattattgggttaattattgtaatgtcaattagattagacaatgtttgcttgtagtttcatgtcttctatattccggcttatgttctgtctgcttattctataatgtgacaaagagaagtgttgaaatatccatctataattgtggatgtatctattgctcctttcagttttgtcagttttgcttcatgtactttgaagttttgctattgcttgcatgcagttttaggattggtatgacttgttcatgatttaacatattattatgaatatccctttttattcgtagtattaactcatgttctggtctatttttatgatattaatggagccaactagctttttatgcttaatatttgcacaacatatcatttttctttctttctaacttgtctgcttatttaatttaaaagtagtttcttatagacagcatatagttgtaactctttcgttattccagcacagtaatttcttcctgcatttctaattgcagtgtttagactacatatttttaatgtaattatctatactatgtgtctcccatctggatttttcctctatattttcattgttcactttttcctcatttccccccttttttcaggctaattgagtactttttggatttttttttttttactattttcttactagatctacttttctttttgacaatggctctagagtttacaatatgcattttgaacttattgaagtaaaaggaggcctggcacagtggctcacgcctgtaaccctagcactttgggagcctgaggcaggtggctcaactaaggtcaggagttcgagaccagcctggccaacatggcaaaaccctgtctctactacagatgcaaaaattagctgggcatggtggtgggcacctataatcccacctacttgggaggctgaggcaggagaatctcttgaaccctggggtcagaggttgcagtgagccgagatcatgccacttcactccagcctgtgcaaaagagcaaaattcagtctcaaataagtaaataaagtaaaaggaaaactgtttctttactcacaatacttctgacactaaatgtttgggatttttttgtttacacacacaaaaaaactctctggacaccaacttagtgtcttatatgcttactcaattctgacactgactattcagaattagtgtcagacgctacaaggttagaggctccgtcctacaggcctgcccctcacttgaaatagcaatcatggccgggcgcagtggctcatgcctgtaatccaaacactttgggaggccaaggtgggtggatcacaagatcaggagatcgagaccatcctggctaacacggtgaaaccccgtctctactaaatatacaaaaaattagccgggcgtggtggcaggcacctgtagtcacagctactgaggtaggagaatggggtgaacccaggaggcgaagtttgcagtgagcagagatcgcgccactgcactccagactgggtgacagagcgagactccgtctcaaaaaaaaaaaaaacattgcaatcacaagtccagtcccaaatggctgataatttgctagaatgactcacataactcagggatacactttatttaaatttactggtttattataaggaatgttaaaacagatacaaatgaacagccagatgaagaggtacgtagggcaaggtctgaaaagttcctgagtagcttctgtctccatgtagtgggggtatgccactctcccagcacgtggatgttcaccaacctggaagctctttaaactgcagttttgagatttaatggacgtttcatttcataggcataatgaattaactcaatctccagccctgttcccctccctggaggacaggggataggactgaaaattccaagctaatgataaattagtctttctcatgaccagccctcctgaagttatccaaaagcccaccaagaattgcttcattagaacaaaagatgctaatatcgcctgggaaataccaagggatttaggggctttacattaagagactcctgtcatcccatcaatcaggaaattataagggttttagaaactgttttaggagctagagccagagaccaaacattagagcagacgatgctcctagtacccatatcacttaaaaaattacaagagttttatgggggcagatacatatttattattatatcacaacagtctaccctcataaaattttaagaaacttataatttatttccatttcaatgtataaaacttctgacaatttatttcttatactattgtgtcatacatttaacttatacatattttataagcatcatcataagcaggcatcaaatctcattcaagtgaaattttgagatgaaaaagttttgatatttatctaaatatttaccctatccattgctctccattgctttgtctagatttaagtttttagctagtatcattttccttactcctgaaaaagtttctttagtgttttcattagttcagataggctggcaacagattctttccacttaatatggaaaatgttttattttgcctgcagttttcaaagatatttttactgattatagaattctaggtggacctcttggaggcccttaaaaaatgtcttttctttttcatctttgtctagtttctcttgaaaaatgtctgctatcttgtatctgttcatctgcatataatgtgtcattctttcgatgtcatttctgggtctattgttttttactgacttatttttctctcattatagtcaatttcctgcttcttggcctaataaacttttatttgattcaagacattctatatttttatgttatttttgtaaatttacattactgaggatatgaatttggttgtatttttaataagcattgagttttgttctgctagacagttaagttacttgtgattaggtttaattcttttgaggcttgtttttgaactttattatgatagaacagccttgactgtccttttgtcttagaattcagcctactattaaggtatatccttttcgagttttctactgagtactctgaatgatcagcaaagactccactctagctggttggagctcaactgtcttccagccagccctttctgagctgagaaactgtgcaagtcaccagtttttggtaaccctttgtctgcctttgtgccttttaggatttggtaaaaattcaaagagatatttagagctctttttcagcatatatccatcctcttctgattgacaccctacaactcagcctctccacacttagacctcttactccttaagtcagttcccatttaggatacccttcctacatcacaggctatactatgctgcaagacagacaacaaggccaatttttgactcactttatttgtttcccttctctaaagaatcactgtgcttctctgcctattgtctaatacccggaagcaagactttcatagattttctccacttttctagttatttatggcgggaggttaaatctgatctctgttactcaattaagaccagatgtggagatcttattttgcttgattttttgtatttgcaattttctttctttgttaaatgagtacttgaaatatatgttaccaaagatatttatctcaattgtgagctttatacaggtcctaaataatagaggattgtaacattttgtattatttaaaatattaacttttaatgtaaattaacatgagggacatattagaagatggctgattatgcataacaactacttaccaaatacagattatatatatttagtgtcatttttacacagtttatacgcatacatcaatttaaatgtttttactaccgttattatctccttataataccttgactgccaaagtttttctgcatccagtgttgctatcatcttttgttcacgaggaacaatctgttctgatccctgggaattgagcaggatgtttggtttccctctccatctgatggtagtaatttgtctttcttacttacaaataatatactagatcttgatgatggaataagcttacttcttgaggaatgtgcaaacatgacaactaataatagaaatttctgtaactacagttagcatatatattttaataatacacctttgcatagattacttacatttattttcatatttatacatatgacccctaacttatgatagtttgatttccaatttttttgactttatggtgggtttatgagggaattaaatctatttcaacttacagtattttcaatttacagcaggtttattgggaaataacctcattgtaagtcaaagatcatcttgtatttcagcatattttattatacaacaatgaataattaaatagacatgtgccttttagtatgcatatacagaaatgcatcgaaaaaatatcagtgactctcattcatcaaaatattcaagccatgattgcaccactgtattcacctgggcaacagagtgcgatcagtctacaaataataataataataataataattcaatctgtttatcctatgctaagtatttccaacatttgtaatcctaattcctacagactgagttactatataacttagcttttggaaataaaaatgtgaatgagatgatctttactatatcagtaagaaagatgcatgcataatgaacaaaaaatgtggggatagggagaaaaagaagaaaattaaggatatttttatctgagtttattgtattcctatgtatcaaaagcctaagattcattttctgacattgttctgaaataaactgaaatgtattagggatgatttggattgttatttttgcaaatgtacactgttgtatattttgcaaatatttttcacatagaccctttaattgagaggcaaaagttcagatagcaattgtacacattaggctcgcatatttgattctaggaatgtacattttcagcaacacactcatagaaaaaaaatgcacagctgccaaagctgttaatgggagctgcatgctgaatttattgctacattgaaaatatatcccttcttgttcaacatattcagtcaaaaatgttcattaagaagtagtcttatctgcttttcattttcagggtataacacaagaatattatattccattaagagcaaatgtttaagtaacatttcagaaataaaataatgagtttttgcagtgctttttgggaaaatttaatttatgaaaaagaaaactcttagaatacagttgtagcatttcaatcttttcttctgtgcttgcaattattatgcaaatattattgctactgcaaaagatctttgtcatgaattgctttgtaatggggcaaggttattgagcactactttttaaagagatgtttctatgacagtattatacataagacttcaaaataaattgctaatggtaaaagactaaacaaatgcacccaccatttttatttctacagtgccagaattaaagacgtttatccaaatgctttaaatcagtttattttatattttctagccatgcctgttctagtaaacatgaacaatgattgtacacagttttcttctttagctgtcactaagatggtgtcataatgtttagagatacgctctctaactgtcagcgtttgttacagttcagtgatgcgtgataaagtatgagggacattgtcttcttgcactgctaaatgtattaatgcagtgatgatatttctcaatgactttttactcaaggtcaaaatgatgaaattcatctgtacttttcaataatttgtttattaatcaatatatttttcatcttagcctgttccttcaagttttttaggtacattttaaaatttgaagcaaatgtatattaaaatttaaagaagactgtgtcatatttttacatttaattgtattttaaattaccagccattatttttcaattcatcttttaaaataaataaaacagcatttagttattgttctttttgttgctacctatgaaaatataacttgagatagactctagaattctctgatctatttgaattctctgtttatgatctctggatataaaaattacttaaaaaatgataatcattatatgataaccattcatactatgtatttagtaattgtgtcttatttacataatcctttaaagtttacaactttaaattgcttgatttcacaagcaatagttatttttgccctaataccaattctatatggtagagactttaggaaatataaccccctttttacagttgaggaaattgagctcattgttgttagtaccctaaggtcacagatattgaacttaaatctagaattttggaccccaattccagtatcttttctttagttccattcttatttgttcatatttatagacaatctgcagattgtatatcactgacataaatattgcaatgtgttatagaataatgaagttactgataatgtaattaaatattcactgcttctggattagcatttctaaatcactattctagtgatgtaatgtcattattcacaaaacttcatggttcattgccaaccctattccttcttcgtatatggaaatcaccatcttcttccactggaaatattttctcagattagagatgccattgtttatagattttcaattactgtagttgatctaatttcacctaggagggtatatattgattataaatgtttacatgggataattacattttatcggttaaataggaaccagtatatatgctattggtttagtagcaatgcctttccaattacagcccacctttatatgatataaattgtctttattctttccccttagcatttttagagtttttaaggacatggtaatttgtattgaaagttacactactcagtggtattttccaagaagactctgcaaatcttttacattctgtgttactagcaatgtgatataaatcagttaacatccataaccgatagctactcatctacaaagagtcttaaagagtaaaacgtacaattcagaaatctgaactctggtgttaaaaaatcctcaagattattagagcaactaccatttgaaaaacagatctgaactatgaagttctgtatcagaattttgattttgaaaaatttctgtaggttaaataacaagaatcaagaacactacataccatacttttggacaaaagtttattataaccctatattataataggccaagtatatcacagtggattcattgttattactaaaagtatgcattcatagtttcagtcactttaattatcatacatggacaatgactagattttttattattaaagatatgtaaagtaaaatacataatatatcaagaatatacatcactgccactaaatagaagtgttttcattgttggaaatttaaaattatttacctattatgaaaacgttagttcttaaaaggattaggttcagcaagagtaccaacagattaaagctggacaactttggcattcctctgttttcgctgtcaaaaatacactttggactttgcaataagttcctcaatagttataaatcctagtagacaaaattgaaaaaaaaaatctcttcaagcttttgtttgctttactgtattataatggtaatagttactggggattatttttaaatttccagttgtttggatggcatgaactgattatgtgtatctaaataatatacttgtattattaatataaatattttgctaataaatatctttaaataaaatattataagttaagttgaaatgtttatctatttttatgttattaaaacgggttaacactaattcacgtgagttatggttggtgaaaattccaaattatttgttaaagatataattgtaatagagctatagagtcttcactctgtcaaaattacagagctttctccagaagcatcactgtttctttagttctcccgcaccctgctgacatgatgtggaatacactgagtatttgtcagtggagtagccaggatgggtgcagttgagagcactgctgaggagctttcaaggaaagacactctgctctgaagcaccagaagttacacccacagggaactttaccctaactcctgagttgaagtaatataggccattattataaaagaatgcttaatttagagttaaattagagttaaaaactattaaataaccgaataaatctttgtttttatgaatcactattttgtaataatcattaaaatggtgtcagtcctttaagaactcacattttatttttctatgttctgaaatatacacaaatgtattttattacacctaccctgcacaagtgtgattattttgcctgctttctcctattcatttttttttaacacagtacctgaaaatagggaaatgggcagtgtgttgtgggaggaagcaggggataaaatctcaaattttggcactggtaatatgagacagaaaggagtgaatctgagagtcaaatagttcgttacactgaggagaggtaaatggtgaaatatctggcgtccatagatccctcaacataagtggaaggaggatagatttgttcttacggtatccgtggcccactctgtacatttgggacaagtaggtttatggatgctgattttgtgagacgtgttgtttgtgagtctaatcatgtggacagaagataactgaccatagaaatggataactgacaataaaaataaatgtatttaccatgtattatgctatattctatgctgaatactttctaaaatagactttcatttttctttcaactttctaaaactttcagtttgtgagatgaataaaattattatccccattttataaatgaagcttgtagacgttatgtaactaccaagatgacaaagctagtaatggagcaaccgcaatgcaaacccagggtgtcactgttttagaaactgtgctcttaactgctacactctcatacagtctatggcctttccaaacttgcagttaaaaccaaattttagtagcaaatagaggaaatttaataaacgaatgaaagcaattgatttctttgaaaatagttttgcattgtagactgtctatgactacaaaaaaaagctttattttttctcttggtagcttatttctatagaagtgatgagtcagtgccttatcaagaattttcatttcttgcttgcacactccccaaaatggtacttgcagctatttatcattttagtcttatcagtgaattaattttggttatgattaacctttaatagagacagaatagcatggtggcttagagccagtttttcatcatgttattaaatgtcttttgagcccaattttttatctgtgaatcagggaaaataatagtacctcagttataaagttgtgcccacaataaataaattgctgtatgtagaggtctttgaacagtgcttaccttgcctaagcacacgataaatgttatttagcaattattgttaaataggattgcatgtcaaagttaaggaaaccaaagttgattctgttttattgaagttcaactaaatatcatcaacttgagttatatacttaaggaaccttcaaaatgtcggaatgaagactattttcattgtaactttaaattaataaagattaccctgaagggacaataataaatataaacattaatttgttctaaaattttaaacatgtacatgatatattacacaaatttagagtttcaaaatatgaatcttttccagccaacacagtaattttcaaaggacttttttttttactatatacctcttgataaaattagtgaaaaaacagcttaaaatggaactgattggattgaacatttgtatacctctgtgggtattgtttaattgcccgtgaaattgagttgttaaacaagcagaataatacatgtgacataaataaggtaaatcataagaaaattggaaaaataatttcgtatctaatgtgcaatccttaattataagtagtatttcgggcttacaaaatatatgcatttcctttggagagcaatttttatcttacttatctcgggttgtttagattctacttcagatattattggttggatattgtcaaaatacaacatttaaagttaaacagaggtagatatattagaaaatgtaaattgatagaatagttattttgtgtccttttaggatgatataattcagtaggtttagcataagtattaagtacacttataaattatttattaactactgtctttcaggtgtttatattctactgtgaagatatttgtagtgaggaaataaatattttttataactcatttttaattgatttaaaaagacaattttaatagttagatggtgtgatatatttccttaaatgctatcagttgtcatctaatgcatatagacataaaagtttattaatattaagatgattaatattctttgaaacataatttataatttaggataatatttcatctcaaaaaatcaaggccagtaatgtagggaattttattgacgggatgtgttaatcagagcaacctctccagtaaattttaaaatagtggatatgattttttaaaatttattaatagcatcaaagaactaaattgacaagagagatagtcattacaaggccaaaaattatgaggaagggggaattggaaaataagaagacaactgagggccagccatggtggctcacacctataattccagcacgctgggaggccgaggcaagtggatcacctgaggttaggagttcgagaccagcctggcctacatggtgaaaccccatctctactaaaaatacaaaaacttaaccgggtgttgtggcggacgcctgtaatcccagctacttgggaggctgaggcaggagaatcgcttgaacctgagaggcggaggttgcagtgagccaagattaagccattgcactccagccagggcaacaagagtgaaactccatctcaaaagaaaaaaaaaaaagacaaccgaggaagtttggcctttgttaaaactgttcgttcaacaaactcaccataataacctgttttagtgtgcaacttctttcttgccacagtgtttactaacatactgtcaacctaaataacagagagagattatctaaagatactcattctattctggagtgtgcagtatagatgctaatccaggatatgtggactatggggatcataggcatagccaaggagtttgagacaagaggaagctttcaaaggaaaaagtgaacgtaattcgttttaaaacaaacaaaatattgattacagtggcttatcacaggagttgatgccaggtccttgtggagacagtatgtcaggcaagtgttcttatgcattcactagctgtccttgtgactcatgtaacaagatgcagtttgaaaagtccttggcaaaagttctttttacaggcatatgtgcaagtaagagactttcagatgttctttgtaatagttcttatcataggcatgtgcgcatgagggccctcccttcctaacctaccagcttaatttttgacacaaatgactccatttgtggaatccaagtttgacacaaatgactccattttgatcctgacaactttcacatttcctcatttgatcaaggtctttctccaaaagcattgctgatcaaccatctcaagcatctcatagttaggttttatttctcagtgctggtatgatcttgtcctgattgttcagttcttctcacatcagtgaggatggtcagcaaattctgagtcagttttaaaaacactttagcaaaatggccgcaacaagtatgtttgaaaaccctgtatctctgattaattttgcctgaagtccattggtaagttccattttgttagttccaaaggtgttggctatcattttaacaaaaccggaccagtattattctattaggagtcttgctgttgcagatgttagacaggcaacaaagagatactgatctttatcaaacgttttgcctatgtctgttgagattatcgtgttgtttgttctttattctctgatgtgatgttccacatttagttatttgcacatgttgaaacacccctacatccctcatgtaaatcccactgtattattgcgtgtaatcttgttgatgctctgttagattcgctttgctagtatttctgttgatttttgcatctgtattcatcaggggtttttgcctatagttttcttattttgttgtattcttgtctatttttagtttcaggctaatgctagcctcataaaatgaattagaaaaaattccttcttcatcagttttttggaataattagagaagaatttatgttagttattttttaaaagtagtttagaattcagcagtgaacccatcaggtactgggtattttgttattagaagactattactggttcaatccagttactgattttatatatgtttgggttttctattttttcttggttcaatcttggtaagttttatttttcccagaatttattcattttcttgaggttttctagttggcatgtagttgttcatatttttttctaaatggtctttttgcatttctatgatatcagttataatatctcctatttcatttctgattgtttttatttgggtctccactgtttttttcttactctaactaataatttattgacttatgtttatcttttcaaacaactaggtttttgttttgctgatcttgtattatatggggttttctttttgtctgtattttgtttagttctgctctgatctttgttatttattttttatactaattttctgtttggtttcttcttgcttttttagttccttgaggtgcatcactacatcatttaattaaaatctttctacttttatgatgtaggtttctatggctataaacgtccgtcatagtactgcttttgctgtatcctgtaggttttggggcgttgttttctattttcacttgtttcaagatttttttttctctttaattccttccatgacccatcagtctttctggagcatgttgcttaatttcaatgtatttgtacaatttccagagttcttcacgttatttgtttctagttttactcctttgtgatctaagaagatatgtgatgtgattttgatttttgatttttcaatatttgttgatgcttgttttgtggcctaacatatgttccctcctggagaacatttcatatgctgaagagaagattgttttctgcagctcttggctgaaatattctgtatatgtctgttaggtttatttggtctataatgcaatttaagtctgatgattatttttgtttttctgtctagataatctgtccaatgctgaaagtagagtgttcaagtacccaactgttactatattgctgtctatattggtctttgattaatatttgctttatacatctgtgtgctccagtgcgtgtgtgtgtgtgtgcatatttacaattgtattttcttgccaaactgatctgtgtatcattatataattgccttatttgtcccttttgttcttcgacttaaaatatctattttgtctgatataagtatggtactcctgcatggttttgttttccatttgcctggaatatctttttctcatcccttcattttaagtctatgtgtgcctttagaggtgaagtgagtttcttatagccataatattgttgggtcttgtttttttttaatcaattcagcagttctgtattttttcatatgggaatttaaagtgtttacattcaaggtttttacttttctattgaaacatattcctgtcattttcttaatcattttctgattattgtgtatatcctttgtttctttcttacttttattatttgtgtggtttggtggttttctgcaatgataacatttgattcctttctctttctcatgagggtatctgctataccaatattttttatgctttttgagtgtttttataataatatatactgtatttttgcttccagatataggatttttaaataatatcttgtagggctgaccagtagtgatgaattccctcagtttttgcttgtctgagatatcaacaagcaaatttctccacatttctgaagagacagctttgtcagttataatattcttggttgaacactttttttttcttttcttctggcagtttgaatataatatataatatcattcttttctggagtgtacagtttctgttgagaaatctgctgttagtctgatagagattcctttagatacaacttgatgcttgatatggtttggatctgtgtccccatccaaatctaatgttgaaatgtaatccccgttattggaggtaggtcctggttggaggtgattggatcatggcggtagattcccctatcagtgccatactcgtgatagtgagtactcacgagatcttgtcatttaaaaatgtgtagcacctcctcgctatctttcttcccgctgtttcagctttgcaaggcaccagttccccttcagcttttgccatgattgtagccaagcagatgctgccagtcttcctgtacagcctgcagaaccgtgagccaagtaaacccattttctttataaattacccagtcacaggtatttctttatagcaatgcgagaatggactaatatagaaaattggtatcaagggaggcattgctataaagatacctgaaaatgtggaaggaactttgggactgggtaatgggcagtggttgaaatagtggaggcctcagaagaagacaggaagttgaaggaaagtttggaacttcctaaagacttgttagattgttataaccaaaatgataatagtgatatggacagtaaaggtgaggctgatgagacctcagttggaaatgagaaactcattgagaactggagcaaagttcacttttgttccttagcaaagcaattagctgcattgtattgttgccctagtgatctgtggaactttgaacttggtaatgatgatttaggttatctggtggaagaaatttctaagcaacaaagcattcaagttgtggcgtggctgcagctaatcacctacactgatacgcatgagcaaagaaatgacttgaaactggaagttatatttacaaagaaagcagggcatacaatttgggaaaatttacagcccaaccatgtggtagaaaagaaaaaccaatttttgggcaggtagggggattcaagtggactgcagaaatttgcagaagtaaagaggagccaagtaccagtagccaagacaatgggaaaaattcctcaaaggcatttcagagaccttcatggaagcccctcctatcacaagcccagaggcctaagaggaaagaatgcttccatgggtgaggcccatgcttatagccttgtgcaaccttgggacactgctccccacatcctagtcactccagctccagccaaggccaaaaggaccgaggtacagctcaggccactgctacagagggtgcaagccataagccttggtggcttccacatggtttcaagcctgtagatgcacacagtgcaagatttgaggctagagaacctctgcctagatttcagaggatgtgtgagaaagcctggatggccaggcagaagctggctggactgcaggttagagccctcatgtagaaactctcctagggcagtgcagagcggatatgtcaggttggagctcctacacagagccctcactggggcactgcctagtggagctgtgagaagaggaccaccatgcctcagaccccagaatgttagagccgactgtaacttgcaccatgtgcttggaaaagccacaaacactcaacagaagtccatgagatcaatcatgtagaataacccctgcaaagccactggggcagggttgcccaagaccttgggagcccacctcttgcaccagtgtgctctagatgtgaaacatgcagtcaagggatattattttgaagccttatcatttaatgactgccctacttggtttcagacttgcatggggcctgtaaccactttcttttggccaatttctccatactggaatgcgagtatttagtcagtgcctataacccctttgtgtcttggaagtaactaacttggtttttttttgttttttgtttttttttaaacggagtcttgctctgtcgccaggctggagtgcagtggtgcaattgcggctcactgcaacatccgcctcctggattcaagcaattctagtgcctcagcctcccaagtagctgggattacaggcatgcaccaccacacccagctaatttttgtattttttgtagagacggggtttcaccatgttggccaagatggttgtgatttcctcatctcatgatccacctgcctcagcctcccaaggtgctgggattacaggcatgagccaccacacccagccaactaactttgtttttattttacacactcataggcataagggactagccttgtctcagatgagactggactgtgggcttttgagttagtgctggaatgagttaaggcatggagattgttgggaaggcatgattgtattttgaaatgtgagaaggacataagatttgggagggcctggggtggacttactttgtttggatctgtgttcctacccaaagctcatcttgaaaactacttcctaatgttataggtggggtcttgtggaaggttattggatcatagggtagatttcctcgttgctcccattcttgtgatagtgagtgagttctcatgagatctggccttttaaaagtgtgtagcacctcccccatctctctttctcctgttttggctttgtaaagtttcagcttcccctttgtcttctgccatgattgaagctgagcagatgttgtcatgcttcttgtacagcctgtggaaccatcaaccaattaaacctcttttctttataaattacctagtctcaggtatttctttagagcgatatgataatggactaatataatgctattctcttactgtttttagaattctgtttttctctttgacttttgatattttaaatataatattcctcagagaagaccttttgagttcaatttacttgggaattttttaccatcttgtatgtggatgtctttatcttttccaagacttgaaaagtattctgttattattgtattaaataagaattttttatgcagctttccatttcttcccttcctggaactcacttaatgcaaatattggaacttatttgcataatggtatttcatatgtcacattggcctttttacaattttttttttccttttcctttttcttttttcagactggtttatttcaaaatacctttcttcaagttagtaaattctttcttctccttgatctacactgttgtcaaagctatcttttgtattttttattttgttcattaaattcttcgttttcaagatttggatttttataatgatatctattactttgtagaattatttatttagatcaccagtttttccctgatttctatttattgggtaattgtttgttcttttatctcactgagttttcttaagatcattattttggttttcatgcatttaaaacattttcttctgtggtctcctcctggagtattattatgttccttgggtgatgcaatgtttctttgctctttagggttttttgtgttcatacctggatgtctgtgcatctggtgtaactgttgtttcttccagtgttacgaaatagctttcataggatgtatttttcctttagatgtatttatagtgtcagttgaataggatactttggctttggttctgtgactgtacagtaaggtagtcttcatatgatttctttggctgtaatcaacatcagttatgtctgtgtgttcctcacggtttaggttgtggttgtttgtgtaggatgtggagtggatttgctggggacagggacatcaggcaggccaatccttgggtctctggggtcatgtgtaagtgcatggttgccactctactgaagggagtgggtttgctggtagcagcagtggtgagtcccatgtgtggtgagccattccatggggccatagagggcacatgtgaacactggaaggtccactgtgagccctgtgcaggctggccccacagcccctagtaccagaggtgcatagcagttccaccagtgaagtggactgtgtgccctgagcaaactgattctcaggcccctggcgagtacacatgagctttgattgtgtcaggggtgggtgctgggtgggccagtcttcaggcccctaggccacacttgcaagcatccgtagtgctattgacagactccaggcagtctgatcctgaggcccctgggtggcttgcatggatgctgtgatacttttgtaatatgaatttaaaagtatagaattttaaacttcatgtttaaccatttatttttcagtatcttatctcatttggatatgacccagactttttatgaatatccattgcctaatttaatataactttaatattttaaattacataaaaatttcatttataaagtttctctgatttgtatttacctaacgtatttatttttaacaacacctggattacttataaaaactgggatattagacaaggatagtcatcatttctaattatcttcttgttacagcctgtcaagatcaggtgtttatcacccaagtatgaatcttaaggttaaatgtattggtattttgctgataattaagaagatagaggtgtttacattaagccagcaatatttaattagtcgttttgttaatccatttcacgttataaaggaatacctaaggctggataacttataaataaaagaggtttattttgctcacagttctgcagtctgtagacgtgtgacactagcatctgcttctggtaaagcctcaggaggcttacaatcatggaagaagaggaagggaaatcatggcagaagagaaaggggaagcatgcctgtcacataggtaagatgtgggtgggagaggtctcagactcttttcaagaaacagatctcatggtaactcattacctcaggaatgacaccaagccgttcatgaaggttccatcctcatgacccaagcacctctcaccaggccccacccccaacactggaaaatcacatttcaccatgagaattggagggacagatatccaaattatatcagtcttacttatcaaggagttacataaaggatgatcgttttgcttttaagctgcttatataattttatgcccttaaaccattttagagacaaatataaaactgtctggccattaaacccaggctaaaaaatatatgctaacaattctaaagattatttttattttaccagcaaatttaaagccaccttatttattaaagatttactcaaagcatgtgaactaaaaggcatttggataaattagtaaatattttaacagtcttaagtattaaattatatgagttctcatttattaaaaccaatcttaatagaatttattaaggtatttctgaccaattatgctagattttaccctgtagacacaacatactacgtgtgtaaacacacatgaacacatatgtacacacaaagatatagctttcattttagaattttagacatgagacattaatatgttctgatctgtaatcttatcatggctgtaaaccaaattttgggtaaagcagttttcatagaaatttttttctaaaaaatgcatattttactccatttccccttttttttcattttcagttgagttaggggttaattccttgtcgccttgtatcattggaatgccattagaaaaacaatctatgagtgagattttccttgtttttatttaaatttgtaactacaaagactgttgaagcattcagtttttattttaatacaagcaaaagaaaaatcagcagattcagagtaggcagaagaaaaacaatacatagagaacttgaaagcctgtacatgtaaatcttatagatgcagtttccttatagagttcaaataatggccattgagctctgaatatatatatatatatatatatagagagagagagagagagagagagagagagagagagagtgtgtgagtgagtcagcatcttacttgtcacccaggctggagtgaagtagcataatcatggctcactgcagccttgacctcctgggctcagggaatcctccttcagcatgctgagtaactggggctacaggcccataccaccatgcctggctaatttttgaattttttgtagagacggggttttgtcatattgcccaggctggtcttgaactcctgggctcaagcaatccacccacctcagcttcccatagtgctggggttaaatgtgtgagccactgctcctggccaagctctgattttttttgtgtaatttcctcatcagtttaaaaatgtgtacaagaatgtgctataatatagccctcctagaatccctgaaagaaggttgttctggaatgccattagaacttgaagatcccattccatttcttattaatctttcagagcaaagaaaatcattttccctgctgtatgaaatttaaagtgtatacttaccagaaattcaaaatgtctctaatagaaaggacttgtgttaaaaatgcaaaaagtcttttgtcttcataagagaaatgcgggttccttatgaaggtggatttatctaagtcagatctcaaataaagtcagcaggaaacatctgccaaaaatagggcatcttggcctgagaggagactcaccagacactaaaggtgaggtgtggaaggggagagcagagggctcaggtgactgctgcacactgttcttaagaattactgcttttttccaaaggtaatcttgctccacttctgactctagatatgtcaacctaaataaaagacgaagagagagtctccgaagacactgagtttattcaggagtgtgcaagggatttgcacttccaggatatgcagcctataggattcatagacctatccaaagagattgaggaacgggcaaacttttaaagacaaaaggaaaaagaacatgtaatttgttttgaaacaaagagaatattggtgacaagggcttatctcaggagtccataccagttcattatggagacagtgttaatcaagtgttcttatgcatccagctagctatcctgtaactcatgtagcaagctcaagtttgaaaagtcattggcaaaagtttttgttacagacatttgtaattgttctgatcataagcatgagtgtgtgagggtcctcgcttcttaacctcccatctttatctatgttttgttggggtttgatgcaagcaatccattttgagtttgataacttttacaatatcaagcaaattctaagcaaaacaaaactgatgtagttgtattaatattatgtaaaatagaatttagggcggggcgcggtggctcacgccttgtaatccaagcactttgggaggccgaggcaggtggatcacgaggtcaggagatcgagaccatcctggcttacacggtgaaaccccgtctctactaaaaatacaaaaaattagccaggcaaggtggcgggcgcctgtagtcccagctacgtgggaggctgaggcaggagaatggtatgaacccgggaggcggagcttgcagtgagccgagatcgcgccactccactccagcctaggtgacagagcgagactgtgtctcgaaaaaaaaatagaatttaaaacagaaagcaaagatagaaaatcttcactgctaacaggttgtctttatcacaacggtataataaattataatttataattatctaacagcatagcgtcattgtatttttaaaaatggcaaaattttaacataactttctcagtaaatgataggtcaagcatataaaaatcatttaaaaattgtacaatataatgaatcaccttgatttataaggtatatggaaccctgatcaaaaagggaacaaaaatgtatgtacacatacaacatttatgaagattaactatatatgacaccgaaaagcaagtttctgaatgttttaaagaatcagtttcagacagaccgcattctgttactgtaatgcagaaagtttcaaactgaaattaaaaaattgaacctgaaatgccaggaatgaacaaattttaaaatgtaagcactatctaatatgacaaagaggtaattgaggtagaaattagaaaatacttggagttgaataatactggaaatgttacttaccaaaacttctgaagtatggaaaaagcactacttagagaaaaatctatagtcttaactattcatatttaaaacaaatacaaaagctgaacattaatgagctatgtatctcatgtaagcaatttaagaactacaaaaaaaccaaaataaagtacaaagaagaaataatgaagtgagtaacaaaaatttttaaaaaattaaatagtgggggtaaacaaataccacaatcagtttttttaaaaatactaataaatgagagagactggctagattattaaatagatgaaagagaaggtatacataatcaatgataggtttgaaaaggtagacgtagtaaaatagtatgcattttcttgattcttgtaaaataaaaatatagatatttagtaaaataatgtgtttacaaatttactacatttcaacggggccaagcagtctattagtcacagtaggtacagggcctagggctcaggatatttttagggacgcatgaaaggatttaattttactttttaaattgtaaaaaaaatgaatatagtcataatgaatatctaataatgaatccaggcaggattaaatttgtttctatacccacatagtcataaaatattatttttctatatctattgctgaatttatgtatttattttttaatatatgtttagggaagaaggagctaacaaaggcaaaagtgctttggacccactaaagtcatgatacagccctgaattcaatagcatacaataataaattttaaaatacttcaagttatattaagtacaatatatataatatgattttataataattatgcctcctaaaatactttgcaactacatgtttaaattatgttttctaaagatagaaaaatattaaacagtattttattaaagtcctcttaagaatcagtttttaatttttattgcaaaatagtcagcaataaacatatatgttatatagttgtaaatataagacttgatattaacattattggaatgacataattgttttggaaaaactaagcaatatcatcttcgattataaaatttaacaatgagatataaaagcaatgtgagagtggtatgcagaagctgcctggagccaatttgtaggagcctattgtgtgcaactcttcccaactctgcgttcagtgtcatcaccttggtattttgaagtaggccatgatgagagtgtttgcaacacagaaatctgcaaaccctgcaaatgaggacccctcccccactgtttggacagctgactgttaaacatttactaccacactactgtatggagtatacgatacataaaagtagtgtctataatgctcctatataaaataattagggggtgataaggagattatctttgaataacttctactcgtctttacaggatatatttcattttctttaagtttctaagttggatctgcaatatctttagaatttgtaaccagaactactttttaattccccttagaagatttcaaatgttttcaggcaatattagtttactatcataatactaaattaaaaccaaagcaggtatggcctttaaaattcaaggggatactttgtggaagggaggttgcgaaacaagcagtgtagactggcagaaacaaaaattatataccttccctaaaagccaaataagatattgggttttataacagtgtcttatttgatactttacagtgttagtggatgctgcctttaataaggaaaatataaatatatttggaacagtacattttgtttttcaatacaaggtcttttggtagctgcaaacactgatgattagcattttgttcgaaattgtatggatgaaactgaaaatggaagagttgtcactgtaaattttttgagctgatagaaatttctgatggaattttttactttggaaattttcaaaaatactaagaagcaaataataatttgtatttccacactcataatttaatgctattaatttcttggcatagttgcttgtagttttataccttttttgttaagaaaaatcactattgttgctgaaaaatattacacatgtgtattgaaaatattcaaacaaaaaagtttagaaaagaaagaaaaaatagaccatgaatattctatctggaaagttttatccataacattctagaaacacctttgcaggtgttttatctgtacataaatacagaaaaatgagggttcaaagaaaggaaacttcacacattcagtccctgagttcctagaactccattcatgcaatttaatcaagaacctattcccagaactccattcatgcaatttaatcaagaacctagaattggatgccaaggcgcataggaatgaccctatatgcttatatttccaacctcaatgaacaaactcttctttctctagatgacatttccaatcctccaaatctaagcccctcaagcagccccaacttgttcgttcctctgtcagtataaagattatccttgaatgcatacccttacttaaacaatcctcacactttccccctcatctcctgaattttctccagcctgccttgcagagtaaatattttactaataataatttgtactacatggtatatctccatgccccctgaaactggtattgacctgaatcaaaatactccaaaatattaaacccttctcagctagtttggttacttatcattcatcatttttataacacacacactcatatacatacacttactttgttaaaaataaagagaacttaaaaacaatggcatacataatctgtaagttgtcagataaagcatttgttttcttttcctatgtcagttgttgtttctggaaggtggaagagggaattaggaataattatactttattatatatgttgctcagtggccaaatcaacataggttcattttaaacatcagctgttctggtaatcatcatacttagaggtaatagtaatttggctcaaatactttatttttgggcatattgcttaagcatctgtccatgaattagcttttgtaatgtttcaatatgttctggttcatgttgggtatatttgattctgttacagtaagttaataccatagattttcaaagtagtccttggataatgtttaatatgtttccttagacaggcagcaatttaaatcattttttgtgactcttaatctacttttcatcttattcaaatttgatactagcaatgaacttgcaaatcgctttctcagatttcacagactacattaggttagatttgaaagaaaaataggtgaattgtcacagtaaagaaaatatttattacttattcatatagatataaaatttatttttcaaactcaagttattgtattattgttgatttacatatgaattccagagtagcatctgcatatgagccatttcctaatgcagaaatcatcaatagagaggttatactgttgattagcctcttgaatatcctcagcacatatgtatttctatctcctaatatttaacatggtttttgcctccatataacctccatattttatgatttgatgatagaaatataattaggcacataaatgaggtaatttttacaaaatattttttagtgagataaaatttgcaaaacttgaaaatcaaccattttaaacagcccggtgtcactttgtgtattcacaaagatgggcacccaccgcttccatctagtttcaaaacattacagcaccacaaaataaaaccctttacccactaagcagttgctccccattctcctctcccctgccagatccctggcagtcaccaacctgaagtgggtctttgtatttacctattctgagtatttcacataaatagaattacacagtatgtgaccttttgtgtttggcttctttcacttatctttacgtttttgaagtttattcagattatgtcatgtattagtatttctttttttttgagacatagtctcacgttgttgctaagactggagtgcagtggtaagacctcagctcattgcaacctctgcctcctgggttctagctattcttttgcctcagcctcccgagtaactgagattacaggcacacacaaccgcgcctggctaattttttgtatttttaatagagacagggtttcaccaagttggccaggctggtcttgaactgctgacctcaagtgatgcgctcccctgagcctcccaaagtgttgggattcaggcatgagctactgcaccccacctcattgtattttcataccacaatttatttgtcacttcatcccttgattgatatttgggctgtttctaccttttggcaattgtgaatagtgctgctaagaacacgagtgtatttgtttgataacctgtttttacttcttttgggtatactcctaggagtggaattgccagttaatatggttgttctatttttaactttttgaggaaccaccaaaatgttttccacagtttgaaatgaaccatgttggctgaggcgggcagatcacaaggtcaggaattcgagaccaggctggccaacatagtgaaaccccagctctactaaaaaaatacaaaaattagctgggcatggtggtgtgcacctgtaattccagctacttgggaggcggaggcaggagaattgcttgaacccgggaggcggaggttacagtgagccaagatcgcaccactgcactccagcctgggcaacagagcaagactctgtctcaaaaaaaaaaaaaagaaagaaaaaaaaagaaatgaaccattttatagtatttccaccagcgatgtatgcgagtttcagtttcttcacatttttgccatcacttatttttgatttttaaaattatacagctattctcatgggtgtgagggcgtatctcattttggttatccctaataactaataatgttgaacatcttttcatatgcttcttggccatttgtatatcttttttggagaaacgtctattcaagttctttgcccatttcttagttggactgatgatttgttgttgttgcattgtaagggttttttatataacctagatgctagatccctatcagataaatgatttgcaagtattttctcccgttctatagattgtcttttcattttctttaaaatattatttaatgcacaaaagttttaaattttgatgaagttcaatttatactttttttcttttgttgcttgcgcttttggtgtcatgtctaagaattcattgccaaatccaacatcataaagatttatctctttgttttcttctaacagatttgctttagctcttataattaggtatttgatcaactttgaggtaatttttctatgtggtgtgagtccaacttcattctatttttgcaatagtatttggttggtgcaaaagtaattgcggttttggtattacttttatggcaaaaactgcaattatttttgcaccaatctaatatatccagttgtcccagtccaatttttttgaagagtctattctttcctaattgaatagtcttggccttcatgtctaaaatcaattggctatagatgtatgagtttatctctcatttttattccattactctcatttttattccatttctatttaataccattttatttttatatcattttcattccattactctatatgtttttctttacaaatatttcaaagctaaataacttaggaattgggcattatccacaatgtttttaaatgattaatctggaattttaaattaagatataattatgtagataatatgttgtaggcactgtgctatgtagagcaaacatagacttgaatatgatactgtctttactctcaaggaagagcttaatgtttagtgcgggtccaactttagtaaaccaacaatttaagttcagtctgataaatgctcagattgagtacgggatgttataggagtgtaggggatgtaacaggtgtactcaccaatgtctattctactccaagtaattagtctgaagtaatcatgaatcctattctccttgccagacatgatgttttcaaggataggtatgcctaagtcaatttaagccatgagagtccccaggagaggttactgaggagttctggatatggttttattgctcttaagagaaagtataggaagcttctctcttcccagtgaaaataaatgaggaaatgttttccaaagtggtaattgttgcatgaagccatattggagactgcagagcagagagtcaagactgaactgtcttctgatggcatcactgaatcattagttgaaccaactcggaattcagaaccatctgtagtcttccttttctgtgagctcatcatttccttaactctttattatagtttaaacatggaattctgtttcctgaagataaaaagtcctgtaaggaacacagtactagaagtacatctaaatcggattgaggaatacttaaatggcttctcggagaagatggtatttgagttgaatgttgacttttgaattaaatgttaaagaacaagtagtagttagctaataagaagcagcatgattttaaaatattttctctcaacttataggttcccttttcattttgtttcctgtactgtgcaaaagacttttagtctgatacaatcccacatgtttatttttgcttgcattgcctgtatatggtgtcatatccaaaatatctttaccaagaccagtgtcgaggagctgtttccctttgtttaattatcagaattttatggtttcaattctcatacaacttagtagaaaaaaaatttaaaaatggacaaaagacttgaataggcattttcccaaagaaaacatacagaaggacaatagatatatgaaaaggtgctcaacattaccaagcatcagggaaatgaaaattaaaaccacaatgagatattatcttacatctgataggatgcctgttatcaaaaaataaaaagtacaagtgttggtgatgatgtgaagaaaagggaaactttaagcactgttagtgagagtgtcaacaggtacagctattatagaaaacaatacggacattcctcaaaaaattagaaataaaaataccatatgatccaacaaatctacttctgggtatatattcaaagaaattgaaataagtctctccaagagacatctgcactcccattacagcattattcataatagtcaaaatatgcaaacaacccatttgtccattgatagatggataaagaaataagatttatgtatatttaaatatttaaatatatatttacaaatttagtatttatatatgtatattatatccatattgaatagatatttaatagatatcatatatctatatttaagatatatatttaatagatatatatttaatagatatgtattgtacatctatatttaatagatatataatatatgtattatacacacacacacacacacacacacacacacacacacacacacacacattggaattttttcagccttaaaaaaggagatcctgtcttttgcaacaacctggatgaatgtagagtacattacactaagtgaaataagccagacaccaaagaaaaatattgcaggatcttacttatatgtggaaagtaaaaaggcctaatcatagaagaaagtaggactatgcttaccaggggtggggaggggggtgtgtacgggaaatggggagatgttggtcaaatggtacaacgtttcatatactagaatgactatattctagagatctaatgtgcagcatggggagtatagttactaatattgtatactcgaaacttactaaggtgaggctagatcctaaatattcccaccacatcaaaaattagtaactatatgaagggatagatttattaattagcttgactgtagttcactatgtatatgtatatcaaaatatattgtataccttaaacatacataaattttataaaaataaattgacaataattaaataaatagagagcacaaatggtagttaaaaagagccttaagatattacacatgctaacaaagattttacagtataaataggataatagaatatagaaatagaaagacaatgtatgctatcatatgtaatatgttttctaggtttcacatcaatcctcttaggaagataattgagtataagggaatagatgggagagacactttgaaatgctgtaactcaacagtaacataattatataagcacataattgttgaggccagatgtgttgataccacaccttgaggagttttcaaagcatcaaagttataataaagagatgatgatatggtctagttaattactgcctatagtagcatattaaatctgtaaactacagtgctgctaccaaatctaagatactgataccttctgatattatcgagatcacattttgaaaggaagagaatgcctagagaccattttcaatggttttctaggactgagctgtgaatagcggtaatctgaaaaacaatggcaagtcgagtctatattccaacccatatttaaggggaaataagatttggcactttggaaattcatctatcaagaatatatatcaatatatagttgtactcatcactgtgttcatactctgctgaccaaaatttaaatgctagctaaaaaggattctgggaagtatgggttttagttatgcatccttgtacctgtctaaaattcaggatgttttattactaaaaagaagaagggaagaattaattctggaaaacaattaactgtggaattatatagatcccagcagtaagttatttagtctaggaactaggtggaagcaaggagaccatataggcaagtaatccagtgatctagatgtgaagtaataaataatgctaccagacttatgaggttggcactgaaaaggattgggtggatccaataaatgttgcaaggaaagaagcactataacttcatgactggaaaacagaaagaaataaataaaaatcaatgcttgattatttttatatgatcttcagggaaataatcaagttggttataaataagaactcctgttatattaacagtaataatagggataagaaagaggatggttctttttaaaaatacctggtttatagttttaaagaatctattttgtaaaggacaagaactgtctttctcttacaaatttcactcaaatatgtagatgattttgattatcttgacaagcaacctaattttacatgttgtgatatacttgatattctgtaagaggtctaaagaactgataatgtaaagggaaaatgcattcggtgaatgaatatgctgcattatttatttgttattcatcatactgggaaattgtagcaggtagagactggtgagattatcacacacaaacacacaattttttggtaagccacaatacatgaataatgttatactaactttaaaaaatgagtcaatattataaatacaaattctagggcctcacattaactttttattttattttattttattttattttattttattttattttttgagacagagtctcactctgtcgcccaggctggtgtgcagtggtgcgatcctagctcactacaacctccgcctcccggatttaaatgattctcatgcctcagtctcccaagtagctgggattacaggcatgcactgccacacccgggtaatttttgtattttgttttgttttgttttaagtagtagagacagggttttaccatgttggccaggctggcctcgaactcctcacctcaagtgatcctcccgcctcggccacccaaagtgctgggattacaggcgtgagccactacacctggcctaaagttaatattttaagcgacaatcttcttgcccattattcactgcaaaaatgcatacatctctaatgggataaccacttctatcttgaaataaagatgtgtaagtcttggttctgtctatgctaatgtaagtatttttatcactgtaagtttgtacatttgattgtttgggacttgtcttggacagtttcttactgtgtgtttgaatttggtctatagatttacactataaggaaacaagtttattattttcttctataagaatttatagttatttcaaagttatgagttgaaatgttttgatagaagactacataaccatgggttctgattcaaaaataagtccaatcagtaatactcatagttacttgctatgagttgttaattaacttgttgttaattgtttgcaagatagataaaattagtaatggtttatcattattgactcccaaaccatcctgtttggatatgtgacatgtgcattttaagagttacagatactgaaagcaagatctaatatagaatttttaaaacacttttagctatctaccaagtcctttggtcatagattatttctaagaataataaaacattgatatcctaaagtatttgacaccagtgatttcttggaaagtgagcaatttgatatttccattgatagacatattagcatggctatatttgctagtagttgtaggtaaattcctttattataaaataaatttacctttattatcattattatgttttataccctcaagtggattgccagtactatcacagggaaaagagggttcttgggtctgagaattttgaaattttgtttcctcttaagaataaaaaataagtgttatatgtaacatcttgataaggaaatattaatgataccgagctctgaaaattaaaattagcgtctgtggaaaaagtaagccaaactagttttattcactaaaacacctaaaatcaactttttgatatatacaatctaccgtggttattatgcacttttatatctttgccaaattatccttacaattttccgactcactgtaatgaaacatattttccacttcatgctataccgtggcatttcattagtgtctataatggtacttgaattcaatcagccatattaagaactgacctatttacaggatggttcaaacaatggtgatacatacatttagatattgatagttttaaattctggtaaaaggtaacgttttatgactgatgaaattaatactggaacaatgagtttaattgaccaccagacagtatgcaaataaaatgtcaaaaattcatataatttaatagtccattaagcctaatggagttatatcccatataagccaaaggattcaagtagaattctattttggataatcatctgttactatttgaatataatttagaaaaatgcttagttctttactgtttgaatgtaacttagaaaaatgcttaatctaaaatatttaaaatatttatatgattttttactggataaaaataaacatgctcaagagtttaaaaatagatgcattttatcacttctaaagaggttataagtctacaatgcaaatattgtcagtgtctagatgtgccggcaagatggcctctgatctgccaccacctgatagtgtagttcccagaaaaccttgagttatcaaaagctgtgttataaaaattgcatatccatgagaacaaaagggccttagggcctagagagtttgaaaaaaaattacaaaaaaaaattatagtttcctgtagaaattttaataaatgctctcttagattctctaaaagatgttataaatctaaatgtgaaaacaaaatatttattaacatattttcatgaccttggagtaggcaaagttttctaaatgagacttttcaaatcattaatcataaaagaataaaactaataacctggaccatattaaagtaagaacttatcttcgtcaaagtacattattaaattagtgaaaaaacaagcaatggagtgagagaaggtattttcaatacataaatctcatattcagaatacataaagaacgttttacaaatcaatgaaaaaagatagagacaacagagtgggaaaagtggtaaaaaaaaaaaaaaaattgaacagaacttcatcataggtatccagacacccaataggcatatgtaaaggatctcaacttccttagttatttgagaaatgcaaaataaaactacaatgagataccattacacatctatcaaatggctaaaatgaaaaagacaatacaagatttgaaaaagatgtgtagcagttgaacctcttattcactactgtagagtgtaaattggtacaactctttttgataattatttggcagtatatattaaagctgagtatatggataccctgtaactgagaaatttgactcttagctacatacccaatagtaatgcaaacataagtttgccaaaaccaccatacaagtatgctcataatagcattaccaataatagccacaacctggtattactcaaaatgcccgtcagtagtatcatttttaaaaacaaaagatagtaatggtatgttctcacaatcagacactgtacaggaaaaaaatcagtgagtgaaccactacatgtaagtataacaaggtagatggatttcaaagaaataatgtctacatatacacaaagctagaaacataagaataaatacttaggattgggtttatttacagttcaataaaagacaaaactaatcagtatgttatgtcaggtgagcgcttccccatgtgaggagtggtcttcactgggaagaatatgaggagggcttttggagtactgctaatataggatttcttattctagatcatagttacacagatatgttcaattttcgaaaattagttgagatacttacgatttctcatcatttctgtattttctacttcagtaaaatttaaattgtgttccgtgcaggtaggcaaccatcaaaagggacccagttcacaacaaggagataaaccttggtagcctctttatcccttggttccgacactcttctccctcacttagagacgtagaggcagctggcaatagcaatagggggatcccaccacatccctatctcacagagagacatcctgcagccagccctggaaaatcccttccattcttcccaggtaacaccagtatgtaccagtgggagctgcagaggcaccaaatgtactgtaagaccaacataagatcgcaaaggctatgaaatttaaaccatcattggaaccacagcccaccatagttatgtcaagacctacgtgttatgtgctaacaaagagaatgcctactaaataaaagatttaaatagaactcagagtctcctatgtgagaaacatgtttcctcaaaaattgcttgtagaaatataaagtgatttcatcttttataggaaatagtttggctatacctcaaggtattaaacataggttaccatatggcccagaaatttaactagatacttactcaagagaaatgaaaacataagcctcaaaaacttacatatgaatgtacatagcaatattattcacagtaaacaaaaagtggaaacagctcaaatgtctagcaactgattaatgaataatcaaatcatagcatatccatacagtggaatattatttgctaataaaaaggaatgacgtacagtcatatgccacataacaaaatttcatcatcagactgcatacacagcaatggtcccaagagatcaggagttataggaactgaaacaggacgataaaaaaagaagaacccccaagtaaattcatagtaaacaggtcagaagaagctgttgcagacctcaagaagctccttaaaaagtttgaaaacatggacctcaatacctagtggtcttaactaacagagaagaatgtccatggtgtattatctgcttaaaagcaaatctatgatgaaaattaactgaccatatcaccgtggacacatttctgaaaagggtgacaattcctcaagaatagccccacacaagtcctttaggaagcattccagaaaaaggcatgcttgtctaggagatgacagcttcatgaatgttattgctcctgaagacattccggtgtaataagatgtggaggtggaagacagtgatactacttaacctgaagggtaatatatgcatctgtcttagtttttttaaaaaaactttaaaaagtaaaaccaaagttaaaattttaaaaatgtgaaagtaaatcaaagcttatagagtaaagacctaaagaaaatatttttgtatagcagtatgtatgttttaacctgcgttattatggaagtcagaaaattaaaaaaattacaaagcttataaagtaaaataattaaaaagtaagctaaagtcaatttattactattattattattattattattattattattattattttgagatggaatctcgctctgtcacccaggctggagtgcagtggtgcaatcttggctcactgcaacctccgcctcccgagttcaagcaattcccctgcctcagcctcccaagtagctgggattccaggcatgcaccaccacacccagctagtttttgttttgttagtagagacagagtttcaccgtgttggtcaggatggtctcgaactcctgacctcgtgatctgcctgccttggcctcccaaagggctaagattacaggcatgagccaccgcgcccggctattaacttcttattaaagacagaaaaatatgtttataaatgtagtgtgacctacttatactatacagtttttataaagtcttttataaagtctactatacagtttttataaagtagtatacattaatgtcctaggcttccacattcactcactactcactcactgacaccaagaacaacttccagtcctgcaaacttcattcatgataaatgccctatataggtatgacattttaaatcttttatcctgtatttttactgtaccttttctatatttagatatgtttagatatatagacacttaccgtagtattacaattgcctacagtcttcagtacagtaacatgctgtacagtttgtaacctaggagcaataagctgtgctatatagcctaatatactccatgatgttctcacaatgacaaaattgtctaatgatgtatttctcaaaatgtatccccgtcattgagtatcacatggctatattaatatgtatagtaagcttgaaccttgcatgcattattctaagtgaaagaagccagacacaaaaggccacttattgtacagaatgtccaaataggcaaatccagaggcaaaaagtagttagtggtttcagacactttgagagtagggaatgagtagtgactgctaatgggtatggagtatcttttaaggaaaaccaaaacattatggaattagatattggtggtaattgcacaactgtatagaaaaactaaaaaccgctctttggacatgaacatggcgaattttatggtatgtataaaacttattttaaataaagaatcaaatgaagattataaaactgaaagattcagtaagagaaataaaaataatttgctggattagccagtagtaaagtagagatgacagagaattgaatcactgaaattgcggataaaacaatagtattcactctgcagataaaatagagtgaaagattatgaacatagcatcagttcttacatgataggaactaaagagccaacattaataccatctgagtcacaggagtggagaagagggtggggctgaaagaatatttgaggaaataaaggctgaaaactatcccaatttggcaaaatacagaaacctacaggtccaagaagacaattgaacaccaaagaggttaaatgctaagaaatccccaccaaaatacatcataattaagtttttgaaaaatataatcagagaagaaaatcttaaaagcaaccagaaacaacacactacatattgacaccaatttgaatgtcagcaaatttctctttttaaactatggagtctgtaaagaagtggcataatttccaagtgctataagaaaagaacttcaaactgtgaattctgtgtttagagaaactatccttcatgaatgaaagggaaacaaaaacactgtcagatgaatgcaaactaaaatcatttatctgctacagaccttcctttaaaattgtgtaacagaagttcttcaaatggaaaggaaatgacaaaggaaagtaatttaaagtataacctacataccattggctatcctcttcctcatgaaatttgtaaatcttttatgattgaaacaaaaagtataatcctatctgatactcagtgcaatgatatttaaaagttgagaaggtaaaggtaaaaattggacatgtggtttcacacttcattctaagtggaaaatgctgatactggtgaactactttaattcatatatgtatgtagcagtacacagagcaaccactatggaaactacacagggagatacattcaacactataaataaatcaaaatagattcctaaagtatgttaaagtagtccaaaggaaggcaaaagaagagagagggataaaatgatgaaaatgaggggtttttttttcaatttttttgattatactttaagttctgagatacatgtgcagaacgtgctgtttgttacataggtatatacatgtgccatggtggtttgttgcgcccatcaaccgtcatctaggttttaagctccacatgcattaggtatttgtcctaatgctctccctcccctggccccctacaccccgacctgcccagtgtgtgatgtgttcttattcaactcgaacatcccgtgtttggttttcttttcctgtgtttgctgttaatgatggtttccagcttcatccatgtccctgccaaggacatgaactcattcatttggctgcatagtattccatggcatatatgtgccacattttctttatccagtctatcactgatgggcatttgggttggttccaagtctttgctattgtgaatagcgctgcaataaacatatatgtgcatgtgtctttatagtagaatgatttataatcctttgggaatatacccagtaatgggattgctgggtcaaatggtatttctggttctagatcattgaggaattgccatactgtcttccacaatggttgaacctaatttacactcccaccaacagtgtaaaagcattccagtttctccacatccttgccagcctctgttgtttcctgactttttagtgatcgccattcaaactggcatgagatggtacctcattgtagttttgatttgcatttctctaatgatgagtgatgatgaagtttttttcatacgtttgttggccgcataaatgtgttcttttgagaagtgtctgttcatatcctttacccactttttgatggggttgtatttttcttgtaaatttgtttaagttccttgtagattctggatattagctttttgtcagatggatagattgcaaaaattttcttccattctgtaggttgcctgttcgctgatgataatttcttttgctgtgcagaagctctttagtttaattagatcccatttgtcaattttggcttttgttgcaattgcctttggtgttttaatcatgaagtctttgcccatgcctatgtcctgaatggtattgcctaggttttcttctagagtttttatggttttaagttttacatttaagcctttaatccatcttgagttaatttttgtataaggtgtaaggaaggggtccagtttcagttttctgcatatggctagccagttttcccagcaccatttattaaatagggaatcctttccccattgcttttaaaggtaggaacaaaatgcagttgcttacaaccaccagtgttattttgccctgatctggaagatgagccaatgcaagcagataagaagcatatttattagtaatacaatcatatctattgaagaaacagcaaaacaataatataattcattattgcagatagttgtaacattatattaaagcttttaaaattctttgcctatggaataattatagcttcctttctaagtctgatttcaacttgatcatataatcaattgatgcttctctatactcttccaggctggaatataataggagctaccatttacttgtttgataggctctacctctgtcatgctttcacagaagaggcttttactataaagaagtcacacattgccctagttaaactgtccagttaagttcctgaaatattgttacagtgccaaaaccaatcatctttgtagatatggttcttagtatttgagaaaacaaatcaggttgtttaagagggagaccttcctagatagaaaaactagactccacagatagaggattgtgtgcacctatgtgatattactactctactaaattctatattatttcatttaactatttacataattttctcataaaacattagctagcaacatgcttatttaaaccttttatgttaaaatttttgtaattttgcactgtaagatgagctaatgcaaatagataagaaatgtatttattagatattcagtcgtatctattgaagggacagaaaaacaaggtaattcattattgtagataattataaaattattttatataaaatattttaatattctttgcccatgtaataatcatagacttatttctcaatctgatttcatcgtgattattataatcatttcatgagctctctatagaatatttgaaaagtatgtgattgattacttaaacaagtaaactataatgtaagctggcactattataaaataaacacgcagagcaatagagttattactatatatgtgaacctagagattttagtattataatgttactaatattttaaattacatcgtacagcataataacaaaagttttcagactcaatggtgttagcaagggtagcacatacaaggccaaaatataaaatcaagggtatttccatatattcacaatgaacaataagaaattgaaatcaaaagaatgcaattcctaaaacttcctaacataggaaacacttacatatgaatttaacaaagtgttctgaaaactacacaacactgatgaaagaaatcaaagaataccgaactaatgaagaaatagacattttttgaattagaagaattaatgttgtcagtcttcctcaaattgatcaatagattcaacatactcctaataaaaattctagtgcttttttttttctttttttttgagatggagttttgctcttgtggcccaggctagagtgcaatggagcaatcttggctcactgcaacctctgcctcccgggttcaagcaattctcctgcctaagcctccctagtagttggggttacaggtgcccaccaacatgccaggctaattatttgtatttttagtagagacagggtttcaccatattggccaggcttgtctcgaactcctgacctcaggtgatccgcccgccttggcctcccaaagtgctgggattacaggcctgaaccactgcgcctggccaattctaatgtatttttatgaattagtaggctgataaaatttatatggaaatgcaaaggaactaaaatagcctgagcaattttgagaaagaatgaagttggaggattggtaacacttgatttcgaggcttattctaaagcagtggctctcaacagaggactcttttgcaccctcaggaaacatttggcaatgtctggggacattttgcttctcataacttcgaggtttctactggcagctagtggatagaggctagggaatctgataaacatttgcaatgcaaagtatggcactcagacaaattatccagcccaaaatgttaatattggcaaggttgaaaaaacctgatctaagctccagtaatcaagaaagtgcaacattcattaaagagtagatccatatatcaataaaacataaatatacccacatatatatgatcaactgattttcaaccaagatgcaaaggtgtttcaatggagaatagataaacccttcaacaaatagtgctggaacaattgggtataaatatgcaaaaaataataataactttgacctcatacttcacattcatatacaaaaattaactcaaaattgattataaacctaaacgtaaagctgaaaatcataaaatacctaaacaaaacacaggagaaaatctttgtgacctggaccaggaaaagactttctaggtatgatatcaaaaccatgatccatgtaagaacatattgataaattagaattacaaagtaataatgaataaataagccacagacagggataaaaatttgtagagcacatatctgacaaagaacttgaatctaaaatatataaaggattctcaaaactcaagaaaacaaaaatgatgcagtttttaaaaagggcaaaagatttgagtagacactttaacaaagaagatatatggatgaccaataagaatatgatgatactcaatatcattagtcttagacaaatacaaattaagaatgcagtatgacaccactgctgcacctacttctactactactactacacacacacatgcacacccccaaacaaacaaacaaaaaccccttaaaataccagatgagaacacagaacttctgcaattcctgtgccttgctgttgggaatacaaaatggtacagtcactttgaaaaaacaggcagtttttaagtatagttaagcatatacataccaatgacataatctcatttctccatctttaccccaaagaagcaagaacttaggtgcacacaaaagctgtatgtgaacgtttgtagtggctttattcataaacaccaaaacctgggaacaatctaatattcatcacctggtgaatatataaacaaagtgtagtatgtttacacaatggaatgctacctggtactaaaaggaactaaactactgatacaacagcgtggatgaatctcaaatgcattatgccaaacaaaagaagcaaaatttcaaaaactaagatcttatttgattccccagcagcctgaaccaatcacattgagcttgttttgtgttacagaaaaacatttttttactctttaatctgtgtgttcttggaggcctctgttacaatggccaaccttaccttaactacgcacagtgtgtaccaaacactgctgcactctcacatttagttctcacgacaatattgtatgtaggcattttaaactcatttttacagaagaggagaatgagtctcaaagagatagagtaacttgctcaaggtcgcatagcccaaacattttggattcagatctattccaaagtctgtatacttttgccatatatagggttgtaagtcagacagacctgggttcaaatcctcatttagccatttactcctcttaagatttgctagacgttaaagataaatttggatgtggctatttcacagtgctgtgagaatttaagtaataaaaggatatacaatttggttcaaagtaaacactaaataaatgctgactgttattatgcctcaatgcctctcctcatctgtatacatacttgggattttgcagtaattataaaactacatataaagtgcttagaagcaatatatctgggatgttgttagctttaattattattcttgtatttgttatacatgcttaattggggaaacttctttgattccagtaagttcattctcaaaatgtgctttgcattctatctaaaatttctcgtgaaatagttacattcctgaaccagtcacttgcaagatagaaaggcgtatatcacttctgacattcattcccagttgagtttggagcatatacagtcagagatgttatcaagataccaagattttgcttcattactcaacactaatggacaagctgaagtagtttatttttcgaagagactctgaagcacacttaaggttttcattgtttactatgctattctgtgttcaacaatagaagggtatatatcaagcttgtccagttcattcacttacatgatattttataatataaatgggaaactgtatgggatacttctgtttaagcccataactcattttttttaaaaaaagtattctcttcatctaaatacattgtttcttgaaaaaaaattttccaaaaagtaatgcagtgaaaattgttctttcttccttgttcctcctctacactgttcctattccattctcaatgggagatatatatatatttgtatatatataatatagatttatatatctatataatatatttatatatctatataatagagatttatatatatataaatataaaaaaatatatatccctctggatatttctccttttttgaatgcatataaaagcactacagaattttccaagaattttgtcatttaaccaaactgaactcttggcacaccatttagatgaaaagatgtgtttgttccatgtggatccctagtatgtctgctaacaggattgacaataacagacattagaaacatactctgaatgtttactagttttacttaatctgtttgtctctggcagtgattcagaatggagttagtctggagctgttattgaacttcattgttactgttcttgaagccccactcatttcctgccaccccatccctattgtgtttgaagtagaaagctaaagtgttgtaagatggtgaagaggaacacagacatgttttagtccttggcatctcaaggcaaaattggtacttgaaaccagatatcaacctttagatcccatattctttcacctatacattgctctagtccatttcatcctctttggtatgtttttacaaaattttaaaatttacacacacacacacacacacacacacacacacaaacatatatgcccatttaagctgagggaatactagaagttatggatgatctgtataaaggagatgatctttattgaaagagccttaaaattatactgattttttaaaacaaagaataactttattctaatattcgtttaaaactgtacattgatattattttataataatggctgctatagtgtgaacatttacgtccataaggtctgctttggaccctttattagataatttagtaatactaattataataaccaaaggaatgtatttacttctcatggaccagtttaatgtggatgttcgcaccagtaagatgttttcctccatatagtgtgttaaagacccctgttctttccattttatggctgcttcattttctagactctacagctagcagaatgttaaagagacagtggagaaggcatctggttcttaaaaactatggccttgaactggtgcataaccacatctgctgcatttcagcaacaggaaatagtaatcatgtggtcatacctgcttggaagaggactgagatatgtggtctttttcttttctttttttcttttttttttttatgataaccattgttaatattttattaaaagccctcccatacttttccctatggactaatacatatatatattcatgtatgtgtattaggcagggcataatactatacatactattatctaatctgctttatttttcactaaatagcatgtatgaattttttttattatactttaagttctagggtacatgtgcacaacatgcaggtttgtcacatatgtatacatttgccatgttggtgtgctgcacccattaactcgtcatttacattaggtatatctcctaatgctagccctcccccctccccccctccccccaccccacaacaggccctggtgtgtgatgttccccaccctgtgtccaagtgttctcattgttcaattcccacctatgagtgagaacatgcagtgtttggttttctgtccttgcgatagtttgctcagaatgatgatttcagcttcatccatgtccctacaaaggacatgaactcatcctttttatggctgcgtagtattccatggtgtatatgtgccacattttcttaatccagtctatcactggtggacatttgggttggttccaagtctttgctattgtgaatagtgccacagtaaacatatgtgtgcatgtgtctttatagcagcatgatttgtaatcctttgggtatatacccagtaatgggatggctggatcaaatggtatttctagttctagatccttgaggaattgccacactgtcttccacaatggttaaactagtttacagtcccaccaacagtgtaaaagcgttcctatttctctacatcctctccggcacctgttgtttcctgactttttgatgatcgccattctaactggtgtgagatggtatctcattgtggttttgatttgcatttctcttatggccagcgatgatgagcattttttcatgtgtctgttggctgcctaaatgtcttcttttgagaagtgtctgttcatatcctttgcccactttttgatggggttgtttgattttttcttgtaaatttgtttaagttttttgtagattcttcatattagccctttgtcagatgagtagattgtaaaaattttctcccgttctgtaggttgcctgttcactctgataatagtttcttttgctctgcagaagttctttaattagatcccatttgtcaattttggcttttgttgccattgcttttggtgttttagtcatgaagtccttgcccaggcctatgtcctgaagggtattgcctaggttttcttctaggatttttatggttttaggtctaacatttaagtctttaatccatcttgaattaattttagtataagctgtaaggaagggatccagtttcagctctctacatatggctagccagttttcccagcaccatttattaaatagggaattttttccccatttcttgtttttgtcaggtttgtcaaagatcagatggttgtagatgttcaggatacaaaatcaatgtgcaaaaatcacaagcattcctatacaccagtagcagacagagagccaaatcgtgagtgaactcccgttcacaattgcttcaaagagaataaaatacctaggaatccaacttacaagggatgtgaaggacctcttcaaggagaactacataccactgctcagtgaaataaaagaggacacaaacaaatgaaggaagattccatgctcatggatagaaagaatcaataccatgaaaatggccatactgcccaaagtaatttatagattcagtgccatccccatcaagctaccaatgactgtcttcacagaattggaaaaaactactttaaagttcacatgaaaccaaaaaagagcccacattgccaagacaatcctaagccaaaagaacaaagctggaggcatcatgccacctgacttcaaactgtactacaaggctacagtaaccaaaacagcgtggtactggtaccaaaacagagatatagaccaacgaaatggaacagagccctcagagatatgtagtccttttctaggcagttacttcctatcattaactcctccccaaggaatgggaaccgttgataaatagctattcatctgtgcacaaactctatttaaggtagtttattacttttggtattgtttcattatgtggccctgaaatttaatatgttggtgggttttgtgaaatttttattttaattcactgaagtggcaaaataaccaccacactttgttgtgtgccattttgtggtagaacatttgtgtgtgaattctcattgcaatgcagagtatttcttgagtgagaatcaggtctgtgttcacctctagcctctgtaactctctaggtgtgaggccttggagaatcacttaatttctctgagcctgtctttcttcatccataaatcaaggaggttagataatgtgttataatcttcaaaggtccttacaatgttaaaattatatgatatttgagtgacataaattttaaaagtttatagtgacgctttgttttatttatttgtcgctttaattattgtgcttaagaaatacgttatcattttgagttaacagtcctcactaaaagattaaaaatttgctatttgtatttattcaggcctagttaaatttaacagcaacatgaaataaatgattacctgttttagatataatttcataataaggcctctgaaggtcgtttgaaatactgcactaattaacgttttatttccagccttccttaattattctagccagatggtcctttatttatgttattgctagaggtttccagctgaggttgtttgattgttgaagaaaaatatgtgatggcaccataagataattgtaattgaattgttaggtatgttagagcatttgagccttctgtcccggttctatccacatctgggaaataagtttgttaacaaagcactttgacacctcatctgatgcttgagtgagattctgaactgtccagatggaattcaaatggggaaatgactgtgcattttattgtaaaaggcactttgcaaatatctgtgcaaaattcattttgtgaatgaaaagaaaaaaacctttaaaataaagtacacttttaagggcatgatctgttttccaagtgtcataataacttcaggaataaactgttgcattaaggtcaaatttaaaatttgtgcagattaaccaccatttaggaagcagttaagtggagtttttatggcatggaacttcaaaagtgtaaatgaattatcagctgaatagatagtccaataaaagaagcagacttaaagtggaagataaaagtgataaagtgacagtaaattagagaatagaactaaaagctctattgttatgaagaacaacaatagacctgaattatctatgtttctttacaaagtatcttttctcatttctgtgcttatgagttttacaattactaaataaatagtattggatctgaaagcttgtatcagccaagttaggtagaaagccttattaacatggccactggcaacttaatactgggcaattttcctccaagcaaacgtgatttcattattatagtacttaagctgtgcacatgcaggataaatcagttcaatgaccttcttcccaatatgttcaaagatgttgaaatctcagcgtatgcagagctgacacgattggacatgattgttcaacatcttggtaattgagatgctgttttttcaaatcatggaggcattgtttatcttatattgtttatctgatttatatataaataaaattttattggtcagaagactttcataagtcaagttactggttgagtataaggcactaatataattattaatgattatggaggtatcaaatctggatgataatttgatacctaatgaaatggtaaagcaaaacaaataagtaacttccagtggaacgcacacacacatgcacacagatacgtttgaatagaaaagctgaccatgttgatttaaaaagattttcaaagaaactagagaggaaggggattggatctgttgttttgtcttctttttttaaatttcttctatcactttgctttcttttgcccataaaaattaaatggcatacttaagtcacccatcttagaggcactgacttctgctaaataagagaaagagcttatggagtgttgtgttgttcatttttttgtgttttttatgttttattttttccttattgacttgtcccaaagccatttctgtgttttggttcgttgattattcccacttgaataatctctctctgcaggaggctttttgtaccgatcactaaagtaagtctcctaatttataactctgaatatattttaatttgcccattgtggaatatgtgctatctaagaatatctacatgtgcttcaatacatatacttagttctaggcagaatgagagtcaatttgaatgttccgctgacttgctttggaaacacacataactacaagcccttattcagctattggccacgacttagtttataaggggagatcaatgttcctagactctgcatgaattaaaagaaagtgtatgtttgaaaatgtgatccagtctttttattcatgctactagacgtggagtgagagaagagaacaagggctacctattgggtactatgctcactacctgggtgatgggatcattcgtaccctaaacttcagcgtcccgcattagacctatgtaacaaaagcttgcacatatgccccttaaatctaaaataaaagtcgaaattattttaaaaagaaatactaatatcaaaaagaggaaattagtcattactactattgggtttcacttgtaactgacaagtcatttccttttactgctttcaagattttctccttttctttctttggctttcagcaatttaatcacgatgtatctatatgtggatctctatgcatttatcctacttcatgtttgtttagcttcctggatgtgtaggttaacgtttttcaatgaatttgggaatttaaagaaaatgaaaatgtgagcaaggcattcgtgaaactaatacagcttacgagaaattagagagggggatctttacataaccatcttgctagaagttattaaatgtgtttctattgggattaataagaagatgcaatgatacctttggttagtttgctttaattatgtatttcgaagttggctttttctttaccgatgattggttagtgatgaattcatcatccttctatatggcaacagtaaataaatatgatatagagaatttgtaattggccaactaaaagatacttgtagaaaatatatgttagaatgaactgtttagttaactattataataatgaaaacaactgtagtaaccctgtttaaaggatttatgaaatagattataagatttctttgttctatacattaaatgaccattttgttcacaaatttgttatggattgtagtaaatttatgctgcaaagtagactcctaaataattgttagtaaagatttatgcagttttaattttttatataattttacatattttcatagctgtaaaggggattgttagcatttctctatccaaacatacctgccagaaatcagtcattgttgttgttgttattttttttttccattatactgacacagtctaaggaaagttagagggttttctattttgtatttttctcattatgtttgagatgacaaaatcattcatcattctcaattactggaaggcaattcactgaattcaatgtgagttaaaagccagatacctataaaattcttgcactgaccagtaataataagttgtgatgcacattttatccctaacatattaataatatacctattttctattgaattatttctgagatatgccaaaccagtgcaagtgaacattaacggatggcttaaagaatggagaacatatttacgataactagaagaaatggacatattaataacctttactattaatagctagtaaaatgtctttgatcttttttgagggcagcaccttaaagaagcagtatatattcgaggtctcatatactgtaaaagcatcagaatgagtgcataccattctgcatacagtttacttttaagagaacattatatattattaatcctaaaagccattagacaagagaacatttgctgtttatttaaattttacttggataaaaagaatttttctgaggttatcttatgttttaactaaatatttgtcatttattatagatgaattattaagagatttataatgcatgtagattttccttcaatttagtaaaaaggaaagtttattactaatttatgtattgtaagttatgtagtttctagttaaaaactagaactgaagcttttgatttatttttaaataatagtttttatttgtcattgcgtaaaataattacaactcttaaactgtaaactaaatcaataggtaatctaataaatgtaacaattgaaaagacacatttggctggtaagtaaaacccttcagatttatgacattaaatgtaaaggctttcacatgcttttatttttaagctctgatgtgtcacttttcaaaagtgttatattggctgtttacaaatatgcttttatatatgtagctatgcacatgtaagttttcatctgaaattgtcatgtacatttattttggtcatgagtgcctctttgtggctttcagtatgaaatccatactcattagcatctagtacaaggcactaagtgatgtgatcacagtaatctccttaggcctatctctcaatgtgacttcttgccccagattttctcttcaccctaactggctttgctctgaacccaccatggtttttgttttctagatctgtttgcaaactttgcctttccgtttggaatgtttgctaagtcctctgttacccaaaactggcccctattttcaaacaacagtaacaatatccttctgatggacctttagcactctggttatcattgttttctggaaggtcttccattgcatattaaccctcagtccaggctaagtattttctctgtgttctctagcagcctgtgtttacctctgtgatggtcatgctgttatggaatttcctgtttattcatttctctccccaacactctaagctccttgtttgcaaatattgtgtcttatttatctttttatctccaaaacaatcctgcacagtgccctggctcatagcagacacaaaataaatgtttgtttcattagtgtttatcaaacaaaatcactcatgagtttcacctacaaatgcaatcttaaatgtgcctgtgatcacatccttttttatgtgtaacttctggaatcaacaatgtaccatgaatactgatattaaatatgattatctcaggtatctcctgtgagatagtgaaataacccaccatatttgtctctaaaactatgttttatcctcagaactaaatacaatataagcagtctgaaatatatattgaaatctatgcagtctgaaatattcattattgacatttcctgaaaacatggaagtgttttccagttatttgtttgagagactggcattgctgttgtagacagaatggaaatctgtgaatttcttttcttttttttttttgtttttgagatggagtctggctctgtcacccaggctggagtgcagtggcgcgatcttggctcactgcaacctctgcctctcgggttcaagcgattctcctgcctcagcctcccaagtagctgggattaaggcacccgccaccacacctggctattttttgtatttttagtagagacggggttttgccatgttgaccaggctggtctccaactcctgacctcaggtgatccgcccgcctcagcctcccaaagtgcagggattacaggcatgagcaactatcattcccatcattcttcttttctcattgactaatttaaaatgttacctgggaaactgtttaactgttaatggttgccttttacattttttgagtaaaaattgtaattcctttaagtaagacactgtgttttatatagctcctttactgtgcatgttgttggtgtccatgtttagatgagtaatgaaaattattgatgggaaatagggtcatttttattattgctgcagacaagatgtggtggatttaagatgaccacaaattctttgacattactcacaaagaaaggtgacatttatgtcccctccccttgaatctggatggactctaagaaggctttgtccagttgtgtacagtggaaatgatgctgtgccagtttcttagccaagaccttaagagactgacaatttccacttcttgtctcttagagcacttgctcttagaatgtttgttctgggtaggccagctaccatgtattgaagtctgtcttccctgagtgaggaggagtgaaagagggaaaagaggagggagagagaaagatggagagagaccaaggaacaccaggataccagataagtgaatgaagaatgtgaatccatcttggaagtggatttcccagtcctaatttcctcagcggccacaacatgagtcagagatgagctacctatccaagttcttccaagattcctgactcacagtcatgatttaactatgggtatcgttggttaagccattgataaccggaaaaaaagggcgatcactttatacaaataaggaaatttaacatagtttagtctctaatttgtgaatagtacatataaagagtggattgtgaattatatcttgagcgtccttggtaataggcatatgttgccaaaatttctttcatattccttattaattaagtattaaggttattttttcttcatagatcgacatgaacaaagtttgaaggaccctaaggaataaaattttagtaaataaagtagaatgcaagatgatcatctcattctgtgataactacttcttttgaattttgtaacagtttctgtgatatgcatgttgattttttaggcttacttttaccttttgggcaagcccagtcctctgaggtggcagcaagaacaacaagccactacaaatagctagtaatccaagtcaatttcagtttttccatatattaatgaataaaacttaaaataaaacttaaaattaattcaaatgtgaattaatgaaagttctgtttatttatcctaccaatgatcatgtcagatcatgtcagtaggagaagcaaggatactttgagctgttagggtcaatatattttctttaatttataactaagatctttgccctgtaattttatcctttgtctactgcaaaaatttcctccccaaactcctacttgcaccgtgcactaaataggaaaataagcctgaccatatgtgctgctgcccctaaatactctttatttgcacatgagttttctctttattatgttattaacataaatcaggatcccatgaccaggacaactgagattagcacctctactctttggtattagccaggccttctgctatgcttaattgatctccaacagtattattggcccgtttcactgttgtgcttccatgaatgtaactgattctgaattacatgtcattaaaacaaatactttgtaatgtcccctttattagcaagaaatgaaactcatcaccagcatgacttatatatatagctccttaaatcacttcttttcattcaatgttgttttgatataatattaaagagaaaaaaatacttcctggatgaagccagtatctttatagagtttgcacattctccccatatctttatagagtttgcacattctccccatatctgtatgggattctctggctactccagtttattcccacatccaaaagatgtgcatgttaggttcattggcctgtctaaatgatcccaatctgagtaagtatgggtgtgtgtgtgagtgcgccctgcaaagggatagcatcctgtccagggtgggtacctgcgttgctgccccaaggtggataggttctggccacccaccaccctgaactggaataagttggttcgaatatgaatgaatgaatgaatgaataaaatgattgtaaaataaaatttcatgaagtttactatagtcatgcaagtgtatggcagtaaatgatgtggtaggagagtgttcactgacccccaagttgtgattgtttgtttttgaactgagtggtggtaggaggttctccttataattttctcttcacaaacatttattccttgatacatcctaccaccactatgattactgtcactcactgactcaccaaaaattgggtaaatcattatcttacttgttttaattactccttcttaaatatatatatagctcacatttgtttcaatgtttaatattagaagtgtttgaggtctttagttagaagcgatgatgttacataattagaaatataccagaggaaattaactcttgtttatatcaattagcctgcagtaaagttggtttcattatacatcatttcactgaaactcagtttccaaggacatatcaataatgttaggtgaggacttaatatacatgattttaaaaaaatacagtaaaatgtcctaatgtaaaagatacataaaatgaaggtaatttataataaatcaatatatatttaatagctaaatgtttatgtgactgtgctacaaacataacgatgtagttagatgcttgcatctattcatagaattagcagaaatagatggctacagatgctgacaaatagatgcttgttgttttggtgactcatccaccatgggcagcattgcagtacagtgacattttttgaaaggataaatggctcacaataaatttagaaacaaagtgaagggaagtcttctcttaaaatgcacatggcatggcagttgcattcttgaaaaattcagtgttaataactgtgcaaaatgtacttagtatttacataaaaatatagttagggattggatttagataattataaatgggtgagtacttggttagacatttgaatgtcatgcaggagtcacgatggttcacagtggggaaagtatcttgggcattgcaggatctttagaattcccggcccattaaatgccagcccagctgtttccccattcattgtcataacggccacactgacacacacccaagaaatttccattacatccctttgggatgtcacttccaccaattaagaatctttgctttaaacactctcccttttcttctttatcttttctgtttctacccctgtatctttctgacagtacatgtttcctgaattctctggattaatacataaaatgtatcctaactaaacatatcacaaaatgttatcaaacttatgtaataacataattgtaactctttatgaattctcttaccaaatatattctcataaatcttggcatataaatgttaaactataccctatttttaatagtataccttttaactaatattactcatcatattgtataattctcaatttatactgttagtaatttttttcctttttttttttttttttttttttgagatggagtctcgctctgtcgcccaggctggagtgcagtggcgcaatttcggctcactgcaagctctgcctcctggtttcacgccattctcctgcctcagtctcctgagtagctaggactacaggcacctgccaccatgcctggctaattttttgtatttttagtagagacggggaatttttttccttttatatctatatatgagtctactcatttgtaataatacaaaaccccttaaaggaaagagcacatttttgtatttaggggtctcttacccaaaatagatggatatatgtatataatatttattatatttgttgaatgaatgaaaaatagactattctattagtatccttcttctgtggataattatgagtcttggaggtttcaaccttttttagtgataggaataatttgataaacttttaagcaatttgtttcaaattagcagcattctccactgaaggagggagagttccagggggtatagtatcctccctatctggtcaggaggatatcagttcaggcaccagcttggagtgtaaagcacactagtgaggtaaaggtatttattccctctgcctcttccctgtagagttgcctcaagctggctgtgtcctttgctgtaaggtcagagtttttctcaaggtagccatctgtatcagtccattctcatattgctaataaagacatacttgagactgggtaatttataaaggaacaagtttaattgaaacacagttcagcatggctgtggcggcctcgggaaacttacagtcatggcagaaggggaagaaaacacattcttcttcatatggtggcagcaaggagaagaatgagagctgggccatgggggaagccccttataaaaccataagctctcataagaatgtactcactatcaggagaataacatgggggaaactgccccatgatttaattgtgatgggtgtctcccatcacacatagggattatgggaactacagttcaagatgagatttgggtggggacacagccaaaacatatcaccatctctacacaacattctcctctggcttctaataaccttccctccttttctctttttggcttgtggagggtcctacacaacccaatatagtttccctgcactctgcccacacctttgtaaataatccttttgtgaaccttcctcaaattatcctaatttgaatgtgtcatctctttcctcttaggcactgactgatataacccccaggcacagttaattatctgcttggtgtttccatgacattgtgcatatagctcctttattcatttctttattacataattcagcatatatttattgtgcatccactaagtgtcaggcagtctcctgggcccacaaggaaaatatatccatgtaagttatgccagcattagttaggcagttgtatgctatttaatgttatttaatgtaatgttatttacattacattatttaatgtattgtaatacagttatttatgcagttattgtaatgcagttatttaatgtaatgagtcctacacatacagaagtctatagtgctatggaacttcataaaaaaggttcataacttacacataatcattggagacattgtctcaaagaatgtgaaatccaagctgagaccagaaaagtgagtaagaattagacccgcagagagggctgacagtgagaagggaatgttccagctcaagaaaaacatacttacaaaaccaaaaaaggaagacatggcatatttgagtaatgaaaggtaacagatgatgtgtttatgacgagtgagggtgtgtcaagagatcgttctggagaatatgggtcagattataaaggacattgtaaactgtgctaagaagtttacctttattctaatgaggatccactgaagcaagaagcatgacatgaacaggttgtaactttggaaatgttattctgattagttgtagagcataggtaagaggagaataagaatggagggagggagactgtatgtatggtcatgatagggggacgaaccaatgtatattcacctggtggggaagaagaagagtaatcagatttcagagagattttacagatagcacctacaagacagagtaatttactggtatttgggggtctgaatccctaattctaaagacggtgggagatttcaagcctaaacctccaagtttatgaccaggcaactagttggcttgtagtgatagtcaacgaaatagagaaggtgaactgtgagcaagttttggaggaaaaaccatgaaggcagcaatagataaatctaagtggaggtgtgtagtaattatatagataagtgggcttgagttttatgagacagatgaggattggtagtatggttttagaagtcatcaacataagctgaccattaaagcaaaggagataagatgaagcagtgggggcagtaagtcagaatatgattgtatcatattctaaggcaaggatattttaagaacgcttcaggatgacacctaagtaaggactgagaagggctcagagaaagaaatgaacagggtgacaaaccttgattgagacagtttccatgataaggtggggaagaaagcctagattagagaagtaagagatgagaaagtagagtgagtaaaaataactctttcaagtatttttttccctgaaagagaagagaaaggattttagttttggtaaatatggtggtggctcaggggcatcgattgcatgcatgcatgcatttacatatgtaagtacacatatgaatatgtaggattctatgtatgttaatgggagtatcttaaagtggtttaaatgctgatggagacaggcactagggagtggattaaaggtatagggaaatgaaataatcattagattcagatttaggggaaggtaggataggaacaatatcattattatcaatgtatattgttctttcttactagcttgatccctaaaaaggcaaagactatattttttttgtatcctcagcatctaagacattacctagagaatactgggatcttctatattttagttttaggaaaaaggaataatagcttgctaaaataaaatagttaatttacctcagaactcttccaagatcctcagccaacatttgcattatatcctaccttcaaaaactgtcaaacgtatgtcctttaggtattttatgcatagaaatgttttttaaatgatcccttttggacattaaataacagttttaataattttgaattagtactaagtgccatttaagtgttctcctgatatatactaaatgaaaacagaaaatgatgcatgggagaaatgagttagatcaatatggttaaatttaataaaattcaaattaaagaatctacattatttctatggtgatatcactatgatatgtgataataactccctcaatgtataagttccagtcagaagatgattatgtgcagaaagcttttgcttttgtgaccctatatctcacctgttcttttttattgattgattatatttgaagagactcaaatctgtttacattagattaggctatataccagccacgtgattttctgtcatactaaaatttcaaacttaagatcagaagtaatctagattctataataaaaaatcatgacatatgctatggagcttggctgtgactcaattaaaattgcattttttttattatactttaagttttagagtacatgtgcacaacgtgcaggttagttacatatgtatacctgtgccaggttggtgtgctgcacccattacctcgttatttaacacgaggtatatctcctaatgctatccctcccccctcccccctcctcccaccccacaacaggccccagtgtgcgatgttccccttcctgtgtccatgtgtcctcattgttcaattcccacctatgagtgagaacatgcagtgtttggttttttgtccttgcaatactttgctgagaatgatggtttccagcttcatccatgtccctacaaaggacatgaactcatcattttttatggctgcatagtattccatggtgtatatgtgccacattttcttaatccagtctatcattgttggacatttggcttggttccaagtctttgctattgtgaatagtgccgcaataaacatatgtgtgcatgtgtctttatagataccatctcacaccagttcgaatggtgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagcaatcccattactggttatatacccaaaattaaattttatctaattatgttggtggtagtcagatgtgtactctttgaccagttacctgtagccaatttgtcacactttctttctgaaacttattgaatagtttttaaaagatattttatcttttgagaatttttggtaaaatgcttagttggcaataacatctgatttatgaatttatatgatatccctcataatagaatttcaaaatacattttaaaaattactttttaatgatagaaggcaaattccacctatctgatcattccaaaggcagaattattaatttgatggcaaattgattttcatatattataaaaaatgatgctccaaatagaaaagttttacttaaaatcataataattttgccattgatcttatacaaactttaaaatccatatgttcaaagtacttaagggaaaaaggaagtagttgatatatccttgacatctgctgctaaaaattagattactttgtattcgcatttaaagtaaacaatgttaaacatggaaactatcaagtgaagaaatatgtactgttatctcttctgaagagttattcaaatttttattgttatataaattaaaatttagtgtaattttaaaaactcgttttctctttgtaactggttagtatatgccaaggcctgtgttaagtgctcaatatacattatattatttaatttatgcaatactatgaattattattatttccacttatccagtgagtaaactgaggttcaaagaatttagataacttgatatgctcacaggctagtaactaggcaaaacatggattcaaatttgggtttctgtgacttgaaagctcatacactagacccttactatgtatattataatttcagccatttgcaacatttttactatactttaaatgtaatatttgtgcatacataatataataggctatatttgtttatatatcttaaatgcattaaaagaatatgtggtacctgttactgtgcttagaacagctgtaggaattatgatttacaagcatgtataatatgctatctacctttcattctgcttggaaaaggatgacatatatgagtaaaatagtgagtgatatcatccaaattgtatgatatacattatcatataatagtataatatacgaaaagtgtgtgttagaggcagcaaatcctataggagttttgttaaaaatgagttcaatgtagtcatatgtcatcaagtagaactttttgggggagatgaggactaaacatggatggatgccaaaaaatcgcattggcttgtgtacacacaaactggacctgctgagatccatctgctttaggattaaggttcctctaaaactgaagagcgtcatgaattttctggttctgaaaatacttttagcacagtggccccatgaatctctatgccctgtgactgctttatattactccgatgtagccaaagaagtttacttggaattctagcacctgcctttgctcattggcaaatcccactgcttgacccataccattttcccacagctcccactttacctgagttttgtcctggacggtctgtcccaccatgctctcacctaaatccagccttcctacaatagcatccttccttgattcctgttctcattgagactaccttcctggcccctttgccagtgttctccgctaaagagatgttccccacagcttctgtggctggcttctccagaactttctaactccctataccaatctgtaggaagcctcacagtcagtattatgctgtgttctccatggctgagtcagatattcagaacgtgtgttttaaaagtagtaacagcttcaccatagcaaaagcatagcaaagaaaggcagtaaatcctgacacaattatgaatctcaaatgtattctttcttgctgtgctattagatatgagcaataatagtttataaggatatatgtaggcttttgataatttctatttttaatttgctatgaataatatatatgtgaaaagaaaatatttgtgttcaagatgagtcagtattttgcttattaaatatatgtcctatcacggtgtataaataagcataccactttgaaacaattaaatgttttgcaataaaataaaattcagatataaaatagttacacatttttcaaattagtctatttttatcaaggtttataatcactttccagtacatgaaaattatcatataaataatttaatagaagactctgctctcttcacatttcaaagtttattttttaggtatagaaaaaaatcaatattttttttctcattttcactcctagaattagaatccaaatcatttttaggtatttcttttaatgcttacttttaaatttacctaactgtaattttatccagcggtgaaaatctacaggatcagggtcaccttgccctgtgtcaagctattccacttcttaactgtctctgtacttaaaaatctatgtcatttgatattaaattctgagtttgtgtttatttaattttaaagccaaagataaaatagttcaacacaggaacattatcccagaaatgttgttactacctggtcatttggccactgaaactgaagaccagatgggaaaacatctaatggtttctcattaatacagagaatgtagttcaatagaagaggcaatatgtttgttgttgtggccagcattaaaataaaagtaatcaagaaggtaaagactactgatgtaggttgggagacaggagttggggagagggatttagtcactatgtttaatagaaatatataacagagtcattgattattaaactatgaagatatttaaagatcactaatacaaactcctcactttcctagaaaaaattgaggcacaaagaaggtaagtggcttaacccagtataatccaaaaaattaataattaaccaagactaggatatcatctcgtgactttcagtcagtactcttttggcctttgaaaaaatacagacctgcgtaagtatttatatgcaccaatatttggagaaaatatataaggaggaagacgagagggaagaagaggcagatgacgaggaggaagaagaagaaatccatgaaaaagctactgagaatcagtgaatacttctaataaaaaatggacaccaatttaaatctgttgctatctggaaattctctttcttcaccacatatatttaagaattactaaataaatgttagaaatcaagcaaaaacataacttgtgactccccttgagtcacagtttgaccactgttgctcatccagggcaacctgtgaagagtcattatctagaaagattcgcctgaataaggcagacattggaccaaagcagcctcaccctatgactaggactcgatttcagtaagttgtgtttcctgtatatttttgttcagaaagtggtacctgttcctcactggtctatcagactcattaaatgttaaggattcttaaatgggttgtaactttgaggcatcttctcttttgcagttttggttttgtttctttgcttaggtttcagggtgaaaagttgatgaaaataacattggtatggtaatttgattatgataaatataaataaaggttagatgttctaagacatagttaaattcaaaggacacctgtaagaaagtggaaagatagctgtaaaaagtttcactgacaaaaatatagattctttctcaagcctcatattcagaaattctgatgtaggaatatacaattttaaaagaaacttccagagtattttaaaggtcgtccaaggtttgaaaaacactgacttacactgtctaaatattggctgttatgattaactgataaagtttatattcaattcattgtgtatcatgttttgactagtttattgttgcttttatgtgtttgtttatgcttttactctgtgtttggattattcatagcttccttaacacccattaccgtagtttattgagagttggctcggttgctttggaaagctatatttctgcaattctacaactccatacttttgtaattaaaatagagttcagacttattatttggaactacctttaggggtaactggcaaaacacataaagaaattagcctcactgctatagctatgcctcatattttttccccaaaaagatatctagatctgagccttccaatatgacagccactggcaacatatggctatttaaagttagttaaaattaaatacaatttaaaatctagttccccagtcataccagcatcatatcaaatcctcagtaggcacagtaaatacttggtatttaacctctcaatattaaacagcataaatataaagcaaaaagttctattggacagcactcatctagaatgaccacctaccctattcacaagactagtctgtagaacttttaattatttgcaatacttaaatccacttttaaagggtaaaagaatttgccaacactaaagatagtcaaataattttgccataggatctaagggaggggacagtgctcgtattttgagcaatatctcaaatacatgcagtttagggactgtggatgactatagatgaatagcacagcttttatatgaatatgtacattttggtagtgtaccaggtatattctgcctgcccctccaggtccactcttcactgctgtctaccctgctctctgccccagaagctgactgtagttactatgccaatggacttccttacactttgtcttccagtaggtttggtatggagtatgagatcaggatattgtctcccactcccttctaaaaaggtctcaaaggctgactgcactgcacaacccaaggtatatcagttatctattgtggtgtaacgaactatctcaaaatttaatgacttaaaacaacaataatgtattcattctcacaatttgatgggttttctgcgttaataagtaatctaagaagttcctcttttccatgttttgttggcttatgcgattacattgaacagggaggtctgcttaagtcagaacctgtctggcatctcagttggagtagctagaacagctcagggtggctgatcttttctctatatattacagttgaatgacactacatcattgctcaggggttcaagaggaggaaagtacaagtttctagacctctgaaagtctaggcctggaactggtccagcattacatccacaacattacatctactgcatcttttttttttttcctcctttgagatagggtcttgctctgtcacccaggctggagtgcagtggtgtgatcatgactcagtgcagcctgaaactcccgggggctcaagtgatcctcctaccttagcctccccagtagctgggactacaggtgtgggctaccatgaccagctaattttttaattactatttttttagtagaggtgtggtctcactatgttgcccaggcttgtctcaaatccctgggctcaagcaatcagcctgcctctgcctcccaaagtgctgggattacaggtgtgagccaccacacctggaccatcactgcattttatcagccaaagcaagtcatgaatcaacttagtttcaaaggatggagatgagacttgatgggagaagcagcatgcacctacaaatacaggagggattgctggtagccatatccaccattgaaaatcacagattctgtctagggacctttctccatgactttcttgcttttgatttcttggtaaccacttgttccccttacccctccaagcttaggggtggtgtgactccccggttcttacgaatccctacacactgaattacaccttgtgaatttcctatgcctgtttaccccagtggggtaacttcaaaatacctgaatggagaattattttcctgcttgatcctgtttcatctattctcaaaaattagttatgttgctttatcttactaccttatacctgaaattgttcacaatattctattaatttttttgtagcaatcataaagcatttaaaattttcctttacccagttagctttacatttagtctttatgatttcttacattaggatttaatcttgatggagaatgaatattaagtttaactaacatatctgtaagccattatttcaaaatgaaatcttctgattttggtaacatctgcaacctccagtgaccagacctacagtctttaactgtatgactcagttctgtgttctgtgttcagtatcaatgtcagtagtgtactaaaatgtccattttttctctaggattacataaatcttttacatttgtgtcttaaacaggtcaccaagcatttaactttaacctttttatatcatttatgttcaatagaattcactacttttactactctcatcagtgcttgtcttctgacttattaataaattaatgagcttgttttaacaattgaaatttaaaccagatggtcatatgattactcagtgttttcaggatcgaggattttaaaaactaaatgtcattattcccctcagacatactgatttcttgatattaaattattttaaggtttatagaactagatccagaaaaaaatgcttcgtattgtagaaggaagagagctttccatctttaatttacctaaagtggttttccaaatgattatatgtaaatatctgacaccacattgttttcttttataatttatttttgattctgcttaaagaaatacaaggctttagcaaatttaaagtggtccactaccccaagacttaagaaaacatttatactaaacaaatttaacaatgtatatgtcatatcaactgaaaatctgaatttttacttttttgctcatttttctgacagaatatgatagctgtctgaaggatatgtaatatttataaatgggatatagcagatacaacctgttaatatgatatacactagagttagagtatatctagatatagaaatactagatttgtaatattgagaccacattactgtgatatttcattgcagctataataaatttttatgacttatcataaggtaaatgccaactttgcaacatgtatctttttttctttgcaactgacattctatgttcagattcattgtgctcctgatatattcccatcatttcctttcctgggagaatccctttcttgtgaactacagtgacttttttattgacatactgcaagtgcagaagctttccaacaaagcattgctttgtaacagtagaccaggtacattctgctaagcaataaatcatgtatatattcactggagcacaaaaatattttggtgatataccaggtaaaaattgatattctagtagggagattttgattaaatgccctttcttctacaactttggtcaaatttcaggtgtttaattcccatatatgatgatgtttgtgaacttcaatatacattgttatgtttttcacctgaattcccagctgaatgtaaaaactgagaacaagaaaaggtgttattacttagaggtgtttttaacagctctccaatttcataacttgtcatttcccttttctttgatttagaaatgtgttatactcctggaagttttcacatttgatagatgtaaaaaatagaatactttgagagggattatactagcatagtggttaagagctcagactctggagccagagaactgggttttacatttcatctgtttcttacttgcttttaacactgtacatgttaatgtctcaatgcctcagtttcttcatctttaaaatggaaataatatccatatacatagggatagtcatactttatacagttatggtgaggattaagagttaatatatgtgtagtgcttaaaaagtggctgtcatataataaattctatgtgtttgctatcattgttgctattgaaagacaatgaaagcacatttgctcatttaattagttccagtcattgttattaatgtatttcatttcatttttcctgcagtgaaaaagaatgcaatggatccttttgccattatttaacattttaagttgcatttttaagtttatatataatgtattctacaatatttcacaatatatgagatattgggactttaataataacttgtgtgagtaatgtctctagtcttaaagactctaacactatcttaaccaggcaaagtaaaacactgtcttaactactgagcaagtagtctctttgaaatcagcccattttgtggatgccatatacatgttacactttaaagcatataaggttgatactttactctttctcaacattgattagagactaagaccttgttttgactataaaatatatttctttaagagggagaaggagacagtgccctgtgtttcagtgaggtatggaacacctgagttcaggtcaaggtcactgccatttacttgctatgttgatctcttacctttgtgactcacagtttctttatcagctaattctgtgattagtataaaaatcaaatatgagaaataatgtcgaaacactttagatgctgaaaatattacagaaataaaaagcagtgttattgaagccactgtacctttatcctgctgaagaggttaaggattaaattggttttgaatatatattctgtggtagtggggttggagcattgcagaacatgctgatgcacatgcttagggagagggacaatgatttctagccaagtgtcagaaggactgtgtggtcgtgaaacacaggctgcatttggcagaagtgatccaagctagaggtcagatcagtggtgtccaaaagatgatttagaagtcttctttttgcccaaagccttttgatgaatttcctatcaagtatttttctaagaactgttaataaatgtcaaaattaacagatttcagttgtatctccttttcatcctgactctgcaagatagactccagaatatagcctaaaggaaagagaagaaaagaaaaagtaatggatagagtagatgcttctaatataaaagatttccaataggctgagtgctatataagaaaaaggaaaaatatttgatatttttaactaacatttattgcgctacacattttgatagcattccaatgatgattcgacctgccttgtctttgagattcttcaactagttgaggaaagacatctatcaaggaaagtatctacatttctcctgaagctatctgaaagagttccactgtttccctaatcaggttgttaggtaaggacaaagatgagagcatgagtaatagaatttgtggggtaggtgagggcagccagaccactgcctcggcagggaacaatttgggcagcctccaaaggaaagggatctttgaggcaagagatttaaagaaggttttttacgaagtttgtttgtaagtaatgtacccttctcttcttatcccaagaaagcgtcactgaacttctgtatttcatttcagtccatttgagttgaagttgtgggtatttagagttatttttggatatgatattatcttgagactgcccataaggtgagagaaacaagatgtcccaataaattttgcatacagatttataaagaaataaacaaaatacagggacactgccactagatttttacataatattcactttaaataacattttaattgtaaatatttttggtcacgacctctaaacaagtcaataattgaaagaaaaacaaataacataattgtatataacacattgtacttttaatgataaaaacaacaattacgactaccatttatatatgcccagccaggaaatattctagatgtctttatatgatctaaccctaacagtaacttgaaacatggtagatgttgatagcctcatttttaatattagaaaaaggaagctcaggggttaagtgacttgccctagattaaacagcctaggaagttgcagagctggaatttcaattgaggttgcctccgaagcctattctttttccaacttattgtattccttttgaaagaacacaacttattttaggaattactcatagaagcatctcctgttaattcgatatttatagtctcataaattgaatcctaaattatagcgttttagaacataatatataaaaaaagtggaaaacatttcgactggtgcaaagaaaatgattaagaggataaaaatagcccaaggcaatagtattaagttaggcaaacgtaagctgaatgttgagaagttaagaatataggcttcttagatttcgattttcaaagtaataacttttcttattacagaaattgttttttatgtatggtgcttattactaaaaaaagattaattatctgtcattcatgtcaccaacttactaagttgttacattggccaatttttgtctttcttaaattattttttatctcatgtttctatctcatttgggggaaagaagaaaaaaggcaaaagaaattcctttctgaatatccatacacattgaagttttatgttcatagtaaactaataactatttcttcagtgtatgacgttatagtattttttcctccaccctcaccacaccttgttttagcaacttagttcattgccaaatcctgccacacctccctttattccactcccatatccaatccagctcatcttttatcgtactgattttaggaatgaatatggtccccttatttaccaaaaggtgtctcagaagttcgtgttgtttcctagtgttcattaaagcttgcagatattgaagtgtcaccagggcattctgatggagatgcccagcaggtgtttgagattgtccctgggaggtcagaatttaggattctatttaagacagtagtttcaaatctgagtgatataatggctctcctttaagagaagtaaaaataagaaatctgcaaaagacattattttattctttttcatggctgtgtagtatttcatggtatatatgtaccacattttcttcttccagtctaccattgataggcaactggccccatgagcatcttgcaaatcccagagtcagaagcaactacagtaagagctggcatgtaagggttgctgaactgcaatatcagacaggcatttgagtctcagtgacagcagcattttctagaaaacagtggtatctccattggtaaagatgattggaatggtgggagagacacttcttatgaaccagtaatttctaagccaagtacagtaatgttaagttcaagaactatatgcaaccaaacactagataatataaaagtaaagcaaattaatataaccaacttcaacatctgtgacagtttgtgttttccagtgatgaccacaatatctcctatcccatatattcttctgtaatgtgactttgctccttccccataaacaggtagtcttattcccctctttttgaatgtggactgaccttaccaactcatttataaccattggaatggaaaagaattcatgtgtgttccttccaaggctagatcagaagacgtgtagcttcttccttagtgtactgttctggaacactgactctctggaaaattcccgctcagcatgcttcctcttgggagctgccatgctgtcagaaccccaggctacataaaaaggctacgagccagcactacacttaatacatccaactgggcccagcctccaagtcatcccaactcaggtgctagacttatgagtgaaggtctttatgtgcaaaggagaaagcaaagagatctttgatgaccagaagaaatatattgccacagagacaataatgcttaccaaatattctatgcacacactcacatttttttaggccccttgcagttatttgaggccaagtaattattcttggagagtgagctatgagtagcatgataaatgtcacttcccaaccataacagagaagatcaggtatgaataaacatgacatttctgatgtcggagctttagatagcctagatccttaagtcactatgtggaagagaaagccctgccaacctctgttagacatcatgtagtgtaagtgaaaaacagacattcttatactactgagattttggagttattttactacctggcctattcttgaataatatactttcttcatttttaaaaaattccattttacttaatcattgatttattacacttactgagttcctactgcatgtcagctacatcctgggaatagaaagatgaataagatgtagtcccagttctcaaggacctccgagtctactgatgaaatttttgtaagtacttaactgtgtatttgcccatttatagactttcttcaaaagagatcttcttggaaaattcaaattatttagcctggaatgcaaagcctttcaaatctgattttacttgtcatacatgtattatttttcacaaattccaaccacaccacatctcacttttctaaaaaaatggactgtatttctagaccactgtgattcttgcatatgctagcaactttgcataaaatgacataaattatctctgttcataaaaattcaacccagcctttataacccagttaaaataccacatctttatgaaatatgtcatgactgtatcaccaaatatgatacatttctctcctaaaaccttagtgatagtgtgttcatttcttttaactctgtctccactagactgtgggttccttgaaaacaagaactacttgcttatttctgctgaacctacacacagtctagaatgcatttaaaatctcatgtttagctgcacatggtggctcatgcctgtaattgtagcagtttaggaggcctaggtgggaggattgcttgaagccaggaattggagacagcctgggaaagatagcaaaacctaatctatacagaaactaaaaagattagcctgtagtcctagctagttgggaggctgagagtggaggatctcatgagcccaggagtttaaggtttcagtgagctatgattgtgcgactgcacactccagctccagcctgggcaacagagcaagaccctgtctcttacaaaagaagaagaagaaggagaagaagaacaagaagtggaagagaaagagaaagaagaaaagaagaagaaaagttcattttctgtcatggggtatattatttatctgcttaagccaaacagacattttaggagcttctgtcttgccttatgttcttgcttgtctagaaatacattgtaatgaagttccttttaacagatatttctctaggcatgctatcttccaaagttcagtgttcattttattcactgcagttatttttattacagcaaataagaacggaaaaatgcaaaaggccataggacttctactcgggtacccactgtggttacatacctggcaagatgttgttaataatggtgtaatagctaacatttatgagtgctactgtgtgccagatagtcttttacatactttacatatattcaatttaattcttataacaaccttattaaatagcttattattatgctcatatcttaaagatgaagcatgaagaaagctcaaaaagctagtgagctagaaaacagtaagtcgagatcgcaggaatccaggccgtctgtctccagagctgtgctggcaatgctctcagcaagaaaggaagttccaagccctttgtagttgttcctaaataacaccgggcaaaattttgcaaatcaatctatctggaaagaaaatctaatagtcgtttcagtgactattaaacaataacaaaaagttaacagtccatataattatagtttcctaaggataattcttattgttagatgaaatttactctagcatatgaaaccatatacagtgacaataagggaaggatgttgtgatgcacaaaactttaatcacaaaaactaaagaaagcaagtttctcagtaatcatggctggagaaaacaaaaagaactttcaaagatattgtacattttactagagatcgaccatagcttaactcattaaagaaaacagttaataatacttctagagaagtacatgtttattcagcaataccttggcataaccatctgcaatacatgtcttatatgcaaaatttagtagaattatttactcagttatctaaataattctaatccacatgcaacttcactttccaaatgagaaaaaatagcagattagttatatataatttggagtgagtgactgagatctctgtctatgtatgtatatctgtattatctacaactgtatctgtatatgtatatatatatatatttatgattcagtaagtatgcagttaagaacacaattctgaactttctaacatctaatgtctaatttatgctgtgtcaaatgtatttttttaaaaaaagataaaaggcaaacataagtcaggggaaaggagcatagagtggagggggaaagaaaaaagagtaacagtggagaaagacggacaggaaaaggataaacaagcagagcaggatggctgattacttacagcatgtgctgaatggagacactcacaggaaacatcatgtcagatatgcttaaatatcgaacttatttctgagtttgtgttttttctgctacacccatgaccaatgtctcagttaaagaaagtagagacaaaagacaaatgcttaaatttcctgatacatacctcttatttacagtacttcttccattgctgtacttgtttttatttctggcagctttatttgcttatttctgagtacccagcataatgtcttacatatagtacacatttggttaatatctgttgaataaatgcattcatgaaagaatgaataaaagaaaacaagtcgatagagggctattgatgtgtgtacatagtctcatgggctaaaagctctaaatgcaaatataaggggttccaggaatttcagggctgctccatgaaaaagatatggccacaggtagaggtagcatacataagctttattttgctaacactttgacaggtttgatacaggaaaatccctcacagcatggaactgtccagaagttactgcatgagagccaccattcagaaggggaggacagcaagtgatatggtttggctgtgcccccacccaaatctcaacttgaattgtctctcccagaattcccacgtgttgtgggagggacccagggggaggtaattgaatcatgggggcttgtctttcccatgctagtctcatgatagtgaacaagtctcacgagatctgatgggtttatcaggggtttctgcttttgcttcttcctcatttttcttttgctgccgccatgtaagaagtgccttttgcctcccgccatgattctgaggcctccctagctatatgggactgtaagtccaattaaacctctttttctttccagtctcggatatgtctttatcagcaacgtgaaaacagactaatagagcaaggaaactcccagaggagggagagaatagggagggggcttacctatctaggtgatgttcctcggcagcaccacattgagtctctgcatcagagagctccaaagggtatcagtggcttggcatatatatagcccaggtgctatctatagcctggggccagcagatatcgggcatagtttcatggggtatgcaaagtaggctgtttgtaactatttaaatatctacttatttagtctatgttgaaaacatagtgaaacgaatgaaaatttgagtttggtatgggtttacttttggactaccaggtctcagcctgctgtgaagaaataaacaatctatggaccaatatacaggagccatctttggctgatttatataacagtaaataagcatgatataaaaaataataattcaacaaagagaggaagtgagtttattggtttttaccaagcattatttcatatactaaatttcttcaggcacatcaagctaaaacattatattaagaaacaggtttacaccactgtacatgtgcaaaaattaaggatcatttctatgatttaactaatataagtacaattgaacaataaataccaatctctataggttaagaaataaactacgaatctttttataaaattgattatgaaatgaactctcccacttttgttattattttaaaaatttatgtggagtagttaaaatgaattaaactccgaagaaaagtaaatcatcattacattttcttttattaccactttgctcattaggaaaactcagttctggcttctgttttgggaaacagtttgtaactgtgtttaatatcatttgaatatctataatcattcttatgcaaatagcatgataataagtattaacattaaagacagaagtttatatttgtcttatattatctgtccccttccaaaaggaacttaaatcttaagtcaaatgctgtaagtgcatgtaggttatttatatcatttctgtcactaaaggtgtcatatgcatatcatagatgccagcaagggagaacaaaccaaaagtcctatccagtcactgcagctggctcaagtttagaaatctggtcatataatgtagtctgcacattatgttctgacttgggtttcttggtcctgagacctaggaactgataaaagaaagtatctcctcactccaaacccaatagacaatggtggaagaggaataagttaaacagtgtaaaccctccattcaaaaatgggaaaaatagcaggcaccattaggcatagtctgcaagcattttggaaatccactgtgcagtagttgtaaaagtgaaggatcctgatgcctgggaggaggtccttctcttactatttcctggaatccctgcatggcatgtactctctggaaggtacttcttttccattatcctctttggccatatctgaagtatgtgtgacggaatatgccttacttgggggcttcagtgaaggcttttcttcctacttcctgcttaaagcaagttggtagcccaagtgtaattttaagtcttgaacagtactagtttttgtttgtttggttggttggttggttttttttttaattccaggtttgttgttccttttgcagtacaaccctctctgaaactcactgggcttcttatctgtttgattacagtgagtcctatgtgccaattaccctgcctgcaggttttttttagagatgttattctcagatctgctgtattgctttgctttctctccgcatacttcactctctagactcagtgagagctacattgggactatctgacttctgcagaaaggttgttttcattctgatctctaccctgagtcattttatccagttgaaatgttttggggtaataacccctaatttgatatttgccctgagacatcatagtgagctcaacaattgtaacaataggcatgaaggctatacctttaatcatatctttgatactgattaaattttaatgggcctctgtcattcaaagtcttcctcagctatatttcttactgtttagggcctttagtagttagcttttccaaaattgcaaggcctcaaatttttggactctctgaattccatttcatttctctttgcaaactgacattactttttgattaaaggtctttccttaataccctgttaaaagtagtcaacatactctactaatattctattttccattatcttctcctagaacttaaacacatgagatatgtgatctgtctcccactttatcaaagacaacatttaaccaaatgtttttgtactgcataacatagattgctagctcttcagcttccagtatcaattttctcataatctgcctgctaagtcaatgccacagagtttaggtttttgtaacagcagcgctctactcctgataccaatttctggactagtctagataggctttgttatgctgtgatggcaaattaaccctgaaatatcaatggctttatatgaaaagtgtttatttctcacttctaaggcatatctaagacagatcagcaaagggtctctcttccatctagttactcagagacctaggctaacagaagagccacatctagatcctcactggtcaccaaagcagatgtagagagagtacctggagagttgacatcttctctgctttggcccagaaataatagatgttatttccactcagtttattggcaaaattagttacatggccctgcctaatttcaagatgcctagtaactataggggatcatatgaaatatttggtgagcattgcagtctcttctacagagaaaactcttaaagtatatgcagttatgaaaagtctatgtaaattaacggctgtatgtatttgctaaggctgtagttccagagctattagaaatcctgagctttgtagtcttggaagactagaccagataaacaaaactaattcttctttcaatgggttaataatgtatttatcaaacacattaaggaatgatatggacaaaaattttaaagtaagttcaagaaagagatgtattgaaagcaatagctatatatatagcaagtggactatagaaaacaagtggtatccttgaagtgtatccttgagctttggaaagataatcatgtgaataccatgctctttaacagggagacacttgggacatttattagactgaatgatgggcttgagagaacacttgtctgacctggtattgcactttttgtgtttcaggagaaatgatttatacctatagtgtatccatatttgaagtctagtgtggttctgctttagttggcagtctatgaataatatccttttttaaactatcaaaatttacattacgtacctctttccagacatgtggaatgggattctactattactagggaatggattatgatgaatacatcttctcatgtacaaaatagaaggatttaaaatataactttgaatgtcaattaataggattattaaaaatagatttgtttggtccttctatgtcatgtgttaattagaggctaagtccttgaaaagttaatagatcaaaattaatacagagtaagtattggacaaagtcactgtaataataatgctattcattgagttatcacataaagacttttacgtgtgttatctcatttatttctcataataatccagtgaggcagtaaaattattatccccactttaaagatgtcaaaactgatagcagtaggttcagcagctgacccagtgtcacacaaaaagtagcaggactggtattcaaacccaagcagtctgactccagaagaccacattcttaattccaactgtatactagtatccttccgtttgatagaaggttgtgtttttattagatcatcaaattgaaccatctcaagagtgtatttgtgttgttagagtgtaactcagtagttatcatgtcataatcaactgaggggaattcttcaagctacatagatctttttcctgctcttctcccttgcatcacagtcagtcattcattctcacatgtttacctgggtgaatatataactaaaaaagaactttcatgtaattttaatacaccatcccacccaccacttctttttgagaaccactgctcttggttatattggtaactgtttttgctgtgtaaggagaaaggtgacatgtgaaagaaatataggtaattttttctgaaacacattaccataaattgatcctgagatacaatgcagtggttaaaagtaaaggattcatggtcaaacaaggtgttaacttggtgtgcagccctttattgttgtagtgatttttttagactgttttagacttgatagaggtctaataccagttcttactctagctgtgaaaataaaactctgttggattttcctttcttgttctctttgattagcaggatagataaactgaacacaagtctcaccctagctccacaacttactgtgtgaatttaggcaaattgccttaggatcctgtgcctttgtttcctaatctgtgaaacagaaaaaaaggaatatgggccaggcatggtggctcacacctgtaatcccagcactttgggaggccaaggtggatggatcacttgaggtcaggggttcgaaaccagcctggccaacatggtgaaccccatctctactaaaaatacaaaaattagctggcattgtggtgggttcctgtaatcccagcgacttggggggctggtacaggagaattgcttaaacctggttgggggacagaggctgcagtgagccaagatcgcaccactgcactccaccttgggcaacagagtgagatgccatctcaaacaaaacgaacaaacaaacaaaaaggaatatgtacttgatatgttgctgtgggaaccaaataatgcctatttgtaaactgtatagaaatgtgcccattttatagtaaacactcaatagataatacatatgatgatgatgatgatgatgatgatgatgatagaagagccagccagttccctacctttatgctcttgtgctcccaccagtggaaatctccctctaaaggaacaaaacagttgacaactgctagctcttagaagctgtagacctctaagtcaaagtttcatcaagaaactacatttttaagtatcacaacagaagcagtattaggaaagagattaaaggcacagaatctagactgagattacttggatttgaattctggttctgccttttctagctatgtaactttaagcaagttacgtattctctcagagagtcgagttcatcttctgtaaaagggggatggggaaacaatcaaaaacttttctcataaggctattattaagtacatattagcattactaaagtgtttgtaaaacaatgaatacatttgtataaattgataaagtttttaatttaatatatgtttatacatatggatattatgtattaaattatgttttaaatttaaatatatttgtctgccaacacatatgttattccatattaaaatatcttttcaattatttcatggaattctggaccaacagaggtgcaaacattaacctttagatttgactctgagcttcctagaagaccaaacaaaaagacactgtcatttatataatttttattatgataagctttccagtattgaatttattgccacttaatttctcaaacattaagttaatttcattatctgtaaggaaagcattatttctaccttctatacctagagagtttttctgaagatcctcttagataatgaaaatgaatatgctttctgtgttgatagaaaccctacaagcaaggtatatgggaagaagaagagaactagcgttttttttttttttttgcatgcctaatatatttaacaccttttgatattaacctcacagcagcctcactgactagataacttatcaataaaaatacatgactaaggttttataacaaattgtagtgctggaaaattcaacccaaacttacctccaaaacccagagagggcaaataattaaaatccagatgaatcacggagaattaatagaacaatgtaaacaaattcctaagttgaaatttgtataagcaaattgaaatttattcctcaaagaattgatataatttatgtaagctattttttaagatttagcataaattacatacacattaataaagcatataagcagagacatagcaaataaataagctctgcctaagaaaattttcattgacctgtgttttagcccaattagactgtgagataataatctagatatctgatacacatatttttatctaatcatgtatcataagctcttctaggaatagtatcagtatactatttatggtaattatttccatatacagaaattattgttctgtattaattattacatagtagtttaattgtaaggaaagttgttttagatacctggtaatttctgtacaatttatattttttcattagcaagggcttataatttaaactttctactttttgttaattttttttagtatatagtatataatatttatgttcttaacaagatatttctacaaatttatattgggtcctccaaaatcaatgcattttgagggtatgttacaacttgaatatgaagtatagcaagaaatatttttctctgtgtgtctaatgatccactgtgttgcctgtgtgagtataatgttattacaagcattttttgtaataacattagtacaaataaaaaaagtttctgtttttttttttatttttcctctaacaattttatatctgtaaggttttttaaacagattttggttcaggatatttacattaagaaataatattactgagactttgttcaaatagagctaattattgtccataatatagcataatttaaaataaatatgagcttttgagtaaaatttccctgagaaaaattccactatgtaatatatcaataaacttgggttaattatctaacttccctgaatcttagcatccttatctacaaaaattagaatgactgtatgttcattacagagttgttgggtaaattcaatcagataattcaacccaaattgtgaccaaatagtgtaatgcacatatagtgtaatatctgtatattacacactgtatgtctaaatggctagcatgttatgatacttaacaaatgttagtcttcctcctcatttttatgttaatttaattgatttgtggctgtcatcacagaatatagtatattctaaaataatgtttcttttacaataattttcaacatataagaagtaagtagttatccacagatagaattagcaacttggagtacatcagccatttccaatcataaatccatggatgggtactggcctctgacttcattttcactgtacaattagaaaaataaggataataaaatttattaagctaagttaatttcagttaattattgtggtctaattgtgttgtgattcagatgtcttccacaaaattattataacatagtgatgtttgagattttaaaaatacccttttgtagcaaaatcaagaagttagaactcctctgtcaattattcatctttatttctaaatttattttaaatatcaactctgccatgtactacttgtatgacttaggacaagttatttagcctctttatgatataattttatcatctatacaatggagatatcaataatgactacctcgtggattgttaagataaaattagataatacatgtaagactcacagagcagttctggcatataataagtattccataaagagctaaagctactgtcatcatcactagtctgtgaaatccaaaatgtgagaatcatccatttagataattcgtcttatgccaaaattactttaaaagtaggaaagcctatgtttacagatgttataatacctcaaagtcatagacagtctttgtagacacatgaagttgttattgaatgtgaaggtattttacaaaatatacctatttgctacaatagattgaatattgtcattgaatatcatctgtatttttatttgatgattttaaaaggcctatttttatattagactaggcttttgatgcttttgttaagtccaagaatacaattgatgcctatattatattttgcatgtaatttaattatcaaaatttttcttagtttttaaatatttcttaaactttttcatataccaaatgcataatgatgagagtctcaatagttctatttcaaataaaaataaataattgccaaatatggaatattatttctaatttttgttcacttttgagttaccatacatagagctctagaaacttctacaaactttatttatagaagtttaggaaaattagaacaatgtttataatttattaatttattaattatttatccaataattgaataatatttttaaaatagcttagcattttatttgaatatgaatagcatttgttctattttctcagaaggaagtgctatttttatctaaattctgaattattaatgccacactgtaagcaaaaagtacatccatgtttgaatggttgaagacgaagcattgcctttgagaaagaaaacagtacaataccgcaaatggttccttacagcaaaagactctgcttccttacatagttctagagaattctagcctcaccatttcttgagctacacctacttagaaaccttagtctgaccttttctaagtatgaaagatttgccctttgtccttatgggaaaatgagagggtttggtaagacctgctattaaccttcattaatctgcatttttagaacactaacaaaatcccattcctagaatgtaaaagctaagtggcagatactctatcttatttatcttttcatcactattacttagtatgatgcttgcaaggcacattaataggtgctcagttagcatttgtaaactgaatggatttcaagtccgctaaccaaaccagcacatatcaaatatgtgattacttttaaggagtcatgtttcaaatgggtcatttaattcatgtttcacactcttaggcttgatatccaagttatcttccatcattttgcattacatctattacaaaactgatagaaaccttgactgctacatttggagaagttagctaagcaccttattgagtaataatataaagttttgttaaaccactttatttaagggtgacttatattcaaaaaactctgcatatttaacgtatatacttgatgagtttggagataagtatacagccatggaactatcgacagaatctatgctataaacctattcattacctccagaaatttccttccaccttatttatttatttatttaggtgattgtggttttgatttggattttcctgatgattagcaattttgatttggattatgatgttttacataacaatggaaaatctcgtctcagcaaaatgttaagtatataatacattaactatacacattatgctataattatacatataattgtgttgtatagtaggtctctaggacttgttcatcttgcttaactgaaactttgtacactttgactcacacttctccacttccgtcttcccccatttcctggaaaatcaccattctactctcttgcttctatgagtttggccattttagatttatcatataagtggtgccatgtagcatttgcccttttgtgtctggcttattttgcttagcataatgtcctctgggtacacctgtgttgttgcaaatcgcaagattgccctcttttttgaggctaagtaatattccattgtatgtatataccacattttctttatccgttcaaatttaatggacatttaggttggacatggacatggttgttagtattgtaagcaatgctgaaataaacataggaatacagatacctctttgagatattaatttcattgcccctttggaagcaggattgctccatcaaatgatagttctatttttaatttttcccttttattgatatataataatttatatagttacagggtccatgggagtgtttgttgcaggcaaaaattatataatgttcaattcagggtaattggagtatcaatcatcttgaatgtttatcatttttagtgtattggtattctttcaagttctctcttgtacttatttcaaatatacattatattattgagaagtatagtcaccctagcctgctatcaaatattagattagaacttattttatctaactgtatgtttttaaccctaatcagtctctcttcattcactcccccgctccccactgcaacccttcccagagtctggtatctatggttctattctctatacccatgaaatcaagtcttttatcttctataagtgagaacatgcagtatttgtctttctgtgcctggcttgtttcacttaacataatgtcctccagttccatccatgttgctggaaatgacatgatttcattctttgttatagctgagtagcattccattgtgtatatatatattacatttcctttactcattcatccatcgatgagcatgtaggttgattctatagctttgctatcacgaacattgctggcagtaaccatgtgagtccaggtatccccttgatacactgatttcctttggatagatacccagtagtggaatggttggactataaggttggtatactttaagttttatgagaaacctctctactgtttccacagtggctgcactaatttacattcccaccaacaacatatgagttacctgttctctgcatcctcaccagaatctgttatttttggtctttttagtaatagccattctaacttgggtgagatggtatctgattgtggttttgatttggattttcctgatgattagtgacgttggggcatttttttatatatacccattggccatctttatgtcttcttttgagaaacaactattcgtgtccttttctcatgttttaatgaggttttttttgaaactgttgagttgtttgagttccttatatattctgtatattagtctcctgtcagttagtaatttgccaatattttccccattcagggggtggtctattcactctgctgatggtttcctttgctgtggagaaacttttaaatttagtattatccccccttttttatgattgtgcttttgagggctttgccataaaatctttgcctataccaatgtcctgaagatttttctctatgtttcttctagtagttttatagttttgggtcttaatttaagtcattaatgcatcttttgagtttacttttgtgtatgatgagagataggggtccgagtttcattcttctgcatacagttatctagctgtcccaataccatttattgaagagagtatgctttccctagtgtatgttcttggtagctttgttgaggatcagttggctgtaaatatttcaatttgtttctgggttctctactctgttctatgggtctatgtgtctgtttttataccaataccatgctgccttgtttaccataaccttataatatgttttgaagtcaagtactgtgatggctccaacttgtctgtttcttctacaatttttttgtgtggtttgttcttgattttctagctccttgagatgcatcattagattgttgagatgcattattagattgtttatttgaaatctttttggcttttttatgtaggcatttattgctaaaaacttgcctcttagcactgctttgtttttgtgtcccgcaaaacaaagtatattatgttttcatatgttgtgttttcattttcatttgcttaaagaaattttcctctaagaactgttcttatgttgctatgcccatattggcagcagtgggatgagcatgcttgatcttgggccccagaacagcatacactggcaccagtattagcaggatcagacagactgattcttaggcctctaggtggctgcttgcttggatgctggtagtggcagcagtggaccaggaaagtatgtatctctgggtcttgatcagtgtgcactggtgttgatagtggctgtagtcagagatcaccattcacagccccagacacagagctcgcaggctgtcctgctctctgcagcaacagttctgtagaggtggggaaggaccctgcctgtcacacactgtcctggacgctggggccacaccatcagtgggggcacagttgtcattcatagccccacacaggtagcctctgttcatgcacctcagcctccagtggcagcagcaatggctgtacttgtaacagtgtgcagacggaaagaaggcatcctactctgtacatatgaggcctagcagagaggtcattttgctggtgagaggggatctcactctctgcttgcaaggccaagtacagaatttgcactactgctggagacagagtcacttctcatagtcccagacagggaggtcttggcctctgaaaagcatgtgctttgtttcctttgtcccacggatggtgcgctgtaccatcctttccccaggaaatagtactccctgtggattacagcagcagtccccaacctttttggaaccagggaccagtttcatggaagacaatttttctacagatgggggtgggtattggggggagatactttcaggatgaaactgttccacctcagatcatcaggcattagttagattctcataaggagcacacaacctggatccctcaaaggcacagtttgcaatagggttctcgctcctgtgagaatctgatgcccctgctgatctgacaagaagtggggctcaggtggtaatgctcactcacccactgttcatctcttgctgtgtggcctggtttctaacaagccacggtcaggtaccagtctgtggcccagaggttggagacccctggaccagagtactggggactatgcagaatcttttgaaccaaccaacactgtgccactttagtggacactgggtggacactgagagatgtcagttggggctcatgggatgtagagatatgggggctatgattcccagggcaagatgcagtcccatggcaactgtgccctcacaagggtgcccagctgctgctgcttaggtcttggcagggacaggaatgagtgacaatgtgcaagtcctctttctggagcaatgtcctcatggaccctgcaaatcactccctatgctagcgtcagggtttctgtgggcgtaagaactctcccattgctcaaattgcagcagtccacagtagggatgtggactgctgaattacgctttacctacaataccaagccccttggggctcccaagccaaccttctctgagctggctgctgggtaccttttccttctctgcctcaggtgtttcctgtggcatctctgttagacatcagtattctttcctagatgttctattcaaggtatgattatctattcataattttggtgcttccttctggagaaggcaggtgcccaatgtctgtagttagccatcttgaaccagtgttcttatttttaaccttcaggaacttccatagtgttttccatcgtgcctgtaccaatttacattcccacaaacaatgtacaagggttccattttctccacttccttaccaacattgattatcttttgctttttgggtaataagcatcctaacaagtgtgaggtgatagctcattattttgatttgcatttccctgatgggtactaaagttgagcaccttttcatatacattttggccatttgtataccttctttgaaaaaatatctattcaggccaggcgtgatggctcacgcctgtaattccagcactttgggaggccaaggcaggtggatcacctgagttcaggaattggagaccagcctgaggaacatggcaaaactccgtctctacaaaaaatacaaaaattagctgagcatggtggtgcatgcctgcagtcccagctatttgggaggctgagttgagaggatggcttgagccctggaagcataagttgcagtgagctgagatcacgctactgcactccagcctgggtgacagaggcagaccctgtctaaaaatcaatcaatcaatcaatcaatcaatctattcagttcctttgctcatttttaaattttgggtttttttcttatttttcatttttaaattttattgtttttgctattaagttgtcgattttgtttatattttttggatattagtcatttaccaggtatatagtttgcaaatattttctccaaagctatgcctttttattttgctgattgtttccttcgctttgcagaagcttcttagtttggtgtaatcccacttgacagttttaggttttgttgccagtgctcttttgtgtcatatccaagaaatcattgacaaagccaaatataaaattcttaacttcaccaatgaggcagttttgacttcatgaggttctgaaactttttcctagagttgaatcaaataatacaatttaaattcctaattctttaacaaattaaagaaaaactatttcctccaactatagtaaggcaaaattttggctattaaacaactgaactctttttaataatgtgtgaagctaataggtgcctgatgggaccctattgctttgaggatctaattgcagacagaactatttattctttgattactagacttgtaaagcaggagttcaggaataatgattagcaaacaagattgtgcaggaatttgaagaataaattgacatatatcactgaaagcatacaaagtttcagtcaggagccatgaacccaaagcatatactgttctaggtacattacaggtgaaggtcgctgcattacatttaagagcctacgggcccttaaaagtttaacttgacaacagatgttagattgttcaagtactctaaaaataatcccttaatatatctttgtaatacaatagcacttgtattcctaaaataattttataaattttataaataataaaataatttttaaaaaatttgaaataaaatgaaatataatcctataagagattcattgaatgtttttaaaacattttatttatttatttagaatgcattttaacctactgaaatccaatataaataatatgtagaaaatagttataaaaaacaagttgtagttgtagaagacattaatgttttagaacaaagtatttcaagcttagtgttcaatgtatatgtgatgctaaggtcattatcatttggccacagatataacctatgagtaaaggagagtccttgttttttcataacctcttctgaatgcaacatccctctttataataggcaatattgcttccaagttgccatattcttaaaaaggcactgagtaagatcattgatcactgatatttgacatatttatgtactgaagagcacttttgtggaaaattcttccctcaattaattagatatgtttatatgtttatatgtaacagaataaaaagggaagatttcattcaaataagggcatttcaccagcccttttatgattatatatagtaatagttttttactatttaaatggctgaaaggtaaccacttttttaaaaatgttttttacatatatttctgttttaatatcctattatgggcagaaatgaaatgggacttaaattcaggttgttaccaatagtctaagattctaagtgcatcactatttcatgtacgcaaatattggctgagatttagcagaggtattgaaccagacaaatctatttatgcagtggctgttttacatttcttctatagagtattggcttcatgctttttgttagcttcagtaccttttgtccaaaccaaattactcacaagctgaaatgtaagacaattcaagattaaaaacgctatacaatcaggcatcacttaatgaaaagataccttctgagaaatgcctcattagacaagttcatcatagtatgaacatcacagagtttccttaaagaaacccagataggatagcctactacacaactaggctatacggtatggcctattgctctcgggctacaaacctgtgttgtatgttactgtaccgaatgctgtaaacaactgtaacacaataagtatttgtgtatctaaatataaaaattaagtagagcaaaaatgcaataatgcattatataagataaaaattgggcacacatatatagggtagctccattaaattctcatgggcgccctgcaatatatacagtccatcattgaccagaaacataattaaacagcacatggttatctttgacaggagggtgctaggcataaggggccagaagcctactggcttttaattctcctgtgaatggaaaatataatgtaagtcaaatgactatccatatagtatgaagtcataataccagatgactatccatatagtaacccatgtataatccctaaatcatagtacttgttccttatctatgcctctttctatttgccattttctgttcctaaatataactttcctatttttcacttctactcccacagtctacacagacgcacacacacacacacacacacacacacacacttcccactgtatatcagtgtataaaaactagacctgtctcatgattggttgtgtttacaaatatgttcatatttatagtaataaattactgaaaaatatgggcatatatgaattcaaaaaataaaatgtttaatatataaaagcatgttctgaataggtacaatttattatagaaagactttggatgctctaacattatggaactaatgtggataagttctttggaagtaaatactagacaaatatcttgattaaagtaaaattcaggtagcaatgttaaaacttttcataatgtaaacagctatgcaaagcatgacttttgaatttatatataaaatacattttcaaagacacagatactgctatattcattttgtgtatactgaatgttatttctgacattcttttagattcttgatagtaaataaatgatattttggagagtactaaagcttatttaaacatgatttgatgttcaatacaactaacaaaattgtagtggaacacaatgatattataaaaatgaagcttcatttgggaaagcatttccccaggtgggaataaggcattttctatgactagtctaaataaaagattcacttttccttgctttattttgggagggtggaggatggtagaaatgcaatttcaagtgaatgagtgcattctatttttcctgtttttttttttttacaaatgttataaaatcacacacacacacacacacatgcacacacgcacacacacacacacacacagagtatcttcatccatttttatgactccttagagataaaaggggttgagaaacatggtttggatttagttaatatttcctaaataccaaaggaatactgtttttcataaaataagggtgatactttcaaaactgtgctcagagaaaaatcaactgacacattttttaaaagaaaagaaaaaaaagaaaaattcaaaaccctttattagtttagaaaaggaccgttgtcaataccctgagttctaccaaattcaattttggctatttagtacaaatctgaaggagaatttttttatgctcatcagtcaggtccaaattcaaggagccattatcaaagttaggaatttaaacaacgctggaattcaataatgtgaaaatactactgattatttttataggagttttattctgaaaagtatgaagtatttataaataatatttcaacattcttttttttgaaagatggaaggtgaagttagtaacgggtaagttattatttgaatctcctagcattcagtccaagctttcaatactttaaacctaatatgatgtcattctaaaacccacgaggagtaaatgtgatttgtattgtattctacattcagtatgaagtgcacattcatgatgttgataaccttatatattagaactatatcatcatttcctataatataaacaaagaaaatactaaggatattaaattgaataaaaataaagaacatttacatcttgatgcttaggtaatgataaagattataaaataataagaaattcattgactattcccagccatttaatagtaacatcacaatagttgaagaatgaatgcattggtttgctaaggacaatgtccttcagctccatccatgttcctgaaaggatacaaccttattctatttttatggctgcatggtattccatggtgtatatgtacaacattttctttttttttttttgagatggagtcttgctctgtcgcccaggctggagtgcagtggcatgatcttggcttactgcaagctccacctcccaggttcacgccattctcctgcctcagcctcctgagtagctgggactacaggcgcctgctaccacacccggctaattttttgtatttttagtagagacggggtttcaccatgttagccaggatggtctcgatctcctgagctcgtgatccgcctgccttggcctcccaaagtgctgggattacagcgggggagacaccgcaccctgtcacaacattttctttatccagtctagcattgatgctcatttaggttgattccatgtctttgctattgtgaacagtgctgtgacaagcatacctgtgcatggtctttataatggaatgatttaattagctaggcatggtggcatgtgcctataatcccagctactcaggaggctgaggtagaaggattgcttgagcctgggtggcagagattgcagtgagccaagatcgtgccactgcactccagcctggttaacagagagataccctgtctcaaaaatcaaaacaaaacaaaataataggacaatttatgttcctttgggtatatgcccagtagtaggattgctagatcaaattatatttttgcttttgggtctttgaggaatctccatactgtcttccacaatggttgaactattttacactcccaccaacagtgtgtaagcattcctttttgtccacaaccttgctagcatctgttatttttttgactttctaataatagcctgtatcagtccattttcacactgctataaagaactacttgagactgggtaatttatgatgaaaagaggtttaattgactcacagttccacatggctgagaggcttcaggaaacttataatcatggcagaaggcaaaggggaagcaggtacagtcatcacatatcagagcgagagagagagagagagagagagagagagcgagcgagctaggggggaaatgccacactttaaaaccatcagatctcatgagaacacagtcactatcaggagaacagcaagggggaaaatccacccccatgatccaatcacctcccacctggcctcttccttgacatgtggggattacaatttgagataagatttcggtgggaacacaaagccaaactatatgatagccattctgactgttgtgagatggtgtctcatgatggttttgatttgcatttctctgatgatcagtgattttgagctttttttcatgtaattgttggccacatgtatgtcttttgaaaagtgttcatgtcctttgcccactttttagtgtgttttttccttgtaaatttgtttaaagaaccaatgtattctgccatgttaacagaatatcacagttggaatttatactttacaatacaagcatgttttgtatttttttgagataggatcttgctctgttgctcaggctggagtgattatggctcactgcagcctccaccttctgggctaaagcaattctggcacctcagcctcccgaatagctggcaatacagatacataccaccacacccagctaatttttgtattttttgtaaagacaagttttcaccatgttgcccaggctggtctgaaactcctgagctcaagtgatccacctgccttggcctcccaaagtgttaggattacaggcatgagccactgtacctggcctatttttttaatcaataaaaaatttctgtgtgttacatatataattctattataatttacttttattaatgtaaatgttatgacatgtatgatatgctattttggaatctcatttgagttagaggtctttatcttaatgcctctcttaatgctatgaaaacaaagcattttttataactaagaagacagagcctccttttgaccgtgtctttgctactatcctgtacttggctgtcctttctgttgtaaattaaaatagatgaaggctgtcgagccaagccaatgatggaggctaatttaatgcgatataattgatgaactctaaattgttccacttttcccttttgaaacacactaagtagagcttaaaatgccagatagagtattttgatttatgctctttgtcacattaatactgaaaaactcattgtagtgatagagaaatgggaattaaccctttatagatactttcatagtttctgtatatttggctgtacaacaatcagagaaatggacccagtttaaatatactaccagaataaccattaaataataataagaagaaatgtaatgaagaggctactaatttaatgctcatgaaactagttaaatgatatgaaaacaaacaactctaacagaaaaaaaatcaaattaagtccaagtaaaatactggatttatatccacatgatttttgtgaattttgctaaatctgatgcccttgaaccagaatacatggagaatttacaaataaggacaggggaaatcatgaaggcattttaagatgatgaattttcttaacatgtggcatactgatagagttcagttgaacataaagttgctacagttgttgctagtgtcaagaagaaatgtgggctgggcacggtggctcaagcctgtaatcccagcactttgggagtccgaggcaggcagatcacgaggtcaagagatccagaccatcctgaccaacatggtaaaaccccgtctctactaaaaatacaaaaattatctgggcatgatgtcgtgggcctgtagtcccagctactcgggaggctgaggcaggagaatcacttgaacctgcgaggcagaggttgcagtgagctgagatggtaccactgcattccagcctggcaacagagcgagactccatctcaaaaaaaaaaagaagaagaaatgtgagtagaccaaaaaaaagagcagctatccagaaatggccattactagcaatattcgtctcagtgctttttgtattaagttattaaattttagtaatatttaaaagttaacaaagtagccagataaactaaatacactaaaggaaatttcatatttatatacaccagcaacaaatagtaaatatgatttttttaatctatattagcaacaaaaatggctatttaggaataattttaacagatgctcaagattgttatgtagaaaattatgaagtcataaaattgtaaagttttataaagctttgttgagagggattaatgatgactcaaccaaatggagaggaatagctactttatggataaaaagatctagtaaagtcatcaattctactgaatctaagaagattcagtgtagtaaagttatcaaattgatctatagatttaataaaattcccattgcaacatgtttttataaaacatgaaagatagttctaaaatttacatggaaaagcaaagtatcaagaatatccaagacactcttgaccaggaagtataagattagatgacttgcctttcaagatactcagttttgttttgttttttaataaaactagagtaattaagaaatgtgattttttgcgtaaggataggcaattagatcaagagaacagaataaagagttcaacaacaaactcacatagaattaaaaacttgatatgtgtcactgcaaattattgggagtaaaatgaataaatgagagcttcacacagaaacataaatggatgttagaaacataagctgaagtgaaaaaagcaagatataaaggaccattcacagtcagagaacatttatttgtttgtttatttatttatttatcatttattattttaaataattgcagcttttattttagattcaaggatacatatgcaggtttcttacatgggtacattacgtgactgaggtttgggataccattgaccccgtcatcgaagtagtgagcatagtaccccatagttactttctcagccctttcctcctgctctctcatctctagtagcctcctctgtctgttgctgtcatcattatgtccatgagtgctcagtgtttaactcccacttttaaatgagaccatgtggtatttggttttctgttcctatgttaatttgcttaggataacggccttcagctacatccatgttgctgcaaaggacaagatttcattcatttttatggctatgtagaattccatggtgtatatgtaccacattttctttattcatctgtcattgatggacacttaagttgactcaatgtctttaccattgtgaattgtactggaataaaaatacaaatgtgtgtgccttttttggttaaatgatttatttcttttggatatatacccagtaatgggattgctgggtcaaattgtagttctgttttaagttctttgagaaatcttcaaactgctttccacagtggctgagctaatttacactcccagcaacactgtgtaagtgtttctttttctctgcagcctcaccagcatctactgttgtttgactttttaaaaatatgcattctggctggtgtgagatggtatctcattgtggttttgtggttttgatttccatttctctgatggtgagtgatatgaagcattttttcatatgtattttagccacttatatgtcttcttttgagaagtgtctgttcatgtcttttgcccactttttactggggttatttgacttttccttgttgaattgtttaaattccttgtagattctgcatattagacctttattggctgcatagcttgtgaatattttctcccatgctgtatgttgtctgttatactttgttgatagtttcaggctttaaaccaataacagtaaagaaggacaaagaagggcattatatattgataaagagttcaattcaacaaaaagacttaactattctaaatatatatgcactcaacgttggagcacccagaattataaaacaagtccttctagacctatgaaaatacacagacagctacacaataatagaggggaagtgcaacaccccactaacagcattagatagatcatcaaggcagaagactaacaaagaatttctgggcttaaattctatgcttgaccatttggacctaaaagatatctatagaaaactacacctgttaaccacagaatatacattcttctcatctgcacatgaaacatactctaagatcaaccccatgcttggtcataaaacaagtctcaataaatttttgaaattgaaaatataacaaccataccctcaatccacattggaataaaagtagaaatcaataccaataagatctctcaaaaccacacaattacatggaaatttaaaaacctgcccttgaattgacttttggataaacaacaaaattaaggcaggaatcaaaaaattattggaaataagtgaaaatatagatacaacataccaaaatttctgggatgcagcaaaagcagtattcagaggaagcttatagtgctaaacacctacctcaaaaaattagaaagatgtcaatttaattatctaacatcacagctagaggaactagaaaaacaaaaactaaccccaatgctaaagaagaaaagaaataactgaaatcagagcatagctgaataaagttgagacacaaaaatccatacaaagaatcaacaaaaccaaaagttggttatttggaagtataaataagattgatagactgctaggtagattagcaaacaaactgaagaagatccaaataaccaaaatcagaaatatcaaagatgatattacagccaatcctgcgaaaatataaaagttcttcagagaatattatgagcacttctgtgcacacaaattataaaatctagagaaaattgataaatttctagaaacacacaatttccccaagattgtatcaggaagaaatgaaatcctgaacagaccaatattgagttctaaaactgaatcagtagtaaaaacctaccaaccaaaaaaatccctgggccagattgattcacagctgaattctactagacatacaaaggagagctggtattcattctactgaaactattccaaaaaatacagcaggagagactcttccctaagcattctatgaagccagcatcaccctgataccaaaacctggaaaagacacaacaaaaaaagaaagttatgcaaaattcctcaacaaaatactagcaaattgaatccagcagcacgtcaaaaagttaattcaccatgattgagtagctacattcctggcatgtaaggttggttcaacatatgcaaataaataaatgtgattcaacacataaacagaatgaaaaacaaaaagtttatgatcatctcaatagacaccaaaaagttttcaataaaatccaacatcccttcatgataaaaatcctgaaaaaactagtcatcaaaggaatgtacctcaaaataataagagccatctttgacaaacccacagccaacataatactgaatgggcaaaagctggaagcttttcccttgataattggaataagacaaggatgctcactttcactattcctattcaacatagttctggaagtcctagtcagagcaatcaggcaaggaaaagaaaaggcatctaaatagtaaaagaataagtcaaattatctcgctttgctgatgatataattctatacttaggaaacactaatgactctatacttagaaaacactaaagactccaccaaaattctcctggaactaatcaacaacttcagcgaggttttaggatacaaaatcaatgtacacaaatcagcaggatttctatacaccagtaacattcaagctgagaaccaaaccaagaatacaatctcatttacaatagtcacacaaaaaataaaatacctaggaatccatctaaccaaggaggtgaaagatctctacaaggagaactacaaaacactgctgaaagaagtcatagatgactaatgaaaaacattctgtactcatggattggaagaatcaatatctactgcccaaaataatctacagattcaacactattcctatcaaactaccaaagtcatttttcacagaattagaaaaagctattgtagatttcctatggaaccaaaaagaaaaaaaagcccaaataggcaaggcaatactaagcaaaaagaacaaactatagacttcaaactatactacaagagtacagtaatcaaaacagatggtactggtacaaagacagacacatagaccagtggaacaagatagagatcgcagaagtaaagccacacacttatggccctgtggtctttgacagagtcaaaaaaaataagcaatgaataaatgactccctattcaataaatggtgctggcatagctggctaaccatatgcagaagaatgaaactggacccctacctttcaccatatacaaaaattaatgcaagatgaattaaagatttaaatgtaagacctcaaactataagaatcctagaagacaacataggaaacaccattctggacactgaccttgggaaagaatttataactaagtcttcaaaagcgattgcaacaaaaacaaaaattgacaagtcagatctaattaaactaaagagcttctgcacagcaaaagagaacattgttataaatatcaaaaagtaccaaaactacttatgacagtggttacctctggagtgataagcagggagataaaatagggaagtagcacataggttgatggatgatctagtaacattctggtttttaggttgagtggtgagttcatggatgttcattatcttatgtttttaatttaataaatgcatgtaacatgcattaacttaatatacaaacatatatgtagataatatataaacatataatcttttgtatatttaaaaatatatttaaaacaaacatattaaagaaatgaaagaaagaaaaccagaatgctctataaaaatagaatagtttgggggaattttctttccaaatatcaaaatttactgtggagctttctgaaggataaatcctttatggaactgaatagaaagtctagatttaggcctcttatcaaatatatggaaatttgatctacggcttgattttcaagtcagtgggaaaatgatagaatatttaattaatgatggtgggacaactgactgtggaaaaaaatgaaatagaatcccaatttgcacatgcacaaaaatgaatcccagatttattaaagacagtcagttttcacttaaaaggaagaaaatttttaaacttgaaaaagtataggagaatatttgagacaacagaaatgtattcttttacgattctggaggctataagtctaagatcaaaatatcagtagggttgtttccttctgagagctgtgtgtgcctcttcctagcttctggtgggttgctggcaatatttgacatttcttgacttgtaagtgcatccctttgatctttgccttcttcatatggcattctccctatgtctctgtctctctacattgaattgtctttataaggaaactggtcatcttgaattagggggcccaccccattttattgtgacatattaactaattacatctgcaatggccctatttccaaataaggccccactctgacatacgagggtttaggactttaacattacctttttggggagacatattttcaacccatgtaattgttatttttaaattgtatatatgagttatatgtactattttcaggatacatttaataattttatttttaggaaaaatattaagcagaataaatatgaacaataactattttgttccttaaactaaaatttttaagctaaaaaatgaaagctaacacacctaggttcgccatccctatagaatactttttgtgatatggggtatacggtcttgcctacctgtctagcttcattcccaccacattttcttatattctaaagaaagcaaaatattgactgttctatgctattttatagaaatattggtgtctttccatttcctattatagtctttctgcttattatatcctcatctttcttcttctatctctttctcctcctttcttcttccataaccctcttctctttctctttcttctcctagttaactccttcttctccttcacgtttcatgtggaagccttcccggccccactctccagtcactctcatatgagacagccctcctcttttgcttccatggctgcatgtggatttctctttcattgcttatttgatttatgtgtactgaagacagagaatctcaatgcctaggatgatccccgaaatctgatctgtactcagtaaatgttaattgaaccaaaccaatgatgttaaatatctcatttatgtttcatctatacctatgaccttggccatcagattgcctgcttcctctggatcctgagaactaaaaatactgtctgtatgcttctatttttcaagcacaagtacacattatagtgattcaaatactaatggatattttagcattacatctagaaattttcttcacttcccagaaaataagattggttaaaataatagaggtattgattttaaaaagcagggaatatgctgtatatttattacttctcagaccagtgatatttcttcatttttttatacttagtgaattttatctcaagcctcattttactctaaatctgttctctactacaggatagctccttgctttggttaatatttaactttttaaaatatatcacattaccttggtgagtaaaatatgcatgtactataagattaccatcactataaaattatgcaggtactataagattattgtcttttactgtaagattactgcactatagattactgtaagatcactgtcataataaaatatgcatgtcctataagattactgtctcccaaagatttcagatttgtagagtaaaatgctttcactattcttttcctttgaattaccaggtcagaccacagggattatgcagaaagtagtttatttttgtgcgttgtgtttggtttctttctaaacaatctaaacaactttttctaggcttaaaaaattagtttgtgtgctaatgcattacttattgacagacatggtcatatttagtatctaattagtggacagagttaattttttcacacttcttacattttcttatatcatcccagcctcaggccgtcttccacttagctgtcatattagttccctgtggctagtacaacacaattactgtaaactcaatgacttaaaacaagttattcccttgcagttctgaagatcagaagtctgaaattagtcctaccctgctgaaatcaaggtctctgtagccaagcccctgctagaggctgtaggggagaatccatgttcttgccttttttagtttctaaaactgcatttcttgcattccttggctcctggcccttgtcaaaaccagtactatcacatcttactttagtggtcacattagcttgacttcttctctagttaaatctccctatacttctgttataagagcactatgattacagttagggcccctcaggatgatccaggaaaaaatccccatcttaagacttaatttaatcacatctgcaaagtctcttttgccatataaggaaacttgcacagattctagagattaggacctggagattttttgggggtgggcattattcagcccaccacagctactatctgaccaaatcacatagtgcacttttatctgccacagctttaatttcccccatgaatttatttaataccaatgttgtcttccatttttacacccatttcaaaactctgaaatagaaataggttaagtgcagacatccgacttgtatcacactgaccaccagatggcaaactttgtcattatatttttaggcctaatctgaattaatttgacagcctgagtagttaaatatgccaatttaaagtcatgtatagtgccatgcagtttagatcaactgaagttttatcacactagatcattttttatgagaacagctacacataatcagatattaatttgagctactttaatggcttctgaaaaagattacttccttatctagctaacgtcaacaactaagcatgcttctatttcacagaaaattcttccaatgcagtctctcttagtttttgagtaatttcttacaaattctaaatttaattgatatgattaattattaatctcaattttaattacttatatacaggatttttcctagaacttgtttcattaatgaattcaactcaggcaggtactaatccgtgtcgcttttatcctgtagtatcacataatatataataaaaataatggctacaaataaggcagctttctaaaatagcaaaaattattattgttctactgttttccaaaatcattgcactcttatcgtatcagtctaaacaattcagagacatcaaaataacagctaatattcttcttctttccctcttacagaaacttttatagaaaagttcagaaaatgtatatttaagtaagttaaaattcatgttctaaagataacactttttgtatttcccaggcataaagatataggtatagatgtggatatcaatgatatggaaatataattgggatgattcgtacagtgagttttttcttcttttgaacctcattcacaatatcatattaagtttattggccctcccctattccatctccccgtatcccccaagccaaagtaaacattattccaaatcttatttgtattttaaatatatgtgtgattatatatgtatgtgcatttacctatacatatatatacacattaatttattctgatttttcatataaagttatattcttaacattttccaatgttattaagattccttgaaaaatttttaatggtcatatgatattttacctttttggtattccagtttaaccaaatagaccaaattgtctccaatttttcactatgataaatgacactttcatagaaacttataaatcttgcttatatctctcattatgtatttcattaatatagaatcttagcggtggaattactaggtcagaggatatgtggacttttgatgtttttgatatctgttggcaaatagctttccagaagggccaaaccagtggcattctcttaatactcttgccaaagtgcttcattaatttaatttttgccaattaggtaaaaatattccttgatgtgctcctgtttactaatttatgactccctttcaagttatttaaattatatataatgaaatttatataaaataatcattatccagcttactgcactaatattgaaaaggaacataaacatttgagatgatgaatataatttataaaggtggaagggattacagaatggaattcagagtcctctttatcttttagagtagggttctctggcttcttacttcacatagatcagtgttgtcaatactgtaatagaaagaaaatgagaataaaagtaacactattaactagaattttttgtgtctttagcttttagtaagtcccataattgctttgtaacttcttttccctgagaaaattggagcctgaactctcagggttcttatgaagatacaatcactttaaaaagtgtgatcttcctaaggggaattattgttttaacaaaatctatatacgttgataattttaaaatatttgaaaatttataaactctttcttcctttttaatactgtttgttagaaatggctaagatctttgtataggaaggggacataatttcaagtgacattatatttgctcttcctcttttgtttgcactagagaaagccttgccatatctgatacatcattgtctgaaggtatgcttgcgtcatttccaattaaatgttttaagtcagcagtatacagtaaattatcataaatgttattgtaagttcaagctgaaatgttagcaagaaaattgctaaaggatatcatttaagctcttactggttctgtgtatttgctaatgtctgtggtgtatattactttgacgagcctacagtgacttctaacttgaattaaaatacagttttggttaattttgttaaggtcaagacaagatttaaattagaatataatttgcttagttatctcactttttttgaagcaagtaagcaatgaattgggaaaataaattatgattgtttacttaagattctcagaaagggaacacacatgcttcgttgacaacagtggcatcagtagactgaataataatttatgctatattcattacttttttattcctgatggaaagaagagctggttaaaaggtagcagagaccagttaaatgttcaggtctattttaataatatttatacaaattcattgactttataataatttgcatatttatttgaattttgacctacttggccttagaattgtcagtgaatataaggcagtttctgaagaaagcccgaaacactcactacaatgctagaattcaatcggtatttgttggcatgtcacacattcagataccttgcatgtctaattattatatactgaaatatatgtaatgaagagcaaatatagtgaacaaaatatatattgggtgagcaaagtttatgtcaagtaaatgattgacacaaatgtagttctgcttttttggaattctggtatcacaaacttattccaatatatctgaagagtaaaatcttgttcctgtggttactgtaactaaaagggaatggaaaaggcagggcaggaaaagatttatgggattcagagatgagaaaatgtgagagatttgaagaaaaagaaggtagaaaagaagagcaatgtatagactttgacaaatgagaagaaataatgaacaggaatttatagtataaagaagaaggataaaagggtacatttagtctcacaaaactagaattgtacaataaaagaattattctaacccaaattatttaattatcacaatgttgttattcaaatcctgcacatcctttgtctcacagacatctgaaggcctttagtaccagtccagtccatgacaatgtcttttcctaaaatctcatcacttgtttatgctacttacttgacaactgattgaacacttgtaattctgagttgttctgtgattaaaatctgctattataagttaacattttatgctttaaatctcaattttctaagtagaatacaaatctggaagacaagcactctgtcctatttcttgatagtttctgtagttttagcaaagcatcttgcattgtagagggatctcaattctttaatgactgagtgtaatatatagcatttttcaccaaaaagagtcatttatcctatagtaaaaaaaaaacaataaaataacactgaaagcatgcagagacttgggtgaaatttagaagctttggaacatgtatttcatcagtaagttatttactttgtttatgtgatagtcctgacatggaaaatcagtgtaagccaagatagtattgacagaaagagcataataaatagaaaaggggtacatgaatcagattatttacattttgaagatggtggctgcaatgagtactgcacttgaattaatccaaaagatctcccttgagctgaaagtgtgtgtagtcataattgcgtgacctgtgacacattgtctttgtcccactggcaggttacaaaattggcactgaatcaagatagagtaattataggaaagtagaaactgtctggatattccactgaaagctgaagatgtgatccattcttgatttgctttgctaatagctttaactttgagaagacagagagaatagtaagataaacaaccaacaggtgggggatgtaggagtcctgggagagagaaaattatcatgccatttgagagtatataatataaggaaaagagaatagagaagtgaagcatttacatacccccaggttttggcaaaatgtattccaaaatgtttacaggaaagctattttgattctgtggcaagagagctaaaataaaataccctaataaatcattcattcatttattcagtttaagtaatggtattagaaagggtaaagctataagtgagttaagccttcaaaatgaactttttttctttttttgttaggataacctgactgatacagcaaggttatgctgcagatatgatatatcttaactttgtaatggcatttatgaatatctggtgttcttttgaagttgacagaaaaatggacactgggtaatagcatagctattgttggtggtttctgagaggggccaataattagcactcttttctttctctgggttctaaacaaataggaactaacagttaatttgaaaatactggtcaatatatcatttttattattgataaaagtcatgctgcaggacataactttgggtccataaaccaaattattttgctaattctgaactcaagaattaggcagattttgtcacctgccatggataatacattaaggtatgctgcctcctgtgggtaggcttcccagataagaagttatgagagacaggatccaaaccaaactcacatcatctgcaggcagacttgcttctaaaaggaagagaggcagattcatctgtagaattaatcacttcacctccttggaacacaatgagtaagagcaggagagaagctaggagagtatctatggaaaattcctcctcatcaaaattaggaatggcaaaagcttttcccctctaactttgccttgcatctgttctcttaggccactgagtttaaccataaagcctgtggtcaactatgtgagggaggagatcagcagtttatttgggcaggaggcgaattctaatgtcagctgctttgggcattatcctgagatccatggtggtcagttttgattctacactgagaagattctgaaatgggttggaacaggacatatatcaaatcagcttcaatgacactctgtatctgaagctggaaatttaccgccaacttatttcttatcttaaattatatataactctatggccatattaaataactctaatactagaatgtgtaaagatacatcagtaataaaattccaaaaacatagaaatgccctaattaaataaaatctcctcactttatcaacttcccaaggaacaatcattaaagtttaaaagattatatttcttggcaagttaaaaccataagtaaagtctaaaattattttgcctttgtgagttaaaaattcttcaaataaattccaaaaccattcttcagtatttcttattaaaatattaaacattcttcaatattagtctcagccataagcactcaccattcacaggaagagttgggattgtctgtttctcaccagaatgcctagagctccttcagtgtcaacactgctatattagttcaatgccaagccttctgtgggcctgattttaaataactcaaattattaataatacatggaaaattttcagagcactggccacacagtgaccaaatttagaaagcagaccaattcctaccctttaaatgagttatctcaggcaaaatgatatgcctaaacctaattcttagtgtggccaaacaccataccagagactcagtggtatctaaggaaagaagggtagattgtaaaccctgattttaatcttgacatgatactattggtctataaaagttgtccagaattcttgagctatgggtttaaatcccagtgggagaaatccctaagcaaatggttgattttggtattatgcatacttacctcttagagaaacattgctgccttcttgcaagatttagaaatttgtggctgggcggagtggctcatgcctgtaatcctagcactttgggaggccaaggcaggtggatcacttgaggtcaggagttcgagaccagcctggccaacatggtgcaaacactgtctctactaaaagtacacagattagccaggcgtggtgatgtgcgcctgtaatcccagctactcaggaggctgaggcacgatgatcgcttgaacccaggagacggaggttgcagtgagccaagattgtgccacttaactccaggctgggcgacagagtaagacaatgtttcaaaaaaaaaaaagaaaaaaaaattagaaatttttaatcatatcaacccagtcccgagcacatcttattcatgccttctcctccaagacagtatttttaaaactttagtttccatttatcccaaccctaaattgagagtgactgtgtttggtgaatagcacccatgcttttgtgactaactagaggcatttcaatcttattttgctgtggctgttgccactgtatgtctctatgactttacttcccaggaagtatttgtctctcctctgtcattagccaattcagagacaatctaagaccacatggtagagagtgaccttgagcttgtgttcaaactaaacgattgtaagtttcatccataggtcctatcttagtcctaaattaatttttaaattcaacaaatatttattgaacatcttctatctaccagatactttctagatgctgagattaacatacataaaaatccaagtactatcagtagagacaaactttaaataaacaagcaaaatatgtagcatattagatgatagagaataatgcggagaaaaacaaaacaaggaagagggaaagtggctgtgtgtgtgtgtgtgtgtgtgtttgtgtgtgtgtctgtgtgaagatgattgacattttaattgaggtggtcagggaagaagtagaaaatgaaattttaggtaaaggaactagtgttggctacttaagcctaacactaaccatttaaagctcatgcacattctgtttatatatatacacacacacacacacatatacacagtaaccatttaaaactcattcaggttctgttttctatctatctatctatctatctatctatcatctatctatctatctatctatctatctatctatctatctatctatagtctctccataagagattgaatgagccaagaaagctgtctagtcatcagttgctgaaggactggctaagacagaaatacacagatacgtttctcagttgccccaagtttgggactcactcctcatatatgtgtacaaagtacaaaaattaaaattcaagttccgtaaatttagaacttgacttctttgtagtttactatgtttggtaacagcaaatattctgctcaataatttccaaagcctttttttccatgtgattaagtcattgcctcagcaaagcttagaaatagttgcatttgcatagtaaatggcatattaaggccttggccctagttgaagcccagtgatcttcatttttgttttctggattgccccatcacttgttctatccttaaggaaatggagtggcttatttgatttctaaatttaagtgaaataaacagcatcagttataaagatgatgttgtaggaccttttccttagttcagctaaaaatggggtccttatcacatgaccatgaaaggttaggctcacagatacattgaagggtgggaaaaattgaatttattgggtgaaaagaaaaaaaaaaactcagcaaagtgagagaatttcctgttaacaggcccccatctcaccaattgactcccaggtaccaccctagaacaggagaggccacgttcctcccgctgcaaacagcacgaactttctgaggctccacccagtgtgcattcctcccattgcacaggcctgtcaaaggttctgccaggcggcccattttacttggctatctcaatgatattatgttctttatcttcactttttactttttaacttgttcagaatcccaagcggatgagaagggtctacttaataatagaaaccttatcagagaccccaacagttcaatagattcattattgattgctatgtaagtgtccatttctagagaaagggtaatgaagcatgtatttcttttctctgatccacttaaaattttcatcaaccaagaaataaatggcctgattatcaaatttagatatttatgggaaaattcatggaaaggaaatatattagaataaagagaatttgtagattaagtgtgaaatatatagaatatatttggtgaaagttaaaatgcttttggtaaagggaagaaaatcatagggttagatatgtcttcttagcaggaatatatcataagccaatacattcaagaaaatttaccagttggttggtgaagcagacaaaacacaggaagacgctgcaaagtttttgggagcatcattagaccaagagaggttgaatgagccaagaaatctgtctggtcatcagctgcagaggggctgactaagtaagaaatacacagatgcctttctcagttgccccaagtttggaacccactccttataaaaatatatacaaagtacagaaattagaattcaataacatatggtccaaaaagttgtattccagagcaagggctaaggagggtcaagttttgggtaagttttgcagtggacaaaggatggtttcacaaagtttgaaaataagggaaaacatgcctagtctgctagctagggaacttcttgggtatcatatacctcttgccacccagagtagacataataaactgaatgtttctaaatccatataccttatctgtcctatcttttgatatacgacatggagggaaccctggaatatgaaaaagcaatactcattcttgtggtggcttttatgatttttattgaattactagcaagtatggcaactcactatcttgattctctttgcccccaaagggcattgacctgttcaggggatggaatcggggtcaacatgaaagaaaacatgcagagagacaactaacacattggaagtttaaaggttcaaagagaattctgcactcaataaaaaaacaggttaaaaataatcacaacagtaaaacatgaaaaatgtataataaataccaatgtgaagttccgaatttagtttcaaaaatttactcatagacatgctaagtaaagaagacttgtcttgatcaaagttcacgtcaaggtattcaagggtcctagatgaccatctgtcaggaaagtcacagcacttctgagcctgctttaataggaacattggacttagtaacctccagtattccttccaaatctgggaatgagttactccaatgagcctgtgactttctcaccttctgatttttgtggtttaacacattgttccaagtacataagaaagccgatttatatcagtcatgagtaatctatgctacatcaaactgcccttcacatttaaaaaattcaaacaattgaaattcattttttttaaaaaacatcatgtctcctttcacaaaatcttaaaagcaagtcagattgcctattcatttatcacaccagttagtcaatgattattataggtatcttccaatggagacttaaaaaaattatatttagcagatgtcttcacaaaggagcattttactggagaaccattttttagcattttgcaatattgaactgaaaatgactccattagctaatagcaaaataatcccattttcctcaaaggaaaaaaatatctttaatatatgtattgattaaaaggaaaatgccagtgtgtgggtcatttacgtatccaggaagatttaagaacctcttgaagaacttcaaaattatagtcataaactacttaaatgttcaacacgaactccttatacactaaatgaaaaagctaactggattatgttgcatttagaattttttaacctagaagctagcatgttgtggctcagaattgaatcattagctttgcattaattcccagaatcagggagaaaagaaatctttcttcagtaaattacttcttggggttgggggaactactgagagattgatctgagctttgttgcagcaagagcctcaagtcataaattattggcacacaagcagaagtcagtgtgtcatttctattgtagtcagatgcttttatatttccactcgtcaaggttgacttgatcatattgtacacctcctggatgtccgagacatagcattcatttgtccctctctttgagagcaggacaggtatttctttcacaacttaaacctctaagtttaagaaatatactccatagtatgactgtgggggtattctatgtgtgaaaaattttttcgagtgcagatttcaaaatttgaaattaaccaggttctcatttttgctctttgaggagtaatatgtattaaaatccattctgaggatctagcttttaaatgaccttttcagtactcatccttttgctcattttgatttgctcagataaattacaaccacctggccttttgtattaaaaaaggttacatacaaaattgaccttttgatacttattgagggaactaggttcattgtatttgagattaactgctgttgctgttttctgaatgatgtcttaaataactttacttgaggatggtaaagcctatttcttgtgccattttgttccaggctaattctaacaccataggaatggactgtctgagatatacaaagaaaattatgttttagaaaataatgaatctaatttattcagctcctgtgtgcctaatgatttacagatgtgatttcaatgtatcttaatcttgataaacccaatattatactttggccagtctgcccttcaccatattgcttattaagattctagcttctttctgtctgtttcttgaatattttaagctcaggcttgcctcaaaacttggtgcttgattttcccgctgcctgaaatgttctttttttttttttttttttttgagatggagtctcgctctgtcacctgggctagagtgcagtggtgcaatctcagcacactgcaatctccacatcccgggttaaagcgattgtcctccctcagcctcctgagtagctgggactacaggcgtgtgccactacgcccagctaatttttgtatttttagtagagacaggatttcaccatgtcagttggccagtatggtctccatctcttgacctcgtgatccacccacctcagcctcccaaagtgctgggattacaggcgtgagccacctcacccggcctgaaatgttcttttctagcttcctttgttccattcacctaatattctatttgccaccctacattttctggcttctgtgtaattaggttggactgtgtgactatttctgataatgagttgtatcacttgtgggctgaagcactgaaaagtccgtacacgattcactagtcctttttctgccatgattcttcgggaagttttgggttgagatggaaagtgacaagattgaaacaatctatatggctgatttcccaaatgggaagttacctagaccagaggattttgtgtgtgcaaaaaataaacttttctgtgttcaactactgagcttttgggaatgtgtgcctattctgattaactattcagggtttcagggcaaatgtcatttctcttctgtaaccattctatctaaagcactttccctctgcactgtatctttcctctgagcattttgtttcccatagcaatttttttccataatacttttatgtatttgtttatgtaagtcaacgtcgaacaaacaagacttctgtgtgctgttaattatgattcttaagtgcccagagtatttttaaagttgtcaataagcattcatttttcaacattttgttttaatgtcaacaagtacaaaaagcaagataaaatactatcttgcaaaggtccattgaatttcctgttggtcaccagaaaagatagcctgtatcaagccatagcacagtttttaagactctcctagataaatccattttgcattatttcttttatcctgaaatgagatcatctttggcaaagtctttataggtaatgctatctgtatcaacacagaaaagatttagagtccgtattttcattttaaaatttcccgaagagtcaccttcaaaaattctgcaatatttttgcatatatggaggtgttcgtccactaacgaatagctttgttgcttttaactccaggctacataagtacttcctccaatagcagactatactatctgccagctgcctgcttccagttttctggcacatggttcagaagagtctctggtattttttttgctggcatggagaagcttgctgaatagaatcaaaagagtcaccccatacatcagttactagaaaaagggcatgcagtaggagctcagtaaaaattcattcaattaattattacaggcaaatttattcaccatggaaatcttgatatgagcaaactatcacatttttctacaaataggcttttattttttaaaaacgatgaaagaaaaaaacaaaatttttcctagaattttagtctaagctattcaggatcatcctttggaatttgaagtaaagaacttcataatttgcttccagtccttaatggagtttcttgacaaggcattaagactttacagaaaaatattttcttattgctaatgcatgaagacatgtgccacatgaagtacagaacttcatttctcattaaggaacaaaatgagatatgtgatcaagtagaagataaaaacaagtatacacaggtatatcatctgcataatcaaagttttgcatggaatattcatcttcagtgttatgaagacttaagtgattttcttttgaaaaagtgttcacaagttggaattctttgttaatgagaagtcagcaagcacacagttgacaaaaaccagggattgtctatgctggatcatgttagtgtttcacttagactaaaaagaaatgatgaaattctaatcctttcctaatttacttcaaaatactcagtgttagcaaacattagaaatttctggaatggatgtgataattagatagggatattattttacttttctttgtttgctccatactgcaaattagcatgatcatccccccgccaccaaaaaatgattttaccaaggtctatccagagatacaaagcttaactgatttgattaacaactttgtgatatgcttcaagacacagcttttgtgttgagaaaaattcaaattttggtaaaattctatccacccccccacacactctttttttttttttttttgagatggagtcttgcttttttgccccaggctggagtgcagtggtggtcttggctcactgtatcctctgcctctcagattcaagccattctcctacttcaacctcctgagtagctgggattacaggtgtgcgccaccaggcctggatatattttttgtattttttagtagagacagagtttcgtcatgttggctaggctggccttgaacgcctgacctcaggtgatctgcccgccttggcctcccaaagtgctgggattataggtgtgagccactgcgtctggcccctatcccttttaaattaaatttattttcatgaagacttacaaatggacagatgtcaggcaacccttccattttcttgacttcaaaatttaattacaaagaatcgcccctgtaagaagtactgttttgtctcccatgatgtttaagtaggaatggatagcatggatatgtaaagataaggaagatttgctaatgaagattattcattttctctgacatttcctaaattaacctaaacaatgacagcccatgcttaaaaggaccatacttgtaaaagtaaggtatattttatttaattcctgtcagtagaaaccttttaaaaataccttattacaaggaaatgatggtgatgctatcaggtcatgtagtttgtaccaccctgctcttgttaatattgacaatttccagagttccatgagactgattttacattgaagttatgatctacaatcagtatgtaaggctgatatctttaagaaacaagatcattcagtatagagtataggtggcattgcatatacaccaaagtttacagaaaaaaacaaagtttgagaaccagtgagctacatgaagaaaacaaataaatgaaatgtttccaattaaatgtctgagctttgaactaattctgccttgaagatcattttcaaattcttatctagcaaataggaatgtgtcagtaattctaaagtagttttgctggcttttagaatttgttcccttttgttttaagcattaatatgagttgattgatttatttcttgaaataacttaaggaagtagagttacattttggttcaggatgaggggctgttagcttctgaagacagcagtaagttaatgattgaatccactgaaattgcagggaaataattaaagtatcatctattagtgccaggttcatagacttttccagtcctcatctatttgccctttagaggtctgtgatctgcagtttgaggaatctctggcctagaggttctgtgaggttcctgccaggtctaaaaatctgtggagattgtgtcttggtcatatgaattatataatcagtgttatccaggtgacaacaagaccctcatttgttgacataatttaatccgttattttgaccttttggtttaattttactttgagtgataacgtatttactttgatacgcatagtcatgcttatactttctacatacattgacatgcatatgtactatatatgcattggtatatacatatatataagcttattgtattagtcccttttcacactactgataaagacatacttgagactgggaagaaaaagaggtttaattggacttacaattccatatggctggggaggcctcagaatcatggtggggggccaaagcacttcttacatggcagcgttaagagaaaatgaagaagaatcagaagcagaaacccctggtaaacccatcagttctcatgagacttattcactatcatgagaataacacgggaaagaccagcccccatgattcagttcctcccactcggtccctcccacaacacgagagatttctgggagatacaattcaagttgagatttgggtggggacacagtcaaaccatatcacttatatatgctattaacattttagaggatattttgaaatctatattttaatcaaagatccagaaacattttccgtttttcctttgtctttcctctgtctggtagcagacctgatgacagtgaaaggtaggtttaggttttggcacattactgcccaaatagcaaccccaaataactgaacaacctacctggaaaatctgctgtggctatttgacaatattttgcttttgaataatgaagaaaaaataactaatcttaaggttttatggaatctcgcattattaaaggccttctggacagtcactcaagtttactttgcaagttaatacaaatattgcaaaaataccatttgacaaagaaatttcaaaaatcattggaaatgaatattatcagccaactcagtgaatacttgtcagtgttagacaggtagaattttttttttatttttaagttaacacattatgtcaaacacagcatattgccggcaggtcaaagattataaaagcctagaaaaaaaaataacaactgtaacctgaataaagatgtttttccaaaccactcccataatgactaacatcactatctaggaaaattaacctcacactggaagactgaaagcagaagatttccaatatttttctgaacaagaatttgaaccttgtgccttgaagatttagttatataaaatggtagaaaaccatgctttcctaatttaatgatactaaaagttcttgccacttctcttctttacaccatcctaacatcaaaagaacaaaaaatgattttttacttgtattactgtatgctaagtatgtttgtgttaataacagaaagcctcttatttcatgaattgttgcataatcttttcttcagaggctttattttagtttgtagctcaaaactaatgacaaaatcattttgagtgctctttttatacctttccaaattgttttgaatataattgctgttagaaatattaatgcattgtgatgactttatggcagtttttttctatgatctttgcagtattgccataagctagatgatgaggaacaatatgaaatctgatattgatttgcaagacaggtccacaaaacatccccattctaaaaaaataaatgtctacctactttcaaggagaagacataaattctagaacatcaaaggacatataagagttttaaaagtttatgcataattagagtcagttttatcataacttgcctttacccacatttggatgaaacagattcttatactatattttattcactcattcattgttcattcataaaacactgttgactatcaactaagtattgtggggaatgaaaaacaaaaataggcttttgccttaaagaagatcccagaaaagcatggagacataaagagatggtgccatattaatatcacaaataattcatagaagaggtgatcatttcaaagttgaggtgaggtagaaggacatttgaaggtggaggagagaatagatagggaacctatgcaaaagagtcatgtagtaggaggtatgaagacaattgcaggcagagttagtcactgctttgttttttatgtatgtgtatttttaaggagtattatcctaaagtcattcaaagagttgtatgccttgtggtgtttggaaaggtagctagtatcaagtttggggaatgataccgtatttgaagtaatagtattaagttgaagaattatctgtattcatatttgatagaatcactgactctacctggttgtcaaatttaagcgtagatattcttttcttttgtatttatttatttatttatttatttatttttgagacggagtttcgctcttgttacccaggctggagtgcaatgacgcaatctcagctcactgcaacctccacctcccgggttcaagtgattctcgtgtctcagcctcctgagtagctgggattacaggcatgtgccaccatgcctggctaatttatttttatttttattttttagcagagacaggatttcaccatgttggtcaggctggtcttgaactcctgacctcaggtgatccacctgcctcggcctcccaaagtgcttacaggcgtgagccgctgagcctggcctgattttcatatcatttttaattccatggtttgttttataagagattttgaatagcaaaacagttattatgtacaacaaataagatagtaacatctctttaatttttaaattttcttcacaacaatgtttatggcagtatgattataatctattgtattatgatcaatttgttcttttggctttattgttctgctgaataattggcaatagcagattagttataaaacagacacatctgctatatggcttcttatgggtatacaaaatgttaagcttcattttatataaaacacaatcctggaaaatctattaattttcaaattttcttaagaaaatacgatacagtttttcctaattttcaggatgagtttttatcattcttagtcacaaatggtggaaggcagttccaaatctaaattcattttaccacaataatgacagtttccaactgtctcataaatttgcaaaacatttgttaaaagggagactagtagagcaaaatgtgtcactgttgctgaagaaaatgggcctgtggtaattagtgtgccgtcttctgagacaaaaatagtgcttgaaatttaacattataattgtaccaattagcagttattgagtgctcacaatgtgccagcctctgtgtggaacagcccaagtgtgttatctctttagtctcaaccttatgacttaaagatactattgctattcccattttatggagagaaagaatgagtgaaaggtctcagtaattagattatgatccaattgctggtaagttcaacagctgggatttaaaacaggtcctctaaggtataggcgtagtgtaggtactgttattatttatagatgaaaaaaattgaggcttagagaggtctaaataatttggttaagctcaaacagctaaaaagtggagaaactggtatttaaaagtaggacaattgttaagaattaggggaggagggcagaaattagttgcaaagataatcacgatttactccatttgattattttagggctatcacactaaagcaagagtgctacgagggaaaatgatgttctcttcctaaatttcacagtaagaacatttgcattagtctcccaaaggcagaaactcagctgtttcagcaaggactctctaactagtcttctactaggtgacacagaataaatttatttgtctaattctttatttgtaactttactgacacactatattgtgccctaattatttccattttaccagatttgctttacaaactatagtagtaaagtcctgggcaagaagaatatttttcttgttctttacataaagtaatttagtaggcattcagttcttaaaaactgatagaaacacaaagctcaggaaacaaactagaatttttaaatatactttcgcattctacaaatttaaaaattgaacaaaagtatcagtcactgatttttttatgagtttttgggagtcacaataatagattacagtccatggaactctattttttgtcaacgattgtgagtttggaatatttgttgatttatattacaatatgtgatattgagtattcattaattctattttgtagaccttatacttttagatataaggaaaaggcaagatgaggaaaaagaagctgttcattttgtctagcaatcacttgtcatatgagatgccgtttatatgctgaggagaacaaatacaaatggagataattgataatacaaatcttagaaaattgtgttcaaacacaaagtggaatttacaattttctcaagactttttgtacatgagtataggaagggtagattgtatatttgtgtgtgttgtctgggcatgttggtgtgtgtgtttttaccaaagacgaagaacctggtgtcttctgcatttactatccttagcatttgagataacattatgtttgcattttgcatagacatactattcagatcaatttcccattcctattgagagaggcataaaccagattctatttgccaggagctgtatttttaataatataattttgaagttatattaaagtgaataatttgataattcagatcacattcactttttactttgaatatgtatttttaaaatgaatttgttacttcaaaaaaatgtgatctacaaacttaaattgttacttattaacagttgcattatttctatcccatattgtcatgtgaatgttctctttttaataataaaaaccaggtattaaaacaaacattttaaataataaactgtcatggcagtttattatttaaacttctgcttaaataaataaacttgtgtttaaataatttggcctgtgttcctttatcatctacaagggaattttatgaatcttcactcacaggactacatccatttacattcaaagactagtagttaacattttaagtaaatgacagagaatctttaaaaatatctgtgaataatgaagccattcattgtgttcaaggattttgcctttcttcaataatacaattttcttctcattttaaagagtatttaattgcatcacacgtcctattttaatatttaataataattttattagctgtatagaatgagaagggcaagaattgcaatatctagtgctggtcatcaatttttttatcatgacttaatgaatatcataattacaaggagaggcaaaaagataaattagcttagtagttggttgggacttgctagtttattggttttagcctgggcacagcccagaatagtcacaaagagaaagaaacaagtatctgggggtgctgtagaagtccttgcacacaatttctgcaccttactaatcatgcctcattttgaatgataaacagaggctttgaacaaaattataaacactgccaataataattccttctggttccatagcagttcacaggggattctgatgacttacaaaacttagtcttggcaggtatatgttcctttaatttctattaatgcattttgacaacttttcattatcttttcttaaatatttttactgttttttttttttctttttcagctaagacaaaaatctgagttattttgagtaggaaaatttggcatagccatcactgtaataacactttttactcaagtagcacctctcacccgaggctttcagagtgcttttgagtacattgtattaggcctgcaggatggaggtcaggggaaaagttatttgtaggcaccgtacatttaaagcttctgtggacatacagccaaggccacggggagaaagtaattttcatctttagtattctagatatggatatctgtataaaatgattcctaacttttcaatgccatttgttaaaagagggaaccagatattgttgaatttcatgtgcttttaaacctattttaagataaatcatttttaaccccctccagcaactgcttcgagaacgacagcagatggccagccgtccctttgcttctgttgatgtagctctggaagtgggagctgaacaaacagagtttctgcgagggccattagaggtaggaacagcggtgctgaaagaggaccactgtgctttgcatatttattatattgcttctctaatctacatctgcttatgaagccaaacagagtctgattatctacagttgacaagattcagctacatatgttatgccattttcaaggcacatagttttaatagtatgacatgagctgtaaccaaagccactggagaatctattagcctaggcaggagtgacagactgctcacctggcagcctttctctgacagaggagctgagggaatttaagatataggtatgatcgaagaaacaaagcgcctatatttagtctttggagtactctgtgcaccaagttaacaattcacatctatctttattaacaaagtttacttagaaaaggtacgagtggagatgagttgcattttaattacatagcttcatttttgaatgttgaaaagtgaatgtttctcacatataaaatgaatatttttatttgtggttaattgctgtattattacattcctttattgcaaaggcagaaatagagtatgatgaaacagaaatcattatatgcaactaaatatggtattagaatccaaaagtaatacatgaagtggtttctgaaaataataatccctaaagatgcaaaattcggccgggcgcggtggctcacacctgcaatcccagcactttgggaggccaaggtgggcagatcacgaggtcaggagatcgcgaccatcctggctaacatggtgaaaccccgtctctactaaaaaaaaaaaaaaaagaaaaaaaaaaaaaaaaattagccgggcgtggtggcaggcacctgtggtcccagctgctcaggagactgaggcagaagaatggcgtgaacccgggaggcggagcttgcagtgagccgagatcctgccactgcactccagcctgggcgacagacagagtgggactccgcctcaaaaaaaaaaaaaaaaaaaaaaaaaggatgcaaaattcacaaattatgattaatgactattcaaagcattatgatgcatactaatttaattgtatgtttattacttttatttacttttatatgtggtaagatatatttaagtagaaaggttaagaaactctagaattgaaacattttattctcttttttaaaaatgtctttatttgactaattttatgttgccattttcagattttactttttgtcaaggaaaataaagaatggaaaaatagaatcattcaaaaacctaggtatacatataatagattctgtctgtagcatttttgttttttctgaaaaaataagacaaaatcacaactcatggatgctactcaaagggtcagtttttagaggaaatgaaatattgggtgcatgtttccctatgatttttaagacattttgtgtacttgattttttactactctagatcacaggttaccatggaagcttagaacatcaggaaatttgtgtgtatatcttctatttgttggggaaaaaataacaaaaaagaatgattaaatgaaagttacagcaagtgctctaatttcattttggttccttgtttcaaataacttttataaaaaactttcacacacagaaaacttagactatttttggactattataaattctttttatccccatctgtttaaaacattcttaaatactgctaaaaatcgagtaacaagagaaaaaaaatgtaagtaatgcacacatagactaaagaagaaaagaaataaagaactagaaaattcacaaactcaaggaacaaatatgacacagacatatgtcaccatagtttgtcagttgcacgttaatagtgttcaataatgtattgttaggtacccatgtgttcataatcatcatatcttcatgttctattttttccaaatgttggttctttctttatcattgtgaatttttaaccttaaattgtattttgtagagttaaaaaatgtctagccctactttcttttagtccatattttctgatattccttatttcatttgcaatttcgctatatccttttgttttacaactatactttctggaaaaaactgttagcttttttattttttcatttactctgttttttattgatgttaacactgacattaactactgttctaccaaggcttatttcagctaccccattttgtgtgtgtgtgtgtgtgtgtgtgtgtgtgtgtgtgtgtgttgttactagccttgcttctttttgtttttttttcccagcttctgtccataaactgattttcatctactaaacagaatattgcatattctatttttatgttgcttatagctaccctttccttatcaagattcatagtgatttttccctagctatgctttaatcttattaaaacatattcctccattgcccatctcaaataaaattaatactttagcatgctctcaacttccctctgtttctccttccatatgttaataccacctggaatttttatcaaaacgttatggatgtacttctttctttattatggcctatgtaaagaacaatgaactttatttgttctcctttacttttgatatctagttgtttgctcatgcatttcttttatttttcactaagattacctctctaaaagatttttttcaaagagaaactttgggtccagcatggtggctcactcctgtaatcccagcactttgggaggccgaggtgggtagatcatttgaggttaggagttcaagacctgtctggccaatatggtgaaacgccatctctactgaaaatacaaaaattagctgggcatggtggtgcacgcctgtaatcccagttactctggaatatgaggcaggagaattgcttgaacccaggagatggaagttgcagtgagccaagattgcaccactgcactccagcctgggcaacagagtaggactcctcaaaaaaaaaaaaaaaaaaaaaaaaaaaaagagagagagagagaaactttgtatggcattatctttgagaacctaaatgcctaccaatatgtttttctcacatgtacaaaacagtttaattgaatatgaaattttaggttcaaagttctcttctccacagctttaaccattgtctcaagtctgatgtcaatttgattttttgtcctttgtaaatgatctccattttctttttggaatttttcagtattttctcctttctcagtgttcatacatttttctccaatgtgtccatatgtgtgtgtatgtgtatatatacatatgtttcttatttcttcccaagtaataaaagatacacgtaaatttacgtatttgctagatcggcagttgaggcgggaagaagtgaatgtttagggttatctagccatctgcttttatagctatgggatttcttccctgagatgagccctataattaccctgtcatcagtgtattagtcagggttctatagagggacagaactaataggagatatatagttgtgtatatgtatatattctatatatataggagtttattaagtattaccttacatgattacaaggtcccacaataggccatctgcaggctgaggagcaaggagagccagtccaagtcccaaaactgaagaacttggagtccagtgttcgagggcaggaagcatccagcatgggagaaagatggactaggccagtctagtcttttcgtgtttttttctgcctgctttatattctagtctcgctggcagatgattggatggtgcccacccagaataagggtgggcctgcctttcccagcccactgactcaaatgttaatcttctttggcacatcgtcgcagacacacccaggatccatacattgcatccttcaatgcaatcaagttgacactcagtattaaccgtcacaatcagtctccagccttaggctggcacttgactggttctgctgctttcctgccccacagcaggtgggatcggtaccaatctatccaggacaatgtggactgtggcccatattatctccatgtttaaaatcaggagagggaacaaatgactcattctgatttgctattttgttgtctgtggggtcatttttgcaagtacttggtataacataaagcattatattaattgttgcaattcttactatttttatttttcactcagttctcttaataactagcatgcctctatttcttttgtatgactttttgcagaaaaataattacatgtaaattctcgtttaggaaaggcctttatatttggggatcaagatctagttattaatgtatggtatttttatggaaatagctttattgaaatatagaacatataccaatagttattatatttatatttaatatatataatgttctaatatttaatatatataatgcactgatttttggtatatatacagttatgtaaccaccaccaaagtcaattttggatcctgtcatcaccccgaaagaaaccctatgcctttcagcagtctccctaccccacatttttcttcagcccctgcccccccaccccacacccatctcctagccctgggcaacgattaatctaccatctttacagattttactgttttggacatttcatacaaataaaactatatacagtgtgatcttttgtgattagcttctttcgcttagcataatgtctttaaagttgatacgtgttgtagcgcctgttagtgcttcattcatttctattgtcaaatgatattccattgtatggatgtggcacagtttgtttgtacattaattagttgatggttatttgagttgttttcaccttttggatactatgaatgatgccactgtgaacatttgtgtaaaaaaaattgtataaacatgtttacatttttttgggtatatgcctaagggtggaattgctggattatatcgtaactttttaccgcttgttgaaaagtactttctttctccattgaatagtctagggacccttgttgaaaatcaatttaccataaccatgaggatttatttctggaatctcaatattattctaccaatctatttatctattcttatgacagtaccacactatcttgatgactctacctttgtagcaagttttggaatctaaaagtgtgagtcatccaactttgttctttttaaagactgttttaaagattgaatttcaacttcctaggtcttgggaatgatcaaaatgtttaaattgaggttaaaacattatttttcaaaattcctttacatacactatctcaatctcatttgagtcttaagtcaatcctataaaataagcagaacatatttcatcttttttttctatttactattgaggaaactgaggctctgagagcttcagacctatgctgaagatcacaaattcagtcaccagtagagcaagaaccagggttcaaatctcatattggcctaagggtttctttcccacattgctttttatatatgctgattttcgttcaaattgagaagacatcttagaccttaatatatctatagaattttttttgtaaggaatagagttacttaaagttcatgtagtatactttgattccaggtgctcaaatagtcatagataattgtggatcttaaggaagaactttcacttggaaagttataggctgtcttagtatatcagagaattccagcagttatccattgtaatctaaattgctataaagaaatcaaagtgacttactaaactgcaataaactcagcacacaagctttcttttatttttatattagaagtttcttataaaaataacttttgtagttttgttatgctaataaagtaacagttctgtagaaacaaagtaatttaagattgtttatttggtaattatagtcaagtaggctaattaataattttaaagacagttgtttacagcatgattaatttttaccagactaattatttcattagtattctctgtatatattttaactactttataccagaattttcattttacaaatttgtaatgttttgattctctccacctataaagaaaattatagctttcgagtactataaagtggagttttcaaaaagacactggacatgtaagaagcatacggtaacctagaaaaaattaatttcgaatctactttctatttggtagctctaacagtgctaattttgacatcacattgaagttcattctctgtttattgggacagttcagcctcgtatcttatgtaagaaacctcgctcccaaggtgaaaaacgcattgttcaagtctaaggcagtcaaagtgaagcagctgtcctattaagagcattgatggcctcattcctggaccacattaagcccagtcctctgctcttgggcacagccagtggtccccctggttcctcattcctgtcctgccatatccatggacagtagttccagtgactggcctaagcagcttatttaattttccccaggtttccttttttcttatagctgatttgtgatatttgatatttttaattattatcatttactgttaatattctgattatgtaaagaatacatcctcattatagataaatattaatgtaaaagatataatacaaattaaaatatttcattatcccattacccataaatattcagtgccagaacttttatttctttccaataacattttcattttgcatatttgtatttttacaaaattgagagcatattttatagtgattttgcattctgtttttctcagtattagaataagaacatttttcacatctaagtttgattcaaaaatacattttaattattttgtggtatatcatcatttatttgcctattctgttttcaattagcattattctaatttcacactattataaataagactgcatttcatttttgtatataactcgatcttactttatgaaaaaaaacctactgaatcaaaagttattaagttttaggatcttgaggtatattgcttatttactttctagaaatgtcgctgttcacactatctttagcaaagtatgagaatttctattttcatgcatccttgtcaaaaatgattgttggtgtttttgcaactgttaatttgatacaataaatgttaccttctttcttttaatcaaatttttattgttagtaaaattgaatatttttgtattgtctgtaaccatttgtatttttcctagatgttcatttgttgatcattattctctaatccttttctattttaatagcatttattgatagtcatctgattatatgagaaatattgtattaattctagaaaacttagaaatgatagctcattcgatatctttcttcatctttctattggaacattccttgcctttttacttctagatcaaatatattaagcatttgtaaattacctgctataaatgttttctctctttggatattgattttaaatgctatattttctctacttttaattaatcagcttattgtgtcttttggtaatatttttcagaccctacctttgctttattttcatcctgaatttcctattatttttccatctttaaaaaatattcccttttatcctcaattgatttgcatgttataaaatttatttattttagtggttactcttaacattttaacaggcatagtttaagtcaaaaattaatgaacatttttccctcttcccaaacaatataaatcttgcttccaatttaagaacaatttaaatcttgcttccaattttctttgtttttgttacctttgttaagttctatgagttttgtcattccttgaattaaacattattgttgttgtattatatgatcaatatgtgtttaaatttacttacatattgtgtattttcttggctcacagttgttcttcgccttcagagcttccttttaaaatgtttctactttcctgctctgtctttaagtaatgcctttagcatatgtcttttgataataaactctcttacgtctttctatttccctctccagtttcagtatcctcttattgtttacaatctaagaaatgtatttaaaatatactttatcaagcattctagttatctttcagtgggagggtcacactcacacattgtgttcacgtgaaaattgttctgacactggcttctgatttccgttgttgctgtagtaggtcccttcatatccccagggaatatgttccaagagtccccgtggatgcctgaaatatgggatagtaccaaaccgagatatacatacctatgataaagtgtaatttgtaaattaggcacaataagagattaacagccgtaactgataataaaatagaacaatattaataacttgccagcatcactactcttgcactttggggccattattaaataaaataagggtacttgaacacaagtactatgatactacaaagctgatgtgataaccaagacagctactaagtgatgaatgggcaagtaatttatacagtgtagatgcaggctgaatatgctagacagagataattcgcatcttgttccaagtcagaattatgtgcaatttaatctttttcttctggaatttttccatttaatattttcagaccacagttgactacagataactgaaaccatggaaagtgaacccatgcataagggaagactactgtactaaaaactttccttcagtatcattgtcactcctttatagagaatctagcttttctctccaaaatccctgtgtttggtgttcagcagttttatcacaatttaacaaagtatacctttatttgtttttaacctacttggcatattttgtgcttcctatatttgaggatccaagtctttggttatttctaagttattgagtcattatcccatttgtattttctttattccccttctaagactctgattagatgcgtgttaaacctctttccatcttcacaatctcttagtctttctgttttgttttctatctccttctcaatgctgtttcttttggcttattccgaacattgttccaattcactaactattttaagtgtataaaatctgtttttgacctgctttctactatgtccatttggattactatcaacacatatttttattactttctaaagttatattttattatttatttattaaagttctatttggttctttttttaaatctgacagtttttgaaagtctcttcttccttactgttttcattacttcatttttcattccgaataaaattatttttacgttgtatctgatcatttcaatatctgaaatccttggaaatctaaatctgttgattatttctgctggccctcaatcattatgactgatttccttgtgtatttggtgatctttatgagctcttatatgatcttagtttgtggtttgctagtgacccaaagaatgctttcctgcatagaggattgcttttgccaaaaaccaagggcctctctttattctgtagtcacttcttccagggtctctggaatagtgcaggaatctcaaactcagttttcctttttatttatttattatttttttgagacggcgtcttgctctgtcgcccaggctggagtgcagtggcatgatctcagctcactacaacctctgcctcgcaggttcaggtgattctcctgcctcagcctcccgagtagctgggactacaggtgtgtgcctccatgcctggctaatttttgtattttcaaactcagttttcttaccgtgtgagttgctcatattaacttttaccctcagggccactctgctgtcatatttgcttgctgctcattgcaccctctccagttttatctggttgccttggagcagttttatctggttgccttggagcattcccttactggctgcattctcagcaatgcattaaaaggtatacttcattgggtaggcacggtggctcatgcttgtaatcacagcactttgggaggcctaggcaggaggattccttaagcttaggaggtcaaaatccacctgagcaacatggcaaaaccctgtctctacaaaacatcccccccccccaaaaaaaaaggctgggcatggtggcatgcatctatggttcagctactcaggagtctgaggtgggagaagtgcatgagcccgggagttcgaggctgcagtgagccatgatcatacactgcactccagcctggttgaacagagcaagaccctgtctaaaaaaaaaaaaagaaaagtatacttcattaagcatttggttattttgaagtgggaaggccctacttacactatctgtagttgtctcctctggcaactctattttactgaacacaggttctctttggattgccattcctcctcctggccttggctcgatattttcattgtcaccaatttaagactcaggctttggcaagttgaaagggatgggaagggaggtccccttcacttgttaatgtggtagtagcatagaaacagtcaagccatccatttcctacagaccttttggtactcccccagtttcagagagaatgaggactcagacccccaattctgcttctttctaagcctcttggggaccagagagtccaggtatagtcttttaggaactgtattgacttttctcttggtgtttacagttctctctagaccaagcctctgtaaaattcttacactgggtcttgatgctggttcctatgcacttggccagtccaaatgggagaaagtaaggcatgagttccctccaccagagtttctataggacccaatccctaattgcacatagttgcctataggccccatgagccatttgccttaagagagggagatgattttcagttggtagtagacagaaggaaattgtaaggaaattgccaaattcttcataaaaaatgatttagaagataatgattttttttttttttttttttttttttttttgagatggagtcctgctctgtcgcccaggctggagtgcactggcacgatctcggctcactgcaacctctgcctcccagattcaggcaattctcctgcctcagccccagtctgtagctggggttatagacacccactacaatgcccagctaatttttatatgtttagtagagacagggtttgaccatgttggccaggctggtcttgaactcccgacctcaggtaatccacctgcctcgacctcccaaagtgctgggattacaggcatgagctgccatgcccagccatgattttttattttaagaaaattatttacaataaataagagatttttataggcacacctttggttcttgaagtgaggaaagatctagtttcccagctgcattttggaattttcttcatctttatgttaaaattataaaaagacctttcttcaccaaaaccatttagcaggcaatgttttggaaaaaatgttttggaaatgtcagatttgtagtattaacataaacatcgtgagtttcatgattgattgaagcatgaaataagaattaagtaatggtgcttcttcaatattaacatgatataaatagaactattaaaaaggtatgaatataatgtattactgaaattattgaaatctacatggttttaagttaatataatctgaactttaagcatgataaaagtcatttgtttacagtttaaataaataatttgataaatgccctaggttaactgtcctaataaagtaaattactgctatcatctttcattcagaattcactgagtcaaaagctaaatatatatatttataattattgtatacatccaaaattaaaattttacaaatgaaatttttcattgcactattgaaatattatttttatcttatcttaaatcatttaagatgaatataagctatgatggagaaaaatgtaaagatgaaaatgaacaacagcaacaacaaaaaactggtttctcttcactgtgtctgacataataaatagaaacatttggatgtacaaaaggcttatagtcctgatcaaccttattcatactggctgccattcaagagaataatgtattatttaagcatatggtcacatcacagctgaatcaatctagcataaactatttttatacagcatccttgcaagtaagaaatggctatgtaaagtaagactataatatcctttattggaaagttataaatacagtttaacaatgcttgggaacagtgttatagctttggataaacaagactgaattgccaacactgtcctccacccttcacctactgtcagataaaagaggtaacatattgaatccaccaaaaataactgtgctcaacagaatgggcagattgtatctcctgcacccaagaacattccacaatctatgaaacacagtagggtaaatttgagtattgtcaaaccctttgaatactcattcctatgtatgttaaaatgattgtgtttaaaacattaacacaaaagtagtattaacatcctaattaatacaactttctcagtaacagcaatcagctagtcatatttttggctcctgtttctaaccttttagattgtcgtgaagcattcattttatgtctggtagtatgcagtagttatttcctagtttttgtttaaatattttattaggctgttattgcctatgacagttacttttacactaaatttatgattttgcttaatatattttttgcttatgtttcatataaaatcagttactaatttaacttgtatatccttttttctgttacacgcagtaggagataatctcatcaggtttatatcctcaatggaatagctgactgtaagaatccttaaaatgctgttaaatcaaatagaatcttatgaagtgaaataccagatattcaaaatgtaaagctagatattttatgtgtagaatctaagaaaccaataatgttatactttagataaacattttcatgtgttcccatattttacttccttagaaaataaaatagcaactaggtcaaaatttagagtattaaatatgcaaatttacctcaaatcttaatatagattttttttcatcaaaggtcatagttcttacatatttcataccagagaccttttcttatattcacacttgataattttgtttatattattatatgtctttttaaatttgctttatagagaaaggctctggatttaccattaatgacatataaaagtggggcagaaagttgggtgcagcagcacacacctatagtcccagctacttgtgaggctgaggtgggaggatcatatgaggccagaagttccaggccaggctgagcaatatcaagatcctatctatctatctatctattttgtttttttgagacggagtcttgctctgtcccaggctggagtgcagtggcacaatcttggctcactgcaacctccacctcccgggttcatgcaattcttctgcctccgcctcttgagtagctgggaatacaggcacacaccaccatgccttgctaatttttgtatttttagtagagatggtgattcaccatgttggccaggctggcctcaaactcctaacctcaagtgatctacctgccttagcctcccagagtgctgggattacaggtgtgagccaccacacccggccaatcctatctctttaaacacacacacacacacacacacacacacacacaaacacacacacaatgttatggaatagactatcaagtatgtaaagtttaagtgcaattttttatgaaggagtttttatttcttgatttttttactcatcccagcacattttggaaaataaaagtaataacagctcagttttatttttccatattttaaactggaaattctaccttaaaaacaaactctatatactatgaacaattgtctccacaaatattgacctatatgcaaagcaatacaggaggtagatatggaaaatatgttatctttacctttcagaaacttacagactaacaagagagatatgtgcgtgtaaaaatacctctaataaaaatatgttattaatgccaaaaggacaataagcatgaagaagaggaaaaaggaatacaatactcaatgtattgctgaatgtttcaggaaaggttgtggtcatttatcttgggctttaaaggtacctaaaatgtcagtaggcagagataggaataggtgaggatggagacaggtaagaagcatgccaagttgagagagcaaggtgagcgagggacggagacagaaaacagggtggtatgtgagtgaggcagtgagaaggccacattcacccaatgaggaagcagctgtgagagttaaggtagcaaatataggagcatatcatggaagacaatttaaacaagatgccgaggatcacacagaaggtttttgagaagagttttatgattaattttagaaagattacactggcagcattttctagcatcaactggattgaagaataattgaggtagagaaacaatttggaagggcaggcgctgaactagtgattgtcaaaatgttaaggtgcaaatattactgaaaactttgacaatgtagaatatatagaatgtaagtaactgaatatagggatagtctgggtcaaaaagagggaggggtcagaaggttgggtcttcttcatatgtacttgaactcatgggagtgagaaaagagaattgaaggtagaatctaggaaaattgctacaaagaaacaaagattcaaatgacaggctgagaaagagtacagaattaagaagattgaagagttttagaactattagaattaagaataagactgcatgccaagaaggatggtgtggtaaaatatgtcatccatttcaaagcagtcaatgaagataagcactaggagaaaagatggaatttggtaattatgcagtcattggtggcttttgaggaagtaatttctattaaatggcagaagccagaccgcaagagatgtgtgaagatgagaaagtggatgcaacaaggatagatgacccattttgaaactgacaatattgaaaggaaggaaggacatgagatagtaatttaagaaattggcagtttcaagagaaagtttttttggggaagaaatattcaagggaaaaaatgtatagtaggataaaggggaggtgaaagcagagaaaggatcaagaagtcaagtagaagtattaattttagaaagatgaaaaaggataataaaattatgggtaaagatgaaagtacattttgagcctttctatttgataggagtttaccttcgatgatcttataatttttcacgataattgagaagtaaggtcacctgcagagagtgaacttgatgtacaaggttgaggcttaagaatagtaagagatgtagaacatttgtttcaaaggctatgatggttaagacaaaaactgagttatccatctcctttcactctattcttcattttctatctgtcattgagctctgcctgttctacagcctaagtatatcttaaatgaatctctttatcatcactactgcccctgtttcaagccttcatgatttttttcctgctctgttacattatcttccttactggtttccctgccttcactcttccaggcagttttccacattgctactaaagtaatctttctagcatgcaaatcttctcatatcaccttgctcagaattccccaatggcttctctattagtccattctcacactgctaataaagacataccccagactgggtaatttacaaaggaaagaggtttaattgactcacagttcagcatggctggggaggcttcaggaaagttacaatgaaggaggaaggggaagcaaatatgtccttctccacatggcagcaggaaggagaagtgccgagtaaaaggggaaaagtcccttataaagccatcacatctcatgagaactcactcactatcatgagaacagcatagaggtaaccactccatgattcagttgcctcccaccaggtgcttcccaggacaccacacatggggattacgggaactacaattcaagatgagatttgggtggggagacagacaaaccatattagcttcctatctcttatagtaaaaaaaaaaaaaaaaatacaactcttctatataatgtactatataccctacatggatctgatactaccattcctatccagccatttcttgtcatttcaccccaataagctgactccacacaacatccctgcccttgcctctgactctgtctctgttgttctcttgtcctagaggaaattgcctaaagtggtagtttaactaattcttaaagttcgaaacaaaagaaagaaataataaagaaaaaatgaatgagaaacattatcttaaggtgataaaaaggattgctgagcaacagtgaagcattgaggatatagaaattatgtaggagcacagtccctattcttgtgaataacagttcaagtagaagtgaaagggaaaactgatgtttaagatcttaaaaaatatttgagttacaaagtaattaggactgcctgattttgctttatttattgattattctcaattagatagatctgtgttttaattgctcaattatgcaactttcttattgtattttaatgcattaaaatactatgtgtattttattaaaattgtatgtgtattaaaatacacatacagtaactcagacttaaaaaaataacaaaaagaactttgtttagaaaaaatatagattttaagtgaacaggaaaaatctttttgtaaccacattgaaagaagttgttcagccagtatattgtacacatctacacatatgtttttattctaggagtaaatataaatgaatatgtattcaacatgaataaatgtgagtaaatattgagtattaatgaacttacataaattttttgcttataacttcctgttagaagaagcattctttcaaaacttttaaaaatgtattgcatatgtggcctcttaaatgtctttgaaagatacatcataacatctatgtgtttggaggaattttagaaatttttagaaactacgttcacaaaatagaatgattatgcctatataaattaaatttcaagcagttccaaataacattttattaaaagtacattaaattttgatgacctcattcattaagcaaaataatgtacagtgctctatactagacattccagatagcacaaaagtgcttatgacataattgatactctagaatatcttagaatctgctgttaaggatgacattaattatatcaccccttgaatcatctctttcttcttctgctactgcttcttctttcattctctttcagtctagttctcttactacacactatttctcatgtgttacaataacatgcaaatgatgataaacccaaagcaccataggatctcagaatacttttaattcatctaagtaagtttaatgttagtataattagtaataaagatatttcattatatttacattaatatataaaccctctttttgccataatatttgattaactatatacctctaatcagcctcccactgtattgaatttaatgtgagtgtatgaatatgtaaatgcacgcataatacatatacacagttttcatccagcactgaacgacaatgtgattgtcacaataattattttcctacatattcttgaattgtgagggcaatatagttataacatcagttgttaatttttaaataatgttagctatttctctaagaaaagtaatatatcttaattgtaaaattttgtaaaatgcagaaaaatatattatacaaataagaagcctcattcatactccatcactgtttgttctacaagtgtgtgcagtcatacagtgaccacaccaatcaagatatacaatgtgctcatcaccatggaaagcaaagcccatcactctgccccaagacccttagaaccacttatttgtgcctttatagttttgcctttcccagaacatcatgaaaatggaactttttttttttgtgaccgagtctcactctgttgccaggctggagtgcagtggcaagatcttggctcactgcaacctccgcctcccggggaaccatattttatgcagacttctgtgtcttgtttctttcacttagcacaatactttcaatgagctccaaccatgccattacgtatcagtagtttattctattactaagtttattccattgtatatccaccacagtttatttatccagtcaccagatagtagacatttgtatttttcaggacctggagctactgtaaataaagctatcattaatgtttgcatacaggtctttctaataaaatatgtttttatttctctcaggtaaaaagctatcagtaggatttctgggccatatggtaaaagtatgtttaactttagcaattttccaaagtgtatatgccatttcgtatttctccccacaacacatgagagtttcagttgcttcacaacctcaccagaactaggtattgttgagattttgtattttgttttgttattctaatgactgtgtgatggtatcttgttgtattagattggtgcagatgtaatggcaaaaactgcaattacttttgcaccaacccaaaatttggttttgaagagacgtaaattaatttccaacattggtggggtctggctacccatttataggtatgcatatcttcaaacgttagttttcccatagctatatatgcatagatatcaactgaggaatattctgtaatgaaatactaggggtggggaatatgtaatatgtgcttaaaaaacaagaatccaaaaattgaattttggaaaatatcttcataaaataaacagttgtatatttccagttcttatgaggccttcttagtgaaataactccattatataagaaaagaaatattaatatcaaaggttaatttttaacttttataagaaaaaactgagtgtacatagaaatagagagataagtcatatcactcaacttcgagaactgctgactcatggccaatcttgtttcatctttatgctctctcaccccgaacttcagcattgattattttgaagcaaatcccaggcatcaaagattaacttttaattgaatctcagagtttttgatttatcatattagtattgaaaataattatcttaaaatgtttaaatttttaaacttttagtattaatccctaaggttttagtagtctcttgatttgacccatttacatgtggagtatttactaggtatgatattccaggcatttattcaataagcaataggaaaatcattatacctgaatgggaataaaagcttattaagtgagattgttttactttattagcatactttgtatatagtttctttgatagcattttatagacattaaattatatgaactgtaggttttgcataatggaagttgccacttaacaatattggcccctattttttattcactataatatatttttgagttacacattgactataatcctaggagtactttcttaattcttatattataatactgatctaatttttctcactgggaagctcagctgaagtgcataacaggttttaattaagaataaaaggaggaaagaaaacaaaacttcacatcattaggaattctgatttctgctgctctaacaaaaaagaccacaagcaatatgagattcatcaaatgtgagaaatgataactaaccatgttaggggtcacctataacaaactacaataattgagaaagtaaccttgacgcatttcagttgaagtgtgagtatctgtagtttattatattccagacagtatacattaccaaagatgtagggccaaattaactttaatgttgcactcttcacaagacattccatagctagcaataacattaagataacgctgttaaagtaagaatttcaattataaggcagatgagattgtgaaaacatgacagctttaatgagcaatagtagttgggattactttgataaggaatatagttatcatagatagaaaagaaacaaaatacagcctgcagccttttcttattgtgtcatgtcaccctctattgataacagctttgggttccaattcatttctattcattctcccaacctgtgctagaatgatgatcctttatcttacatatactgttagaacaccttccaattctgcattccttcattcttccaaatagctgatagcatgttatcttacttgctctcatcacatcttggttaagaaagaaaggcaatcaagatattggccccatcttgcaggtgggaaaactggatcgataactcagtggtaatactgggaatagattcagattacttgaaagatcaccaaatgcttattcaggaggctgactttaaccaaggaatatgtaatgaatagaacccaaatacagtatcattctttgtggttgtatgagacatgctcttgtttttgaatttagagtggtagagagagacatgatcttgtttttcactctggaatgacagccttcttttcctctgatcttattgttcccaccagtgatcttcactattccaactagtgagaggtgtgttattccatctggactgctacaacaaaaataccataaacttctgttgacttataaacaacagaaatttatttcttacaatttcagggactggtaagttcaagatcaaggcactggcacattcagtatctggtgagggcccaactttcgggttcataaatagtgccttcttgctgtatcctcttatggtgaaagatgcaaacacactccattggccttctttcataaggacactaatctcattcttgagagtctggctcttataacctaattacatcccaaagacttcacctgataacaccaggactttgtagattagatttcatatgaatttgggggaggatacaaacattcagaccatagcaagagcgacatattctttgttgcccctaagcatgtaaccattcctacagtggttgtatctactggccttgctagtgaagcctgtaagtcatgtagaatgtactgctattgcttttctgatattatttaacaaagaaacctactcccagggcagccagcaatgttgacaacattttgacctctcctgaagcttccaggctgttttatacaatgaaggaagggtaacaggtcatcatgcttatctgatctataattcatttgattaatgttactgatcagctgcatcttttttttttttttttgcctctctgttgtaaattggtagggattgtagtttcttgttcactttggatttttccattacacatgcaaatggagatttttctttacataaataaatctttatgatcattttggttatttttaaaggtctggaacttttttctgtctctgaaagccctggacactcttttggtttcaatcaccctatgctgtatgtcactatttactcaccatttatataattaatataaatatttttcctcaatttctttttaaatacatttctcataaaacattttcacccacattgcttgctctagagcatgaccaatgttcatagtctttgctacaatatgttgtagaataccataatgtttgtgctgtctactctcatatttacttaatctgtcatcaaagggagcattgccgatgcctttaagtgaaccaatcgattatacagcattatgtttagcttccatagcagcaattttgttttctcccttaggaatcttaattctggaaatgaacattttatctagattcggaatgcttatttattaaatgcaaatgtatttagcttaaataatatatttataatgattcacagtaacaatgaaatgtataagacattttactagagtctatgatgattttcaatataatcacaatgaaatgtatttaaattaaaaatattactgtaaatctctcaagatgaaccacagagctcaatacaaaattgatgttcttaagttaatcagttagttaatgtattgccaaacaaactagaatagaatactatattatcagggcaactttgttaaatagatattcaactttttaaatataagaacatagtgtatttcaaccatcttttaatactaattttatgtatttttattgtacttattttgttttatttctttatcattagaaacagtaaaccaataattccaaaacaaagaaaactcactaattctttttattcttgttcattcctttttgtcctgttaatcgtacttagaaatacagtattgacatttcctgggctgcttttgtgtagagccttgtgctgatatataaacatagaaatttatacatagttttcattatatattagtaaaaaaataagtgaagtagaaaaacgggtaaaagacgtgtacagtaaagatgctgaacaaaaactcacgtgttttattttttaataccaccctcaggcatgtaattaatattattatcctcagaataatgtttaaaactgatcttttataactgttatttcagctctcatgcattctttttgctggagaataattgattcatctcattatttgccaggtttagaccttagtaacttgtacatccctatgataaaaattattttggaatggaaagagagatatctaaaaagggatgaaatcatgccaaacatcttatctctaacataaaaaaaattaaatttgaagccagaatttcagttccagttctacttttagcttgtgtgaccttgagaaagtcacttaagcatttctgagcttcaagtttctcatttgtaaagtcgaagtaagaaataccttttatgcctagcactcagagttcttgttggatcaaacaagatttgtacatttagttggaaaactcaacatttgtatctaaacataatgtattccagcagagaattactgtccaccattttcatttatacattttaaatagtgatttattgatgatcttcaatatgcaaggagcactgctagacactagggaaataaaagggaattaagatagtacccaaacacttcaaatcctcatgggcaaggacacgtgaacacataataaaatactttaatttcaattacagacactaatgggcaggttgttaatagaatgtttgccaactttaagtagttttataataaaatataatagtttaaaagaaaggtctattaataaaaacagaattaaaatatatatagatcaaataaagtatggaaatttagttgaaaaattggcattaatcagtaggaaaaagatgggcttctcagcaagtggtattgggatagatgaacagctatatgggaaaagagaaaactgaatctgttccaaatgtaacagaatcaaattctaaaaagatcaaaaatttaaattcaaaaactattatgttactaggagaaaacaaaggtgaattactctgtaacctcagagtggccaaaagtttcttaactgattctaaatccagaagcaataaaggaaaaggctaataaaggtgacaatatgaaaatttagaaaaaaaaactttttatactaaaataattgcaaatatttttcacttgttaatgcacaataacaaatggaaaatatttgcaatttttgtcataaacaaagggttgttatccctaaaatataaagcacttttaaaattaaaagaagaccagcaactctataaaaatgggcaagagacatccaaagatagtttgcataacataaatgcaaagggtccttaaatataggaaaagatgttccaattcactcataaaaatgctaattgaaatcactgaaattactattgtttatcagtaaggttggcaaaaacacaaaaggttgaaaacatacttgtggtaagcagaaaagtgacccccaaagatgtgcacatcctagttcccagaacttcacatggcaaaagagattttgaagatattaaggattatgagagatgaagattatcctggattactcagatgggcccaaagtaatcacaaaggtccttaccagtgaaagaggagtcagtcagaggagatgtatctgatgatggaagcagaggttagaacggtgtgatcagtgcctttgaaggtggaaggggactgcaagccaaggaatgtgggcaacctctacaagctggaaaaggcaatgaaatggattttctcctggagcctctgaaaggaatacaaatctgctgtcgccctgattttagctccctgagaactatttttgacttctgatttccagaactgtaagataagaaatttgtgtttttaatctactaaatttgtggtaacttgttgctatagcactaggcaacaaataaaatactcttaagaggaaggttgtgagaaaacaggcactttcatttattgttgggaatgcaaactgtacagcctctgtggaggagaattttgctatatttacatatacactcacccttagatcccacaaacacatctctgtcactgtcaaatattgtaaaaagatttttcagccctatttgtaatagcaaaaaatactgggaacaacccaaatatatattaatagaaattggttgaaagaagtgtggtattacgttgtactatgcagttgtaaaaaaattaaagttttcatcttatgctgtggaatgatctcaggcaatattgctaagtgaaagtggcaagttgaaaacaaatgtatgttactatttgacgaagaagagggagaatataagtatacctttacctacacatatatatttgcttttttaacaataaaatgataaactaaaaagtattatttgggttttcttttcttttttagtggttattcataggactgaaaagaccaggatgaaggaaatagggatggtaggtagacctaagtgtactttacttcgtagatctgaccctctagccctataaatgtattacaactatgaagttttactgatttaggaattcaaaatatttcaaatatgcacaagttagaattaatatgtgaatgaatataaatatgaatgactgaatcttatgagaatttcctaatttacagaaagcagttttcaaaactgatagaggatggagttcattaaaaatatttattcagaattcattatgacctcatcatcaagtaggggaatcagatgatatataattatactgcaaggaagatgatgaaacatccaaaagagagatttaaagggatttcagagaaatgagagtgcacttccacctaggagaataagaaagattttgcgctcattcagttagttatatattcaacaaatatgtactgagcccctattatgagcaaactctgttataggcagtagggttcagtgatttttaaaacagtcaaaaactcctaccttcatagagcttacatgcttataagaatgagggtaacagacaataaataaaagatgaaaagaactgataattgaccattacatttagtgtagtggagatcagtgttgaccatggcaagagcatgcacattcctatcaccaggacattcatagtccccctagatgaagacagacatttacataagcaagtactatgttgtatgatatgttgtacctattttaaagaagcctctatagcgcttgtagtacgttgagcactttaatagacagtgagtactccataaatagacaagaaaatgatagttatgcaaactaatgttagcaattattttgtacttatactgtccagcctctgatatatttatgcctagtattttaagtaagtagcgttcttttcattttctttgctttaccaatgaaattccatagaaacaaagtattgccaacacttttggaaatgaagctgtgctgttttgcatgaggactgttctgcgtgagtttggtcaagggctaaggtcaaatttgggagactcccttctaccatgtaatagtggcatgacactaggtgaattagtttacctacagctcaatttctgcatctagaagataggaataataatacctgtgttcagtgatgttgtgaacatgaaatgggatgcacatatggaagatttgatgttattaatcacatatttttgataataaaaattctctttaactagaagtcccttttttattatactttcagttctggggtacatgtgcagaaggtgcaggtttgttacataggtatacatgtgccatagtggtttgctgcacccatcaacctgtcatctacattaggtatttctcctaatgctatccctcccctagtgcctcattccccaacaggccccagtgtgtgatgttcccctccctgtgttcatgtgttctaattgttcaactaccacttatgagtcagaacatgcggtgtttggttttccgttctcgtgttagtttgctgagaatgatggtttccggcttcatccatgtccctgcaaaggatgtgaactcatcctttttaatggctgcatagtattccatggtgtatatgtgccacattttctttatccagtctatcactgatgagcatttgggttggttccaggtctttgctattgtgaacagtgccgcaataaacataagtgtgcatgtgtctttatagtcgaatgacttataatcctttgggtacatacccagtaatgggattgctgggtcaaatggtatttctggttctagatccttgaggaatcaccacactgtcttccacaatggttgaactaatttacactcccaccaacagtgtaaaagctttcctatttcttcacatcttctctagcatctgttgtttcctgactttttaatgatcgccattctaactgatgtgagatggtatctcattgtggttttgatttgcatttctctaatgacctgtgatgatgagcattttttcatatgtttgttggctgcataaatgtcttcttttgagaagtgtctgttgatatccttcacccactttttaatggggttgttttcttcttgtaaatttgtttaagttctttgtagattctggatattagccctttgtcagatggatagattgcagaaattttctcccattctgtaggttgcctgctcactctgatgatagtttcttttgctctgcagaagctctttagtataattagatcccatttgtcaattttggcttttgttgccattgcttttggtgttttagtcatgaagtctttgcccatgcctacatcctgaatggtattgcctaggttttcttctatggtttttgtggttttaggtctaacatttaagtctttaatccatcttgagttaatttctctataaggtgtaaggaagggatccagtttcagctttctgcatatggccagccagttttcctaacaccatttattaaatagggaatcctttccccacttcttgtttttgtcagatttgtcagtgatccaatggttgtagatgtgtggtgttatttctgaggcctccagttctgttacattggtttatatatctgttttggtaccagtaccatgctgttttgctttgccttttagtgtagtttgaagtcaggtagcatgatgcctccagctttgttctttttgactaggattgtcttggcagtgagggcacttttttggttccatatgaactttaaagtagtgttttccaattctgtgaagaaagtcattggtagcttgatggggatggcattgaatctataaattgccttgggcagtatggccattttcacgatattgattcttcctatccatgagcgtggaatgtttttccatttgtttgtttcctctcttatttccttgagcagtggtttgtcattctccttgaagagatccttcacatttcttgaaagttgttttcctaggtattttattctctttgtaggaattgtgaatgggagttgactcatgatttggctctctgtttgtctgttattggtgtataggaatgcttctaatttttgcacattgattttgtatcctgagactttgctgaaattgcttatcagcttaaggagattttgggctgagatgatggggtttcctaaatatacaatcatgttatctgcaaacagggaaaatttgacttcctcttttcctaattgaataccctttgtttctttctcttgtctgattgccctggccagaacttccaatactatgttgaagaggagtggtgagagagggcatccttttcttgtgctggttttcaaaggtaatgcctccagtttttgcccattcagtatgatattggctgtgggtttgtcataaacagctcttatgattttgagatacgttccatcaataactagtttattgagagtttttagcatgaaaggctgttgaattttgttgaaggccttttctgcatctattgagataatcatgtggtttttgtcattggttctgtttatgtgatgtttacctttattgattagcgtatgttgaactagccttgcatcccagggatgaagccaacttgatcatggtggataagctttttgatacgctgctggaatcagtttgccagtattttactgaggatttttgcatcgatgttcattatggatattggcctgaaattttcttttttggttgcatttctgccaggttttggtaaccggatgatgctggcctcataaaatgagttagggaggattccctttttttctattttttggaatagtttcaaaaggaatggtaccagctcctctttgtacctctggtagaatttggctgtgaatttgtctggtcctggacgttttttggttggtaggctattaattactgcctcagttttagaacttgttattggtctattcagggattcgacttcttcctggttttgtcttgggagggtgtgtgtccaggaattttccatttcttctagattttctagtttatttgcatagaggtgtttatagtattctctgctggtcgtttgtatttctgtgggattggtggtgacatcctctttatcattttttattgtgtctatttgatccttctctcttttcttctttattactctggctagaggtctatctatttcgttgatcttttcaaaaaaccagctcctcgattcattgatttttttgaagggtttttcctgtctctatctccttcagttctgctctgatcttatttcttgtcttctgctagcttttgaatttgtttgctcttgcttctctagttcttttaattgtgatattagggagtcaatgttagatctttcctgctttctcttgtgggtatttagtgctataaatttccctctccacactgctttagctgtgtcccagagattctggtacgttgtgtctttgttctcattggtttaaaagaacatctttatttctgccttaatttcattacttatccactagtcattcaggagcaggttgttcagtttccatgtagttgtgcagttttgagtgagtttcttaatcctgagttctgatttgattgcactatggtctcagaaactgtttgtcatgatccgttcttttgcatctgccgaggagtgttttccttccaattatgtggtcaattttagaataagttcgatgtggtgctcagaaaaatgtatattctgttgatttgagatggagagttctgtagatgtctgttaggtctgcttggtccagagctgagttcaagtcctggatatccttgttaattatctgtctcgttgatctgtctaatgttgacagtggggtgttaaagtctcccactattattgtgtgggagtctaagtctctttgtaggtctctaaaaacttgctttatgaaactgggtgctcctgtattcggtgcatatatatttaggatagttagctcttcttgttgcattgatccctttaccattatgtaatactcttgtctcttttcatctttgttggtttaacatctgttttattagagactagtattgcaacccctgcttttttttgttttgcatttgcttagtatatcttcctccatccattcattttgagcctatgtgtgtccctacacatgatatgagtctcctgaatatagcacactaatgggtcttgactgtttatccaatttgccagtctgtgtcttttaattagggcatttagcctgtttacatttaagtttaatattgttatgtgtgaatttgatcctgtcattatgatgctagctggttattttcccctttagctgatgcagtttcttcctagtgtcgatgttctttacaatttggtatgtttttgcagtggctggtaccagttgtttctttccatgtgtagtacttccttcaggagctcttgtaaggtaggcctggtggtgacaaaatctctcagcatttgcttctctgtaaaagattttatttctctttcacttatgaagcttagtttcgctggatatgaaattctgggctgaaaattcttttctttaagaatgttgaatattgtcccctactctcttctggcttgtagggtttctgtcaagaaatccactgttagtctgatgggcttccctttgtgggtaacccaacctttctctttggctgcccttaacattttttccttcacttcaaccttggtgaatctgacaattatgtgtctttgggttgctcttctcaaggaatatctttgtggtgttctctgtatttccagaatttgaatgttggcctgccttgctaggttggggaaggtctcttggataatatcctgaagagtgttttccaactcggttccattctccccatcactgtcaggtacaacagtcaaatgtagatttggtccttttcacatagtcccatatttcttggaggctttgttcatttcttttcactcttttttctctaatcttgtcttcttgctttatttcattgggttgatcttcagtctctgatatcctttcttctgcttgtgattcggttattgatacttgtgtatgcttcacgaagttctcgtgctgtgattttcagctccatcaggtcatttatgttcttctctaagctggttattctagttaacaattcatataacctttttttccaggttcttagcttccttgcattgggttagaacatgcttctttagctcgaaggagtttgttattacccaccttctgaagcctacttctgataattcatcaaactcattctctgtcccattttgttcctttgctggcgagaagttgtgatcctttggaggaggagaggccttttggtttttggaattttcagcctttttgcactggtttctccccatcttcatggatttttctacctttggtctttgatgttggtgatgttgatactattcctttctgtttgatagttttttccttctaacagtcaggcccctctgctacaggtctgctggagtttgctggaggtccactccagactctctttgcctgggtatcaccagtggaggctgcagaacaacaaagattgctgcctgttcctacctctgaaagctttgtcccagaggggcacccaccagatgccagccagagctctcctgtatgaggtgtctgtcggctcctactgggaggtgtctcccaatctgtatacacgggggtgtcagggacccacttgaggaggcagtctgtcccttatcagagctcaaacactgtgctgggagaaccgctgctctcttcagagccgtcaggcagggacatttaaatcactgaagctgtgcccacagccgccccttcccccaggtgctttgtcccagggagctgcagtgggctccgcccagttcgaacttcctggtggttttgtttgcactatgagggtaaaacccgcctactcaagcctcagcaatagcagaatacttttaattcttatgggtgtacataaatgttaaaatacattagcttatttttgtactttatagagtagatgcaacagaatcaattttgtttttataaaaaaacttttggttatgtaatagtgtcaataacaaaatatttgtattacaattttaaaatacttcattcaatctttgcaacagcccattaatataggcatttatactaccttaatcttatagagcaataaaaggagctcagaaatacaaaaattaatgcctataatattgtattattttgtttacgcggatgcaggaagtctgggttaggctgaatatattttgtcttgaggaaattggcatttttaaataaatttttgttttgatttacctttctctttaaatcagggtttctcaactagtgacactagtgacagtttgcactagtgaatacatatttgggttgttctatgagaaaacataagcactagtgacatttcgcactggtgatccattgttgtggagggccgatctgtgaatggtaggatgtttagcaccctctctagccactacccactagatgccaggaacacacttgctccatttgtgataaccaaaaatgtctcctacccatattgtcagatgacccctgggggagtgaccaggggacattagtgagaacgaatgagtgaggaaaaagtgagaattagtgagatgtgttaaactacagtagagcaaagttttaattaggttttgactaatgttttcatttgtattaaaaagtaaagatgataattttaaagcattttatgatatagtcactaaatatttgagtaaataaaactttttttttttttttaagatggaatctctccctgtcgccccggctggagtgcagtggcatgatcttggctcactgcaacctctgcctcctgggttcaagtgattctcctgcctcagcctcctgagtagctgggattacaggtgtgcaccaccacacctggctatttttttttttttttttttttttttgtatttttagtagagaccaggtttcaccatgttggcagactgatctcgaactcttgacctcatgatctgcccacttcagcctcccaaagtgctgcgattacaagcgtgagccactgtacccggcctgagtaaataaaactttctaattgtgaacactttacattgatctgataaaatttacagaaataaaaatgtgaattttagtcaaaacaaagaactatatataatatatatttttccatgtggctcattacatatgattttaattaatactttctacaaaacactgttcattactcccctttccaaaaaaaaagactaaactcttactaaatatatttgtggttttggttttaatggttttgtttttggttttacaaatactgattaaatgttagtagggaagaagtttagttttattttttgctctagtacatgtaatattctataaattttattgtgatgacatgacattttcctccttcaaaaagacagcagatgaatgaaaaatatatttttacgtattcattggtactgaattttaaataaaaataatttataactaattttaaacattcctaaatggtaagtctagaagacttttaaaaattgaataaaacaatttacagtttaattatatgacttagtagagcacattatttcctattatcctattaccctgattgaaagataaatataaatgttgggttattgttggtataattaagccattgaattgtaaacatctttcttctgaaacaatacacacacacgtatataaaaaacaatattattcttattagctatgaataaaaaatacattcctatgtatatactggatttcagatgacagaaacagatagaagatagtgtccaatatttttgttctacttgtttgaaaggttatcaagtagtaagtaataccagcagagcatgaaaatgaccagtaatttaaaagtaatcagacaaggtatagtttgttgtatttttaactacagaaggctggtcaatagctgcactcaatttgctgttatttccccatggaaagcccagtttgttagctttaggataggcgcagtcaatagattcttttttactaagagaaatgatccatgggaggtctcctaaggagtaaagtcatgagaaaacataggcagcctttcatgctgcacaacacaactagggaagtaagactctgacctatttgaggtagcgtttcaaagactgcactgttggagctcttttttaaaaaaatcaaatcatgtaatcaaaagaaagctgaaaataatagcaaaaggctagttttattagaaaacttttgttctattataataatgcattatgtgaagtgcttggaattggcctcaaatactgttaaaacacatattaaagaagccaataattacactttgtaagtttgcctctttgtgggcaccctttgtcatctccttgtggaataatttgagaggtggaggagacacatagacattgggcgaggtaaggaaaaagttacaacacacattccagtgctctaagacctcattggaccacctgctgatccagatatgtgtatggtggagacacaaaaatcataaataacttcccccccagttaaatatcgctgcaattaaattctccatttgagaaaacaggattgaagagtgatgcccttgttgacagcatttattactgtgggctcacctacttccaaaaaagaattgagatgacttacaatgaaaaggaaggacaaaataacagcacatttgctgttgctggtggtgttggtgttgggttttgttttgttttgtgagtggtgtgttagaataaactttggagtcacagcagctggataaaaatcctagctttttctcttataagattttgacttgggtaggttaattcagttctttgaactttgtttccttaaataaaatcaggcacaataatgactaattcaggattgtggtgagaattaaatgagctaaaataggtaaaacacctaggatactacccaaaacaaagtcggggctcaacaataaccattactttcctcccttaagaagatggagattttaaggaagcttacccacaagggctcttttctctttctctgtcaacttattgtcttttaagtatctaagatcacaataaacatctccaaattatgtaaaaaagaaattggccattgtcagaattcattattcaccaaagcttctctgagcacttgctccatgtatgacacctcacacatgaactctggggaatatgagaagtagctggcatgccccagccccagcagaaggctctttgctgcttggaaaaaggaattcaaaacactaagtttccttctttcttctgtttcaaaaactattaatagatatgtcagtaagcctgaaagttttattcctcctggctcagactgcactgatgacttcttcagaaagcctgcctggtcttttggcagatttgctaggatttggatgacctcatccatgatggctaaaagtatatagaagggtcagattaatttaatgcagaaaatctagtacatcctagaaaataatgaaaagttcaaaattaagaattcattgatggaaccagtcatttaatgtgagaagaaacaacacagtaatatagaactcagtatttaaaaaataatcagtacttatgaattattttcttaaggattaacttagagaactgaaatctgccatgtaatttatctagattgtaacatgatttggggagaaagggtacatttacatcccacctaaaactaacctcccataaatagtatataacattatataaattataagaatacaaattactccatacttgagaaagttactatcaataatttatattgacagattctaatgacataaaagttttaaatgtaaccagttaatcatcaacataattattctttaataactttacttttgaatttcttcagtggcttagaaaatgaaagcatacaatttttctaactgttgaaatatctttattcatttttgtttaaatttttgaaatgttctttcttaagttaaataaaaattatttagaaacactaataggtaaaatataaaggtatattaaaatgtgatcagcactttttatggcatttgtataatatttgataaaatttcagatggattgggaaggtttaaataatttatctaagttgtaaaagttatcatgcaataaatatactcagattcttatcagtgagtttttttgttttgcgtatatattttactctatgcagtttgtatcaaaggttaagattcatccatgaattaatgtatttatttattcattcatttattcatcattcaaaaatatttattgaacaactcttttagaccaagatctatgttaaatctggaattggaaacatgaatataacacaggccttgctcctgagactcacataatctactaagggagagacacagatacttgaccatgtgacagtacatacatagagaaatgtacgtattctctgtgaacaaaaagaaaatagaaactaattatgctcaggagaagtggggtaattatttcaatgagagggcagtatttgagcaggatcttgaaaaagaaaaaagataaatttccctagtgaacagagggcattccattcaagagggaacatgatctggttggcctagttgtgacatggagcctaaggaaaatgatgagaggcaaggaaggggagtcggggatgggcacaaagattctgaattctgtagacagtgggggactggagaagacttctaagcacaatcaataagaaaatgtgtgtgtgtctgttatatgtatttagaaagatatctgtgtgtgtttgtatacacacatatccattaatgtatatatacagacatatacatatgtatgtatgtatttatatgtatttttgtatttaaaaatgtatgtatgtttaaaacttctatagcatggaaacacttttagaagaaatattgaattgttttagtagatactaaatgcctattacataacattcacgttaaaagtttgaaagaaacagaagatgatacggtgaaaatgaaaactaagccattcttctatctcaattttctagccacctacttgccttcctagaggcaatcactgttttcgggatttttgtgtttctttgaggtattgtatacaggtactagtatttgtgttctctgctttatagatgcagtgttcttaccttgctagataattccatatcagcaattaaggaacaactacgtttttaaaaaattaaagactttatttttttagagcagttttaggttcacagcaaaatttagaggtaggtactgagatttcctatatacctcctgcctctgcatgcacagccttcatcattatcagcatccccaccagagtgacacagttgttacacttgatgaagctacattgacacatcataatcatccaaagtccattgtttacactagagttcactctttgagttttaccttctgtgggtttgggcaaatgtgtaatgacatgtatttatcattatagtatcatacagagtatgttcaatgccctaaaaattctctgtactctgcctatgcgtccccacacccactcctgctcccaccaacccctggcaaacactgatctttttactgtctccataattttgccttttccagaatgtaatatagtttgaatcatacatttctatgattattgtgataatatgtagacttttcagactgtgaaatgtatattcacacagaaatatacatttaagtttcctccgtgtcttttttgtttgtttgtttttttgttgttgttgagatggagtctcactctgttgcccaggctggagtgcaatggtgcaatcttggctcactgcaacctccgcctcccacattcaagcaattctccctgctgcagcctcccaagtagctggattacaagtgcctgccaccacacccagctaagtttttttatttttagtagagacggggtttcgccatgttggccaggctggtctcaaactcctgacctcaggcaatccgcccgccttggcctcccaaatcgctgggattataggcatgagccaccatgcccagcctcctccatgtctttttatgtcctgatagctaatttcttttttagagctaaataatatcccattgtctggatatatcacagtttatttattcattcacctactgaagggagtcttggttgcttccaagttttgacaattatgaattatgctgctacaaacatccatgtgcagatttttgtatggatataagttttcagctcctttgggtaggtatcagggagcacaattgctggatcatatggtcagggtagcttagttttgtactgccaaactgccttccaaaatgactttaccattttgcattcccgtgagcaaagaatgagaattcctgttgttttatgtatttgccaggatttggtgttgtcagtgttttcgattttggtcagtttaagagatgtgaaatagtatctcattgctgttttactttgcatttctctgatctacagaacatcatctcatatgcttctttgccatgtgtgtatcatctttggtaaggtgtcagttaacagtctttcatccattgttattgttgagttttaagagttcttcatatgttttggataacatgcctttatcagacgtcttttgcacatattttctcccagtctgtaacttgtcttcttactctcttacattgtctttcacagagcataagtcttcaattttaatgaagtctagtttatcaataatttctttcatgaattaagcctttggtgttatatgtaaaaaattattacagtaccgcaggtcatctaggttttctcctatgttatcttctacaggttgtatcattttgcattttacatttaggtctacaattcattttgagttaatttttgtggagggtactacctcacttgtaatggctgtatagtgttccacagtactatattcaactagtcccccactgatgtatacaattagactttttccaatctttagctattgcaaacaatgcgacagtgaatattcttgtccagctctccttattaaccatcctttcccccccccggctcactaaagatcttatcatcatctaacatactatgtattttctttattgctttcattatcaaacttcactcctgtcacatattagcatgttagatccaaaaagcagagattttttttaatttgtttcctactgtaaccctagtcatagaataaatgtttaatgaatatttgttgattgaatgcctcttacacaagtatatctacaggaaaaaatcatagaagtcaaattgctggttcaaaagggataggcatttgtaattttgacagatattgccaaattgatcattatagaacagagcatttcaaccttgacactactgacattttggcctgataattctttactgtgtgaaggtatgtgctgtaggctgtttaacagatcctccagttgtgacaaccaaagatgtttccagacattactaaatgtcccttgttaagaagcactgattgttatgcaacctttgactctcactgacaattatgaaaatatctccccacagccttgccaatatcgtcttttaggaaacagttcactctgaatatctaatggtgaaaagtagtatctcatagttttaactggcatatgaattcacattttgatggaactttgctgtaacaaatccccagcactgtacattgtaatgatgaaggtaagtttggttttccactgtagagggaaggcgggggatagagtgaagatatgaaatccacaatcaagtgtagaaaaagtgctttttgctcttatttttcttcgttaaaatatctgttttataaatcctttcttatcttcagactattatgcattcatgggctgaatcttctctagaattatatcaactggccttgattaatgaacaaaatttggagtcaaaagccttggaatttgagtgcaggctctcctaattactagttgtgttaccttggggaagtcacataaactctgagctgcaatttactcatctgaaaattgtggataataacatttgctctctctacatcactgagttattgtaagaattattttttagactgcaaagcctttcacaattgcaagggtttatgataattattatgaaggttttatgacccgctgctttatctcatgactcacagtgtcccgagagtttttctcttctcagtgcttctgcgatcacctcaaactgttctcactcatttatttattaaacatgggcattgtgtagccttaccatatcttcaactctgtagcctaaataatttcagaacaattctcctcctaactgaacaagtcccagatagactcatcatttattcagcattcattaaataagtaccattgtcttccccaaaactgccttttcctcccaacagccccatttttgtcaatgccatcattttttctagtcttgagggtgggaactttgcagtcatctcttgtgcttgtgctccctgtcccatggatcctgcataccacaaccagattaaagtagactacctccttcttcaggtcccttcttgtgattataagctgagagtcccctgttgagtgccacatcaaatccaaattatatttcagtagcactccttgttacccatattctcctaaactactttttctttccttgcaccagactcattcttgcacctatgcttttgttcatcatgtttttctccctagaattttcttcacctgttcctttacctatcaaccagcaccaactttcaagacgtctatcatccctattactctatgttctctttttctttatagctcagcttactctaatctcttttatcacttcactctcattgttattggtcagtttaacttaatgtatcatagtggatctcaatcctgactgcatatcagaatcacctcagtaaagttttgtttgttgtcttaatataatcccaggatcatgattggggattctaattctagacagagctttgttattataattttagtagagtggtttgaacatcttcatggatattttaagcaggtcatttttctcttccagaccacagatttataaatttactggtagtaagaatgttaaagacatcaatatacccaatgctcaataattgattaactgatagtgtgatataaaaatatttcttattcatttcctgcacagcctataatttgtgtgctacctcttccagtttgtggctctgtgactttgtataaattgctgaatctcttaacctcatgtttctttgtatgtaaaatgagaatagtaacatatatgttgctaattatgagaagtagagctaatgtacataaattttcagagctacatggtggcttttttattactattaatactatatagtctctctgctgttgtagagatgcttaaaaaaccctttttctttcttgctttatgatttgctattttatgacttagtagatttacttatttacattactattggaattaagacaggatatcaaggccctatcaaatcaccatgtaatttgatacctaattacctttgatacctttgaaacctaattacattttcatattttaaggagcaaatgagtattctattttttgaccatcgttctactgactgttttcttggttacaagagaatatgcaccattacagtttttccttgtcagcagcaactccacgccgtgaacacgctaactttatgtatcttcttcactttacctgacattgccaagtaggtgtttcttcctcctaactgtaatttaaaagaggatatttatttttaacttagctcattttattttatttcatagtttataactatcccatttaattttaaaattaaaggaatataatactattctattaaatttagacttacagattgtgctcctgggatcagcaagaaaacataaagtactttgtttccacaaaagacacttcctatataaattatttttattattaagttctgtatctttaaatgagtcacttttaaatctttttcttgtcttactagtgaaaaaatttaaattgtattattaaaggaaaacatatagacatatgaatgagaaagtattcattaataacttgtcttcattaagttagatgaaaacaataaaaaaggaattaaccaaagtggcacattgccaatcataagacaggagaaagtttccagagcaattaaaggaaagaaattatttgttcaaccatggacatttatactgttttttcagtttcaaagttgtaaaagtaatgtatggaggctatcttctcctgcaccaaaacaagaaaccgtataggtttctttggaatgcctattaatcatgcattgctcccataaattagtcaaagctaaagaaaaagtgttgctaaatagtgcacattttcatttccctgaatatttgtagctgcaatttatacagataccaacaacactgtgggctcagaattaaaatgaaagtgcttgaaaacttgtgtgaattacctttcttacagtatatttatggagccaaacagacatatgtttgattctcatttcatccgtaacatgaatatattgatacttactttataaaattattgaaaggattacatgcatttaccatggtgcctggcacatagcgctcagtacattgtagtaacgggctatgctgttttgagaagattgtgtggagagaggatatcactgactttggagttattcatgcctggttttatattccagatctatcatctgataactggctgatttcggccaaattactactctgaatttagtttccttgacaataagctaaagtgaaataacagcaacctcatagggtggttctgaggatttaataagatcatacatataaagggcttccaatgcctgttacatatcatatctttcagtaagtagtagatcttattactcttattcttactgctaaaatctgtgtcttaggttcttgacttctttgtaaatatgcctttgaacaatgtggaagggtcaaacaactattaccccaggagtatattgactttgaagctaatgcagcttaagcctaagggcctctcatttgcacaagtcccttccaaactgacacttaatactcttcttaattttatattctctttcttaaagaagacctccgaagctccaaaaatttcaggtttcagaaaacctgggtctaggttatactattacctgaagggttttttttttaaaactaaaaaaaacaagagaaagtttataaggaagcacaataatgtatgctatctaatgaatatattgatagcaatatttatattaaattgctattttaagcctaaatcctataagttctattttgtgcattcagcttcaaaatgattctactggtaataaaaatggcatactaagcaatgaaaataagagataacttgagtacagcaataaaactcaaaggaaatgtaatcagtgatacagaattatgtaattttgtatactcaatattttctaagctacttttcagaagaaaaagaatagttttaaccaatcagtgagaaaggtaactgattaagcttattcaaaataaatatctgtcttcctcaaggcaggctgtgtcaaaagcatattgaggcatagatcttccaacaaattataaattaaatgtccattactcacacatgcaaaaattgaagttgagaaaattacataactgaagtcaataaaacaaactctggtattatataaatacactgtaatccacagaagatatattcatgtttaaaatggttagcttcaaatttttgagaaaaaaatacttcaaggtctttctggtaacatcagttggtaagttagaataaaaccttaataaaaccagtaaaaagactttgtaatttgcattgctcatctcattctttaaaagaatttattgatagattttctcattatacctacatgttcagtataaaatatgaaaaatatccaaaacgtttttaagtcaggtgcttttaaaatatgtggcttccccttgaaaagtatatatctactcaaaatatataaagtatattaaaatttgttcatcttaaaacaaaattgcaattttatgagacaatattaacttttgaggacgtcaaatgtagaaattgaagctcacagttaataacagaaaggatttgctaccatttatcaaataccttaccctggtattatgataagaaacatcattcccattttacagacaaagaaatatcagagcaaccagggttaaatgactttaccaaagttattattacaaccaggactagaattcataggattcttacttttttttttttttttttgagacagagtctcactctttcgcccaggccggactgcagtggcactatctcggctcactgcaagctccgcctcctgggttcacgccattcttctgcctcagcctcccaagtagctgggactacaggcgcccgccaccacacctggctaattttttgtatttttagtagaaacggggtttcaccgtgttagccaggatggtctcaatctcctgacctcgtgatccgcccgcctaggcctcccaaagtgctgggattacaggcgtgagccaccgcgcccggccagaattcttacttcttatctgcctcttaatcttgttaggtcaaaatctctcagcatttttagaaaatgccttttttattatattttcagcagatcatgagtctaatataccagcgttacccttttctatgctttccttccttgagaacgctttcaggagagaaatcagttatagttttctgtctcttccaaatagttaaaaacataagagatcatagatgtagtaaatcagtttagaatcccaatgccttgattgggatgcttaattttactataatagcctaatctgaaatgttatctgaaaggcttatttcttcacattcttttctacaccacaaaaattgttcataacaagaacaatcttgggggaaaaataagatgagatgttttagacagcttaatggggctgccactgtcttggataaccactgtttagagctgtcttggattagctgaaggctagtgttgactgaacatattgaacaccatcttaagttgtactttaagtcaggatagacagtccttacaagaaatgaaagctgctcctttgaccattataggtgttctgtggctagagatgaagtgccacactaacagaacaaagcttgcaatttgtggaattgaattccaaggtgaaaaagaaggttaacaatttgtgtaaaatcctctctcaagaacagaaattccaaaagtattgattacaatattcacaatggcatttcacactgtggctggtgcttttaaataggagtcagagaaaatatcatgttgcttaatatttaggcaactaattacaaaattctcgattaccaagtctcactgaagtgttcccttacgaaaacgtgaactttattaggtatcaactcattgacatggtccatttgaagaagcaatttattagtctaatggttaacacctgttagatgaagctcaaaaatgaaaaagattttaatgaaaagcaaatgcagtaaatgctagcttttaactggtttcataaaagattgaatatatattcaatattctgtatatatatatatactgtataaatatacaaaatatatactctgtctgtgtgtgtgtgtgtgtgtgtgtgtgtgtgtgtgtattacacaaactctccttttccctggacaatttaagtacattttccctgtaagctaaaagccataagtatccctacagatattttttgcaagtgaaattgcttttcatttggcaaaaactaaacctgtgattcatagcagcttagagcactcaaggccaaagagtacatcttgcttgctttgactgacatttttgcaggctaaatcagacctgcatgattcagctgtactgagattcataatgctgtgagcagagaaatttgggggtggtataaaagagcatggagggaaattgtcttggaaattgtgactactgactgaggcaaaaatcaaccacagccaataggcggtttcaattgatatttgattggggaggcgttttcttgctaccctctttatacaaagaacattagagaaattttagtgaagaaaactactacggaagcagaaaaagagggactttactatgagaaatgaaactgcaatagggagcaagagcagggagaatgactctttttaacagttgtcagctcaaatattaaagggaagtgcacattgtatataaaaggaaaagtggcaaaaaatccattcccaaaaaatttctcctaaatgtctaccattagcaattcattcctttcagatttcttcattgagttcattcctcagttgcccttaaaattcatatgcccagaggagtaaaaatcttcctacatgaagttatttcctatctggactacaaagggagcacaagaaaattgctttgggaagttcaggcctcaggaaaatacggtgtttaaaaaagattactatatagcttatgctaaccaacacctcatttttgcttaatatttattttattctgtctcactagtaatatataagatatagcccagtcataatggatcttattcaggtatggctacgtaatctatggtacaaaatgtaagtatgagccacttattaaacaaattattaagaatttcagcagagcattcagccaagcttagagcccttctaagactggggacccctgcacctgcacagatcacatgctcatgaaatcagccctcattttatttgatggtagtgaactgtgtgaattccaaacttagttaatgaaagtgtttcgttacagattacctaaatattttggcttgtaaatgctcaacacaaatattaataccaaaaattcaaacccaaattctttttgggttaattggaggctttgcaaatcactaaatttaactatttgttcctatctccctccctttttgtgtgatcttctatgggaaagtataggatttatgaggttacacattatcatttcagatttggacctctcccttaaacctgaggttcaagagcctaatcttcactctctattcctaacttatgaatcatctagctgaaaatagccaaagactgctctctaatagccaccccaaaccagcactcatcctagaataaccaataatttccccagccccaggtgtggagttaggatgagtgtggataatacctggttgtgccaaacactaaaagtagattcactttgggaggccgaggcgggcagatcacctgaggtcaggagtttgagaccagcctggccaatgtggcgaaaccccgtctctactaaaagtacaaaaattagccaggcatgatggcaggcacctgtaatcccagctactcaagaggctgaggcagaagaagcttaacccaggccacggaagttgcggtgagccgagatcacaccactgcactccagcctgggcgacaagagcaagactccatctcaaaaaaaaaaaaaaaaaaaaaaaaaaaaattagattagtgaaagctaggggtggctttgggcaaggtgctctgagggcccagataatagggaaattaagcctataagagtcttgatcacctaagctataaaaaacacttctgggtagaagaagtttttacattccaattcaaacttgagtatgctgctgtttaagccaatatttatttcctcttagcatatgtttcaactttagtaccgtccaacaataagatacgtattctctattaaaatctccctcttcatcttttgttgacacagcactataattagtatcacataattcctaccactgacagaatgccccagaatattttgtcttatttttttttcaagattagctagcacttataacacttcttgctaacgtttcactcagttatagttggagttagtgaagtcatggtttgtttttttttttatgtaaagctgtcttttcttcttctcacccccatcccacaggcatcaaaggaagttaaataaaagaatgactattgtgacgttgactaatagtcataagacattagctaagaaatgaataccattgaggttttgaatgatcagctgttaatttttaagattatactttagaaaataataaatcctgcttttgatgagatgtccattaaaaaacttattttaaaagtaatatattttgagtaactacattctgtccaatgcaactctaactgcatacttctgaaatgtttacccccgaatgatcccttctaaaacatatagctttagcttgtcagtttactggcattgaatttcaatacttaagttaaaatatattgaatcagctttgcaatacttggctggatcttttagaatagtattattctttcatcttacttatagaaaacacctaagtaaaatagtattcatttttaaacttcaatttattgtatacagagctttctttcttaatagattgacttcaagaaacattttttcttcaatcagaaaatattgacttattcttctgaattgaatctgtataagatttaaaccttccagttattacccaatataacaaaattaacatgaaaccaaagctctcgagcaaaagttataatatttgaacttaaaaagacaaatatcctatatggacttcaaaatatataataaatcttaaggagtcagtgcaataatttttttaaagcacaattttatttaaggtacaataagggtttaagaaggagaaaatgggccaagcacgatggctcatgcctgtaatcccagcactttgggaggccaaggcaggctgatcacaaggttaggagttcaagaccagcctggccaacatggtgaaaccccgactctactaaaaaaaatacaaaaattagccgggcatggtggcatgcacctgtaatcccagctactcaggaggctgaggcaggagaattgctttaacccgggaggcggaggttgcagtgagccgagatcgcaccattgcactccaacctgggcaatgagagtgaaactccattctcaaaaaaaaaaaaaaaaaaggagaaaatgaatttacagaaaagtcgaatattcttttattaaagcagctctgttatacaagaggtaacactgttataggctgtctgctttcttgatgacatagccaattagtttgtaatctaggcagttatcaaggttaatcacaaatggaagacaatacatatttaaaataaatgagatagttcaggaataagtggtatattatctagcgagtaaattcagtaccaaaatcagtctctaggatcttactccaaagtagaccttggcctccaattatataaagcgtatgttaatctggacatggagtatctgtagctaaatagtatatgccactaccaagtaccatttggcctccctagaagaatgtgacctgatgaagaataaagaatatttcataataatgtacagttgctagataatcttacctcttttggtagattaaagatggcttcaaattctttgacacttcttctgttaagaggtggggtctaggtctcttcctcttgaatctgggtgggatctgactgtctgactaacagaatgtggtggcagtgaagtttgtcagttttggggtccaggcttgaagacaatggcagattcccctcctgtctctcgtaatattcattcttgaaacgaagctagaggctcgtacatcttaatgtttgaagagacctgtgtgcaaaggaaccagtgtccctgctgacagcccttgatgagctgacagctgacagccagcaccacctttcttggcctatgaatgtgttatcttggcaaagatcttgagagatgagccacatctccaagccctacccaaattagattcagttgtattgggaattctgggattggttactgccatttgcagcagggttagcatcttaagagtgcaggagaagggccaggcgcggcggctcacacctgtaatcccagcactttgggaggctgaggcaggcagatcacttgaggccaggagttcttctcagtacagataagcataaacattaattgtaatacatactgaaggttttaaggatgaaatgtactgatgtctctaactttgaaatgtctcaaaagaaaaggtggattaataaaggaacaaactgatagatctgtgatgaggttgtgataaagcaaatgtagcaaaatattaagaattgtagaattgaggtgataggcatatggtggttaatatacaattttacttttttgcatgcttgaacatttcttttatgaaatgttgggaaaaacaaagatgtgaggtgtttgacacctagtaaacattcaaaaagtacaaggattttaaaattgttactagttttatatttactagtaactgaataaaataaagtatttatatagcttcatttccttgaaaaattcttctaaaatattaatttcagtataacttgatatactaaaatatcaagttattgatattttaccaattttgactttgttatatcaagaaatgtaaagtcttgctaagcaaatagtatatttcctgtaatagatcttgaaattcagtaataatcctgtagcactaagaaaaattaattgacccaaattccatggtatttgatgtattttaagataagttttactaaatttaaatttaactctagtttaacacaagaaagaagaaatccagcatacaattctaactgaatatactgttttcaaataaacagttcatttaacaaaaactggccctgtgctagatgctgtgggacagaaaattgagctgcttaacacaaggccctcacccacaaaaggctttcagtgtggttaggaagaaatatgcaacccttggggaaaaaaggaacaatgcgtgagttaaaaatataaaacatgtaacaaagaagtaaatgattaagaatcaagtgaataatatagataatatgagctgagagttcagaagatgaaaaaaatcattatagccttgaagtgaaaattttgggagtttcactgcctatttaagccctttggaacatgaaagaaacttattgcgaacttgtggttttggtagaagacaaaacacaattgaataaagagtaatgttcaggggccggactttctttgagaattatggagaggagggaagaataaaaacagaacttttagccgcaatcagctagaaattgtagctgaatattacaacctctcttcctttcaagagatgcttatttattgtctggttcatataaagcattaggataggtgctgagggttactatgaatgaaatttggccctaacttcaagaggtttaagagtaacaataacaagagctatctactagatgacaagagtatgccaggctagtcgaagcttatggcctattagaagaggtaaggaaaaaaaactgtaatatagaaagtataaaatgtcaaatgccatttaaaaagaccagataaaatgctaagtgaattcagtgaagagttttcttatagttgtataaaggaggataagtatttatgcaggaggtaacactgagttggtctttaaagagcaataagtagattgtgaacagagatatggtgaaagagtaaagaaagggataagaatgatccaatgaacgaactaaatcatatgcatgacatcgaatatgtgattctttccagctacagtgcagactatggagagaaggatgattgaaagggaaattgggccagaccgcctaggccttgaataccatgctgagtgtcttgggctttattctgttggcaacaggaagacattaaagaattatgacctgaggaatgaaaagttgagagctttttggtttttattgtttggtgttagtctggtagcttgtgtaggaggaattggaggaagaaaaatctagaggcaaaatgaccacaaggcaatgaggacgtgaaccaaggacactgaaggagctatttcagaggataaagggatataaccttgcaaccaattcagtatcaagagcaacaggacagcagagtataccaaagtggggttcagtaagttattgacattgtttagaattgccaatacatgataataataaaaagccgactagtttttagttatattattgttcttaaattccctagaaacagtattccttttgctgcctgcacccagggcagattgctcccaatgtcccccacctggtaggccattgcatggaagcagaagcacttaaagaagcttcagaaattcaagcttagcacctgggagtttgatggtgcttctaatagaaatggaaatcaggaagataaaagcagatttgggaatgagttcagttttatacatgttaaatgtgagttgtggttggctggccaattgataatgcccaacattctcaatgtgatagtggatgtaactcagctgagaagttaggacagtgctctaggtcagcgagtcatctgttaagaggtggcaattaaagctagcggaatgcctctaggtctgagggagttaatatttataattgagcatctacaatgtcactcacatatctggtctctaaagctagtggatcttaagccaaacaatactcaatgtgcacaatcaagggcacctaccagaaatttccatcttgaatttcattccttttggctcctgccaaaagtacagctgagataattggcacttgaaagctaaatattaggaggactgtgcatatatccttttttattttttctaaattctatcactacaacttaattatttgtgcctaaataactataaatatcagaaaatagattacactgaatagattagaacttagcttttacaggaaatactctcaatgatttagaaggtaatgttctgccttagccttcctctagggttggtacaaaacatatagaaaatgccaatgtagtctataaaactagtatgaaacatattgtcttatacacacatgatatgtcctggaaaaatggttctttgagaggggcaaagcaagatggccattgatcatccctactgcaggaacaccaaatttcacaactttctacacacaagaaaagcaccttcataagtaccagaaatcaggtgagcaatcacactttctggttttaacttcatattgctgaaagaggcactgaagagagtaggaaatactgtcttaaattgccactgccactcctccttcatcccccagtagcagccacatgcacggagagagaatctgtttgatggggagagggagagcacagtgattgtgggacattgcattgaactcagtgctgctctgccacaggatacagcaaaaccaggctgaactcagccagcacgcacagagggagcatttagaccagccctaggcagaggggaatcacctgttccagtggtcagaaattgagtattagcaagcctcaacaccacaggctaaagtgctctggggttctaaataaacttgaaacacagtctaggccgtgaggacggcaactcctaggcaagtcctagtgctgtactgggccagtagaccttggtagggggcacaggacctagtgagacactagtcggggctgctaaggaagtgcttgtgccacccctccccaaaccccaggctgaagagctcatggcaacaaaagtgactcctttctgtttgaggagaggagagggaagagtaaagaggactttgtcttgcaacctggataccagctcagcaacagtaggatagggcactggtcagagtcatgaggccccctttccaggccctagctcctggatgacatttctagttatatcctgggccagaagggaatctgctggccttgaaaggaaggatccaggccaggcaagattcatcacctgctgactaaagcgtctttgggcccttaaaaaccagcagtgatgctgtgggctttgggtagaatgctataggctttgagtgagactcagatgtactggtttcaggtgagacccagcacattcccagctgtggcggctacagtgagagacttctgcttcagcaaagtggagggagaccagaagaaggaatatatatggaagttctcatatacatctatatatgtgaactccaaatcaatttttaaaaggcacagtcaacttgatagagaaattagcaaaatacttgaggagacacttcacaagaggatctgcaaatgtccaacaagcatatataaaggtgctcgacttcatttagtcatcagagaaaaacaaattgaaaccacaatgcaatgccattacatatccacaagaaaggctaaaattaaagacaagcatcaccaaatccaagcaaagatgtgaagcacccataaatctcacacattactttcgggaatatccattgctacaaccatttggaaaaacaatttggtcctatattctaaagctaaacatatacatactgtatgaccagcaattctcctagatataagcctaacagaaatgagtacaagtgcttaccaaaaaaaacatgtacaagatgatttatggcagcgctctgtatacagtcaaaagtcaatcaagattaagataaatacattttagtatagtcacataatggaatactgaagtgaacaaatcacaactacatgcaaccatatgggtgaatcccacaaacataatgttgaacaaaagaagccagacactaaaagagtatcctacttatatcaagttcagtaacaggaaagactcatctatgatagtacaagccagcatagttgttacccttgggaatgtggaggaagtgcctggaagagggaataaggcaagtttctgagatgatgaaaatcttttatttttctcctttaatatgggtgatggttacataggcctgttcccttcataaaaattcacaaagctatatatttaatatttttatagttttctgtataagctatatttcaataacaacccatccatttaaagaaaagtaatctttctccacgggctgaaatcggccagattgggtaattatggtcagctgttatatagtagcaactcttacccacaatgttttttattctgttgcctttttgccctgaatgataattcctgtcgctccatggatatatttagataatttaggatatttgttccaaatgatgattcatgaacccaagaaaggattaaagaaagagttaatatcactatgcttttgaaaatggaaagactgcaaatgtctcagtttaagtgtctttacgctattctaactcagataaagtggtatgtaaggaggccatatgccacagagcccagatgttcttgaaccagtaaacattcttcaatctgaatcaggtaagatctttagcttttcttaactgcttcaaaccttaaccacctcaactttacagtttatttaaccaagctccttagaaactaacagcaggcacagcaaaatctgtttttaaaggaataaacagggcaaaatgaaattgaacctttacattaaattaacattattttatccctaatgttgattgttgtttctgttaaataattatgatgaaaagaaaaagtgttgatgcaatcacaacttgacattttgttgttaagcctcctcattttgttaaacctcctcacatcatctaattgattattaggtggctgatttcattcacctggctatagtaggccacctgtaaagcaactgtgcctatcctacagcatgactcttcagtgctctgaaaagagaaaagggctgagaagttgaaactgggagtctgtcatgttcttgattctattggtcattctgttggatcttttagaaaatcattttacctctctgaccttcagattttcaatctgtaacttaataatagcccttggcagtgaaatgtcttgaatggtgacttttaacatagcagcagtcataaaaatataagagtataactatataaaagggtttctaggagcttactcttggggcaaattgttttgccacataatattttttaaacggacaggacagttatgaaagattctagagagtgttgtcatgttaactgatcaaatatatttgttaggagcatttttattaatcagtacacatgacttagcctgttttaaacaatgtcttcaaatcttaaatatttcatttaaggatattaaaagtgcttagtgatctggttggtattattcagcatggattaatttttttctaaaagcagacaatgtatataatttattgtggacatctaaagtctaatggcactgcagaggtgatggtgaattgttaacccttctcaatagtttatgaacaggatgaaaaactagaggctatggattcatatttgtctatatgatgccacacacacacacacacacacacacacacatttaagtgtgtattaagggcaggtagtaaagagaccaaaaaatgcttttaatgttctaaattagactgataaaaatccgtagacatatgggcctctgtcatgatcaaataaaaagagttcagatttggagatggaagtagaggttcaagtcccttagacttactagctaaataactgtgaacatatcatttaacctccattcacctcagcaggttcattttgaaaaatagaacaataatgcttaagagcttactgtgactattaagtatgataataaatgttaaaatacgtataaattgcaaagtacctacacatttaagatattattgagataacctttgagttttcacattcaaatataatgtcatttaagctcatagaatagttactctttgattcttgtaagtgaattacaggagatcagcaggaattatttagctcagatagtaatgagaaagaattataaagtgattcggggccgggcgcggtggctcacacctgtaatcccagcactttgggaggccgagacgggcagatcatgaggtcaagagattgagaccatcctggccaacacagtgtaaccccgtctctactaaaagtacaaaaattagccaggcgtggtggcgggcgcctgttgtcccagctacttgggaggctgaggcaggagaatcacttgaacctgggaggctgaggttgcagtgagtggagattgtgccactgccctccagcctggtgacagagcgagactccatcccaaaaacaacaacaacaacaacaaaaatgattcggagtcagaactgtgttgaagacctagctttatctcttatttgttttgtgaactaaaacaagagattaaattctctgaatgtcagttttcttttctgtaaaattggaatgatatgccttatagagtgttgtaaaacttcaatgagactctgtaatcgctacacacagggcttattggctcttaggattaagatttattttgtatgccagacatagtcctagatgctgtggatacataggaaaagacgtgagtcttgccttcaaatccataaacgattgtgggggtaatcacatattaagacataatgtcaataaaacatgataattcccatgatataggtatgcccaaggttcatggagtagtagtagaatccgaaaagattttcacaggagctggtcctaaaccgagggttgacaaatgagttagatgtgtgtcagttgcaaggcagattctgtattagttttctagaactgccgtaacagattgtcataaacttggtgactttaaacaataaaaatgtattctctctcagtcctggaagccaaaatcaagatgtcaacagggttggtttcttttggaggctctgagggagaaaccatcccatgcctctctcttagctgttggtggttgctgggcatccttggtgttccctagcttatagttacatcactgcagtttctgcctcagtcctcacatgaccttcttccctgtatgttttcacatggccttcttataaagatagcagtcattgggttagacccaccctaatccaatacgacctcattttaactaattatatttgtaaaggacctctttccaagtaaggtcacattttgggtggacatgaattttggagggacactattcaacccagtacagggactctctggttcccccaaattaagttctatttcatgtgcaaaatacatttgccccatttcaacatcctccgaagtctcttaacccattccagcattaaatctaaatccaaattctcatctaaaaattcaaaaagtcccaaatctcatcatctaaaccaggtataggtaagactgtgagtatgatctatcctggggcaaaacccctctccatcggtggatatgtgaaactagtaaacaaattatctgctttcaaaatacaatgatgacagaggcataggtttagacattctcattccaaaagggagcaaatgaaaggaataaagggatcactggttccaagcaaatctgaaatcaagcagagaaagttccattaggtttcaaggcttgggaataatcctctcatgatattctatcttgtgggcctttgttggggcatccccaccctctatggcctcttcatccgtggctccacccttagagtcattcctcctccattttctctcatctgtgtccctttcagtccaagcctagcagtgcttgttggtataaaattctcaaaaactgtgttgattgctcatgcaattcatgggagtctgtgccattatgcaagaaggccctccacagatcttttctagataatctcttgtctattgctggcttctgctgagattggttattagatctgttaaccacacacctaatctattcaatgaaatgtccagctacaacctttgtgttctctccagagcatgttttctcatcttttgctatccaaatagactgagaatttcccaaatcataaagtgctggtttgtttttgcttaacagtttttgcctcaatttatctcttccctctcgcattttaccataagcagtaagaagaaagcaggccacacttctcatactttgctttgaaatctccttagctaagtatccagattcatcctttacatgtttcaccttccacacaacacaattgagttgaacacaactcatttctttataacaagcactgacttgcctccagtttccgataatatgttcttcattttcatatgagacctcatcagaggcaccgctaatgttcttatttctagaaacattctgttcatgacaatttatatattctttaagctgatagaagctttctctacagcttccctcattcctttttgaaccctcaccaaaatcacctttaacatttatatttctactaatattctttttaagtcatcaaggcttttcctatcatatgcttcataattctagcctccacccattacccaattccaaattccaaagccatttgcagactttttttttaggtattattaccccttacttggtatcaaaatgtgtgtcagtttcctagggccaccataaccaattaccacagactaggtggcttataccaacagaagtgtatggtttcacagttctggaggccagaagtctgaaatcaaggtgttggccatgcttccttggaaggttctaggaagaatcattgcctctttctacgttcgggtggttcctggcaagcctaggattctttggcttgtaattgtatcactcccatctctgccttcgtcatcacatgcacttcctcttccttcttatgtgtcttcatatggccttcttagaaggatacaagtcattggatttaaggctcatcctaacacaattgaacctcatcttaattaattatatctgcaaagactctatttccaagtgaggtcacattctgagattctggatggacaagaattttaaaggggacactattcaacccagtatgtgttcttacagacctctaattcttcctcatcttctcttttaggtgacaagacactaatattaagttgctatggtgatagtttatttatttgacctactatctgcattctatttcttttcaaaatgtgtttcttatatgttaaacctttattatgtcagactgtggcaacacctagagaaatctaaacattatgtttttgccaagatgaggtcagaaacagtaaaacattgtttttaagttattggattaatatgtctgcctgctactaactgtggttaaataataatctttgtttttattcatagttaattacatgctcaagttgaaaatatcaaaggttctttatctgattctgtgaattgatatttaatacatggtctgccatggttacctagcctgggatttgttactttaacacatcaatcaatggcaaagtcaatgtgtaagctgctagtgatttgggaagcatctttgtattcaatagtcttgtaccttgtttgtgattgaaggtcattctttaagaaaagaatgatatctaagactgtaaattcattgtactttctaagctcttgagagtagagatttgcaacatcaatatatagccaggctttacccattcgggccactaagactgatactcatagttttaattattttcacttgatgaagctaattccaggaatactattctttactttcttggctcttagaagatatgtctattttatcatttggaaacttaggaaacaatatccttttggtttttgtgcaggcttttttctcatcatatacttgcaatattttacttatcttaccttcatagtaatccacatactagggatattatatttagaagcttcatgtcccactacttattaactatactggagtgttatttcttgaggtttattttgaaaatatgatccaagctcctatttcatgtgggtttgttgttggctaaaaaaaaatcctcttcagcaccccatttcccccaaaagatatcatgtcctaatctctgggacctgtgaatgttaccttacttggtaaaaggacctttgcacatgtgattaggttaaagaccttgagatgggagattacactggattattgggatagaccctcaatgcaatcaccagtgtccttatgaggaagagataggggaagatttgaaaacagacagaaaagaaaaaggcaatatgatagtagatgcagagatttgagccgtttaaacacaaactgatttctaatccctggcctccacaattgtgagaaaatccatttctgttgttttaagccaccaaatttgtgtaatctgttacagcagcctcaggaaaataatacaggtacgtaacattttcccttggaaaatatgagatacaccatactcctaacaaaaatgtaattggctgctggatttatatatagtagttatgtttctcagtagttctatgcagaaaatgcatcctctgagttgatactgggtttcgagtaacattcctccactttgtccttaactgaaatacttaacctgtcaaattaattctgaacttccccatagaatagatttttaaattgggagactatttcagtgatgtcttttataaagaggcacatcttttcctacctaaatagtgtatttcagatttgccccctctgtaaacattcatatttctttataaagcctcaacttctgttcagttttcatttcacattataaattacagattaaaccaaagcttccctcctttatgggtgcaaaattgatggtataagtaactgttctctcaaatggctaattatatttctagttgcctacttgaaggtctaattagccaattgcatatgcttttgtgggggcaaggagataattggcatcctcaagcaggtaattagaaaagcaattattagtgcccacggctaattacaagaatgaaaattgtccccaccaaaatggtaccagtgtctactgggcagaaaaccagtccctggaaagtgacaggaaacttaatccatttggcagtgttagaatggcaggcagtaaaacaaatcatcaactagacctacataatctataagcaacctcctgtgagagggctgtcagaagcctttctaactgtggcaaagggctgcagttggggcagttgccctattgccaataataacctgcacatgaacttgtatccctgtcaggagcactgtgatcttcaaagttctttcattcctagaaataacgtattatgaaatccattctcgagtggcgattttttatgatgttgtgttatcacacacgttataaaataaaggattctgtggggaaagccacttgtgtttagttgcttttcaactgcatctgaccagttctttaagtaacagaacttcagttaaatgtttcagtgaattcgtcttttgcagaaagcttcctgtggttagcaggttttggtgttgaagtccctgcaggttttatgcccaattaagcctctgattgggctctttgttctttattacccaagtatttatcccatgtaaatgagaaagggtagaaataggcaaatttgttttatctgacagcaagtcaacaatttagctctcaagtaacaagaaaataaaacttgttgagaaagttggtactgtatctgaaaaatttaagtctgctgtcaagaaaaatgaaaaagcctgaatcgctgcatctcctgacacatttcaaaatggggatacatagcacaaattatagtgtgcttgatggtgctgttgataatagcaccctgcgctcctcccagggcaccgagcactactgctgaaagggctcaactgcgggggttgtgcgcagatagttgcctgggagagctaaggactgttaggtcagagtttccaagaatagagaaaatacgccagaagaattaatgatttaactgggaaaatgcctttgtcattttttcctattttaaaatttctttgccctactctgtattttcccatcattcctcctgcctagtcttagtcatttactttaatcaggaccccctgcttcctacgccagggcaaaatgtctagaactatgggaaaattttgcctcgaagtaaaagtcaaaacaaatgcaaatctgctattagagttgagcagtttaaatgctccagtacaattgaggattaaattctggaaaagggtatccaacataaatacacaaccaagaggttattttttttaattagccatgattgaaggatagtgaagaagaagattaaaggcattaattatagaagagacaaagaataagcagacttttcttaaaatgtagtataaaacagttttgttagccagagaataaagatatttgtattccattaaatattctatgcttttatttttttcagacacattttcttgtacatttgtgtatttcatgtgtttcccaaatcaattttgagatcatagaatgcatggtctgtcattgtctctccagagcaggacaatctgacaagtggtcacccagcctctacccagtggtggcccccaaagcagccttgttagtttaaaaagaaaaaaaaaaaaaaactcttattatttgaaagagccttctttccttgaattgacttgcttattctaacttccacccacagtttctgttccccagaactgccacagggaggttctgaccctgaataaatggcaacctctcagatatcaaaaggctcacgtactaaatctttcctccaaatccccaaggcctctacggcctttctgttacgattgaattttagctgatttaatatctgttcctaaacagtgaccaaacaataattcagttaagcttatatccaaccagaggatcattatgtaaatttgagtgagggtagagagagtgaaggaaaatgaaatattctgcctcatttacctttagaaacttgtaacttgacttaaaaaaaaaaaaaaacttttaaactgaatatattggtgtcagagagatctagaccagtatgtttttaaaaattccatgcctaaggtaatatttcatctgcttttctagctttattctcttttttctatcttctactacttttttaataagcttaaagtagaaagaattaaaaggcacctattttctttactcagtttcttacacatacttcaagcttcacatagatgttcgttagcattaaaaatgttcgggggtttttaaatgaacacattttctcttactctgccatctgccaaaccagtgcagttcctatatgatttatgtgagataacccagaagagtcagagacataaataaaaactaaaaatccatcagtggtaattagaatctgtctaatgacaatggtgatgtttggaagaatatattatacatgttcctgtctcaggactttttaatatccttctcttttttgctgaaaatcttttctcccccaggtccacatagcttacttccttacctgcttcaagtctttactcaaatgtcaccttttcagtgaggccttgcagagccagaccctataaaattgtgcttcccccttcctcatgccaacatacttctaaccaccaacatttcctgccttatttttctccataacatccatcataatcttacctatgctttttctcattattatttgtgaaatatatcatgtgtacaggagagtgtacaaaatacatatgcacagtttagaacaaacacctgggtaagcaaacacctgtctaatcaccacccaggttaagaaataagaagctccctgggtgttcggaaaggtaaccactgtttcaacttttatgatagtcattcccatatgttttcttattattttatcaattatgtatatttgtgaataataatacagactttagtcatttattctagttaaaacaacagactaagatatctggcactctttgtatatagatgagttcctagacctattccagaatactccaaaacttattctcagcccaagcaacttgactcttccttcaccagctctcttaactctgtctatttcacccccaaccttccatctctttccaacctttcttccctagtttggcataccactactagatgtttagattcttctccaattctcttaacaggacagtcttcacttttgatatgagtcagaatcaactgaccaaggtaatcaaattttaatgaaaataggtaatttctttcattcctgaaacaaatttaaatagttatagagtttctgctatttgttacctattctagtaacagaaaacctcatgcttatctggacagccaaactttttgttctctggtacaatcctcagagtgactttgctttgcttacagttatcccatgtacaatttccatttagatttattccaaagatttcagcaagcatactgcttcacagatgatctcactttgttttgataatgtgctcaatcatttcatatacaatcaaaatgagtaatcagaggttatgcaaatgaaactttatcatcattgggactgctgcctatttgcaagtatccttcatcctcatctagttgaagttagctattattctattctacagaattttcagtggaacaatgtccacctttcttttgtacgctacagagtccagagaactgtactcattttctttttatgttgttagaactagatgtatcattcagctataatctgagttctacaatagctgtaatcactgtgtcactggcccctgaaatgaattcttagattgggcaatcactacactatcaacatatattgggtgtagcatctaaatcttctgttgagaatattgccgttttacttatctaaaacagtatgcagtaagtgtagcagtatatatctaaattaacttcttttgtagcattttatcagtgttctgccttttctctacattggctgcattttaccagaaacaaaagttgtggagcagtaaattatccatagatagtctagaagctcttttgataaaggatattcaaaatgttatatgaaaaaaatataagtttttctttagttttttcatttattagcttcagcatttttcatttatttcttcattcaaagaacaggtttttaactgatagctaaaattattatatcctctgctcaatacggttaagttcaaataggcaaaaatatacacagaactctacttctaaaaatataactgaaatatctattttcagtttgaaaaaaaaatcattctttctagagggtacctagcttcagtggcagactgatccagttctttgagagacatgttattgccagatatttagaataagtagtatttggaagaatacaaatatacaaatgattttttccatataagtagtaaaactttaaggagatgctttaaagaagaggcttaaacattttttcatcactaccacaaaataataatttcaccatttttaagggttcggcactgaactgattatgaaaagaaagtcttgttgcaagacttcaatgaaaataaaatatagtatttttaataattgtatggttagtcattatctgtgccctactgatttttggtcataaggttatatttgaagaaatgtcttcttttatatattcaacttcaactcaatcatgtaataaacttatctggcatgtgaagaattttatgtagtctctcatcatagaaaatgatggtaggttgcccatctggcaaaggttgtaagttcagatatgctgatgattattatctgtgttaaagcagcctcaacactttccaaaatatattcatataatagtagctcattatctatattaaaccacaataaagttaatattaataccatggattttataaaataactttgaacgaagctgaaagcttcatttagtttaataataacgatgcttgaggaccactttggttttaataaaaacatggaaagtagcagatgagaaagaaccataaagatgccagtcgaatagctgtaataccaattagttggcaattgattcattcatcaaatatttattgactacccactatatttatgtaccatcacaccttggaccaatagaaactgaattaagttttaaaactacgatgaataagggtgcaaatgaggaatgactgattgataatcccaatgagtgtgggatttttctttgtggtgggtgatgaaaatgttctataattacatgacaacaatggttgcacaattctgtgattatactaaaaatcaatgaactatgtgcatccactctaaacatgttgattttatggtatgtgaattaaatctcagtacagctacttagaaaaacaaagctttattgatggaagacaacaatgtcataatgatattgatcataaagttattggctctcagccagtgttgaacaagtagacaagtgtgcatcaaacggtttatgagacaatcctaaagaagtcggactatttggatttgggattaacatttgctctactttgcatgcacaagaaaactcaggccttgtgacacagtatgcatgcctgtttttaaacaatcacaaatttacaaaaaagtatttacaagtatatataaagaatttttttcctcataccatttcagagtaatttgccacctgacacccttttatctcctaatactttgatgtatatctcctaaaaaaggaacattttccacataaccacaatgtagccatcaaaatggagaaattaacactgatgtacgactaccacctaatcctgactccattcaagttacagcaatttttccatttacagcaaaattatagcaaaagaatctagtttagaatcatgcgttgcatttagtttcctcagtatacaacagtttcacagtctttccttgactttcatgggcttgataattttgaataattattttataatggattttagaatgtccctcaatttggatttgttcagtgtttcctcatgattacatccaggtaatgtaatctttagtggtgatattcacttcagcaaaagtgattctatattcttttcattgcatcctattgggatgtgcacaatgtcatcttgtgcattgctgatgatgtttgctttaatcatttgcataaggtagtgttttcttcaatataaaattattattttcctttgtacaattaataagttctttatgggaaacactattaaactatgtaaacctcccattccttatcaaactttcaatttaatatttccttatttatatgacaccttcctattttattcactgaataataatctgttactatcattattttgatgctcaaattgtcccagatctgagaggcccctttaagatggcttctgtgtccttttgaaaagtctctatattctttgagcatttctttactttctggcacaagatattccagtctcatcttgtactttctatgcctcagtgatttctccagaaagtcctggtttcttttagtggaaaatggtatttagaagccacaatctgacattaggtgtgctcattgctattgaggtattgctgcttccaggcctctctgtagacagagctggaaaacatagctatgtatatatacatttacatgtatatttatttctctgtctatatactgaacaccatgagtttatataaatggctaaaattctgatccagaatccaaggttcatttatctgttcccatatttataactcctttacctaattaggtgatgaacccggtttccattatccttaatgtattgagtcaaaaataaagcctccttttatgtgaccagtctcctggtctcagctttcctcccatccccagtgcagattccagtctcccatgtattagtccgttctcacactgctataaagacatacctgagactgcgtaatttataaagaaaagaagtttaattggctcatggttctgtgtgctatacaggcttctgcttctggggagacctcaggaaacttacaatcatggtggaaggctaaggggaagcaagtgcatcattacatggctggcaggagagggagagagacagcaaaagaggaggtgctaaatgctttgaaacaaccagatctcttgcaaactctatcatgagacagcactagagggatggtgcgaagtgctaaaccactggaaaccacccccatgatccaatcacctcccaccaggccccaccttcaacactcgggatcacaattcaacgtgagatttgggtggggacacagagccaaaccatatcatcccccattcaatctccaaaacccatgctgggctggcttctgccccacacggatccctccttatcctgctaatgcccttgtgctgagtgccagatcactcccacatctagcttccctcctcactctgcctgggcacctgaactccaaatccctgtgcagagttgtcccctgaatgcacacacatctcacctcactcaggctttggatccccacatgggccacaacatgctgcactctgctggctctcagacacttcatgccaggctgcctctctgtggagatgccgtcatcaccctgcttgggacagctttaaaacaggcaactgccatatgcggttgccttttccaccccactcatgttctgatgccacgtctgccctccttcacatgtacctcctcaccccaatggggctctgatgcgtgttctggcacaccatggtttccccttcccacctaatctggacacctaccttgctctgctgcccctaatggctttaggactaaattgttgaaacaggtaagcaaaaggaagcaaaagggaaggggaaggggaaaagctcatgcaatattttaacttaacacatctttctcacccactggactgaagttcatggccgaaggaaccacattttttccatctttttattctcagttcttaacaaagtatctgattcatagaggtaggtagcagtgcaataaatgcttgttaaattaacctcattcaagtggaaagctgagaacttaagcaattccagtctttggctcttatcagtgatctcagtcaaaccctttgagcattattttcgaaaggaaagtaaatcataagcagtttggccagttgtcctccaaagaggatctttctgaaaaaatgtaacaaaatgaagccttttcatgggggctaacccttctatatacaatttgctaacaatataaattaaatctattgatttattttgaaatcataaacttaaaaagagcaatgttcattagatgtagagcttttattcttaattagtatcaaaaatcattgatcagaattatgccttctttcttccattttcataatataggcaagtgaattagtttccatatagtttcaaccttatagctcctccaagaaatgtaataaacaaaaagataattaaatgatatttggactgaagcattacataggaataacaaacataaaggctttattctaaaatatagggaccttgacttttagttcctgttaatggcaggaacaagcttttatttgtgtcttttctgggaagtttgttcatttattcaaaatgtagttattagacaactcaggccagcaacataatttgtggggcccagtacaaaatgaaaatgcagggcctcttgttcaaaaagtaggaaaaataggcctttaaaagtcctaaaatatgacaccttttcctttcttccgtggtctctctcctggcctttcgaatagtgttttttaatttgcaatttaattttacactcaggcactgggatactcaccaagcaggtatcaacttttataggcacctgaaggctcacctggggcagaaggaagggctggggtgcaggcatccacagcccaccaactgcaaggcttcttctgccaatttttggactgacactggggatattagaatgaacaaaacagacaaaaagtccctgcatcatggaatgtacatgtcagcagaagactcagttaaaaaaaaaattgtatgtgtgcacgtgtgtgtagtatctgttaggtagtgataaaccctttgacaatcaataaacaaagcaggaaagtggggtttggagtactcagtgtagtggatagaaatgggctccaatttgaagtaggttaggaaagccttcactaagaagatgacattcaagcaaagatctgggagaagtacaggagccagccatagggctatctgggctgagatgttgcaggcagtggcaggagcaaatgcaaattcttctcagtcaatgttgcaaatacttcagtgagacagtctaattttctcagagacctttttttttctttttttgagacggagtctcgctctgttgcccaggctgcagtgcagtggcacgatctccgctcactgcaagctctgcctcccgggttcacgccattctcctgcctcagcctcctgagtagctgggtctacaggcacctgccaccacgcccggctaattttttgtatttttcgtagagacggggtttcaccgtgttagccaggatggtctcgatctcctgaccttgtgatccgcccacctcggcctccccaagtgctgggattacaggcaggagccaccgcgcccagcctctcagagacttctttttactccacaccccacctacctttccccacatcactaatcttgtttctggaatttgttccaccttctcttttccaaatttagttagcctaggtgagattcctgctctctcacctgttacaggaggcttctaacttcctgcctcaaagctctctgctccccataccactgcctgttgccctcagcactgctggagctcaagtctcaaacataactgactgtgtgttcttactcagaagacccattgtgtggctttcatgcaccataccaaaatgcagaagtatgggaccctatgttatgttcagaaatgccataaaatgatctgccccatatgctgactaaactggttttgtcctgttacagaccatcacctgctcatctacacctccatgcctttgctcatcctggaggatatttgttcagtctcagaacttgagggctaacttttcattccaatttcaactccaatggagttcttcttgaaatgtttcttgatctctccaattagaataaactacttacttggtttcagttttacttaaatatctctctgtccaccaagtaatgaggttgctttttttttcttttttttcttttttcttttttttttttttgagtcggagcctcgctctgttgaccaagctggagtgcagtggcgcgatctcagctcaccacaacctccgcttcctgggctcaagtgattctcctgcctcagcctccccagtagctgggacgacaggcacgtgccaccatgcctggctaattttttaatttttagcagagatgggatttcactatgttggccgggctggtcttgaactcctgacctcgtgttccgcccacctcagccttccaaagtactgggattacaggcgtgagacaccagtaataagctttctttacgtcggagatcctgtcttatttatctttacatttataatacctgtctctttgctttgcacacaatatggacttaatacatgcttgttgaatttaacgttattaatgcaactcatattattaattgtaatggtagtaaattctacaataacacacctggcaataatgcaaattagaatagcttgaattgaaacatggaatgattggaaagcagctttttctcctctacctgattccttttctcaggaaggagaagggaacatagaggcctctccctcatggggatgctggacagggaaaaatcagacaatcctatttcaggaaacagagaggtgggggttagttcccagtattctcccagcccattctctctggatcaggccaacaaaacattcaccaattaacgaagagattcctggaatcacagttgctctcccagaagtcccagccaggccccagaattctgcccatcaatttttatgttagagcagtcaccactaggtggtgccgaacttcagcccagggtaggtgaaatttgcatcaaatagactcagaacttccagatgtccagttgcacaggctcaccttggccatttagctaatctcataataacacaaccctacattttacacagctgaatttctggggcactacttattgcattatggcagttttgttgtatcattttctaaaaatctttcaatatcagatactctgccagccactttacaggctttatctctaatgctcacagtaacctgtatggtaatgggtactgatacttttcttcttttagtaaagaatctgagctgggcatggtggctcgcacctataatcccagcactttgggaggccgaggcgggtggatcacccgaggtcaggagttcaagaccagcctgaccaacatggagaaaccctgtctctactaaaaatacaaaattagctggacgtggtggtgcgtgcctgtaatcccatctactcaggaagctgaggcaggagaatcgcttgaaccccacgagatggaggttgaagttgccaagatggctccattgcactccagactgggcaacaagagcaaaactccatctcaaaaaaaaaaaaaagaagaagaatctgatgctaagaaaagaaatgtctcttgcccaagagctgtgccttgtacagctaagtgacaggtgacagacctaagaattacattcaagcctgtctcactctaatgccatacttgtcatatttctgctatacttcaatttaatgatcaaagaaaggaaggaaagagacagtggagaagaaaagtagggaaagaaacagaaagagaaggggagaaagatatgtttgacagaaaagtaaatgaagtatgttaccatctgtttttttcaaccccagaggtctgattcccccgcaggaaagagttgcttctagcctgtcctttatctctgcacctgccctgcttatctcctgcaccagaggctcctaccatgaccattaatggactgagtttttgtgtccctacgaaatgcatagcttgaagccctaacccccaatgtgatggtattaagaagtggggcttcaggaaggtaattaggtttagatgaggtcatgagggtgagttttctctctctctttctgtcatgtgaggacacagcaagaaggcagccatctgcaagccaggaggagagtcatcaccagaacctagccacacaggttccctgatctaggacttcccagcctccggaactacaagaaataaatgtctgttggttaagccaccccagtctatgacactgtgttgtagcagtcagagcaggtgaaaactgtaacttgttattctctaaggaaaatacaggtcttcttctcaggcctgtcttcagaaacaggttcacatccccatcttccagtcattgaactaaatggaaaagtttttgtcttcctagtcattgtctgcacctaaacacaggcttgcccatctgtagtcctagtctgttccttttctttggtgaggataacccttcctgtcttgctttaacaccctgtattttccgttcattagtgactcagacctctgataatggtatactagttaaccccctgtctcgtctgactttaaatgattgcctgttttgaccttgaggaaatatgagtccactaggaactacaatctttatggccacttgaaaatctttattccacttaaggtggaatagggtaccttgccacagaggaaacaagtaaggagagaaagagagtaaagatcagtgagaggaagagaaaactaaaactactagtataaaaagttctgaaatttcagcaaattattttgcttccaactgtacttaaccattctgccctttatttgcaataaaaatattggggtattattatctttgaaatgcagattatgtggttaaccattgttcactttctaaaccctgtaagtatttaacttgtggatggggaatattgtttgggactgtattggttgcaaaccaaaatgatctacactcacacagcttagtgtcaacattaacatgactttactttttagctgtctttgttaacatgactttactgtcctactgtcttcatcaacatgattttactattccaagaaactcttgccttggaagataaaaatagcaaatgattttcttgtccctttcagaaactttttgaaaattcatttaaaggaatattaaataattcaactttcacagttagcatcagatgaatgtttatgctccaaaattcattgtgaaaccttcagcttgtgtgtcttccaaacttaaattattatgtagtgtcttaaccaatgttaagacattagtgtcagcattactgacacacaatcaaatgctcccctatggaaaaacttgccttaaaaaaaaaagaaacacacacacacacacacacacacaaaacaaaaaaaaacagaatttctaccttccgccccccaccaccacacacacacacctaaattctcttaaatatcccgactttgccttcctcctcccagagactactaaggccatgtcaaggaagctgtctcccctatggtggtaaacaatgaactcagctctgtcatatgacaggctataaaaagctgattttgttgatattctgggaaagctaccattcagcaggcaagtgattgaagccatttcctctcaaacttatgaaagtaaactaaaggtctgattctgcccagggaggaagtttctccactctatcatatagaatccatatgtccatcatacttttatttgaaaagaagggatgctaactctcagaagcatgtcatagtaagcacagaagtggaaaaaaagaattgatcatttttgtgagggaaaacttaatgaaaaaattacaaaatcattataaatacaattcatttgaagttatgttttgagattacattattttctctctggcatttagacacctaaaattcactttaaaatatgttggtgaacaaatctcattctccagaagtacatttttaaaatggcaatatttcataataacagtataaaatgaaaataattgactatctcttgccttgtgggacttggcttttagtctaaatagatatgaaacaaaatgacattcatctatatgagacgtttgttaacttaaaagaaattaagtcagaagcctataaggctaatccataaatcagcaaatcagataaattagtaaaacttttccagaatattatccaggggctccttactcctttgcaatttgttacctgttttacatgtccttttaggaagggttcatttcccattgacaggcaaaaagaatatatgaaattagaattttcaacagcttgcaacatttgtgtcatttttgatttaacaattttagaagacttgttccaaaattacacctgaatttcattttctttgtagttttctaaaatgctgctactatcaggacataataaaagccacacagccagtactagaaatgctgtcatgtaaccactaagaccacactaaaaggcaaaatgctgcagctgaaagtatttttaatgacttgaaattgcttggaatgctttctagaagtaaaagggtgcagatttatttacctagtatacttacctaaattaatttggcaagattattttggttcaaatcctcattcaataaaatttatgttaatatttttaagtggtttttttcctgaaggatataatatattgcattaacacaaatttacaacagtcatgaaagtaaaaggtaaattaagccatttctgaaatatgaataaggactacatttttaaatagactacatttatgattttatgtgaccttgcagataaacatcactatgtaaactgttaatgagaacaaatagaatcacattctatttttagtttttcctgatgtatagtttccattagagatatggaggaaactttattcttgcataatttttgttttagaagtttgggtttttttgtgttttttttttaacattttaagcaaatgggctttttatatatctttttgattcggtacattccttactacagaatgaatcctagtgaaattctcactataggccatttttccatgtttttttcttttatggaaattttaaccatggttactaacatataaataaactcttttaactgcaaagtcagaatgggtatactttgttatgaacatattaacttattccagtttcatgtcttgtgtttttctgcactcattaacatctccttggtacttgggatcatggcctggccaatacgcataaagatgacgagatatctatggactacagtacatctgtttaataattagtaattgttatgcattgtaaatgaacgattttgactcataccactgacatttaattagtttttactatattccaggtacatatgagaatgtcacataattatcttctttaatttttacagtaactgttatcattacttcagaaaggaacaaaactccatttagagaggttaaatagaaggtccaaaacatgtagcaagtaaaaagtatccagaacttagatccaggtttgtatactactccctaattggggctcttaactactttgatgcattgccttttaaacttactttcttgattatctatttgactaacatctccccaggacacacaaaatacttgaattcatgctattatggcctgaatgtttgtgtccctttacagtgtatatgttgaaatcctaaccctcaatgtgatggcattaggaatcagggcctctgggaggtggttaggtcatgaggttggggccctcataaatggcattagtgcccttactaatagagacagagacctggctcctgctctttgctctttgccacgtgagggtacaatgagaagacagccatgtgcaaagtaggatgagtgcccttgcaagacactgaacctactggtgccttgatcttggtctcttcagcctctaaaactgtgaaaaataaacgtttgttgtttaagccgcccagtttatgctaaattgttatgatagcctgaactgacggagacacatgcgtaccacaaacaacaaaggctcaaggatccttaaaataaaaaccaagactttcagtgggttgtaacatcacgtagtggaggtaggtttcctctcctctatacctctcccaagtaggaaacatattaagatcacaggggagttaattggaactattatttcatatgtaaagaatgtattctttataacttcttgggaatatatcttaatttcttttaaagaagattagtctaagttatagtttagtctatagttttgtaggttagtctaacaacattttcgttaagtctaaagaataatttgcaaactatgtgtatgtgctacatttgtgtattgagtgggtgaagatcgagttcagcacagcatgcctcttaggtaaatatgtaaaattctaggagttatttttcaaggggtacaattctacacccaaacattcccctcctaattctacctcctaatcgtagaagaagcagccccttggttatttagcccaagaatccaatgtgacttatctgtaatcctattagtccattctattcccttgatattgggaagttttgcctgtcccaaaagaggccattcggaggttattcttggatgattcactcacttgtgaaagcaaattgtgttggcttcaagatgctgcatttttttgtaaacaatgccatgacttttacatttctttacatcttggagctacccacttctgcaggtccattctctctctgtcaccatttaaaattatgtaaggtaagttttcataaacccgtaaaataatggttacataaattggaacttcctaccactcatatcttagttgtattaaatcaaacatttactactatttccatctgtttcactccatgacagcatcacctacttgactctgttatactaagagttcagtgagaagagcatcagggagcttagttctatgtagtatcacagaaccaaaaagcaccttaaacttgtcagggttctgtttcttcagctgtagaagaaaccagggttagggttgggggttatggggaagataatacaagtacaggtaggcagcctgtgtgactaaaagttgtatctggtatgtttgtcacttagggacttttatggacctagattctaaaaatcatcccaataataaccttaaatcatgtcagaaaactctacaatggaatagatttttgcattcagaaattacgtgcattttccccagcatggtatccacttacctaacactttatgctacataaaacgataaattatctagtgtgatctaaagccatcagaaacatttaaaagttttatagtacagtattttaaagtttactaaccattatataaaattaataagatagtttatacagtctcttgctttattgattgtgggtaataacctgtagatgggaatatagtggaataatgtgcctaactgcctttaaaagaacttacttaaacttcagtaatttatttctgtgtttcttggattccttttacttctgaagtcttagtgaggaacggtcagatattgagttgctgtattcactaaatattttgtggagaatttctttaaggaaagatgtggattttaatgcataaattttttagacagactattgaagttgaaatttcatttcaagaggcagtcagctttgtttaactctatatttttagtatccaaagttactgagccagactttgctttaattaattactataggatgtgaggcagttccagtgctgctttttctattaacttgcaatttcctgtaggaaattaataaaatgaaagagggggtggccggcaagaataaatatatgctacagttgcaagtcactaaaattcatcagaataaattaaactgcacaggtttcctttttttataattctataaagcttctcaattcttaaggcaaatttgacaaagaaacagggccatctaaaaatgatcaactttcatataatatacattaattaattgattagaatatgaaatttgtcagatcagtgttgtttaatggttaagaaggtaaattctagaaacagactgcctgagtttaaaatctggctctgccattactagcatgagactttgaacaatttacttaacctgctgtacctctttatgtttaagatgcaaattataataacacttatagggttcgtatgaggattaaattagttaatatgcatagtacctggtatatacaaagtactacacaggcattaacagcaattagcatctgttttttcatcagtattaacatttaagaaaaatcatcttactttagctatccctttctgcaacctctggagtcaaatcttaaggtgacaaatttaagtttttaaaatatttgcaaattttgctttgtttttctgagtcctttttaagtgagttaccaggaactccaatgaatgcatgtcgttgtactcaggtacttttttttttttttttctttgagatggagtctcgctctgttgcccaggctggagtgcagtggtgtagtggcatgatctcagctcactgcaaactctgccttctgggttcaagtgattctcatacctcagcctcccgagtagctgggattacaagcgtgtgtcaccacacctggctaatttttgtaattgtagcagagacggatcttcatcatgttggccaggctgttctcaaactcctggcctcaagcagtccatctgcctcagcccctaaagtgctgggattataggtgtgagcaatttcacttggcctactcaatatacttttaagtgaatactatgggtaccaaattcaagtgtctgataattttaccccatgagtaaaaggatttctcttgctgagatttcagaaattgttgagaaaatatttggaagaatgttagcaattgaccaggatataaaaagaaacacagaaattactcgcatttagatctgcacctcaaccacattgaaagggtggcaggattttcagaatgtggttgccttttcattgtcatgcttatgttcattctacaatcaatatgtattgccactgaaataaagatataatacaagatagaattaaggcctactgctttgactctattgtttatctagttaatagcgttaacaaattttagttctagcttcctttgaactgcatgtaaatgctgcctagtcaatgacatacctgaaatagcttcttgttctttattatgtgtttatgtgctcatctgagcgtgtcttgttactaggactgccttataaaagtcggttttaatttcccgagttaattaaaggtttctcttacaattacagcctccctagttttcaggggtttgttctttttgtgtgtatgtgaagtggggaagaaggtagttggaagagtactaccttttatcattccatcttatatgatttatcttcgctgtgtgtattattcacctattatttttcattaagtaacaataagtgattgaaacaaatgttaataaaatgattaaaatatatttagtaacaaatttatctgtttttccccctttctagtactggtttaagtggactggagtgagaaagacattattcgaaagatgttgcaaatttatcgtgttttcatgttggaaatgacataaatgactttgtccaaatgatgtctttttcagtgtagaatacttaaaccagtgctaggaagaaagttttttattgtaagaaagtagatttctttttattataagtaaataaaatatcctgattatggatatttcataattcgttcattcatcagtttatggacttttggcttgtttctagtttggagctattatgaataaaagctgctatgagcatgtgtttataggtcttcttgtagacacatgatttcatttctcttacgtaaaagtccaggaatagtactgctagattgtatggctaggtatatgtgcaactttatgagaaactgccaaactgttctcaaaggggcggcaccgctatgcattcccactagcaatgtgcaaaattttcagttgctccacacaccattaattcttgaactagtcagcatttttaatgttagtcattctattgggtaccttatggtgatttgtttttccatttccctcatgacttccgaggttgagcatcttttcatttgcttattgaccactgatataactttggcgatgtgtctgttaattttaatgatgttcagtttattgactttttctccttttatgaatcatgctttgatgtcaaactgaataattttttgcctaactcaaggtaacaaggattttcttatgcttccttctaggagttttattgcttttattattatatttaggtctgtattgtattttggcacatgttttgtttgtttgtttttcttaatgttgtatgtgataagggctgaaggtttttttcataagaataccgaattgttccagcatttattttgccaccattggattaccttaaccactttgttgcaaatcaatcaactatatatgtatgattctatttgttgacttcattctgtttcattgataaataggtctatcctaacaccaatcccacaatgtcttggttattgtgactatattaggtcttaaagtagtgtgaagcctccaatttgtacttcttttccaaatttgttttggctattctagatcctctgcatttcccgtataaattttagaatcaactttttcaatttatcaaaaaaatcagattatgaatgagattgggttgaatctatggaccaatatagggggaattgatatctgaagtcttgtgtctcttctaagctacaagttaaataatattacctcttttatttaggttttctttaacttctgtcagtaatggatttttagtgaaatattttaataaatttgtacctaaatttttgatactactataaatggtagcttttttcattttgatttccaattgtttgttaccattgaatactgaaatgcaattaatttttgtggatttatatttttatcttgtgacattgcaacactcaagttattaattgtagtagcttttttgtagattccttagggtttcctatgaaacaatattgtcatcttcaaataaacacaattttagttcttcctttttcatctgtatgcctattatttcttttacttgccttgttgcactggctaggttgtctagtacactgtggaattgaaacgattcaaacaaatacccctacattatttcatatattagggggaaacattcagtcttttaccattaagtatgatgttaacttcaggttttgtaagatggtctttatcagagtttaggaaattttctattcttagtttgctgagaaattttttttaggaatggatattgacttttaacaatatttttcttattttttgagaaaatcttgtggattttacttagtatagtttgttattatggtaaattaaattgatttgtttttccaatgtcaaattgacattgcctttttaggattaagctcacttgtcatgacatatgttttttgtgcatggctagattcaatttgccaatttgtaaaaggatttttactgagatgttgataaagtatactagtcagtaatttttattacttgccatgtcttttgcaactttaatatcagaataatgctggtttcatgaaatgactggggacatgtttcctcctcatctgttttctggagagtttgcatagaattgatattatgtcgtcctcaaatgtatttgatagaaattgcccactgaagctgcctagtccttggggttttctgtggaatagttttaatgacaaattcttttatttttccataaaagaacttgatggtttttatttgacctactaaccttcggccagggtaattttgacagtgtctgtaagataataaagtggcaattatagtagtaagtttgatttaaaacacctttaacataaaaaagaatacttgttaattcttggaagtaaaaccacaagtgtttatacatgtgaatatatataatattctttaataaattctatatctttagtagatatatggctgttcaagttatatagttcttgagtgagttttggtatttttagattttccaggaatttattattttatctaagttgtcaaatttattggcagtctcttatcttctaaatattcccttattattttttaaaatgtctgtaggaactatagtgatgtcttctctttcattcttgatatatgttgtttctttttcttggtctgtctggctagagatttatcatatttattgatattgtctgagaaatagcttttgggctttatggattttttcctttgtttttctattttgcatgttattgatatttgtatctttattatttccttctctctctttaggtttaatttactattcgttagtgtcctaggagggaagcttggaacattgattagagacattttttctttcttagtataagcatttaatgctataaatttcccttcaagcatcctttagctgcattgcacaaattttgacttgttatattttcatttttattcaattcacaacttttttcaattttccttgtgactatttctttgatctttggcttatttagaagtgtgttgtttctaaatgtgtcacaattttccagatttttaaatttatttttagtttatttctattttggtcagagaatattactctatggtttttatcttttttaatttgttaaggtttgttttatggctgagagtatggtctgtatggtgaaggattcatttagatttgaattgaaggtgtattctgctcttgtatggagttcttgaattgtcagttagattagtttcattgataatgccattatgtgttccacatacttagttctatattcttactgattcttcctcagagaggagtgttaaaaatctccaactataattgtagtcttatttatttcttctgtatattctatcagtttttgcttcatgtattttgaagctctgttatctttaagcacatacacattcagctgtctactattagctagaagctgataggtcttcttgattaattgacttctttattattatataatgttatacattttcctggtactattccttgatctgaagtcgtctctttgtgcctttaatatagccactccagctttctttctttaattaaacatttttagatttcttttttattatacaggtaagaaacatttaattataaaaatatgtgaaaatttgaaaatactgatagtcaaaaataggaaggtaaaatcagctgtaagctcactacccaaaagtaatcactgttaacaactttgtgtatatacctatttttaaaagttttatttttatggtaaaatacacatgacataaaatttactatcttcattcttttttagtatacagttcagtggtattaaatacattcataatgttgcacatccatcactccagctttcttttgtgtttgcatgaaatttctctacctttttatttttaatctgtgttatatatttatatttaaaaataggtttcgtatgggcaactatagttggcttttacttttgtatccaaaatgacaatctctaccttttaattcatctatttagaccatttgcatttagtgtaattatcagtatggttgggataaaatctattatattattatttgtttacaaggttcttgtttggatcttgttgtcctatccctgtagtctcatacatatttcacacttcttttcttctactctacatgtagccttcataagcttattctaataccttcaaagggccaattttttataccccactgatatttttacaagctattctctgcctacttaagcagacggagttttgttcttgttgcccaagctggagtgcaatggcacgatctcggctcactgcagtctctgcctcctgggttcaagcaattctcctgcctcagcctcccaagcagctgggattacaggtgcacaccaccacacccagctaattttttgcatttttagtagaaacggggtttcaccatgctagccaggctgcctcaaactcctgacctctgttgatccacccacctcgacctcccaaagtgctgggattaggggcatgaaccaccgtgcctggcctttcccctttttctcaaccacacttaacaaattattgctcatccttcagatctcagtaaaattgtattcctctaagaagcttttcttatatttcaagtctagagtaggtgcctttccctactttcgcttcactgtccctagaattaatagaattaatatcaatattaattatttaatttaaactgtgaatggaagaaagtatgctagagagtgaatatggatgtcttctcttcctttataaaaggagaattccctagccagattgccatgacagcaatccattctttcacactgttagaatgtcattttgaagtgcctctgtggggttcttttgcccaccctgcctgggatcatctaaatgacgagttaataggtacagcacaacaacatggcacatgtatacatatgtaacaaacctgcacgttgtgcacatgtaacctaaaacttaaagtataataataattaaattaaattaaatttttaaaaaatgagagaggtccctgacatccctgcagggatatgggttattatgtatagtctgtccaactataatgttgcatttttgtttcattgtttcttagagattaataccccaaagaggggtctatttcctgtaatttctgtatttatcaagctgaaaaagcatgtccataagtttagaaaactgaagctgagatgatgaaaatactgtgctgttgtttttcactaatagttgcctgattatatcactgaaagaatatcaaaaactgattttatgctattgcagtaagatagctgctggttgtacttggtatccttatgaaacaacattcttttggcattagattatcactaacatttaaataaccttctctaaattaatttttaaaatttccacaacaaagtgcatcaccattaaaacatcacgttagtggcaattataaaatggtattaaataatagaatagatgcctgaataataatatgtagttttttaaaatccttaaaagataaactacagtaatgggtattgatgaaaaatgtggttggtctatttatagaaaagctaactatagcagacatttttaaataatattttttatttctcctttaattaagtttgttcagacattcatagatcatcttgtacctacaaaaagatattatttgacaaccaagtacactctgaaaagaagaactttataagttatcttttttaattttccttcattgacataatgacagtgaatctcattatgttggtgctaagaatctaccattgtgttttgttttatggaaagaaaatttaaattatgtcgtgtttaaaaaatgagtaaagtaggtcaacacccagctcactccctgacatcacataaatgtaagattaagtaagtgaatgacctaatgttcagccttctaaatattcctatatttcaatttagggagcaaatatgaaagtaaaattaatggatcagttcatacttttaaccttgagtcatgataataactgtattgaagaaaatatcatgatcttgatatggtaggcaatggcaagttacttgccccacaaaatatttttaagtaaaaaataatttcccaagagaattttcaagactcattattggctgaagatcagaatattccagtggttcctttaataataatacttttatatactcattttaatcaaactatagagttcaacttttgaaagcaaaagtttaaattttgaaaataaatttttgaaagtacaagaagatagttatatagacatatgtgatagtgagttaccagtcccacagagatccaagtattaaaatgagcgattgctcactggacaaggcagactaaatgtttttttcctaagggtttcttcttaacattcctgtctcaggaagggctttaattgacagggtaaggcagaaggacaaagaggaagaagcagcactggtttgatcattgacaaagcactttcattttatgcagcctatcttactgtccagcttggtcagaaaacacaaaaagttagtcatgagacctgagtttgagttccagctcttctacctacttggcataaaatctgtggcaagttaccaagtttctctgggccccagtggcttaatccgttaaaaagatgattgtaatgtctacaccacagaattactatgctacctaaattccataattatgtgaaatgaacattttcagatggcaaagaatattacatatcttagtttcaggtaacatacctgatcaagttagaagaaaatctgaggagcacatttccaagacaacccacctacagatttctgatatgaacagacagtggctattaaacaaataaacaaacaccacaaaattaatcctaggtgatggtagtatgaaatgcatagtttatttctatacttatttcaggcttaacttattctcacttctaactgaatataatagagtctcacaagctaagacctggggctgaggatctcctcccgtattgtgagaactctacattgtagaaaagtctagttttattatttgaaattaatagacctattctgttcatgtgttaatatttgaattatttaaagtacctaaaacgaagttgctattgaattttaccaccacagatcaacacatccactggtatgtggtgtgtgtgtatgtgtgtgtgtgtgtgtgtgtgtgtgtgtgtgtgtgtattgtaatatagaatatgctaaattcataagtttccacttgtgtttttttcagtacttttcttaaatcacaaattacacgaagcttaacaaacatccaaaaacactaacctaactggaaaatactctaccatctttaggtcaatgttagtggactgtcttcaagtggaggttgacttcagaatagaggctcttttcatttttaatctatcttttctccttggtcttttatcaggaatgatgtaacaaaagtatatgtatccgtgaatagaaatgtgtgcaaagaataagtggcagtagtgggagaagcctctagatctgtgtctatttagaaaggctggaaaataagaaaatagtagaaccctgaatatatgctatacattttatcttctcagtgatttcctgccttataattctttttaaaaatcacattatagcctcaaattgccaggtaagaggagaataagtaggaaaccaggctgatttcataaaccttcagtattgtcccacataagcatgcattttgggcctgattatgttctctgcaaacactgtccagaaacagattcagtgaattacagtcttaggactaaccaagacaattttgagcaaaaagaaacccctctctaatgtgacagtagaacataagaaacatcagtgttatcactgaaattcagcaagtgcagatgttaatcactgcacatctagctctacctgccaaattggtcagattctttgagtctgtggccacacaatgtgatctgccaactgcagtttgtcacagtctgccactttgttctgcaaaagaagactgcctacattgtatcactaagttcttttggctgttactccacgggaatgttgctaaacaatgagaaatccaatgaaacattccattggcttaagaatcagatattgtataagtcgttcattcattaattcaacaaatacatagtgagaagttactctgtgccagataccggggcactcataagaatttctatagatttaacatcgttagtaatgtatatatagctaacaagtaaggccatatattgtcattagccaatgtcttatcatcagggacagacacatacatatattacagaaggacgtgaagaagagtgagcgacctgtttagacacacttataaggacacacacagacacacacacacacacacacacacgtgaaggaagaaaacagccttacctgttaagtttcagtcctctactacgcactttaactattttcctattttttagcagaaccaccttataagatgttaaggtgtttcttcacgtaatgcctgtctctttcatctgtatcatatgccctcatcactgtgaggaatgggagaaagaaaattggtaactctgatccatactatgcctctgaaatattttagcaacagttggaatagaatcatgtctggagctatgtgtgcgttagaataggtatttaccaaaccttatttttctatttcatcaaatagaaattctgcttttttaacctaactgttcctcttcctactgcattgctggataatttgcaagaaaattgattccctaaacccaactctcaggctagattggaaataaagagcttatagacccttcagaatccccatgcctttagaatccccaaggcctccatctgcatgtttacttacacaaatttggccctagagccagtgaaacacagggacataaagacatcctcattaaaaccaagaatttaagctccatctcgtggtcggatttgaatgaccaagaacataggttttccttgattctttgaattgaggatcaatatgattatcctgtactatttaaaaatttttcggaaaaaaatcatgaaattatttatgaggtcataataaacatggattacattcccagcatgcatttcatgaggctaaattatctgaggagttctagcacctgaaagaccataatttatttaaccaatatttattaagcactaagtataaaatatggcactagggctcaggcaaaaatgaatgagacacagccttttatctgaaagtcatttacaatctaataaagccagatgcatacatatatgacagaaggacatgaaagaagagtgagccacctgtgtggacccactgagaaacacttaagggtgattatgttgaggtacaccttagcaatcttaattttccttcttctacctttttgtttcactagtaaaaataaatcacctcttatacaagaaggaaaagaaactgtttcatgcgctgaattaacacttagcattaaatgcctatgctaactggcccataaaaaagtagttttttttttttggtttgtttttaattgagagatattttaattgagcctatgacataggctactttcccaaatacaaaattttagcatatggctttgattttacgttgtgtttttttttttttttttctgttttaatgtttagtcacacaaacttgaagttatcgtggctccaacagaaaattctagatgtcattagccagtgttttatcatcagggagagactattttacaacaaaattccaaaacaaaacttttcctttattacacagtactcgttctccattccctcctcttttagctgctccattagtctgtgcaaattgcctttcattttattgctttccagggcttctaagtgcttgtttagaaacaaattttcttaagtccaagctaaagtccagggtttatttgattccgttttttttttttttttggacagtcagccaatgctttactcactagtttcagtttctgtgaataagtgccagaagcatggagctgctgagctttatgaaaaggtatagacttttattaccatgaagccacactgcaagcaagtcttgcctgttctgtccctaaactactttcaggttaaccaacagttggaactcatttggcttattgtattattcaggattttcaaatgatttgccattatattgatggcttaatgccctattcaaaaatgtttcatagttttattataaggattttaatctgtattctgctctcatgttagtctagcaatcagcagtcattaatatgatgcgactctattgtagttaaactgttgtcagagaaaaggttattttctagaaattatgttggctgtgcccttcctaacagttcttcacatctctaatatttgaaaagccagtgatatttattatgctattttccttctagtcacttagattacactttcctcacactaccaggaatctcctaattggcaaatccagaagaggctctccagtcctttccttacttcactggctgtagctttttgtactgccagttcctccttcactaagtcattcaaaaatacatattgagtcctacgcttgtcccagatgccatgctagtcactggcaagacaaggtgagcaagagaaccacggtcatcacccacacagagtctattgtccagtggcagattccaagaaaacctgcaattacagcccacaaaactctcttccctttcatgtcacaattgtgttcaatccagattttatctaccttatcagacgtctctatcacagtatcatttgctggctgcttgcccttgtgttaaggatgactgttgctcaggcatccctcctaggctctctttttaccccacctgttctctacagataatttcagctcctcttcagatttcaaccacactccatatgcctgtgatgccagttctctggatctgcaagcccatcagccaccagcttgctagacatctcccctttagtgtccctttggcatcttaaatgaagcatgttcaaaattgaactcattaactttaatatgtactctttatactgtttcccccctccagtaatacttgatttcttggttaattgcattactatctatctagaatattttcactactgaattctgtgaggatagagaacttttctgatcaggcctatatctctaggttttaagaaatttaggaattcaaaatatttgttaagtaaattaagaggttttcttgactcttcttcctcaccgctagcatgagttgttcaagtgatcccctagtcctgcaaattataccaccaaattctctcaccaaatccatcccttttttattatcattctgcctaattcaagccctttcttttatacttttaacatactgtttcttctctgtatcactgtttctatctctgtccctctcagtagcaccctgtactttatatgaaaattaagttttacttcataagtaaattcagtatagatgcaagtgcttgaaataggcagagtttttcatgttcttccaccccaagtcactggttcttgccactgaacactaaactaaacatgaaacattgccttatctcaaagcaggtctttttctcctcacctccttcattcacgtataaactagaattctatttccaagaaataagtcaaaaaaaaaaaaccctaacacctggctaaggtggaggaataggactaggtgggagaggtggcagtgaggttgtttgcttggagatgaaaccaggaaatgctctaacactgctgtgttactacagccccaaatccacatgtgaaaatggcctccaaaatacggctcaatattaggctgctctctttttatcatttatgtacatcctctttcaaagcatgagtaggacacagctttttctctgagcctcactctaaaaatcactgaggttttaacattgtcagaaatttcataatttattggaacatgatattcattttccccttcatcatttcattctgtcccacataagtaaatgtcatcttcatgcccatcaagttccctctactactgattagtaagtttctgttacaatagaatatattgattgtcttccctagttgtgcgtatctccagctttacacagtgtttatggcagggagccccattacctgtgtgctccagaactgtaatgcttcaagtaattccttcatcaggatacagaaaggagatggaaccatctttgggggaaattactaagtgctttttgcaacatatgtcaagactttggatattcgtgatttaaaaactgatctctgatagtttgttttttcctaatgaaggcaggtcggcctgaactatatcacatccagttactacagcctgtcagaggcaaagggctctggttccagtgttttctctatttagtccgtttttcatagtctctagagcaccccttcagatcctcatctgagaggcggtacaaagtcgtggtaaagagtgcatgctctgaagtcacactgacttggctctatcaaagactaactttgtcacttctgtctcacccctttgtgcctcaatttcctcattttataatgggtagatgatatggtttggctccgtgtccccacccaaatctcatcttgaattgtaatccccataatccccagtgtctagggcaggacctggtgggaggtgatgggatcgtggggatggtttcctccatgctgttctgatgatagtgggtgagttctcatgagatctcatggttttgtaaggggctctttcccctttgcttatgcactttctcaagcctgctgccatgtaatacatgcctttgcctctctctcaccttccaccatgattataaatttcctgaggcctccctcaccatgtagaactatgagtcaattaaacctctttcctttataaattatccagtctgaggtatatctttatagcagtgtgtgaacagactaatacaggaaataaaagcacctacctcataaatagttgcaaagattaaatatatgttattcaatctttcttagaaaagtagcttgtgtgaatttgatcctgtcattatgatgctagctggttattttgcccgttagttgatgcagtttcttcatactgtcaatggtctttacaatttggtatgtttttgcggtggttggtactggtttttcctttccatttttagtgcttccacataacaatattaaccttaagtgtaaacgggccaaatgcccccaattaaaagacacagactggcaagatggataaagagtcaagacccattggtatgctgtattcaggagacccatctcatgtgcaaagacacacataggctcaaaataaagggatggaggaagatttaccaagttggaaagcaaaaaaagcaagggttgcaatcctagcctctgataaaacatactttaaaccagcaaagatcaaaaaagacaaagaagggcattatatgatggtaaagggatcaatgcaacaagaagagctaactatcctaaatatatgtgcactgaatacaggagcacccagattcataaagcaaattcttagagacctacaaagagacttagactcccacacaataatagtgggacactttaacaccccactgtcaatgttagagcaacaagacagaaaattaacaaggatattcaggacttgaactcagctctggaccaagcggagataatagacatctacagaactctccaccccaaatcaacagaatatacaatctactcagcaccacatcacacttattctaaagttgaccacataattggaagtaaaacactcctcagcaaatgcaaaaaatggaaatcataacaaacagtctcttagaccacagtgcaatcaaataagaactcaggattaagaaactcactcaaaaccgcacaactacatagaaattgagcaacctgctctggaatgactactgggtaaataacaaaatgaaggcagaaataaataagttctttgaaaccaatgagaacaagaacacaacacaccagaatctctgggacacagctaaagcagtgtctagagggaaatttatagcactaaatgcccacaggagaaagcaggaaagatctaaaatcaacaccctaacatcacaagtaaaagaactggagaagcaagagcaaacaaattcaaaagctagaagaaggtaagaaataactaagatcagagcagaactgaaggagatagagagacgaaaaacccttcaaaaaaatcagtgaatccaggagctggttttttgaaaagattaacaaaatagataggccactagccagactaataaagaagaaaggagagaagaatcaaacagacacaataaaaaatgataaaggaaatatcaccactgatcgcacagaaatacaaactaccatcagagaatactataaacacctctatgcaaataaactagaaaatctagaagaaatggataaattcctggacacatacacccttccaagactaaaccagaaagaagtcgaatccctgaatagaccaataacaagttctgaaatcgaggcagtaactaatagcctaccaaccaaaaaaagcccaggaccagatgggttcacagccgaattctaccagaggtacaaaaaggagctggtaccattccttctgtaactattccaaacaacagaaaaagggggactcctccctaactcattttatgaggccagcattatcctgataccaaaacttggcagagacacaacaagaaaagaaaatttcagtctaatatccctgatgaacatcaatgcgaaaatcctccataaaatactggcaaaccgaatccagcagcacatcaaaaagcttattcaccacgatcaagtcagctttatccctgggctgcaagtctggttcaacatacgctaatcaataaaatccatcacataaacagaaccaatgacaaaaaccacatgattatctcaatagatgcaaaaaagacctttgacaaaattcaacatcccttcatgcttaaagctctcaataaactaggtattgatggaacatatctcaaaataataagagatatttatgacagacccacagccaataacatactgaatgggcaaaagctggaagcattccctttgaaaactggcacaagacaaggatgccttctctcatcactcctattcaacatagtattggaagttctggccagggcaatcaggcaagagaaagaaataaagggtattcaattcggaagagaggaagtcatattgtctgcgtttgcagatgacatgattgtatatttagaaaaccccattgtctcagcccaaaatcactttaagctgataagcaacttcagcaaagtctcaagatacaaaataaatgtacaaaactcacaagcattccatacaccaataatagacaaacagagaaccaaatcatgagtgaattcccattcacaattgctacaaagagaatgaaatacctaggcatacaacttacaaaggacgtgaaggacctcttcaaggagaacgacaaaccactgctcaaggaaataagagaggacacaaacaaatggaaaaacattccatgctcatggataggaagaatcaatattgtgaatatggccatactgcccaaagtaatttgtagattcaatgccatccccatcaagttgccattgactttcttcacagaattagaaaaagctgctttaaatttcatatggaaccaaaaaagatcccatatagccaagacaatcctagtcaaaaagaacaaagctggaggcatcacactacctgacttcaaactatactacaaggctacagtaaccaaaacagcatgatactggtaccaaaacagatatgtagaccaatggaacagaacagaggcctcagaaataatgccacacctctacaaccatctgatgtttgacaaacctgacaaaaacaagcaatggggaaaggattccctatttaataaatgttgttgagaaaactggctagccatgtgcagaaaactgaaactgaaccccttccttacaccttatacagaaattaactcaagatggattaaagacttaaacataagacctaaaaccatagaaaccctagaagaaaacctaggcaataccattcaggacataggcatgggcaaggacttcatgactaaaacaccaaaagcaatggcaacaaaaaccaaaactggaaaatgggatctaattaaactaaagagtttctgcacagcaaaggaaactatcatcagagtgaacaggcaacctacaaaaatgggagaaaatttttgcaatctatccatctgacaaaggatccagaatctacaaggaacttaaagaaacttacaagaaaaaaaaaccccatcaaaaagtgggcgaaggatatgaacagacacttctcaaaagaagacatttatcctgccaacaaacatatgaaaaaaagctcatcatctatggtgattagagaaatgcaaatcaaaaccacaatgagataccatctcacaccggttagaatggcagtcattaaaaagtcagatgctggagaggatgtggaaaataggagcgcttgtacactgttggtgggtgtgtaaattagttcagccattgtggaagacagtgtggtgattcctcaaggatctagaatcagcaatctcattactgggtatattcccaaaggagtttaaatcattctactataaagatacatgctcacatatgtttattgcagcactgttcacaatagcaaagacttggaaccaacacaaatgcccatcaatgataaactgtataaagaaaatgtggcacatatacaccatggaatactatgcagtcataaaaaaggatgagttcatgtcctttgcagggacatggatgaagctggaaaccatcattctcaacacaggaactaacacaggaactgaaacatcattctcaacatcaaactaacacaggaactgaaaaccaaacatcgcatgttctcactcatgagtgggagttgaacaatgagaacacaaggatgcagagaggggaacatctcacaccagggcctgtcgggggttgggggactaggggagagataacattaggagaaatacctaaagtagatgacgggttgatgggtacagcaaaccacatgacacgtatatacctatgaacaaacctgcacgttcttctgcacatgcatcccagaacttaatgtataataataaaaaaggacctagcgtatatagactttctatatttagacattattaacttggtacactcatgcttaaagttgccctgatctgccacccccacccccaacatggcatctcgttacctaaaatatgcttaaagttacaaatcctttgcctacaaatggcacacagaccctttgagatctgtccacactgtgcctctccatttgtatctctcaacttttcctgttaatcgtcagtgtgttttaaccatgtcaagctgcatgccagactctctctggacttcccaaacattaataaatactagtcctttgtgacccagctttctggccaaatgctgtcttctcctggaagattcctggctctagcagttagtcaacttcatatagttattcaagctgtgcaagcttgtatagcctatgtatcgttgcattgtgaccttttttttcccttagggtctttcccacttgaactattccacctgttaagctcagtgcctagcgcaatggtgcactgctgaatgaatgaatgctgtaaatagaaattagtattatatatgtagacatgggattttagcttttattaattaagcttttggtcatttagtgtcatacatcttgaagtttttgcaagggtgaactcacatgaaatatacacatatgataaaaactacctccttggagagctgtttcctggggaatctatagatggtcatgctagctatgactgttctctagtatatttttggaaatggatcaaacaatatactatcccatttttttttcaaatctgtttccctctgaatttctcttgggttgctggacactggcaccctctgtcacagctttcttgctcccacagttaggcaagcaggaaggagtggtacccagtggcttcccttcttcgctcccatagcttggcgggagggagtggcagccagtggcatcttctctcccattgttcagcaagcaagagggagggttacatcttttttactccagctgcctgcagctcggtgagctggagggagtggcacccagcagctttttcactcccatagtttggcgtatgggaaacaatgttacagcccttttactctcacctcctgcagctggtgagcaggggtgttagagctctttttgctcccacagttcagcaaattccgggttcttgtcccatgactaagaggaatgaagtcacggacaccggagagcgagtaaggcagaatagaattttattgagcaaaagaaaagctctcgacagtgagtgggcacctgaaaatgggtagccatctgtgaagctgagtccggggttttttatgcatttggaatgaggaagcgcaggctgtaggtaatcttagaaaaggcaacattcgattaaaaaatgataaaaaagcattattcagaaagaaccaattgaaaaagagtgggtaacaggaatagaagttctcactctagttcatggactctatctggaattggtagtttggttttcagacttcagaggatccttggcttgtaggtcaagtttcaccagggacccatccctgtctgcctagaaatctgtctcctgacacctccattcaagtgtcatacatcaaaaagctacatattatcaaaatgtgtttccccacagacagattcctttgcaaaactggatgggagtgaacatcatggctggccgtcttgtgctgtgtgacagaacattaacatgcccaaagccagaggtctagaagacagtgtccctgccacagagggagcctccaacgtctgaaagtccgacagcattgactttaactcattgctttataaaaactgtaaacaactaaacccatgaggcaagagccaaagtattacagctcagtcaggccacaccccctgcaaactgtttctggataaaacagtcataacattggcttgtgtgctgggatttcacagtttaaaatatgcatgattagtgcctatgattgatgtgttaactaatgaagcctataccagtttagcagataatgctggcaggacgtaaggtgtctcagacaatttcccatgtggtgttgcatcagtctaaatccctttgaggtcacaggcaggatattggtcgattttaatgttgacgattatccaaaagaatgaccacatcatgaacacattacataatgtggtgggggtttcagtcttcatatggacaaaagaattctaacatcctaatggatgtaccaaacttctggctgggatagatatgaaatttagagaagagatgagagctgccttgtcaacagattggctccacatgccacatgttggcataggtaagagatgacatatgaacaaaagcagttgtcgaatactgacacaagggagctttcctggactcagtgagcatgaaatagactagccttaagcagtggtcacaatgaaatcatggctaaagaatgtttccgtggggctgtctctgaaggcagtaccccagagctccttcttgctcagcacccaagacaagtggaccacagagaactgcagcagtccaaatggagccgagggcagatccattaacaaaggccccaactcacatggaatggaatgaatgcttcaagaaacaccaagcctgaagccgggcacgggggctcacgcctgtaatcccagcactttgggagaccgaggtgggcggatcacctgaggtctggagttcgataccagcctgaccaacatggagaaaccttgtctctactaaaaatacaaaattagccaggcgtggtggcgcatgcctgtaatcccagctactcaggaggctgaggcaggagaatcacttgaacctgggagccagaggttgcggtgagccgaaatcacaccactgcactccagcctgggcaacaagagcaaaactccgtctcaaaaaaaaagaaaagaaaagaaaagaaaagaaacaccaagcctgatgcaaggcttggaagagcagactgcctgcagctgttaaggctgtgtggaaaggcactgtggaaaatggaaatcaaggaaataaagcagagattcttcatggcttgtcagttattttactctaaaggatatttcaattgcaatgaaaggtttaaatagacaggtagctacagtacaatgtttgcttctcactctggtacacagcatggtggtagttgtctacctgtttttgttgttgttttctaattcctcaggatttaattaatgttttacattcagtattatttagacaagctcaaattataatcattatatttacctccctaaattttattactatttcagtggcctagggggagttgtttgcagatctaaccttcataatagtctattaaatggctgccaagtttcaccacctcgatctagtctgtgcgagtagtgaaataagtatgcatttatcagcctgtgcaggacaaatctaagagtctcctaataaatttaaaagagcattactaaattcctctttaaaaaatgtaatgtcccattattagccctctccaaattcccaatgtcattagaaacctcaaggtgtctacatgctgatagcatttttaggggagagggccttggattcaagataaagagtcctaacttctgcagatgggcattatttcacaatcaccctttttttcagttttcctatctgtagaatttccctccataaatatcacatgaagaccaaaagccataagtgaagatttataaaatatttttatcataagagtgatatgccacatagcatttgagggaaaaaaaaatgcactgaatgaccagacctacaggaagataatcctttatctctacagattatttctactttaggaaaagaaaagggaaatttatggcagataggagttgagagcagcagaagtgttaggaggaagaccagtagagcagaccagccatgactgggttggagtttttatagggaagagagcaaagagattttaagcgggtaagacacataggtagataaaaacaactttttaggaaggttaattctgtattacatgatcaagcttatgtcaatttccactttgcagtctcttcaggagatttcagcaggctttctttttaaattttctttttcaaaaaaaaaaaaaaaagtaaaatattccttatctgcaatgcgagctgagcagcacagtgctccttggtatttataactcatttcccttcctgagctagcatatacttttaagccaaaaaaagatatacccttttccaagaccttctctgtcttatgccaccaaggaattccacttcagtagttgcaaaatcaagggattttcttttcctttatggttttggagactccccaagagctaaagcagaaaaaaatcaacactagatggccctagaagatgtactcttcatggttttgtctcttgtctgactgcccggagaagagttccttaggcatttacaaacacagcaatgccaccttttagccccactctttagggattttacatgactaattttaattgcataaaaggaactcatctttatcttggtgtgtgcagtgcaaaacacttaatgtagggtctgactctattctacagtaagtgcagtaagtgttagctactattacctcatcagcagacctgcaacaagagagtcctttgttactacagaattctcctgccctaatactgccaaagtctgcagttctagctgcatatatgcagttcctggtgcattggcggatctcaataatatttggtttgtggatatacaagtgaacaaagggctttgggtttttgtttttgtttttgtttttagcagaaactaattcatctggctaaataacctaagaatatgtaggaaaaaaattacaaccagaataaattcttgtttgctctttataaatggatcattggcaacctttgaggtaagatttgatgcatctcttcagtagaaattcagcaagatcaacctcctcattatgtggagcagcacactgagtaataagaaatctggcatggctacagtatcttgcacataggccatgctcaataaacatttattgaatgactgtcttgttaccaagactttgtagcaataagctttaggggttttagcctgaccatctgcttggctgggatgagtcgtgatgatagttcacattgggtttgtgtttaccagttcctaaaattcaagtgtgttcagatgtagatcctctgttagaaaatatagcagtatctgaaaatgtcttgcttttcaaataaaaggtgcagaggtgtgagtgtttttgcactgttggtttcagatggaaccacaagcatttggcagcatattgaagaagctgtcacaatcgagcttttcctcttggggaacctcaaccaaagctcagcggtcatttcccatggaaaactatgtgcctttggccagttgtgctaagataacttattggcctctctgatgtcagctaatttctgtccatcagtcctcagtgcctgagtgactttcctccaattcatatgaaagtatgcagaaggaaagttttacagctttacaacacagagcaggccttgcctttttatcccttggctgtgagcaccagtccttagccacatacattctcttgtattctgctccctttcctgtcccacattcttcatagatttttccacgttttctggaaaaaaaaatcaagaaaagcaatttcctaagataaatgctcccacctgcccttgttcttccagaaacacggatgggctggttggttcgttggtatttcccggtttgcttcccttttccctaagtgcgtcactgactctttgctcccgggagagaatgagcatgtggaagccagaggaggcctgttcacgcccctctcccctcctagcacctcccggcctccttccttgtatgtgtttccctttaatctctcaatcttacatctttcatatttgcaagagtgtacagaactatttgaggagagagaactggagatctagaacttttttttaacagattttatttgtcatagttccttaataaagaggaatgagcatctcatagatgagtgcatatggatgagcatgatacagcccagagcccacctgagctcatgagaaaatccccccagtgaaaagcacgccggggtgagggtggagcggagcgtggaaagcaaaccaattggaaaggtgttccctgtattaccaagagcccaggagtcagtgtttagatgttcacttcttgcaccggctaacatgacatagctactttgtgtcctcaagcaagtctcttaactctcagaaccttagttttgtcatttgtaaagtttgggtagtaaaggctgctctcaccacctcacatagtagctgcaagagtcaagtgagtttttttttttcaagtgagatttttaaaaagctttgtcaattgttaggtgctttaaaaaagtcaacagagagtgttataactgaaagagatactttaaaattgctatagctacctgctattaactaaaggcattaagaaacttgaaaaccaacaccaagaaaaagagtataattaaattccccgacaaatagtaatttcatcttattcaaatagtcttcttctgaagtgatctcagaaaatatggagctatttacaggattaatatgtcctaacttcccttttatgaggtaaataaagggggaaaaagctaaggtcatagaaaatttgagggttattggttgccagaattggcaaaattaatttatatttctgctttgaaacctgtttagtttctgtagaaaggggaacttttcaaattaaaactgtagtctgggtcagaaagctatcaaatagccaaggtaaaatagggaggaatccaggattttcccaccattcactcgtgctgttgactcctgccttgtgggcctcatcttggtcaggagctgccactcaccttttctcacctgcagaggctccaccaacctaagtgggaagattggcttctgttaccaagaagcagagcataatgctaagggaaggatagaaaaccctttctgttgtgtttcttctatacttgctcatcatttgacattgtttttgcactcccttcattccttcaaatctcatagactttctggattctgagtctcagaccttgaactacaacgtatgcgtctgtctgtctcctgtggtatgtcattacttccagatgctagtatggaaagtggggaagaattaggcattggaattatgataagtctgagtccaagtctcgactcttccactctccttgcacaggcaaaggaaacattaggtattcaaaaatggccactattattatgtatgtcacttctaaacccacaactgatttatccattctctaaccctttacttttgctgtccttgcttgcttgcttcaaagccaccccttcttgatcctgcatctctgtctcaaccttttatctgatactcacacctgaatcccctgccccagctctgacaagatcatgaattagagtttcattgtagaaagatctatggtgaagagatgcaatgaagtatcaaggtaattcccttctaaatggaaaatgaccatcacaagtatttttatgtcccagtatttcattttagtgagatttttaaaaattccttcaggacatgtaagaggagaaaaaaaaagaaattcaaatagcaaactaagaatgtatggtgttcatttgtaataagcaggaaagttaaatatatttttaaggagataaaggagctaaatcataacatagctgccattcattgaatgcctactgtatgcaatacaatataccaggtgctttaaataagttattgagtttactcgttgcaaaaaccctatcagtaattagcactattattattctcttttataggtgaagaaatttgggcctagaaagattagtctagttacctaaagtcacgtgatctgtatgtggtagagccaagattcaaacttgattttacttttcacggcatagcgtgctcaatgtagaaccagcctgcaagagtttcctcaaaggctgtgtcacaccagggccacatataagctcctgggctattctatcataaatcagaagatacaggctaagttataagaataagttattattatagtaagagtgtatgctatgttaaacagaccattaaaatgataaaattaaataataatcactgacatttattgaacacttgccctacgccaggcagtactctaaatgctttgtaagtatcaatttagtttatccttacaacaatccagtgaagtacatattataattattgccattttacagatgaggaaattgagcacagagagttaagaaacatgcccaagtaagcggcagttaagaattaattctaggcaataatgtaccagagcccacatgtttaccctctatccaatacaaactgcctagttaatttaatcctgtgttctaattcttttgaattctaatataaagcacattatcttgtaaagctttagtttaaaggtctgccacataagcaacagggcctgctcttcaccatatgtgttcataatctggataattccctgatggggatcatttggagcaaacatttcttatggaatgattttctatgactgtgctatgctcaactgccggagcacttcactgctatacctcaatggaatgccagcgaccgactgtctttctatctacagttaatttggtggctaccgctatgctctcaggagccagttgtctatcatatccctgcataccccacacctttagtccactccaagaacttgctccccacagtaggcctgtgagtctgaggttatatactcttattctactggcatcccattagaaactactttctgcggctccaatattccttctttattttgtcacttgggatttcaatcagatattttaaagcttcctgtcctttgagccatattattttagattctctaatggtgggattatacctgtaattttttctgaactttttgaaacccacttccctaagtttagtatatatgtctgaatccataaggctcaacaactcttcttttctgacccaatcgcctacttctcccttgcctctcagactcttccaccttgtttgcaaagtttgtttgcctgtctctaggcaaacctctatattttattggaatgttccctttaccattttgctctggtaaggtaatatgatcagtttctacttgttttgaatagaatgagattgccaacagacaggcagctgttgtcggatttggaatctgtattagcaaagcatcttccttgtttgttctccaatgggatgtctacgtgtagaaccacagtgatgtcacctcacaccttcccctactaccttccaccatgtgttaatcttcaagataatgaattctcctctgctgtgtattttcttgccttagtgtgatagggaccaatatttatcttaaaaggattgatgtaaatcttccacccaaagggtttagtttgctttgttgcagtagtttttacaactaagatgacatattcatgttctggattcaaaaaccttttaatcttgctaatacttggaacatgtattagtacttagcagtgtccaccaactgctttttagttcaccttccacttctcaagggagtgctcagtaaatagtacatgctcaattaataatagttgacattattattattattagagaaaagacatataaagttgcagttttccaagagacaatatgacttagcaggcaaacagaggatattggcgtcttctctgccatcccttttgacaccttacagaaccttggtgagattaattaattactcatcttccactgtccctgaatgcaaaataagggtgaccttatttcagaggaaaggtgacctcttcctctgaaagcttcatgacttaacaaaaagtaagatacattgaatcatttgaatgccaactgtgaagaataaaatattgagtaatgcttactcagttctttaaactattgacctagccatggagttagcaccaagatcataatttctgcccttttttgaagataaaaatcaccatcagaattgccagccaaggtaggaaaattgaagaggaaggttacagtcctgaagagcaagcactcatatgggagaattgggaaaggcaataatatagcggcctcagaagcctggtgaggaacaaaagtataaatgcccaataaccttatctataccacaacatataaaattgggccttggcccagtcactcttagctaataaagaaatttatctttagaactgtgaatattatagtaggactgggatgtgctgcctgcattcccacttcgagactgagcctctcattttcacagctctgagcagagtccttctccagaaatcaccctctgctgagagaagctgcctctcacaatggccatgccccctcgctgaggacagcctccatccatggataggttcagagacttagcctcttgtctcaatgtgatacaactctaaagaaccacccactcaggcagaggctgccgcaccacaggtgaacttctccctctgccacattctgctctgtccccccacaccgatgttgttcctgtggctacttcccaatgaacctcctgcacacatgtctcagaatctcagaatctatttcctggggaatccaacgtataacgtatactacctttgcattctaaggagcaattacaactattttcaattttaagaacatcatcaatcatacaatgatcacagaattcccataactaagtgaatctccctcttgacctttgtgtgggctgcatttgccatgctatgtgatatgtagctagtttctcaagtgcaagtgacttgaatggcccccaaataggggaaatattctgaggtattgagactggccagttaccgtattatacttatgatcatttccaaaacaaaagaaaaagatggcaagtaatcaatactccttggccattctgttgaaggttggtttgtgactagggagactgtattagctcctgagggctaaattaccacaaacttggtggcttaaaaaaacagtctgggggctagaagtctggaatgaaggtgttggcagagttgattcctctgagaccctgagggagagtttttccgtgcacctcccctcgcttctggcgttgcctgcaaaccttggtgctccttggcttgtagatgcatcactgcagtctctgcctctgtcttcacatggtgaactcttcggtgactctcccgtgtggcatctccttgtatcaaaagtagggcaggcctaccctaatggagtatgacctctcacctaatcttaacaaattacattggcaaaggccctatttccaaaagaggtcacattctgaggttctggataaacatgaacttttagaagatgctattcaaccctctgcagagaacaactgaggaaacaaccaagatctgcttcccagttgatacctgtatttgtgctgtggatcttttaattaactgccttaaaagaaaacacagtgacccagatgtgtgcagtgggcgccacccaatgacagaaggctccttgaaggcttaatcaattagataattagtaggaccaacagggagttggtaaagcagcataagtaaaaccagggaaaggatcattacccagactctgaccattaatttttagtcatactgaaaaaaggagctttggggaaaagacagatttgaagagatattttattcactctcatatacttcattttctaaagcaacatgatgtggtagttgagttcacacagtaaaatattagataatttgaggaaaagacctaaaggaatgctacacaaatatatttagtttggccacataaggactccacgtatctcaggtcatgcacaggggtagcaagtcctgtcttgtgagttccataactttgattcctgcaggaagaccccagagacctgcaaaaagcatcctccgtctactaacatcctttctctcatttttccctcttacctgacttgattataaaattaggaaatttaaatttaggaaataatgaggagacagctagtaagcaaagaggcttcccaagccacacacacacacacacacacacacacacacacacacacacacacacacacacacacacaccagaacacccttaggaggcatttctaagcatatccatccataaaatatttttctgtttgctgtataagcagaaaggtttgcatagaatatgtcctttgtaatggcttttgcctctgagctttctaacactagcattgatcaattatcatcttctccacaatagactaatgtttgaacttggaactcagttctagaccagacactagaatactcgtgccatactttcggaccaagccagagagaatgacttcacccaggagagaaagataagaaaagatcttgatgtgtaagcctcctttatttacttgccatcaatcaccaaaacaaagtggaaggaagggaaagggaactattaacattgacccatataaaattgctgatattcaattggttttgacttttaaaaattgcatttgcaagtgattctacctaatataaaattgtatttaaacaactactttttgccagtcactatgctaagtgccttattcttatattattctttataatcctcaatgtaaactttcaagattggcattataatctctattttctgtatggaaaagctgtggcacacaaaagttcaataatttattcaaaatcccataatatttgaacccacacccacttcatgtccagtaaagtcatttgggtctgctgaagtatttctagactttatagtaagattattttcaaactctattgtcaaaattcttgaaattgcaaaggctactccgtctacaaacttcaagggacgtaagaggatggttacagactgtcaagaggatgtctgtggtacatgggattggtaatgtagaaattaggcagtgctttgaatgttactgacaggtcacagcacactgacagcaacagggaagaagatattgtggaaaataagacaacctcttgagaaggtcatctcagtatttgtatcactgatggggtttacagaaaagcagtcactttatccactggcagctgcataagttttaggttgcatttatgtaaagaaacaaataagtaacaagcaagctggcattggtggtttctgggactgaggaagaggagggaaaagaaacccctagggctatagctgtaacatacttactcattcgcacatttgcagctctatgtgtctttagcattctgtgaaagctgatgttcataatgttgatcatggaacatcgagacaatactaaattatgtttaatatagacttgttgagaagcagagaaaaggatattcgttttaagcaatttcgcagtattttttttaataccctaaaacggcaaagttttagctcttgtagagttaatgttcacctttctgggaaaactctgtaatccagaatgacttattctctgagaaatccaggtagtttcatacatgcttttgtaccaagtcatattaaactctttcattcatagttttgtccatgcttttgtacttataataggttgcaactggtataataattacagtagaaagtcatttattatgtggatctattaacatctgattcctcattaagcattaagaatattgccaaatctgcacttttattctttctgctgacagttagttttcacagtgcttcttgatttacttttatgattgaagtttcaggaataaatgttttaatttaatgttccctcagtataacagatttgactaatagtttaataaagggacaccgcaagtttctaatagagagaggtttgcttgtgttcacgagggatgatgcgcacatcttgatgaaggctgcccatgacccactgtgtgctgcacgtgtccgtttccatccgagcatctcagcacagcatttgaagcaggtagtgagaatcccagtcatggccaggaaggatgtgaagggctaacgggggacctggatattttggagggcctcagtcttcctctcttgcctcttctcatccctctttacagaatatttcctaggctgtatccccaatgaacttctatcgatttccaatacaacccatatgtctttgcacctctgtgtgcatgcccttacttctgccagaaatcctccttcatcattctcctggtgaactcctagtcatcttctgcaaggtaaagtccttctccagaacttcacataccctctcctgcctgcctccctccgttactacccccaggactctatgcataactcttccagtgcattcagctccaaattagtcagagttgcatttagcttaaaaggatgcttcaccagagtgggtactgtgcctatgtagcactctgccaccaataattagcacatttaccttttaaaaagaattgatctatcagctgtattcttatggtggccttctacattaatgaatgacataatgtgttttagaatggactagcctgggaagtaataccaagatcttgatttttctaactttcccaatggtttacatctatctattctagattgagattttgtttataactttgagatttaccttgtgcacaatttggaaaagggaaaacaaacatccatttattcataaaatatttcttaaatgcctcagtcttaggtgccagggaaagtctgttctcggcagcatataatgcttacagtcaggtcagattccttgataacagcagggaacaaaaatgggaagaacaggcaggctttccggggcagtgttgatgtggtaagtatgggaagtttggcattgggattagatttttcctaccctgaaaaccatcaataaaaatctctcctcaaggctgaatttcttaattaattcatttcaagccattaacagagattttaaaaatatggtctatgtcctcagatatctttcttttgagttgagcatattcttcatacggaacaaagagcaattccaaagcaaagtgaaaactggacagaatggtgtaataacaatcactgacttactgagtacttactgtgtgctatacttcatgtatatatattactcctttaatcattataataacactgtgagtaaggtatttttagctctactttacagatgaagaacttgaggcacagggaggttaagtgctttaaccaaactcatgcttggatgagagcatggccttgaacccaggcagttgggtgctaaaggttgttctcataaccaccacgttacacttcctctcaatgcttaaaaaggaaaaattatttactcagaagtattgaaagagagtagagcaaagaggtcctggagtggcctagcatgacctggcatggcttcttgcaggtagagagatttaagccaatatagcaggaatggtagatgttggcaagaagtctacgtgaatggaggggcctgaaaaaaaaagcctaagtctgggcatgagcaagatgggaagtgactgatttggcaggcacagttgtctctcacacttaacagtacctttcaaggccagaaaggatgttcttaattttgaaactcatacatcaagtatagtggttaggttgctttttgcactgagctgtggagaaaagtacaggttgttacaaacctaattaagataattatttaatagaaatctattttaaagttttgaaaaatgctaacaggaatcaacttttaaggataatctattcagagtcacctcctattaacagtcatgttattaaccaactcagggcaaagcatgattatataatagctcaagaagaggtagtgttgtctcattttactttctgggacctaaacacctagggaaaaataggtgataaaactgaagctgtcacaatccagcctctttactcccaaagtcagtgccacacaattaaaataactacaaaactcagttaatctagatagtatactataaagataatccttaaatatgggtacatatgagtgtgtgtgtttgtgtacatgtgtgtgtttagttagaaactttgaacacagattgaacttgaaggcatttcagcaaggagagatatttggtaggatatgaaaatgaagtttacggttggaataccttcagaacctcaagtgcagcatcctgattctgtgaagattatgttttattcctttacctattcccacgtgtaatactttattctctttgaattggcttctaatgcaatttaaccctgtttttgagtgtccactagcttaatttcttttattaatatgaattcttctccttcctactgaataaacccagctaatgtgtttttttctcctttatcatttcatgcaaagcaaaaagtaaataaggaaagaatatgattttcgcttccatttttttccccaagcctaaacaatggaatcggagaatctgtttttgaaatctggaatcttagtatttgctgatcctatggaatcaggacacttgattagctgcgagccaagtcatcaggcccacttaatacaatactcagtaaattaattcaattttactgatgtgactaaaaactaaatttcatatcaatataaacacttattaagctgcaaataccacatcatgcaagctgttgaaaaagactcatttttatttatagatgaattctgataagaatagcattagaagtattttagtagggaaatgttagagtgattaatgtgtagttgtttgcatttttaatatttcactcatatatcagattaggatttgtgcatactgtcagaatttattctgttcttgtcaaaatacttattactgctgacaggtataacatatccacattaatccttaattccttgattcaattttctaattgcttttttggcatgcgatggtggccatttagtcttatgtgatgtattcatcatatggtataaaaatgttctttaaaaattagatgtgccatttaaagtaactgagcaggaagaaaaaaatactaaggattggaaattttaaatttcaccatacttagacaaactattagatactggtatgtcacagattctggaggttgtccataaatcatagtcacagaatgttaaagaggaaagggaccttaaaaatcatccaacctacctgttcattttccagttggggaaactgacttagtaacaagcccaggatcacacagctagctagtgggagagctggtctgagtacttatatgttctgatcactagtcagaaatggggtaggtatttgcatataattgttataactggtattctaaattgatttttactattaataggctgacagaatgagagactccttagcttcttaagctgtatgttttagtaatattgtatagtggctgaaaacctagattctagaatcagagttccagtcctggatctgcccctcactagctgtcttaccctgagaatacagtctgaccgctctgaatttcaattacttcatctgtaggaaatggaaaataacagtatcctgctaataggactgctgtttaggttacatacaataatgcatgtaaaaagcttagcatagcacttggcatctagtaagtactcagtaaatgttacatattattattattagtgttttactatccctttaatatccacaatttggagagaaacttggtcatgccttgtcgcttatttcaccatgtgacctctgtgacaacttcatttattcattcattaactctttcacttaccatgtgcaatgcactctagtagttgctataggtaagacaagaatctaacatgatatctgccttgcagaagcagggctatacaacatgtacatcaataagtataataaaacattgggagacataggtcccaaaaaggtggcacaagcaccgtgcttggacatttcaaagagaggaagtgagcataggggatatagggatgaataagaaaccggacctgttctcaaggagcttgatccagtgggaaatagacatttacccagctgttattcaaagtagaaaataaagagggtcacaaaagttaaagttaaagaactaaagagggagaaactaaatatctcagatcagagaaggctttatagatgaagtgacatttgagttggctttgagggacgcataagatcaggaacgttggagacctgtgggaaggatgccttagacagtaggaagattaagagtgaagaaggcacagatgattctgaaaaccctgggaacagttgttgaacagttattaatagcacttaatttgactaaaaaatagagcttgtgcagaataaaggatgtgattagatgagtatgtagggaatgtcattttggactcaagcctcttttgacccaagacatggtcagcacacgttttaagagttaatgtctttaaagaactttctagttagtacccactactttttattgtcttactctagaggataagtcagtcttcctacctattacaggcaatatagcataaagttaagcatacaagctcagaaaatggactgcattggtccaaattcctggttatgccacctattaggtctacaactttatttatgtcacttgaactcttagaccttcagtttcatcatctgtaaaatggaaacagtcagtgtctcatcgggtaggtattgacatcaggcatatagtaagtgcttaataaatgttagctattattactgtgttacccacctgtgccttgaagcgacttagtttacaagttctgctttggaactactgaaaaggtttttgagaaaggatgtaacatctttttaatcttgagtccttgaatgttctactaaaccccacttaaattgtagtgactcgtccaaggacatcagataattctgttaagccctcacctgctggaatatggtttctagtgatgggtctcagtgtgatttacagaagtgaatccctcactcgccattggagagggccagtggaagaacaagtagccagctttacccattgatgttttccaaacgtgcagtgattcatgtagcaggagtttcccaggattgatcctgagctcaaatgaacacctcattttcagaacaaattattaggagttttaagaactataccttgaaaatcttcatgattctagaagcttctctggtaacatttttttctgtttgtaatagctgaaaaatagaaagcatttaatatagaatttttgcccctaaaacagcaacttgaaaataagagtacaacagttttaaaaacactagactgaacaaaagcagtctttttaaaagtgctgtgggcctaatacacagggactgctaattacgtaactgtcagtgatgttttctggcagagcctaacaccagcttcttgcagtacaacgaatatgaaaatgcctagaagtaaatcacagttgctgagtgctgtgggcaaacaaacccaggccttatctctttgaaaggcagcaatggaaaatacatgataaattgcacagctcagtgaacatgttatgtcattgtgaaatgattttgattcatggttatgtagttatcacgaaacaactgccaaaccccagggtatcagaaacattatcatttgtggggttttgctattttctgttgtaaaattcaagtgctataaagagatgtttgggtttttttgtatataaaattctgtattgaaagtgatatttgccacatactctttggaaataatattttaaattatgtgaatttcttccagaagtatcaaagagctgtgctagtaactaatattttaaacagaatgaataattcatatttttgctaatatccttttatgaaaattattttacctaaaatagactaagttgtaagtcaatttgattttttaaaatagaagtataatctccttttatatagcttatcaatatacagaaatttctgaatgttttctatacaatagcagtagaactaagaatgaaagagtaattttttaaaggaagattttatagaagtagcttttatgcaggcataatttcctttccacgtttgagatattctactccactgtccttatttgttgctaagtctctgaagtttaaagtgttaattagaccatattccacctgaagtttagttattttttgttaatttttttctccgttgatgctgttgatgatttgatgttttgaaatattttctgcttgtgttaaaagtggcagaaagatagcctggcaaaaagatcaaattgatgtactactgaatcatttgtcgtttttctcaatctcctaaaccaagacccactgtttctcaacttttttgtataaacatacaattctactgttctaatttttgcagtcgagttttttttttaacatgcctttggatatgctgaatagtatcagttaatacactgagagtttaaaaagaaaaaacaaagaaaagcttgcccgttggtagaaatgattgattgtttcttaggtatggtttttccaatatatcactatcgtttaaaccttgagtttattttatgttctgttagtatattttaatcaattgacctttacatattgtttgcatttattaaattaaaataacttttagtagcctgtaaatatgatttgaaacatttcatagtatttttcttttagctttggaataagacaaacctattctctaaatatttacatcactggagaatatctatgtacttatgctgatttttacttaacattttcaaaaataagtctgttaaattaaatgtaagctttaaagtgtaaaaccatagatcatgtaacttgatacaagtattgcaacatggcttacagcattttcttggaacatttttatgccctttgcttccaccaccatcgccactttcacctttatattgaatgctcccaaaatgtatctatatgaggataattttaaaacatgagatttatgttgctataaaggagaaatcctttataaccacataaaaccattgtcaccagaaatttcagtccaagttttacaagaaagcaggcatattttatctttaatgcctcattaaactttctagaaacgacagtattctagaatattctaggtgaatgactgcatatgtctgtatttcttcttaaaagtttaaatatcatcagtgaaaaaaacctgaacaaatcatttgttctaataattaaagccgtggtacttattcttctatttaattttgcctttcctcagaaatgttgctttgatatatcaaccatgtctcttctatagctctttaaatgatggccaaaactaacattcctaggctaaactgatagcctcactattccaaagatcacattgtgtttaattccaaatttcatatgtggatttgtgtacacgtgtgtacttgtgcatatgtttatgtgtacatgtgtggaggtgcatgtttgcatatgcacacatgtcataagcctgcattgtgtgattaagaatgtgaactcaggaggcagcctgcctgagcttaaatgctagcccaactactgctaactagctatatgaatctgagcaagctttgttaacctcttgcttcagtgttctcatgttacagagttgttgtgggtttaaataagtcaatatatgtcatgcactttgaacacctaacccatagtaacaacttaataaaatactagctattactattattattattatatatttatttactctatgttatttctaaagttatctatacaagtgcattgatgggtgattagtaagtaggtatttcactaaaacaatattaaagatatgccaacctgatctcacatttacatgtggattcttaaaaaaagtcaaagacatagaaacagagaatagaacaatattcaccagggacagggagggggaggatatgaggagatgtaggtcaaagggtacaaacttgcacttatgtaggatgaataagtctatagatctaatgtaagcaggaggactgtagttaatactgttgtattgtatactgaaaatgtgctaagagagtgtattttaggtgctctttccacgaaaaaataggtagctgtatcaggtgatgaatatgttacttcgattgactgtagtaattatttcactatgtatatgtatatgtatctgtgtatgtatatgtatatgtatatcaaaacatcatgttgtacaccctatagacagtaaaaataagaaaattaagatatgccaacagaatattttgaattgtgatcacttaattagataaactatgctatgttatacatcattggtgagaggaaacaattgggaaaaaggaacaaaagttgcataactttgtggctcacaagctgctcgtcaaatatagtgaaatttgttgatttattcaagtgtaggccaagtgcacatccatagtgtgcaaggagctagtgttaaaataacacatggtgtgtcctgaacaactaggaatgtacagcacagctacctaaaggatagataaggtgaaaattaaaatagcaatgctatgtcaattttgcaaacttaaagtgggttttctttttcagggggcacccaagccaattgccattgaaccatgtgctgggaacagagctgctgttctgactgtgtttctttgtctaccacgaggatcatcaggtgcccctccccctgggcagtcaggtatgataaatgaggagccttcagcagttaagcaaaacttgtagactgaacagaagaaataaacaataccactaaatagcgcagtaaggacctttgcaaggttctaatttagagcatggtaaaattttatgagaatacaaacttttacccaactatctagatacctgcattgttataaaggtagatttcccagtgtttctccgaaaaacacatgttgaatatgtgtttatttgtgtattatacacacatgtatgtatgttcccattaattgctggaattacaatgagaaatctcattagaagggccaccatgttctagacccttccagccagcttcctttcttccagtatgtgtggcatgttggaaaccaaattataaatatgattagaaatttgctttgtgaatgtggaaccaaactagggaacgtgtatgtttggaacgttgagtggcatcagaggatgatagcttcacgcaaccatctcagtaggtttaagatatgccattgctttcagcaccagctggagttcatggaccagggaaaccctctgtcttaggtgggcacagccagcctttgttctgattctccttttcctgtaggaaaagcatgtttttgatttcaggataattatacctgtcctcttagagctctgctcattgcgatggtgttgtccacattctaagcatgctcaatgttgaatataaatcatacttaaattacagaccacacttttttctctctttttgcatatactattccatctttataattttgaatttttctgtctcctgattattttatctatccaaccactactggaatgaatgctttttgagggcaagggtgatttcaaatctgtttttctcttcaattccccttaagcataaaataaaatgccagcaagctggcaagttctcaataacagtaattgatgatgaaccggcctccttgcttattttatcttttcttacttccctacttggctttgaatttgctcctcactttcttgacttgtgtccaaccagacacaaaaaatggaaaatgtactactttatgccttgtaaacgttaggtattcatgtaacagaatttttcccatatatgggagcagagagtttccatcaccttcagattcatcattcatggtacctgatgatatcttattgcagaaatttctatccaaagttcatttatggatgtttattcaaagaaataaacattttctgcaccttttcatacattgagtgaatgtcttgttcttttcctttcagcacctccaaggtaaatgggatgcaataagtaaaatagtttggcactggtcagataagatggataattataggtacttgcacagctaatggaagtattgttttaaaactgggatgatttccaaaacaaacacttcactaatgaaaacaagtctgtgtgatatacaccaaggtttttctcgatccttcacgagatgggcagactgaaggcaactgccaattctctgtccctttaacctttgaagtcctttttgactgatatgaaagagacaagtagcagtgtgaaccattacctcagctgtgttttctaacaactgcattatgattactaatgttaatgttatcttagatatgcatagtactttactctttctaaaatgttttttctgtttttcacatgtgatcctcatgacagggttgtgagataggtattataaaactaacatcataaatgaggggagtgagacgtagaaagcactgtatatctacactcaaggaataattggggagaggggatactagagtatagagcaaaagaataaaaaatacttactgctagcattccaggtaattgttcctgatgatttgtagcagaaagcctctctaaaatcaacagcccatgtctttacaaaagcaagcatttggatgaatactgaaaatgtctacagggttgatagagctagacaaaagattgaaatagcttaccatactttttacagagcctgaggatgaaactatgatgagtatctgcgtacataattcagaatgagcttgttctttgttttctaaaaacaatctagtagatttttcaagctcttagaggagtaagacagtggttctactctttaaattgcagcattatctgttatctgcatcaatttggaagatgggtaagaggggtagatggactgatatgtcataaagcaagtaaagtaaaatgttaatggtaggatctaggtgctaggaatactgatattcattataaaattcttttaactttgatatatgtttaaatatttaataatgaaatgttgggaaacaataaaacaaaatgtcttgatttcactgcaagaaaaaaggcagtatctgtagagaaaaatttttccaatatcatcatctaggttttcccagaacaaggcaaatactgacaccaatatatgaactaagtgactatttttttcagtgctcgtccaaatatttagtgtatgcacagccaattaaaacttcacatatttgagaggaaatatatcccagtgattatttgggaaccatattggctcttgggaaccaaatgctgacactggttatctcattgctgaagtttggtttattctgtgtcttcacagaaagtccttatatatgcctgtgcttatcccagtgccctacacatagaaatcagttaataaattattttgataatgatgatgacaatgataggagacttgggaaatgtgacctttagcaaccacttgaatctgttagcttcagctaatttcagtaaaatgagcaacagagttcaaattcatttaccctttcccagattcctctcctagaagccctctatgttctcttgagcctcctccactatttgtgcagggtgacaggttgggggagttgaggaggaggtagaggtggagctttgttggcagactcctgaccccaaccccactgtgtgaaggacagggtgccaggggtcttctcttggctattgggctatttatttctccaaatgttagtgtatctgttcagttattaaattagcgttcattattaagagtcttcttatagattaaaagtcttatagtactttgcataatctcaaatttttttgtcaggctccttgtttgaaatgtagcttactaaaattttttttttatcaggctccttgtttgaaatgtaacttactaaatgtcagtgtcatgtgtactctccgttggcatgaataagagcatttaagaaggatgagcttgaggatctgcaaaggcagaagcatcctatgagcatggtggatttctctcacacagtgaatttcaaccctgaaaatgagtgacagaaatgcacaggagctagtttggccatctcttttcaggagcagctagtgattttttttttttaatttaaaaaatagcattatctttggacttgattttctttccaccagcaactgcttcagcaatatgtggcaagtaatgcttagacatggccattttagtttctttctgaaatgtgtgaactcccttccttatggatcttgtcttaaccagaggtcaaaagaaaaactgtgccaactcatcccttagattacccatgcactaatctctttttaatataataaatttaggtgcttgggagaaattctccctttagggggcttagaatagtaaggcaaaagatattaagtaggctttttggcattcctagagctgggctaattaggtttcctgcttccccgcccagtaaacctgctgcttcatttctgtattttctgtgagcagccactgcaatccgtgccagactcttcggttaaggtgggatttatgctgttgtttatgcatatgttcactgtgcagccactttgtcttctgacctcaaagtggttgaaagattgacatctccatgaaaacaggacacattaagtaactctcctacatgacacttaacaaccaagcatgtctccagtcaccccggacagcatggtccccaagcgttttagaggcacattaagatgaaatgtggacaaagtaaatagagctcttcagatgcataaattgaaaatgataatgattgctgtcactttgtgatggaagattatggatttcataatttgtggattcttcctaatgagaagcagattaacttttctcactgaatcaaaaatcccaatggcccaaatatccactgctgaaaagaagctatgtgctacaactggaagtagaattttgccatgatcctgcctcatatatgattgactataccattaccaaaagaatactgccagaaagtctaaggttttgaaattctgaagttttctacgttagccttagaagtttgggcagaatgattagattattttgaataatctagaaatattacataatgtttaaaatgatagtttactcatggtgtcatggatgtctttcttgtttataatgataacaataagataactttggtttaatttaatgaaaagaggaaagggaaagaggaccaggcattatattaagcgctttatgtattcattggtgtgaccctcttaatgattctgtggagatgattatcccacttttactatttagaaaaccaaaactctagagagattaaatgactttcccagggtaaatgcagctagtgagtgagtgagccagaattcaaacccagggccactggctcctcagccagtgtgactctccctcatcactgtgtccctgtggataaagatactggggcatagcccttattcctaaaaaagctttaaatccagagtcaaggaggaaggacctagagggtctctgctgagcagtgggcttattgtagtaaggacaattttatctttgccggtgacttcagaaatttggtaaaatgcaaatctgtgcatgccgtggcgcatctgctcatgaaactatgactcggtgtatgtaataggaagaagcccgtgaactcataggaaaagaaattaaacttgtatgtctgagctctggacttggaatcacaagccctaagatctagacctagctctgccactgactagcaatgtgaccatgggcaagtctttcagtctctgggtcttctattttcccatgtgaaaaatgatggggtcgggttagattcctaggatgcgtttcactctaaccccactgcacagtttaatactacaaattatgctaagtcatgacagtttggggtggggagagcaaataacttgcttctgagtggtaccttgatttatcttttcagttgctcagagccattgggaaacttaattttcatatgtattattagtgactaaaaataattagcattgctccttacatttaaaaaaatcttaaaactgtgttaatgaaatcttcctagcatgtttgaaagatgtagatggtttatagtgcccctattttagaattgagtaaaaggaatctaatactaccagtgagaggtacatttcccataatctcagagatggattggaaatggactccgggtctgctggctcacagtgtagtactttctcctctgaacacagttttttaaagcaaatttccagtttctagcagcctctgaaatttctattccttcacactttgtttttcttttataattctgccaccatatcttcacacttgtagaaacacatctgttgatataatcttagcactttctttgttagaggtggctagaataagaaatagaactactgaattatatcaaaacttcattataaaaatctggcatgttagttaccctttaacctcaaatacaaatattgtttataggcagcgtatgtgtcttcacaaagaagaaagaaaaagtggcattcatggtaaaataaactagaaaattaggcagagagcccaggaaacaacagagataagaacaaatatctgagattcttgttaataaatatgactccgtgtcaaaaaatatctgatattaaaagactttaaaatcaacagaagaaactattttaccttgtatccaaaatacagttattgtgaatccccacttgctacccttactcattcaagaaacgtgtaaaagtgtctattatatgacagcactggatatactatagtgaaccaaacagtgttcctgccctcatagaggttacagcctatgcagagataaacattcaacaaataatcatgcaaataaactcatacttacaagttgtgttaaagtgctatgaacaaagaatagagagatgaaataaaacagatggacaattgctaagtttaatatttgtctacagcagtaatcgagtgataaacatagtcattaaaatgccctttcctcaattctcgcatctctgtagtgtttgactgtcgattattcccccacttcacctccccaccttctggaaaccttcccctcctctgttgttttgtgccttgacccatcacaggtacccacttagaattcacttagtggcgatggctatagagcacctcctttctgtgcatcctcagcttcatctgccccttgcctacaggcattcccccaggtctgatccttagccagcttcttttacctctccactcacttagggaaaacttctctgcagctaactgccgatcctgtgggtcttcagccaacacctctcacctgctgagcagcagcatctcaacctggatttcctcccgttcagatgtaaagtgagccgtccttccccctttcctctgtcacttcccaccattccccagaccagctcttctctcctgacttgtctgtttttgtaaagtctgtttcagaatggctcaagtttgaaaccttcaaattagcctgtcttctctctctttgtgcccttttacatctcagtaatcgtgaagttctatagattttatccctggagcggacagagaagacatcttattttttccattcttattccctccatgctttgttctgggagtggttgcttctcacctgggttgctcccaaaggaaggcacagctctaatcatatcgcttcctcatacctttgcagacttttcattgcctgttgaaataggtccagacgtttactctggaatgaaaggtcctctctgacttctcctcaacttctcttccaggtttagcaccctcagagtcctaagcctacctgcacagcaccactggctacatgggggtccttggacaattattttaaactctcagacctttagtttcttcatgtataacattagaaaaatgactagataaaatatctttgtgattgctgctaggcctatcattccatacatatttttcttatgattctctgagtgtaggtgtggtctgtcatactgctgtttcttgtacccgaaatcccctgtgttaggctgcttattttcaaagcctggttcaaatgctatttcgtcttccttgagaccttttcagtcccttccatacaaatgtgacctcactgtcttgaaatcccacaccttctaacatatatccatgccttctaacatatatcagagttgctatgttcttttcttttttccccagtagtaagctctctgaaggcagtggcaatatcttatttcatctttgaatccctagctgctaacaagtttctggtacttaatagttgcttgataaatatttaattgatgaataaaattatctttaaattttggagactcttcaccaaaaaagatgtgcaaaagatgtatactccacaaatgtatactttacgatgtaaagtttcacttcaagcccataacctcgatagactggattttgtgtttttataattcatgtaggatggatcaagctacatatctcagggaccgaaatcaagcccaaaactgtactttcaatggattacatctatgaaaactaacttgtttagctttaagtttcaatgaacatgagaatattagtgaaagatgacacaaaacaataaagcaatttatatttccaatgtagcatgtctgaaacctatcatagagatcttctgttttcatgatttgaacactgatttattccttggatagtaatttttttaactattttatttaagtttgaaagagcccaactcaattctaccctttatgaccagaaaaataaattactttgaatcttatggaaatgtccacatattagttatactcaggacagataacctcacaaaagataactggcaaataaaaagcatcaattgttggtgtagtcattaaaacatactgtttggaagaccaggcacggtagctcatgcctgtaatcccagcactttgggaggccgaggcaggtggatcacctgaggtcagaattcaggactagcctggccaacatagtgaaatcccgtctctactaaaaatacaaaaattagccaggcgtggtggcagatgcccgtaatcccagctactggggaggctgaggcaggagaaacgcttgaacccagcaggcagaggttgcagtaaaccgagatcgtgccattgcactccagcctgggcaacaagagcgaagctccatctcaaaaaaaaaaaaaaaaaaaaaagccatacatactgttcgttgtgaatctattctttgcaccatgctgtcctttgagttactgtaaccctatagggcagcagtccccaaccttttggcaccagggacgggtttcgtggaagacaattttccacagacctgggggtcagtggcaggggtgatggttttgggattaaactgttgcactacaggtcatcaggcattagttacattctcacaaagagtttgcagcctagatccctcacatgcgcagttcacaatagggttcgtgctcctttgagaatctaatgcctccgctgatccgacaggaggcggagctcaggctgtgatgttcactcacacccacccattgcacaacttctgctgtgagtgctgtgaggcccggttctcaataggctacaggctggtacatgtatgcagcctggggttgggagcccttgctgtgaggtatatgcagttgacccttgaacaacatgggtttgaactgtgtgggctcatttatatgcagattttcttctgtctctgccaccctgagacaccaagaccagcctctccttttccttctcctcctccttctctgcttactcaaaaatgaagacaattaggataaaaatctttataatgatctatttccacttaatgaatagtaaatatattttctcttctttatgattttcttaataacattttcctttttctagcttactttattgtaataatacaatatataacatatacaacatacaaaatacgtgttaatcaactgtttagattattggcaaggcttctgataaaaaataggctattagtagttaagttctggaggagtgaaaagttatacagggactttaaactgcacagggggttggcactccaacccccattttattcaaaggtcaactgtgttatcacttttcttttatatatgagaaaaatgaaccatggatattaagtaacttgcctacagtcacatagtaaataattatggagtcagaatttaaaaccagaaaacttttacatcaaaatgctctttataaatgtttttgttttgttttgttttttcatttcttagctatgagtaaagaccattagctgtttgtgttttgaggacagcacaagctttttcttttactgaccagtgtcactgtaaaatgacatggtgatggtccttccatttcagacttttaaatatatctttccgtcacttttgtgagaaattgattaatatgtaaaggaaacaaaagaaaataaggatgagaagcttaaagaatagtgaaaatggctaattaaacatgctgcagaaaagagtcaactttaaaagttaattcaaatactttaaagactgaccaattagaaacaaactcacatgacaaatcaggattcatggaaatgaaaaatgagaccactagcactgaaacgtgaccaacacatttttcttttcttttttcttctttcccacctgccacctctttctggtatttctggaattcactgttaataattactgtgctcaaagagaaaaacaggaaaaaattaaaactcaacaagacaacttacaaaaccaaagaggaaaatcaaaatgtgttgcaatacccaagctgcctttgaagcaacaaaacaacaaagcaagaatgttgtgggtgtgaatacaatgttatgggtcaactattgtgaaagacagtatggtaattcctcaaagatttagaactggaaataccatttaacccagcaatcccattgctgagtgtttacgcaaaggaatataaataattctattataaagatacatgcacgcatatgttcattgcagcactgttcacaatagcaaagacaaagaccaaaatgcccatcaatgatagcctggataaagaaaatgtggtggtatatatacaccatggagtactatacagccataaaaaggaatgagatcatgtcctttgcagggacatggatgaagctgaaagccattatcctgagcaaactaacacaggaagagaaagccaaatactgcatgttcttatttctaactgggagctgaacaatgagaacacatggaaatagtgaggggaacaacatacactggagcctgtcgggggagagaggggttgtggagagagcattaggaaaaatagctaatgcatgctgggcttaaaacctaggtgatgggttgataggttcagcaaaccaccatggcacacgtttacctatgtaacaaacctgcacatctgcacatggacctcggaacttaaaataaaataaatgttaagggtaagtttgtgaggtcctccatttttttttatgatagctgacaccatggtttatataaaactgccaattggtaaaaaaaattacttttaattggttatgaattaaatagtcctactttacataggtttgggagaatttaacagaagtttgctgccttcattacctcgggctgctataataaaatattagagtctcggtgacttaaacaacaaacatttgtttctcacagttctggaggctgggaagtccaagatcaagatgcctggacaatttggtgtctggtaagggcccttttcctggtttgcagatgatcacctatagctgtatcctcacatggcagagaaaaagagctctgatttcttcttataagggcactaatctcatcctgaagctccactctcttgcccttatctaaacctaattagtcctccccaaaaaccccccacctccaaataccattatattagggattagtgcttcaatgtatgaatttggtagaaggtggggcacaaacattcaggccatagcaggcttcttctgtagttaaaaagaatggaagggttctgagtctcagaatgactagaaccaaggtgtctggatctctcaagcagggagcgagagatccagagaccttggttgtagtccctgctcatattacccctccctcatatttattgtaacatgttgcaaaacctaaccagaaaaagaaaataatataattcacctcttaccagcaggcagtactgcacaattctgccacacagagcccagaaaaggcaggcagaagggaactccctagatccagaaaggaaaattaagtgacttgagaaaatatgtaaaggctaagactgggtaagtggccctgcaaattccttctagtcacagaaacatttttctgggggtcacctcatagggccagtggtccgtcagcaaatccagaagtatgttcaagttttgatcaaaactccatgttatactgatagctggtttaatctcgggtcctcccacagactgtttaatggtgccatagtatctaccaaaggcatttttgagtatggatgtccccttactcttaatggaagtcctggtggaggagcaagtgccagcagtaaaaatgtaattctataaaaggtaaatgttgattacaattatattaactccttaagaccacagtgatctttctctaagagcttgtagggaaaaagttaatggccctctgaaaagagagtaattcatttccttttatccactttataatttgcaaatttgcaaatgagcatagcccatgcaagttgagcaggcttctctcactgatgggtagcatatccaaagctttcatgcaggtaaaagcactggaaaaaatatgagagagttcatcttcttccttaggagctgggactgaaactggtccacaggacttcagggaggtggtttgaggaatcctacatggtccctgggatcatcatttagaagctttgagggaataaagattcttgttctctgaacctgctgtctgatataatttgaattgaaccttgaagcccctaaaaatctggatgcagtgaccatacattcagttccatttattcaacaagccaggcaaggatcatcaaatcaataacatgactgtgccatctgccttccctttgctcaccatcacaatgaaaaatgactccttaagtgttctgcaaggcaattaactctgaaggcagagctgtaatggagagaggctgagttacatttgtattcagaactttactggtaaaatggaaaggaagctgttgtccatattaatagatacataaaatagatacataaaaaaaaatgtataaatgggataatttggtattactctatttatgcataatattatacaactgcagaaacacagagctaggaagggcactgaaatgacatatggctcctccaactgcatgcagccacagctggtgaccctgtccagaatcatcttggacagacagactgtttctaaagacattcccaaaagtcatgctgataacttccgggactaattcattctgttatttaacagtcttcactgcaatttgattccattttcttttgttctctttcttcttgttctcatctctctagaaatagagaacagctaattatgctccctataataatccatcatgtggtagaaggcagttttgaaatcaccacccagccttcagttcaggttcaatacagcactcccagtccttccatctgggcctttgaagagcctggctcctagcctgagtcatctggtgactctcagaatgctcttcaaccttcccaaatattattgattcaagagacatgaaatacaaagggactctgtatttctgtttgttctggtaccctctgcaggtaccattgcctctgcctagattgtcctacccatcagcccctctccgatatacacacctccccttttgcaccaagagaatttcgaattcaaaggtcacctctttcatgaaactagtccccatgtttacccatcctcagtcctctgctttgctttttcatttactattataaaatttttcttacgctgtctccgtcccacccaggcgagctaagggcagggatgtttcccttattatttctgtaggggctaaattgtgcctacaacatagtaaaagacaatttgcttaattatttcccccacttttcttacctgtgcatgttggtgctaatgtcccagagtccaactcttaagctagctgtaaattcacactttctactgccctttgtcatgtaccttgctataaattaattatagatgcttctcaggttttaaaaatgataaaccaccctaatctctggcctgaaatttggcttatgaaaactttattgaggttaaatcagttccttactactaactaggcctgttgtctcagccccatccttgtgacctatttgtctcaagtcttagtagtcatttcgcaatacatgattttttctatgtttaacaaatttgtttcggtcttttgttatttttttccagatataaaaatatcactttgatactctggtcattcataagatcattgtttgatcatttttaacaccattctttttccttttctcaaaaatgaggccaggagcagtagctcacacctgtaatctcagtgctttgagaggccaaggtatgaggatcgcttgaggccaggagtctgagacaaacccaggcaacatagtgagacccccatctctacaaaaattagaaaagaaaaaaaaataatgtttcatagattctttattctcagtgctttaagcaggatcagagcccttaccacttttcttgatgacctgggtatgactcaccagactctgcttctgctccttggaccatccatttatagtttctgctgactcttgctaggctacctggctcctgtatcctttgttgtggatttttagatcacagttgttctttaagactgaaatttttcaagcactttgaaagtctctttttaaagcattatttgttattagtattttctgttacatataaaaacaagccaaatttttaaacttattgcctactgcattacaggttatattctgtttccctttatgtttccagtggatcactttagtcctcgctttattgcttttcaccttccctgatgcttcagaatcatcatgttttgtcagcttcttaggtgacttatagtcttgtcacagcactcctaagttccattttagctctttgtgcagctcttgcctgtccacttgaacttcccctcagccaacttttttcatatgcattaaaagtatttctcagaaatgcaaattaaaacactactgaaatactatttcttacctcttatgttggtgaaatttaaaaagtgtggcaacctagtgctgggaagaatgcaagctggtacaacaaccgtgttggaggggaatttgacaagacctaacacagctacacttgtactcttttgacccagcagtcccacttctaggaatttaccctaaaatacacctccagcaatatgaaactacatatgcatgagttatttattttagtacttttttgtaatcacaaaatgttggaaataacctgaatgaccatacatagggaagcagtaaaatgaatttggtacatgcataaatggaatacactgtacctgtaagaaagaacaaggaagaccttgagaaactcatatgaaattatttccaaaatatattaagtgagaaaagtaaagtgcatacagatatctagagtgtctgtccctaaagtaagaaatagggactataaggaaatctacaaacgtctactcatttttgcaaaagatgtaaagaaagataagtcagaaaccaacaagactgtttacctacaggaaataaagcgaaatggggtataaaaatggagcaatgagagggggagttggagggacacttctctgagtacacttttgtatataactctgacccttagaaaaaacctgacctttcacctacccaatcagttaggatgtgggagaacccaaaatgaaatacgaactgtaaaaaatgaacctaaatgtattcaaatgaataaataactatgctgggggtatagggaagaaaagagcaacctaagtacctttagaaaatgattattttgactatatactgtaacaccaaaagcaaccaaaaatatatatatgaatgtactatagttgtatatttgtttcttctacaaacaggagcatggaccagcaattctgacactatttaatgtccatgctaggattgaacaaagtaaatattttctgggtaatgagagctagttttctcactgtcagagaaaaatgatacatatgaggaaagtgagaagactagaatgaaccctgtggcattgggttggaattagagggatcagtatgagtttattcactgtaggtggatgcacatagaaatatagatgtatgcacgtgtgttggtatacaattgtatgtttcttaatgctgcctgctgagaggtcctagaagcaatgatatctcagtagcaataaatgtacttagcactcatctcttggttttttaacaccattctccaataaaatgaacaaggacttttgggtatatggttgattccagggctaagaagggccaaccacaagataagcttggaatatctaatggttccagaaaataagtactcaaaaaattgtgaagacatgttaaaaggacttaggagccaacctgaaggagcagctaatggccaaagttggaacaactcgaacaaagtaaataagtatagtattggattattactcaataaatgtatgatccatgagtccacactgaaagattgaatagataaagaatagatagttcgagaccagcccggtcaatatgataaaaacctgtctccacaaaaaatacaaaaattagccagccatggtggcatgtgcctatagttccagctattcaagaggctgaggtgggaggatcgcttgatcccatgagattgaggctgcagtaagctgagattgcaccactgcactccagcctcggagcctgggtaacagagtgagacccagtgtcacaagaaaaaaaaaaaaaaagaagtgggagagaagagagcagtggtttcttatagtagaattctaattaatggatgtagaaataagggaaatagaaaaatcaccattagacaaataccacagtagtaattgttaaaggtaagaaccattgatgaaatctaaagttaataggacaaaacacattgtaaaacaacacatttgtatagtcagagtatcttcccacaagacatttattgattacaaaggggaaagcagtaaatttgtaataaagaaccctagcagacatgacttatccaaatgatcaaggtcaatatagctagtaattaaacatatagaaatcatatgcctgctgacatgttgcatggagaagagcaaaatatcacttctgtggtattcttcttaaatgtgtaacaccaatgtaatcacaagaaaagaggccgggcgcggtggctcacgcctgtaatcccagcactttgggaggccgaggtgggcggatcacaaggtcgggagatcgagaccatcccggctaacacgatgaaaccccgtctctatgaaaaatacaaaaaattagccaggcgtggtggcaggtgcctgtagtcccagctacttgggaggctgaggcaggagaatggcgtgaacccaggaggcggagcttgcagtgagccgagatggtgccattgcactccagcctgggcgacagagcgagactccgtctaaaaaaaaaaaaaaaagaaaagaccagacaaatccaaattgagggacagtttacaaaacaaaaccaccaaaactcttcaaaagtgccaaggtcataaaagacaaagaaagactgaggaaataatacattggagtctaataacatatacacgcaataaaatcctgcattaaatcctggaccaaaaataatatataactgagaaaactggtaaaattcaaatagggtttgttgattactcaataatagtatattaatgttgattttccagtgttaatcattgtactctggttatgtaaaatgttttcatttggggaagctgaatgaagagcaaatgagatctctgtactcatttgcagtgttcctgcatgtctaaatttatctcaaagtaaaaagctaatagaagtattttgtcaggactcttttataagttggtcatattccaaagttcaatctatagtttacaggctctattttgtcatagaaatcatatttatttcattatatggttcctgggccagcctcaaaagcttacttaacctacaatttttatatatgtatgtgtatctctatttattaagtagtctcactgtattcttgaacataacatagtatagccatgttcccattatagaaaaatacccctatcttacaggtaaagaaatgaggttacagaaaggtttctttacttgccccacattttttattttaagattttagagcaagcaagttgcagacctgattttagagccaggtctgtgtgacgccgtatgctgagtttccctgctgaggtatctgaggctttgtctgctaggccactcactcacacattagctgctgaaaaggggcaaatcttatggacacttctgtgctgtcctctggaatctttcccttgattctttttcttttcctggattgttgaacaaaatgttcatgtttattttgttcatgagaattgccttgtttttagaaatagtgacttttaaatagtttgtggattttttttctctaattctgcctatcattttaaaaccatgttttatagataaatcaaaaagtgtagaactcctaatgcagcatttggagcaaagttaataaaattttaaaacaagaggatatatatttactaaattacactgtgcttataatgtgctgccatatttttgttaaaattttttaatgctttagataattaagcatctcaagactataatattaggctaagaagctctttcccattaaaatattcataaattatgttgacacgaacatggtgttctgaacaattataaggagtggggctcctaatgcaaatgtcattcctattatgactttttctgaacttagaaaatacattcaagtagtctatggaactgtccaaaagatacacagaaaccaaaaccaaaacaaacaaaaaccaccatttatcaggtacttactgtgattcagtcactatcataaaagtattttcttatgttttctcatttaatcttgcagtaactctgtaaggtagatactactgtgtctatttgacaaattagcaaaatcaaagttcaaaaacctaccagtagttagagagttcataattgacaggaccaagatatgaacctagtttttgtgtctactctacagtttatgcctttaatccttgtacagtactctagtgtttcctgacaggaaagcattaaatacagcatagaaaactaagaaggaaaaatggcaccaacatgaaatatgttaagcttatatttaatctgctgttttatgggagttttttttaaaggagcgagaagaaaagctacaagggattttaaagagtaattcaaagatcaaacatgatttttatcttttgtcccagagcacttcagattcaaacccaaggcttcaccgctgctgatgcacatccgcctctgagtctcgtaattggtaaatttacatcatgtgtgtcaccagcagcttaagaagggaacagatgtcagttttaggaaatcctgtgaatttcaggcttgctcagactaattggtccaattgataaaatgctaatgagaaagtaaattcaaacctttaccataataagtctgaattctgaccagtaaagatgaatgtaactgcctttctgaaattcctatttttcacagagtaaaaaacatatttttttctttaaaaaaataaagccatatttgtcctttaagaaagtgttaatgttgagctggtaatgtaagaattacctagaaattttaattgaaaatattaactgttttatacaattaaattcattttttggatttctttttttagagcaatagaattccatgctgtcacttgttagatttaatgtcatcttgataacacatctaggaataccaagcaactaactgcttaagcattaacgttttttccatgtcatataataagaggaagtttccatttacttataccatctttaatagaaaagaatggtacaagtcaaggtcaaagtctccttactggaagcagcagcctggcaggctgcttaggggtcctcatatgctttttcctctcactgaagtagtcctctttcctctcttccaagttcagtgtcattagcataacaggatcagacaactagagttcatcttgttcagccctctgtcttgtgccgcttccatcttatattttttaacatagccacagattgggaacacacagtttctcacagtaataattccacatcttatttccttttagtgtttggaatgtggccaccctgtgaatttttttttttttttttaattttttgagacaaagtctcactctgtcgcccaggctggagtgcagtggcacgatcttggctcactgcaacctccacctcccggttcaagtgattctcctgcctcagcctttcaaatagctgggatcacaggcatgtgccaccactcccagctatttattttttaatttaatttaatttaatttttttgtattttagtagtgatggggttttgccatgttggtgaggctggtctcgaactcctggcctcaagctatccatctgcctcagcctcccaaagtgctgggattacaggcttaagccaccatgcccagcccatgatgtgacttttatacaaacatagagcttatacattgaattggttgctgcccttttcaagactgttaccttggaaggtcaaatgtatatattcgagtgatatgcatcttagtattttaggtaagagaagactctgggagttacaacttattctagctcctttgccttctctttcatcttcttccaaaatttcttacattaccatctattattgccatcttcatttattccctagcccattgtaatctgacttcagtactcacttctgtattaaaactctcaccaatgaggttacccgtgaccgccaagtctcttaatagggacaattgggtgcactctcattttctccaacccactcattaccctaagagttatcatctgcctccttaactaaactaagagcagcatggaggcgagggccatctttctttatcacagtatcctctatgtccagcacacacctgatatcacagaccgtcaatgcttcactgaatgaatgaatgaatgcatactctctgcctctcattttacacacagagacacagaagccctaaagaaggcatgcagttcgcccagggtcatacagctgattattaggagaaccagcatgtgacctcaggtctcctaactcccaggccaatgccaatgggtttcatataatactgatgtggctcaaaagaggtttcggctccttttaaattgttttcaaagcccacaatatattcttttgaatatatctggtggcaagtctttattctttttttttttttttttttttttttgagacggagtctcgctctgtcgcccaggctggagtgcagtggcgcgatctcggctcactgcaagctccgcctcccaggttcacgccattctcctgcctcagccgcccgagtagctgggagtacaggcgcccgccaccacgcccggctaattttttgtatttttagtagagacggggtttcaccatgttggccaggattgtcttgatctcctgacctcgtgatccgcccgcctcggcctcccaaagtgctgggattacaggcgtgagccaccgcagccggccaagtctttattcttttaattggtggcttttatttttggaattatcctaaagctaccaggacacacaacgtgtttcacaacctataaggcattacaaaatctgcaaaggggtattaaaagagctgtccagtctacttttagcctaaagaatttaaggcctcatagtgggagcatgattagccagagcaatttgcataaaaatatacaatgggaggctttgactctgttctcatctgtagtagccaggaatccccaacattagtgggaaagagctaggctccttgggcagtcagatatttgtctacatgtgtgtgcctgtgagtgcatgcctgcatgcacaggtgctgtggacaggggaggtggaagaggggccaggggtgttgggatattccttctgggaaaggaggactcatttctcttctactgttcatttccactcatctcccaccaccacacacaaacatatgctagtctcccccgtagctcatggctatttatgttttataggttgattttctgattataaaattaatgttttcattgtttaaaatttaggaaacagaaacaaaaatcttacaaccccgagataaccaataaaacacatattttattcaggactttagacatatttggatttctttttacataagcggcatcattttttaatgaagttctgtattctgcatttttgctgaatgttataaaatgagtatttctccatgtcattaaaaattattcagcaatataattttaatgactgcatattgctttttatggatgtatcataaacttcctaattattctcctcttcttgggtatttatgttgttcccagaccttttttttttttttttttttttttttttggtgttataaataacgccatgaaaaagatttctgggtaaaacttttgtccacatctctggttatttccttgggacacattacttgttctgaagctagtatgtatgaaccatacttaggtttatcaatacatattgctaaattgtttttcaggaaaattttaccaacttttctcagccaactgaggtattttgaatatcacaaaaaagtaaattatggtaaatggccatactctctccctaaggaaaatggcagtgggacatagcaaggcagtcagattttccaaatcaaggggttgatcacaattgactagctattggctcctgcctttggcaaaccagaagcctggcagaggcctaatagaggaagagtctagcagaaatcatctgaaattaagataaggccatccttttgcatatgaagggccaggtagcaaagtataccaatatgtagctagtgcttttggaatatgcagtttattatttgacacatacctgcatcctaaaagcatttgaggtaagcactggttatctgggacccaactgctcctgaaggactaacccctgaactccccagcctgcataactaagtaaccagattccaaagcagagattattatcctcatattcagtgtgacctaaccaatccatcttgacattatttctgataatatcgtgcatatctttatatatcaatcaaggttttatgaaacgcagtaaaacattaaaatggctaagagcatagactctggagccagactgtctgagatttaattcctagctctacaatttagtagctgtgtgatcttaggcaagttacttaatctatctgtgccttagttttctcatcataatttgaagataataatagttcttttctttatagttgtcatgaagagtaagtgagttaaaacatataaatttctaggaacaatatcaggcccatagtaaatgctatatacaaatttcctactattattatttcgagttgctaagaattaactttagcagaggaagtaacattagataacacaaatattttaaagcaattgcttgagttttgggaataaaaggaatgctttttttcaactaggatcccaataatatttcggttctgtccttgaaaagtttttcttttttttatcatgattgtactcagtaaacttttggatctctcagacatatttgaaagcagtgtcttatactggggacaaggaccattagcattaccacccatctgatactttcccctttacactaaggcattattcccataatcttacaaatttcccataatcttacaacccagatataacaatgacaatgacaacaaaaggcatatttccttttaggacttttttttttttgccatagcctttctcttagattcatctggataaatctcactgataggttgaggttatcagagtgtgtctagaatttgacagtaccggtcctagaaaggcctggtcagattctttgtgtgtgtgtatatatatatatatatatatatatgacttttgacaatgaaccatttgaaatctaattccactgcatgatccagatgaataaataagctaaatgaaaagcatccaaggaaaggaactactcaaagaagcaggaactgcttgagcagcagaaattgacatgaccatggacatgagggtctataaactctgggctatcatggataattgaaagtcataattttccaaagggcttaattgaatatttgaaaatttgtatgaaaataaactgagtcaactaaataataataaacacagctaaactaaacaatataaatcttcaaaagaagaaccctaattaaaaagatagattgcacttcctggactttgccattctggttgttttcaatattatgccactgggaaaatacaactgtttctaatcaaataatttaaactcccatgctggggcttaagtgtgtgttctcccatttttctcttgctacttgttttggggataaagcagctcaaattattcagacaccaatcagatttatcatcctgtgccttttgatgacatccatctgtttatctaagaagccattaaagacttattgagttacagtgctatggagaaaattgggttatcatctatggttaaatccaattcttgcatctgccatcttttcagcttatgtggtatattctgaaattaccgggacttgcagacctgcactacaagaatacatttgcttcctagcctttctatgtcatttctagagaatttctaatgtatgcacaatttgtggttcaggaatatgttgacagaaagatgtcagtgctttctgttgttaaaagttcaaaagcctaatagagactatgccagcttaaaagtcttattcagaagtgggtactgtccaattccaacgtttgtgtttagactagcctattcaaaggaaaatttgactctaggtcacaaaggtagaagtgtgttaatcagaagataaagataaattaatatcaagtcaaaattcaaacggacaaaaaaagtgagagctcatcacaaaaggtgttaaataaacaccagcaagtaaactgataagacacaaaggatccaatcttgctagggaatgactaggtagaagtccagtgcttatctcacaagtcaagcagcttaagcaaggctaaaagtcatgttttctgagctggtgaagaagcagtggactgtgtggagaaaactaattgaaataaagtgaatatttgcagtttccgggagatactgttatatcctgactgcaggagccccagagaaagagcaactgtaaatcaggcagatgcttcagtttgccaatttttctagcatttgtcagagaaataatgaggaacccatcaggaaaacatttccttgatttgtttatgtaaatcaggccagaattctgggaaacccaggttttctgggaatcttcaagaattacagcatagctgctcctcctgaaattctagctgaacacactatttattgagcatttaagaagatctttccgatcatatttcagtttcctttctttgttttcctcatagtaaggtaagtaccctgaaatgggagacgatagccgtgcgatagctgagcataatcagttgagatctacatgccagatatggctggtttcagaaagatattcatttgtctgtctacctgtttgcttcctgtgaccttcatataacttctacctgtactgtcagcagagatgctgtttttgtgtcactggtgatgccacagtgaaagaaaaatcttgccaaggcaaggatgacaaggaaccaggacctagaccctaaagtagcaaatattgtggggaagagtctcctgggagtactctttcacaacctactaaattcatccaaaagtaaattttagtaggattgaaaaatactcagcctcttgttcagagtgagaagctatatactgtatgattttaagagttatgcctttttgtctttaccaccctagtcaacgcacaaaatacttgctctaacttgctgaaattctatgattaacaattcatttatttgtcttaagctttgttaaccttttaacatataggtatatgtagattatctgaccctttctttaaggtagtttctggctgcagaaagggaggagtgaggaccctttgggccagaaggagaagacacctcgtttctccaaagcttttgtctgtgatttactgtattgattgactatttaggttagcattttgattttcagtcaaaacggcagagggaaatatattggccacttttcagtcatttattcaaagaccaatgagactgagacaatacctgtggactattctctaatattttattgagtgactttattaattttagtgtttagataggagaaatgatattgagaattctctaagaaggctttcaataattgcatcgatcagttaaaggtgttgatccagatgcaaataactgctggaatggctaatgacaaggttctggaaatgtactaggaattactcaagacagaaggtctgagaggatcaaaattggtatccagaaatggcaccaccactctcccctctttcactgtttccatcttcatgtctcctccacagctcttcatgcttgtcaacttggggaaagtcatggttgatgcccttctgacagcctgctggagaagatctgttgccttttctggcagtcagtgacgtcttctgccacaactgggctttactctatggctttcttagaaagcagcatccatagctggaggagccttgagctcactggactgagtcctttcagcttgaagctgacctccctgattgccctgcctctccattgcagtttccgttctcacactgaccaatactaattgaaggagatagcatcacctactggtaatcaggtccctgccttgtcttaggttgccatccaataacaacttgagaatttataaaatattgtttttctttacaggtgtttcttgagtttgtttctcaagtactaagcactatcagagaaagaaatcaatgttaattatacacaaactgtaggaatacaaaagaacatttagataatcacttctctgaaggaaactacaatctcttcaggcagataatagataatatgggtatcttccatttctacaaaagataaaaatgtaggtgagagagaaagagcacttactaaaagttaaatggagtcagcagaacctgagatttccaagtgatagaaacctggacaggcagcagaggtggagaagcacagtctaagtggagagtcacatgagcaaaggagactcagaaatcagagttctttggaagtgggaggttgctaagaaagatcgaaaatgccaggaaggcccttacttccaagatgagcttgaatttgatctggtaggaattgggaaaccattttggatttctgagcagggatccaagctttaaatgcacagttttgaggacatttacttttctggagtatacaaactcagctgttaaagagtgggatcagaagctaaagatcagctaggaaaaattacagtaatccaggcaggtgagggtctagattgcagcagaaaaagagagtctctgatgaattcaaaagttattggaaagtggaaattgataggacttggtgacaaattgaattaaattgactaatcatttattattttgtgcatctcagcattctacatctctaccagtgaactcattaaagagatttttatgttaatagcgaagtttttaatgtaagttgatttgagagatcttttctggttgaatacagttggcaggctgttggatttagtaggcaaggccacatttatctggcatcattaaaattaggtaacctaaataaataaaatatttagacaattgaagcttgctgtcattgcccaatttggggaggcagtccagagggactggccagatcagataccattctgtggataagttatcctgagggacaagtggagaaacaaattcaggggcactttttctaagaacgggaaggggactcccaaagaaattccccaaactaagacatcagtctctgagacaaaatagaacatgaaatgaggatagagattcaaggatctaagtagtccattcattaatgaaataatattacttatgtgcattgagtacctacttccgtgctgaaagctttgcataggtcatttgttttacttgtatgtattgagcacttactaggtgttggctgagcaaagaacctaacaggtatgttcccagcccttatagagcttatagtctggtgtgggagatagtcatcaaacaaataattatacaaatacatacttagttacaaattgtgatcattgcagtaaagggaaatatagagtggcatggaggtaaaacaagggttctccacttagatttcacagtcaaaaatggtgttcctgagtaaataatattctagcagaaactttgaaggatgactgggaattagccaggcaaagactaaaaggatgagtgtcaaggacactgaaaggcaaagtaggagatcaaatactgggaatcttgaagtcggaagtaggtatttggtttaagctttggagcaaggtgaaactggaacctggaatggctgtaattacaaattgtcctcagattacccagctcagaatctacagacacacgctaaatgaaaaaggcagcatatttaatggtcagaacatcacaacatacaatttgcagtcagatgaatgtggaccacttcttgggtgttttatcctgggaagacacttaccctttctcagctttaatttttcattctgtacaatggggctaatactacttatctcttggggattgtgaaaggctcaaatgagataatgtctgtaatatacttaattcagtacctgacagacaatatatgctcttccttcatgtcaccaagtcttttgttattctatttaattcatatttattttgataacaacatgaagatacccacatacctagcaaaatgtaggaactttataacaggcattttctttgctgctcagaagcttatctgagtcttttccacctattccctgatctgtaattgtgtttcatatttttgaggctctctgaagtgaaatctccagattgggaaagggttaagggattcatatgtaaatagacatagaattcagtgtgtgctcaattaagatttgatgaatgaatgattactgtataattatagagatctgacagtgataaccatagttaattcattgctaaggtcgtgtacattgaaaaataattttaaagcattttttagtaatttgtgtttttaagttgttagtaaactaaattgcaaccttttgttctctgaatattctcttaactataaatctaccatgttttaatcagagaaatgttgtgacagttccaggaaaggaaacattttttctgtttaaaacatttctagcatttcagccaaacaatttatctagaatggttttccctttaaaaggaatagtagacaattagaagcatagtacagtacattttctgccttatggttccaagccaaaaaccagagaacttttgtgctttataagcaattgtaaactaaaatgagtaactggtatatggtaatagactaggctttgagctgctattaccatagaatacttttccggctttcttagaagcacgagaacaaaattgggaagaaggcatttatctgattgaagctaggatgctacttgcattgtacttcactttaggtagaaaggcagtcattttatttgctgttaatgtgaaaagagatatcacttctctttagaatgtagccagcaaatcagtatctaaagcctatacacatggctagaaacaaagctacccatatagccttagacctccctgaacctgatcaggccccaggatactgttctgctcatcacagtgggaagctacaggtttgctcaaaccaagtccatctatgggagttactaaaacctctccttagcacttctccagaatatggaagtttgggaaagcccactccagggggtccctacatatacctacataaaagcttcatttatttgtataaacaggcagatcagaaataggttagtgacaataaatgggtaaagtacactgatgtttaaatatttcccttgcaataatacctggatgagattattttatttggactttgggaacaaaagcattgtttggcaatatttaaatcctagtaaatataaacagtaagcaaattttacaattaatttaaatagttcagccaaccacataactatataaatcctatgttagtttaatctctctagggacttggcaatatttttttcttgataggcagatttcacatatattttattcatttattcaaaaatattaactaagtccaagaaaattcctaagcaccgtgctaggcactaatgccaaacggccctgcactaaatggacacttagagtcttgtgtgggattcagacaggaagcaaatagtgtctcagtattctctctgcagtatccttccctcttaagacgactcccagatcagaggggagcagctcctgtagaagtggcccagggctaggagacctgccactccccttctccccactgccctctcagcgctcctctgtagggctctgcagatctagtttgaagattgctttacatatggttctgatgtgcagaaaaatggaagaatctttgctgaatctatttcatttggactaaatctgtttcagatcttactggccagcctcaccatactggccacacacatgcaagaaaaagccttcattccaaccaacctaaagccacactatttgctcattacaatgaaagacataatttacttattgcatggcttaggccagagagaatgccagtaggaagactcttctcccaggaaataaatagattataagaaacaataagaaataaatagatgtggacaagaagcctcaatatgcttacctgtctacacacacacacacgttattgaacctgatgaagggttctgaacttgcagaataccagataattgacatatcagtgcatctctagtctgggtagattaatctggggtacaagtatattttctctgttttttatgttgttgttgtttctacaagcagtttccttttgcatttcctctgtgcaaaacaaggacctggggatctgcttcatttataattagagcaagaaagtcctgcttgacattgtattggagccttacagtttcaagactctcggttgcataatgcatgtgttttgttaataccgttaataccatgtaatactagtgcccctgatactgtgtataaatgaggcatacaagtagctccttcgcccagcagcaacatggtctgtacttgtagaaaaatttacctcctgaccccctaaatattgattgtttgattggagaattgagagattccagtggtagggatcagaaaagatgaaaaagatgaaaatgtgtaggcataaaaatagtatgaggaagagaaaaattataatggcatcacatatatgttgcatattctatgccaggtagtgttaaaaaggtttatgtatgtgcattcacatactcatttaaatattacagcacccccccaggggatacacatacttactgaaattttagtctgtgtaacatagcaagatcctgtttctactaaaaattacatttaaaaaaatagctgggcatggtgatacatgcctgtagtcccagctactcaagaggctgaagttagagaattgcttgagcccaggacctccatgttgcagtgaaccatgatcgtgccactgcagtccagcctgggtgacgtgcaactctctatctcaaaaaaaaaagaaagaaagaaagaaattttatagattggggaaaccaaagtaaaatgccttggccaagatgacatggcaaacaagtgacagagtgaggatttgaacccagacagtccagctgtcaagtcaatgctcaaagcatgatgctatgtagccataggagagccctatatgcaggtagaggaaagatttctttataaaccaaaagatgggtgtagactcagtgagtctgtataacggggtaaagggagttgtgagaaagggaaccgagaattttgaaaggaatagagggctgaactgaagctgaactggggaagcccctgactgtggtaaataaacagaaaataaaaacaatagtagtcacttagctgctttaaatcccctttttagcaatagattgtaaatgataatcactgtgagttttttttaagggaatactagagattctggtccaactgtggttcgagtggctgcaaggaaagcattttcaaccagcagcggaggctgcagtcattcacgagcatcaggaaatcaggggagcctcggagaggctgtgggtgatggatgggaacaagttgaaagaatagtatgcagaagcctggggtcagggtggggcagtaaaagctgagctcaggagccaggaaattgttcagaagctagaaatcaaaagtcatcagatggtaaaagccaacacagcagagatgatgccaaaagcacctggaaacaaggcaaaaacagcttcagacaggagaaagcagcttatattgctggactaggaactgaaattatttcccaggataaagtcatcctgctggaggctttcagtagagtgcttcacctcaactggcagtggctgtcagccaaggagaaacagatgcaatctgtagctctaactgaaaagcctgctgtcgcaaggacccagagatctgagacagtggggtcaacctgagcctggccatgggagagggtgaactatggagaaaagtgaaggaatcccaggcttcggctagagaagacctgtgataaatagaaaggggccaggtacggtggctcacgcctgtaatcctaacacttggagaggccaaggcaggtggatcacctggggtcaggagttcgagaccagcctggccaacatggtgaaacccagtctctactaataaaaattttaaaaattagccaggagtgctgatgggtacctgtaatctcagctacttgggaggctgaggagaatcgcttgaacccagtgggcggaggttgcagtgagccaagatctcaccactgcactccagcctgggcaacagagtgagactccatctcaaagacaaaaacaaaaaagaaagggagtggtactgtggaactggaagggcctggaagaatttgatggatgttgtagaacatctaggccaattgtgtccctgtcatttacctaatcagtattggatttttcatcctgagtcttttgtgcatgtacgagtagttaaaccctttatgctcttaagtatttatcttgctgcaatgtatggtaatcaatgaggtttgaaaggactgctttagaagagaaagagaggaagcaggtaatcataagagttgttttccccttgagaaaccaaaaagaacaagctctgaatagaggtgtgaggccccttcccactttaacattctgtgagtgtctgaatgtcctaatccccccggggtgaaaatgactcagaggcaggtggtacctactgtatttttgtggagctgtcctggggcctgtgccctcaatgcgtggcctgtcttttctgggacttcaggctctctctatgaagggctttccctgttttatgctcagggcattgcctagctaacatgagcctatctctgggtatttccactgagggtaggctgcgtatccagctatacatgggagtaccgtagttccagggccaccactagctttcattgcctttgagcaaatgctgtcctgctccagagtttatggcttggcacagagtggaatctgcatttcagccggtgcccagcccttagccaggagtcttgtgcagtgatgaactcgcacagccatttgcagtttgcagcgcccctatggattgcttctgtttctgccggatggtgatgaaggagtgctccaacacatcaactctgtagcacaatagctttcacccacaaagctttgtttcctatattctctctggcttacctaaccaaaatattgaagtcatctttgactcctccctcaacctttacattcagttaaatactagtgttgatcccacctctgatttctcaaagactatttctgtagttcaaaaaccaaaagaactaacattgacagagccctgccatatgctgggtactttaggtctcttttactcattataggctatcttcttcttccattatgttcatttcgtaaatgtggaaagcgagacttggagagtttcactatcatggcctcaagctagtaagtgctgcctacccaggtctgtctgcttctaaattccaagctcacctgccctgcattacactgtgctcatcaatctgctccaggacctaccattaaatagctttgccaaccccacacttgccctccaccagcctatcttccacactggtgctggaggtaactcccctaaatgcataccacctatcctgtcacctgcagatttttgaggaccagccatttctgacaggtaaagttcacccttcccagcctgtcatatgcagtctttacttatttccccagccttggttcctaacactcatgccccatctccaacaccatcagactgagaccaacacgtccaggccctggggataaatggtaaagggaagatgttgcaggattggcactcagcattcaaaaacagttgttgtctctggggaagagccacaaaaggccttgaataaacactgagagctgagcaaataagcacatgcattagaatgcctgcagggtgcccacactagttaggggtgtggcgggctttgggagaaaggctggtggtcaggtctgccccactgagggctgctgggaagatattcaccgaactgcctaaataagtggccttaagacgcccctaacccaggttctgacacccacattgtacttcctagtcacactgagttagttgttctttcccataggtaccctgtattttcatacttcattcacatgtgctatttcgtacttcattcacatgtgctattttttcagcctgtaagacttgctgtcatctggaaaaattttccactctccagggtcacacattattgtcatcttctctatgaagccttccagactccttgtaggcagtgttacaactctcctttgtggttttatagaggaagggagaatgttttggtaaggaaggggtctgagttggagaatgagaagaggatgaggagtagaatggcgtctcttccccgcagagctcttaggtctttgctcattctggtgcagtggcattagccactttgtatggtgaatagttttgtaaaatagacagatgtctacaggtacttcacccttgccatatagcaagcttttagtgctccctgcctcccaatgggccgccagttatttatggaaggaataaaccagttacaatacatcatagctccggctgtttgaactttctggctctagccatccttgcccatgttctctgcccataaagcctttacagatgcctcaccactgtcatggtctatcaggggaacagatgccagtagctatccaagctgcgacctcttgataatcccaaactcctgttctctaaggcaccagcgctgggcagggctttgcgcagatggtaggagtgcatcttctggaccctggacaactctatacccatccaagaacaacatccatgcaagaaactctttacccctcctgcacatccagtctgcaagctccaatggagaataagttatatttcttcccccactatccttcccactccatctaagacctgtcctcaataaaactctcttctattaggaaaacaaagctcttgtgcatatgagtgaatgagctacagctgttgggagtgaggacaatcctatctttagataaacaccccacagaaatgggtggatatgtgtaccaaaggacttatacaggaatgttcacagcagcataatttttgtagctaaaaactggaaacaatctaaataaccatcaataacaacatggataaatgaagtgtagtatattcatacatgggtatggtataccgtaatggaataaactactgctacatgcagcaatgcagatggatcctgtgtgcataaggttgagctaaaacacccagccacaaaagggtgtgaactatatggtttcatatgaagttttttaaaaggacaactaattaatagtgctgggagtcaggaggagagttatatttcaggaggagagagcagaggggatcttctagagctttggtatagaaagaactgatttaggggtgaacgttctgcctaaggcctgggccttctgcctgggtaagaatctctgaccagttcagaaatggcctacattcatcagatgcagaggcagtcttttcaaactgtccattcagcctgcagtgggggcatttggaatggatatgaagaatgacattttgagtagcttggtgtccactctgctcatgggacagaacctaatgattgattcagtaagtaaaattccaggaaagaattgcgtgcatttagatatgggcttctgtggcaacaatgctagagctgaggaaaaatggaacaagctgtcataaacaggcaaaagaaaatagcagtttccatctggaccttacctttacatggctgttttagccgtgatcattccaaaatgaatttgaaatcacattttacctcatttctctttatatctggcccaatatttcttttggtaatccatggctatgaagcccttataaacagaatcctggcctattttcaaggatgggagatatgacacaccaattaactctaggaaggtttgaatttagggtggttttatttcaccatgcagaatgtttaagccatatctcaacatagccagctactgcaaattccaatcccagaatcacattgctcccatagtggatcatctggctgtcaggagattctcagcaaacaacaacaacaacaaaaagcattaggccgcttcttcctaattatgtctctctctaaatatctaattatcattgagaacaaattgcatgttacagagataatattatggggaatcgttaatctgttgggcttctgcttttgaattcctgagtcggtactgcagctgctgaagcaaaaaattctgccacctggacacttcattatgatttcatatttaaatgcaaaaaaactgccgaagagaggttctatttgatggacttggcttcttcaggcatttcgtacttagctacgcatcacatgtacaggtcttccaaatatcccaggtacctgggaatagtgaataattgagcatttacagggacagaattacaagggaacaatgggaatatagtaataccaataaggtgacagtggaattgacttctctaattatactttctttttatccatgcacaaaggtctgcagctttttgtaacattcctcagtaactgcataggacttccttaataaatgctgatccaaaaagtacacattcccaaagattacctgataattgcacctaccataatatgcttaaagctaattaacattcagacttcactttagagaatagaaattaccaggtacttatcccataattacatctttgtgcactcactattgtaatccctggcattagctatgtaattaaatgatgaacagtgactgtgtaagtagagagtacttatgtaaaatttgtgtcttatcaaaaataaataaataaacagattcaaagactcaggtctcatttgaaattccattgttctcagggagattgtatagcatgtcaagaattgataataatactgttagctccttgaaggtgggaagatgatagtactgccactctgtcaggaagatgcccactgtggttcatcttaccaccagggatgagcggcgccaagcaagtctcacggtttttttcttggcatgcctcaaataacaagtacttagacactgtcttactaaatctgacctgtctctaagctatgaaatccagtagttttttgtcagatgctttgtgcaagaattcttttaaaaaaataatgttttcatctgatcacaatgctaacatatattcatcgtggaaagtttgtaaaatattgaaaacccacagaagaaaatagaaatcacttataattccttatcaatgttaacttttttccgtatatgctttcagtctctcttgtagatgaatctcactgtatctacatatatatgtatacttcttgcgacctgcattttagaagcggtatattgtgaacattccaatgaagtattattgtcttttatcatatttctcatgactccattataatctgtaatattggtagtccctaaattatttaaccagttttgatggacgtttaggctagtttttcaacattaatttctatcattttactattcaccatgtgagggttctctaaaagaagttttaaatgttgtgttttcatgaaaacatgttaaaggtcattcattctaagttattaccttgtgacaatgtcagtgcctgcgtttgcatctgtattcacagtgtgctgtgctgcgtgtcactttcattgttgtgagctgatgagaaaggacagaggtctgcttaataagtaaatgatcatatagttggttccaccgagtgaaaccaaaggacctcatagtatgcaggacaaatggaagttcaaatagcaaaaagcagtggcaggattgagccatcacatggaggtagcagagatacatcaaactcaaaactaaaaaagaaaatagaaacccaagaagttgataccatattcacagcagacagcaatcaaggctctcataaaaatcattagtttcgagaccagcctgactaacatggagaaaccccgtctctactaaaaatacaaaattagccgggtgtggtggcgcatgcctgtaatcccagctactcgggaggcagaggcaggagaatcgcttgaacccgtgaggcggaggttgcagtgagccaagatcgcaccattgcactccagcctgggcaacaagagcgaaactgtctcaaaaacaaaaacaaaaacaagaacaaaaacattagtaactctaaattaatgttgttgttttgaatgtcatgtgatttgtaagtattgtatttaatttgtagatttgttttacatttgtttggattgtatagttgtataagaaccataatcctaaagagccactatgtaatttcatattttcatacatctaagtaacagtaaaattaatttaagtcaacagtgagagtctgtaagaagtttccatttttaaaacagatccatacattttctcaatttgggttacattgtcctcatagctacatcattatgcatatccttagaataaattatttcctcagggaaatttcttaaacataaaattattgtcaaatgttataaacattctaaggcttttgatgtttctgtcaaatttgagtacagactgttcaagttacttttctccctttagtttacccttcatttttaatactttctgcagtagtacattcgttctagtttgccaaatatttattgagtgctaaccatgtgcaggcatcatgtattggcattgactagtgaacatgttaaaaatgcatcatcatggaccccacaccagaccaactgaatcagaatctgcattttcaaaagatccctaggtgatacgattgcatattcaagtttgagatgcattgttctaagaactagacctggaggtcgactgtctctctgacacttcctcttgaccatctcgaaggtgccccaaacacaatatgtttgtcttagttttgggagctgctattacaaaatattacaaaatatcataaactgggtagcttataagcaacaaacatttattaccctcagttctgaagttaggaagtgcaagatcaaggcaccagcagatttgctgtctagtgaggggcagcttccttcctaggtggatgtcttctcactgtaacaacacacagtagaaggtgcaggacagctttctgggctctcttttataagggcactggtccattcatgagggctctgcccttgtgacctaatcatctcctaaaggcctcatctcctaataccatcacactggtgattaggtttcactacgtgaatttagggggcggggagaggcacaaacattcaggctgtaacaatgctcaacatagagctctttttttttttttcaccatgcctagttctttttccagttttcctcttctcagtgagtggcatcaccatccactctctcatgcaaaccagaaaccttcctctactttaccccccatatctaatttatcaccgagttcactatctctcacatccctcctattttttcactctctctccactgccaccctccttgtctaagctactcttgtgtgttgcctggatattttgcagtatcttctgaactggcccccctgcttccattcttatcccctctagtttattttccacagtaagttgtggaaaagagtaatcttttggataggcatattggaacttatcaccagcttgcttaaaacgtccaaaggaccttccattgctctcatgataaagacagaaatctgtaaggtggtcccacgagattgagtcttgcttgctctctagacttgttctgtgccgagttctctaaggtagcagtcctctctcactttgctttctccttacccttcagtttagctagtgaacttctattgttccttagattgtagctcaatcatttcttcctcagaaaaccttccctgacctccctaattagattctttcctcttgttctgtgatctcaaattacacaacttattcccctgcgtttttatcactgttgtaactcaacattcatttttgatgtctttgattaatatctggcaccccattagagtgcaagctccattagggcagagaccacatctgttttttcagggccagaagatgataggtgatgtcttacaggtccttaccgctctggctctcttcatgagtggttcttccagatggaatgcccttctcctccactgtcacttaaataaataatacctgtctttcaagattgaattaaaggaacaacccctcaatatgatcttcctggcggaagtcctcttcaaatcctcttataaggtacttattaccttctacaataattactatgcatttttctctctctgtattaatcaacgtaagtaaccattagttgctgcaaaagataaacagaagttgaatttcacccatacccagttcagcttgggctaactgaagcacttcttcatccagtgacttgacgatttaggcccccttcatcttatcaggccattttcctagcatgtggctcacaaggcagccacaaagcatggagaggcctcccagtctcttaaatgacaaggcacagaaatggcatgtcacttgtgctgacatttcgttggctggaactagtaatctgactcctcctaaatgaatggtgcagtggaatatagtcccctacatacccaggaggatgcatagagctagatatgagtgaaaactagtcatctctaccaagctgtagtaaactcttgaaagaggacaagatctaagcccaaatcactttcagaacactaaagtattcaacctctcccatatttgccaattaatacaagttgctgattcaatgaatggctgaggatttcagaagagggagacaaaagcagagagaagcagaaaggcagatacagagcagcactagaagacagcatctctctcttagtccattactatttgtttcagctacttacacacttttgggcagtgctaactaaattgataaacagcctgccccacccccacccccacctcccaaagtcagttttttggggtttttgtttgtttttgagacagagtcttgctctgtcacccaggctggagggcagtggtgctcactgcaacctcagcctcctaggttcaagcaattctcatgcctcagccacctgagtagctaggataacaggcatgcgccaccacgcaccacccgcagtcagtttttgttataatagcttggcttcctatatgtgatattattgaaaagtttcagaataacgcccatgtgctggacagtgtgcaaggtgttttacatagactgctatacagtcattctttcagcaattctgcagtacaggcattcttatcacagaactcacaattttctgccttagaatgtgcattgaactctgtctgcctctaaaacctgtgttcttaaccacgacaccacattgaagtttattaaacatccgaatatttatcaaccctgagaatgagcgcatataagtaatgtgattaatctacccattataatccctgtgacttagccttgggaaatagactctaaggaaacacttgtagaattttgccaagacagtagccaaattccaaggaatatatgtgtatttaattaagttacatattctaaagccagggtgatgagcaatttggataatgtttctggtgtgtgtgcattgggggagtggtggtttccagatgagacaacagccacaaagtaccttgtcatttcttccattgatatatatactcatatatgtttgcacagataagactagcttttggctttatgcttagttttatgtacagtacaaacattaaatcgtgaaggtgttcatcacaggaaaaccagagaagccctcgtaagccttataaatcattgtccttatacccagctcactgtgggtggtggaccgttagagcacatggggacagagtggcagtctgtgtgatgttaagaatgcaacctattaagcagagaatgagaagttgaaggattccatttttcaccagctctaacatggttaatctttaaagctatttattgaacacaaagacatttgactgagcactttgtagtatgcatctttctctaccactctcattcatcacctattttcaccgaatctttgttaagatttgcagtaatggtgctgtataaaagggcctttatgtgactcacagtccctataaaatatgattttttttcttcagatcatcttttgaaaattgctgctgcttgttatttcacatatttttttccaagtgcattaagtttacctgcaacgggaaaagattatttagagaaacgtacactttctatttcctttaatagcttgtgttatgatatgtttgatagttcatgaaggacactgtcagatttggagaatgagccaataaactttaggtcctaagaaatatagccccgtaatgatgcctactcatatgcagagatattttatcagcttaatggtaccttttagtgtctgacaccttcggtttacaggtttgctcgatggcctgtttgcttctgtgccaaattagtgttgagggaggtttctgatgagaagaatattcagtttggatattagagttatggccgtcaagttggaggcggtcagcctggtttaatctcagatggtaccttttactgcagatgccgactggggactcatgaaatgcccaagcaactcttgtttggctgtaagggtgcaaatcaaggtgtgtgggcaggggagagcatctcttgcctacagcattaacagacattttattttgtaaaatatgttctatcttccccaggttaaaaaaaaaatcatatgctcatcttattttaaacagattcttttagtggtaaatgaaagcttgtaacctgtaaggtagcatttatctttatattcaaagcttgggcagccatggaagaacattgggagtgaggacacttataaaaggaggagaatgtggggtcaggaagcagagaatgcaaagaatagtgttctggaagaaaaagggaggccaactgttatctctaaactgcctatgcctgtgaacttcatccaagaacagaacatccaaaaaccaggcttactagccttgtctttctttttggaaatacagagtttcgcaaataaataaggggatacttaattatctccaagcaaacatttcatgtgaacagtatagcaaattatattgtgcatatataatgccaatgtttggagcagatgaagatgactgagttgcaaggtggaatgatgatcgtgaatcttctgtcagttactcctctgtcctggatctagtcattatacatttatttttcaacgtcttctgttttaaaatgactcttctccaaatactagatcacttagttcctttttgtagataatttgtatccttgaaatggacaggtacttcaaatatcacaagaaagggtagctttagttttcttttgttttaccggttagattatctggctgaggttgatttaactcagtcaggtaagctagtaaaagtttgtctttccttaataagactgattttttttgttgcatttatccaacaatcttgtatattctaaattttgtgcagtttaaataggacattgttaattcagttcatcaattcattacaaatgtgcagtacggatgctcacacatttacttcctgaatggtagatgcagggtaagaaaagcaaaaccagcttcatgatatctgtgatcaagatacatattaaggtgaatacggacaagattctactgagtctgctgaaaccgtttcaaatattttggggttttgttgttgttgttatattactctgtttactctaaaatcaggcacttgaggctttttttctcgcctcagaaagatatttctgaaattcatgacattgtaatggtgatttttattaaagcaaaatttgatggcttttgtttatgagacctgccaaacagtgcaaacacaatcagttaactatttcctttggaaggagtatggtaaatttttgtgtaagagactgtttacccaataaggggggatttatagtttccaaaagtgtaatataaaaacaatcttcagtttccccatgttatatatacatctagtaatatactttctgtcctgtgtagctaccagcaattttaatatatatagttactcttaaaaacttttatatgatacaccacttttttgttaccttctaataagaatagtggattctaggctagcaatatttcatgctgatgatacatatcttgtaagactatgaactttttgaaagcaggcatagcaagcatataatttaaactctactgtatgcattagagattacagagggcctgagtttcctcaagccacccatcttattaagtcatagcactgcatactacataatggatttgaattccgattgaaatcattcatgatcagggaatatttactctagatatagaaaattcaggcagctgggaaaaaagaagggatcgagttgtttcacaagcctgcttatgcgcctgtgtttgtgattgtaactctaattatatttgtactgtattataatgaagtaatttaattaaatgttccataagttgataaaatatttgctcaaaagttgtttatattaaaattatattaatactttagagagactcaagacaagttgcttttaaaaattgctattgaattctttataaacatatatgtcatggaaacctagggaggagagaatttccataaacagactatgcttcattgtgtgccaatgcctcaataataggaggaaaataaagaatgtgtagaggccatgggcttggcatctcaggaaccactgctgacaatgcaggttcgagtttcatcatatagataacggcaaaagctggatttcaatatcttaggcatgaggttgagggaaatgggggcagaacatggagatcatgattgtgtggcatcattcagcagccaggtgaagtggagaggcgggagttatggagaagttgatagtctatcgctgggaaggactttaaaagagtatgtatgagagaaaaagactttaaaagagtaaggtgtttaatgagtatgatgcagaggaaagagcaaggtttcggatttgcaatctgtgtgccttttattaatgtatttaacctctgagcatctagctgctccttctataaaactgaaataatatatgactcaacagattttgggcgaataaagttatatgtagatgatatagcataattcgttctttttctttatatcttgccttcttctgttggaagactgtattctactgagcatgttgatgggttagcataagcactttgggtgcaggcctggggaaagctgaatagccctggattcagaaaacagagttccagccactcctgcagatgattcaggaggctgcggctgggcagcagaggtggcagtgggcagtgaagggctagcaaatgagacagatgcctggcatgaaacgcgactacttccataggacccccacgcaaacaataatttctgtcatatctgttgaactcacagatgtttggtgtggatatagtgtgaaccaaataaggacctttgtttcatgccagggtcagtagggcaaaggaaagtttctcagggaagacaaaattcaaaagaccatcacaacttgatattcaagaatggaccaaaaaaaaaaaatcttaggaaagactttgtacttctacaggatgaggaaagagacaaggggaatagatggaaatttcagtaagacttcagttggcaaggaagccctgagctgactcctgggccacatataaagccaggtgtcttcaacataactgacatggaatcagtgatgctaattagcataatattagatcaaagatgcaccaaagggcattgttgaaggtccactgtccacaaagtggttggaggaatgggactgagatgatggctgagtttcttttctttataggacatgcaattaatgactgcagccgaatttcggctcttgtgttccgtcttcctaattcctgagcattggtcatgaacttgctagccttgccacaatttatccagtaaacaatgttttactctcacctttacagaaatctaagagctttgaaattggctacatatagatgtaatgtatgtagggcagggagcacccaagagaatttttttttctctaagattacaagatatttaccagacctctgaaaaaaattgctggagttataaatgtgctgggaaccacctaaaaatcccaaggaatattagtttttgaaattggtgccaagatattgaccattgttgcattcttataaagatctagaatatgttcttatgaaagaaatttttatcataattgtttaagtcagcagcaaaatcgcggggtgtctgttatgctacccacaataatactcctggacagagagaatgacaatatcagttctttaaaaatccaacacaaatatctccttccttctgtttgtacaaaggcaaccataatggcttttgcttccggcagactgaagtaacatgtggggtctctgtagaaacacttggagtctacaaaatgagcttttagcttatcccctggtagttaattactatacctctaggtcaattagatggctctcaattgctcagttgtaactgtggtttcactcacaagctgtgtgtggtaattctagtttacttgttttcttaagtaaaactcaaattgccgtgtgcatgagatccagaataatgatcaaaactgaagtatgctgaagtgggctatgtaattaaaacaatttcatcaaaagcttcgtattttaagttgccattatattggtaatgctctcttggttcctccaaagaccatttctaaaagtaaaaaataaaataaaaagagcattttaccttcataactagcactaataatcagatatttgcatgatctgaaatgaaacaagaggtacacagtccaaggtggtcgtgtgtattgaaggaacaacactgcactggtccaccggggatacagctgaataacctggaggtatttgttgtcattcagtattcccgggtgcagtgccttttcagctgccgcaaggttaggcatacaggagcgtgttgcacacggctgtgctcatcctgccgttctaatgtgaatgcattatttccagctttgtggaagctccagcacatttataatcactttctactcactcttgactatgactccttcatctgacaaaccctcagtgaaacatcttctgcctgtcactgtccccctccactcaggaaagccacagaccttgtttgtgcattcagcaaacacttactgaacatccactgaataccggacactgctgaattccagggatataaaagcgagtaagactcggacccggtggtcaaagatgctaatgtcttgtgaagaagacagacatttagacaagtaattacaataaagtgtaagaactcttactcaaagagggaacacctaattgtatccaagagtgatgtgcagaagaggaatcagggaggccttcccaacggagctgatgcttgaactgggtctagaaagatgcaaggaatttgccaagtggttcaaatgagaagtcaagatattagcagacaggggaaagaacatatatgaatgtggaaaggatggctttgtgtttactaattcgatctaccaggtggatgaggttgccataatccaagaaaaggaatataaaaggagagaaggggatgtgtacaaggagcccagttagcgtcttctgtgttattgtcactgtcattatcatcatcatcatcatcaaaccatgtttgtaaaattcttctaacacgttcagcagactgatttttttaaaaacccataaaaacatattgcccattctataaagattcagtagtatgctgtcttcctaatatgtattctgagattatggttctgcctgtactattaaattataaagtaagtaatgactcacaagttggaaagctgaaattgaccaataaccacaaaatgatttaaagatatcacttttttatatttcaaagaaatcagtaattcctgtgctaattaaactgtttcacagcataaagaaaaaactgaattttttccgaagcaagtgtaaatagttatccttttattatagaatgcaaaacctgacaaagatagcgcagtaaaaggatgccttgaaaaactgatgatgtaatttattcaagacaataaaggtataaaaagatctggtaaaagtctggaaaaaataacaatgaaaagtctaatggagtgtgaataattatcccagatattaaaacataaaactatagagattaaaacaatgtgggctttggcctcactacacaaattagttaaaaagaaaaagaatacagaaatagattcaaatatatgtggtaatttagtgccataataaagaatataaaataaatgaaggaaggatgacttttcaatagtagtatagggagagttggctggaagctgttcaaaaaatatgaattcaaccattcctctttatattaatttttaagttccagatagataaaatagtgtactataaaaaggcatacataaatacataagatcgaaatatgagtaaacatttttacaaacttgtaatagggaggacccacaaagaaaaagactaatcgctggtgactgcaacactgacacataaattctataaccaaacctcagtgaaagactaaatcaaactagcaaattatttatatcacttagaataagtatccctaacataaagagtcctgattaactaattttcttaatgtgctaataggaaactaggcaaaggaagtgaatgggcaattatacatacatacatacatacatacatcccaaagaaagaaataggaatggcctatatgaacatgaaaatatattcaatcttgctaataattaaggaaatgcaagttatgactatactgaattatcatttatgatttattagataaagatgaaacaaatcataatatcatctgttggcagtatctgaagaaatgggcatgctcatgcgttgttggagggagtggggcaatttttaatcaaaattggaaggtactttatctagcaacccctcttaggaattaaagatatttgaagaagtattcaagggtattgatttcagctttttcgatcctaatgaaaattgaaatattttaaatgttaatcggaaggagatacagttgatctatgcagacatacaaagcttaaatgcttagagggatcatggagctagttaaatgaaggagtggttcaggtggaagacaatagggagtgatgggatcatagagaatgggagagtgtcctcacaaagggacaggcactctcggctccagctatttgtcaccatcagggaatgctgagcccaggctgccagatttttgtggaagagaagttgaaaatcgaaatttgagaatgcagtccccggatttttaaactaaaatgtaaaagaaaacacagtgcggatcataaccaacactttcgccaactctggatgtcataaatttgtttcttctttgtttatctaataggtcataagtgatcattcatgttagtcgtaacttgcatttctttaaaattattagcaacattaaatatattctcgtataggtcatccttattttttttttttgagacagggtctcactctgttaccaggctggagtgcaatggtgtggtctcagctcactgcaacctcccgtcttcccgggttcaagcaattctcctgcctcagcctcccgagtagctgggactataggcatgcaccaccacgcccagctaatttttgtatttttagcagagacggggttcaccatgttggccaggatggtctcaatctcttgacctcatgatctgcccaccttggcttcccaaagtgatgggattacaggcatgagccactatgcccggtccccttttatttctttgataggtaggtatgtatgtatgcatgtgaattgtctattcacttccttttcctagtttcctattgacaaatttactttaaaattaattaatcaaataccaaatttagctttcaaaatccagtttgcaccatgtgatttgtgcagtgaaagacttccaggccatcattgtggcaggctgttctgctgcccccacgtgggctgtcccatctccaagacaggattgtctaccccatgctctactgtgtgcctggcagtgctactgtgtgcctggcagtgctgctgtatgagcagtgcactggcccagcccgttaatgtggggccaagcatgtgtctccttttggccaaacacatacgagtggaggtgacacacaccttgtctaggagaccttaaggccataacaggtctccactccactgttccacactctgcatctgtcctaaacagggaccacctgaatcctggaatgagatggcacatgaagcagaaccgtaatgaatgacgaacccctgatatgttgtgtagttataagtcaccaaaactgttgggttcatttttgtagcaaagctgactaatttttaaaattgtttaaaatatggcagttttcactgacatgaaaagatctctacactatatggctgagtggaggaaaacagcagcaaaacagaatacataatatgaaactttttttgtttctttacttttttcttctccttttttttcttttttttttattatactttaagttctagggtacatgtgcacaatgtgcaggtttgttacacatgtatacatgtgccatgttggtgtgctgcacccattaactcgtcatttacattaggtatatctcctaatgctatccttcccccatcccccaccccacgacaggccctggtgtgtgatgttcccattcctgtgtccaggtgttctcattgttcaattcccatctatggtgttctcattgttcaattcccatctatgagtgagaacatgcggtgtttggttttttgtccttgcgatagtttgctgagaatgatggtttccagcttcatccatgtccctatttttttgttgttgttgttgtttttgagacggagtttcgctcttattgcccagactggaaggcaatggcatgatctcggctcaccgcaacctccacctcccaggttcaagcgattctcctgcctcagcctaccgagcagctgggattacaggcatgtgccaccacgccctgctaattttgtatttttagtagagatggggttcctccatgttggccaggctggtctcaaactcccaacctcaggtgatctgcccacctcagcctcccaaagtgccgggattacaggcctgaaccactgtgccaggcccattatatgaaatttttaagtaaaatgttgcatattaatatacctccatatagctatatgtatttttaaaaaagcctgttagatatgcagaattggtaatagtgattgtcttgagacgctggacttgggacagcttttactgtagtttttccactttcctgtattcttgatttcctgtaacaaatcatctttgtaaaaagaaattaatatttctacatgactgatggttaaaagaatctcaagagccatatagaacataaaatgattccaccagaataatttttcaccctcaaaaaagtaaatatcttcatctcataaaaacttgattatagagccaagactagccaaggcactcctgaaaatgaagatcaaagagaaaagatttgcttatcaggatttcaggaattattataaagctatactaattaagacaatatgctactggcataatacaagtatgtgaaccaattttaaaaagtggagagtctacacatatccagaaacttgattcatgacatagttggcattgtagacaagttggaaagaaacagagtttccaataaattgtgctggaaaactggttgtccatatttttttataaaaagataaattgggcccatacctcctattataactcaaaaattaatgcctcttggcttaaaattttaatatgaaaggtaatatcataaaacatttagaagacagtctacaaaagatcttaatgactttaaaggaagagaaagatttctttaatataaatctcaaacgatgaaaaaattaattcagctacattgaagttgagaacttctgttcatcaaaagatttcatttaaaaaaattagaagataagctacaaaacaggagataatatttttaaaacctgcaaaaggcaaaaaataatatgtagttatttttcagtgcttatgatgtgccagatgcttatactaaggctttacatgtattaatgcagctaatttcacaacaaccccatgagacaagtagtattgtcatccccattttgtagatagcactgaggcacaaagaagttagggaacttgctcatgcccacgtagttaggaagtagcagagctggaatttgaacccaggctgacttgctttgaagtctgttattttaatcactccaacatgacgttatactgcctcagctatattaaaggatgataattcaaaatatatgaagagcacctataatcaataataaaaaagactagcagtacagtgcaaaaagggcaaaagattaaagggtcattttacggaagaagaaaaataaatgatcagtaaatatgtgaatagtagtcaatttcactagtaatcagtgaaatgcaaattatagctactttacatccacctgattctacaatgtagaagagtccacatccttgccagcatgaaataatggtatagaggagttcatatccttgccagtgtgaaatagtggcacagatatggactcttctacactgctggagggagcatagattgacaaatatattaatgtcatcattctcttaagagttaattaattgatattttggtcctactatgtaaaaattttatggaaaaagtcatctctttaggtcacatttttctcccacatggacacatgagacagttctattaaaaatagaagcaaatatgtctcaattgataaaatatgtatatggagtttattaagtggtttgtaaaatataaaattcatctttaaaacttgaagggaagtatgagcctcactcaagtctattttgattaaaaagatagtacatatttgagtgaaaaaaattctttaacttattcttaagggcctatttaagacagatttttatcccaacttggaggcgttgacaaaccaaaatggtaactgttaattgatggcaggtttttaggcagtgggttttttgttttttgtttttgtttttgttgcacttaatatggtgccctttgtctcatttctcactgtcccttttatgcttttgtcttaaaatattaaatcagcaaggaaagtgtcagaagattacagtttagttcattgcaaaccacagcttatctttacactgacctgcagaacagtcttagtgatgttattagaaaaacaccagagaggaacagaactgagaagaaaaaaaaaaaaaaaaaaaaagctttgcttttctagaacagtttctaacagtgctaaaaaacatcatgttttgaactatcattttttgactcggtaatcatgatagcgagcaaatgccctctatcccctcagttcagtcctacagaattaagtcctggaaacagcggctgtccagtttgttaaagattgacctaggaaagatctcaatgctaccagcaccttatagggcgcaaaatgtaataatagggtaaattatgttttctttttcacatttgcacgctgagattgttttggagatcttttaacttagctcgttataatcaagttgtacagcctttgttttaataagattctaatcctgaggtctatccttcgcatcaatgactttacactgttaattgctttcttgtcctccattaaattgcggttgcagttgcttcatcttaaaaggcgccttgtgctttgtattctgccccatgctctgcagacacacttagtaacatcatcttcctaaagaacaaaattacctattatccctttaatcttgatgtacttttttatgtgtttggttcctagctagtgtccaaccaggaagctacatattatcttcttttaaaaaaaaatgtttttttaaaagccgcatagtgtggatggccaaaatttatttctcaatagaactcacatagtgcattcatttattttttataggactaattaaaaagacaaagggatctattctccccttgatacaccagagtgacttccattaacattaatggaagggaaatacttgcatggagatgagtggagacctcatattagaaagtgaaaacagcagagtctggagtgaatgtccccacgtttttgatgagagaagctacacaaaaagcaaatagctcaattcacaaatgtgttttccccctatgctttctgtttgtttgtatattgaggaaaatcagcgaatatttggaggcagttccttccttcagaaatcaattggatgtgaatttgtaattttaacacgaatgacacaacttacaggaggaactcagcaatgagaagcaacggggggatctgacaggtctttgctgcagtggagtcctgtgagacctgcttctggaggcagaggtgagagtagaaattggatacctgaagaactctgtacacagaaacttaattttcaaggaagcccagctgtccgtgtcaagctgatcttttgacacatctttccagaaatctatcaaaatctggagactgcttctgacttttcagtgtagcctctgaatctgtgatcctcttggcccccttgtataccttatgaaagttttaaattttaaatgtacataatctgacacacactggggaagtttctcttttatcatgtcattcttaggttaattaccagggaattaattatttaaagtgtgactagctctccatgctgtatattgttttaaaatattgatacattcattttgcatctggtgggtgctaagttcaaactgctttttaccctttgaaaatgtacttcaaaaatacaagcagtcttctgagtaacaaacctctccgtggtatcttgccactgccctccatttccctggcctggactttgctttagctgcttaaatcaggctcaggagcattatattttgcctccagtctctccctccccctgtctggttagcactatctctggaattttgttactattcatactgacctggaaaatgcttctaagatactttcttactttaattgcttcctttcttaactatgacaaactccctgcttcagaaccttacctggaactttctttggagctaaaagagattcaaatcctttagccagagttctttgttcagcttaaagtgtgactttccctgtcttatatttatcacctttaataccttctcctgtcttgggatccaattcagccttcatctgctctcgtcagaatttcctaaagaatcatctatatttttcttctcacagtaaaaccacattttcctccatacttcctatgttgtgaagtggtttgcaaaatgtatccagaggaacttgggctggaggagaaggagaaggcagtggcaaggagatcccataagcatttcattttaactttgcattttaaaaatcctttcattcccctaagattttttagtgcgttagttcaggacctctgagaagctgacaccaagacgaggtgaaatgtgcaagagctttactgggggacatgcctatgaagggtacagggaggaagcatgagtaagtaaggacggcctcagaccaagaggtaagtctggcacctgtgggaggcagtgtggggaaggctaaaggaaggaacaatgattgggtagcatggtgcagttctaagaaagttttgaaaagaccaatggaaagtcctcaagccaatcacctgccagcaaagtttcacatcaggcaggaatggaccctgtaccactactcccaccaggctcagcattggttggctgggaccatcctggaagaatttggcagcaccgcacatggtgctggatccagaggggtggcatttggggttttgagtcaactgtgctcccctccacaggaaatctgactagcacctttttaggccaccactctcagctgtttgttttcctcctgcagtgtggctgttgccctcagaagagatcagcaacctgtcaagacagtcttactcctactggccattctcccagggccaactaatgctgctttggcagtcaccatgggatcactatagacagtgtggatttccccctcacaagctctgagattaatgacacctgtacatccatgaaattagctccaagactatactgtagccaaggctcaaaatctatttcctattccccatttcaaattatatatagtcatgtttctaaaagacagcataacaggttgtagagatcaaacaacctgattaagatatttaatcgactgtcaacataaagatgccctaagtttgaatacaaactccctaccattttcaaattcctggagagaaatttaagtccaaatattcaatcactttacaaattaaagtccaaagaacataaagtctgcaatcagattctcttatcctagtgagctaaattttaaaaatatatatccacagtttattctctccaatttttgatattgctcagtgccaggtactggggttattgatacataagacgagttaggattgcttgaacagcttcagcctggagtttctatcactcggatggatgtagtcccttcagtgcttcataaattacagctgaagtctgaaagagttcaaaataaatccttaaaaatctcaagattattattggcctggcacttacccaaacgagaaagtgagctagtccccagctactaaagtaattagtctagtgcccagggttactaaaactgtagcagagattgagtgctaagtgagtaaaggagagtagttggagaaaatattggttttagtctttttttcctttgaagacagggtcctactctgtcacccaggatagagtacagtggtgcaatcatggctcactgcaacctcaacctgccaggctcaagcgatcctcgtacctcagcctcccgagtagctgggaccatatgcctataccaccacacccagctaattttttttttttttttaagttttgtagaggcagggtcttcctatgttgcccaggttggtcttgaactcctgggctcaagtgatccacccacctcggcctcccaaagtactgggactacaggcgtgagccactgtgcctggctggttttagtcttccaacaattccagtcaggctatatctgatgcccagaatctatgacctgtgaatataaattcaacggaaagaaatctttccataagaggttaactagaccctatacatttgtatttatgggaaaaagtcatccgtgtaaatggtcaactccagtaaatgttcttgaaaatggtctactccagtaaatgttcttaacctggttattcccctttcaaagcactcatctggaggccaagaatcacatctgtcatgagcaccatggaatccctggcatccagccccatgcctaacataaaggagggacttgataaataattgtttttatgaaaagaacttaagagaagttaattcctcctcatgtcattcaagcttctatatcagcttagttgaagaatagcctggtttatagggtgaactgttaaaactcttttaaaatttacaactgtgcaatgcagggttttcttaatactatgtaacaataacaaaaaaataaatcaagctctgagactagcataactgtgactaacttccataagctttgatttccaaattctatgttaatcactatacccacattattctcattgattgactttacaacaagtaaatatttactgttatgactgtgttttaaaaattataattataacttatatttaccctaataaaataatacatttaacatgcatgattttgttttaaagctaggtttctgctaataaagtttgaaaactactggcttggcgaaagtaaaattggctttgagggtgagaatttgatctggattcagatttctctctgccttaacatattttagactcaggtaactattttgtaaaatgggaatgattatatatacctcaaaatttgtttcaggattgagaaagttcagtaagaaaatcttaaaaggccctggcacagagcaggctctgtgtcttgttttcctcctctcttaacaaatgcctttattcaaaacaatcacagtagattatacaggcctacagacaaaataggcatttagtaaatctgctgattaatttcatttttcaatatttgaagatattttcattaaacaattttaactgtaagtgggttaaacagttttcattattagaattgactactttcttcaaagttttcgtattactttattcatacctgggttccagtacatgcctccccctagaatttcagcacctagagtacaggattatatcctagacttcatctttacagtgaaggccatataattgaacttcgtaaattttgaacaaatactttttttaaaaaaaaatcagaaacctatatataaaactacttatgtaccagcgctttgtaaatattaattcacttaatctttataatcccctgaggttggtacaggttatccgaaatgcttcaatgagcatttcctttaaatatgatgtttgagtgtcaactcagtgctgaaagagttttagattttgaagcattttggattttgaattttcagattagggatgctcaacctgtactgttattatccccatttcctagatgaggaatttgaggtctagaaagtccaagtgacctggccacagttacacgtcttctaagtggtagagtccagcttggagctcatcattgctttgctttaatgtccattctcttgatccttgtaccattctgcctcccattaatgacaatgcttatcatcatcaaaaaggaagctgcggtagcaagctgatgagattggtaataatttagctccagaatttttgtattacagtttctatggtaaccttaactcttccctttcggtatgtgctcattcatacagttgagctcagttagttgcaggtgctattttgctatttcgtctcacaggactactttatccatcaagcactatgagcaaaaggccatgggccttatgaacatgtttgagaatgaaaacaaagtttttactccaaaataagaaagctgcaaaattaaaattaagaaatcccttaatttaatagctacaacatgtaatataatgcccacattattgttaaatgtagttttcatacacatttcaatacacttgcagtctgtaggtttaattgctcacttcattagaattcccaagtaagcaggatcattgcagaataatcataaccagtcatacattatataagatacttatagcaaatattttaaaataaaattataaaaaaattttaaaatattttataataaaatgttatatttaatgtgagtaccttttactctgacatgacatgtagaggatctgatgaaggtcttaaaggccttgttaggacttacttcattttaatccttgacaaactaaccagcaagctgcctacctacttctctgtacacactagctatactgaataaggcaaagaagaaagcatacaccgtcttattgatgagttttataagtaatccactttttaaaagtaatagctatttttcctatccattaccatgcaaattcctgaattatttctaattctcatttttctgatttggtcattttgagatctacttcctacaagaaacagcagagaacagaaaatgtagattccgtgaacacataagacctctcagaacccttcggctgcttgcttgattttgaatattccatgactccttctctgcatggagtacaattctgagcttttaggaggccctagcaaattaccacgacctaggcagctttaaacataacacaaatgtattaccttacagttctggaggtcggaagtctaaaatggatctgcaaagcttcatttttttttctgggggctctgggaaagaatctgtttccttgcctttttccagcttttcgaggctgcctgcattccttagttcatgcccaccttcctgcatcttcaaaactagcaggatctggttggtggatttctcaccctgcacccctctgacctcctcttctgcctccctcttcccctttgaagaatgcttatgatgacattggtcccacccaggttgtccaggataatctctccatctgaaggtccttcgtttaatcacttctgtaaagtccctgttgccatgtagaattccaaggcttagtacatgtgcatccttgaggggccattattttgcctgccacagaggcacaaggcaaaatctagaagaacagatttctcagggcacctaagctgctgcccagcacacactgttagttattctcagaggtatattcggttcatctcactctgctcctgctactggttccctaatgcaccttacattctgcttctaaagttgctgctgcctctcttcctactcattacttttttcttaaacctaataacatggaatatatgattcactacctccctttgattctgttggtaataatgccctgtgcagtagacccttggtgggcagagcagtgtatgtaggcacatgtgcacgtcatgcctgcacacccccatcatttttatttcccatctttacctctgggttttcactactgtttattcagaaaatatacatatattctttagagaattgccacatgcaaggaattcattcaagactttgtgtgaaataataatgtacacagctgtagtgaacttgttttctctctccccctaggcgcaatccccctccccttcctcttcatgcccagtcagttaaaggtaccagaagcaacagtggcgtagacttgtcagactcagacctgccacttagcagctgtgatatcctcctccgcatattccttaatctctgtatgcgtcagtttctttatagattaaatgcaaatagtggcagcttttccacttcagactgcgctcaggaatcagtatttcatttgatttttaaactgccatcaaggctaagacaaagcccttatgagataaaggccaaactcctcaggatagctctacagggctcttccaaatcagatcccatcctgaccttccagcttcaccttccattgcttctactgcatctcaccctccccaaaccagatctgcttgccaggcgccagacatactgaagacaggacatgacttcaggttagcttcatggttttttttcttttttccactttgataatgttaaaaaaaaaaaaaaaaaaaaaaaagacgaagtgaggtgggaggacaaatgccagccagtgttagagagagattttctagaactcccaaggagaattatcatgccttgagaaaggggaggacatatactgaatatgtttaaatttagattaaatgtatgtttccttttacaacatacagttaatcagagataactttgtagcgatcagtgattcctagccagaaggctaggaatttggcattattaaatcttatcttccctaaataaagtaaatgggatacccacaaataactgagtcctcattttactcaatgggcattagaagtaactaaataaattgaaagttggctgttactgaggatgttgcaacctgatttggggaggagtggaggaggagaagaccatgagaactctcacctctggacagggcttggcactccggaagagttccactttttatgcacctgatcccttagcaccactaggtggtaagaaagcaactgaaaccaacctgagaagggccattgacattacatcctccccaagtcacctccatatggaggaagaatgactagacccacaggagtgaaagccacaaggtcagaggaaaggggctgctgctaccacattctcagctgcactcttggtcttgataccctttacatagacctcttttacttcttaaatgctgtgtcaagggcactcaatttgactattctgagtggatgaatttttaataagtggtgtttgtcaacacctgtctccccatcggggagaagccttctgggacccaggccatgccctgtcaccctgtcacacctcctgaccactatacatgctgctccagtaactgagccaccccccaccctccttacatgctcatcaggcagtccgtgctcagcagcccatctgtgaagcatttcctagccggctgccacacccaacacaagcaaggaaaggccattcattaatattttatgctaacctttaatgcactatacaggatatatatgtgtgtagaacagaattttcctacagacttctcatgaaaacatttcactcactgggctgggctggtcaccatagaaatcaagttaaatgactacagtgcctgcctgttagaggcatttgaatgtacaccatagcagggacaggggcacacaaagaaatgagagtaaccctctgagaaaaatcctaacttctcatcccgcctgccaatatttttttcctataagatagtaaataactacagcaaaacttctactaaaatgcatgactgacatttcgttttttgctttctagtttgcaagttgttttcatgttcgttatctcagtggatcttggcaacaacccagtgtaaaactcgttgtatttttcattatttatttatttatttattttggaaacagagtctcactttgtcgcccaggctggagtgcaatagtgcgatcttagctccctgcaacctccgcctcccaggttctaacgattctcatggctcagcctttgctgggactacaggcaggcaccaccgtgctcagctaattttttgtatttatagtagatagagggctctgccatgttgcccaggctgttctcaaactcctgagctcaggcaatccaactgcctcagcctcccaaagtgctaggattacagacatgagccaccacgcccggcctaaaacctattttatttatttatttatttattttcaagatggagtttcactcttgttgcccaggctggagggcaatggtgcaatcttggctcactgcaacctccacctcctgtgttcaagcgattctcctgcctcagcctcccgagcagctgggattacaggtgcccaccaccatgcccagctaattttttgtatttttagtaaagataggatttcaccatgttggacaggctggtcccgaactcctcaggtggtccacccacctcagcttcccaaagtgctgggattaaagccgtgagccaccgtgcctggctaaaacccattttatagatcatgaaattgaggcccgatttcatcagttgaggcaattgacttatctaaagttacagagccggtgggcgtggcagtcaggagagaagagtgtggtcatccatctattcatcctccaccaagcccttagcaggcagctgccatgggaagagcacaaggaagagcacaagggagatgctgataaatgaactccactttctcccctcaagccgctgctgccttgcttttcccatgcaccatcccgtgtttctccccgttcctccttgtttcatctgcctattatttcagtaactcattctgtgctcaaaggaagcccccgtatggtgtgcttcctttatgtactatgtttctcaccactacaccatgcgctaacacaagactattcaatgattgaatctcaggcttgtgacttaaacagtttcccacacattgggacatcgggaagcatttggggggaagaactacaggagacagggcagcctagttctagaagtcatcatcaataatgaagatacaacaaggccaccaaagcaagggggaaatccagggaaattttacaaacaaatgataaaccattgattgttgattataggaaaagctcacagaaatcaattaaggaaattaacatatccatacaatgaagggacaaaatatacaaaggagcacttgataaacaaactaatgactaataaaaatgactgtagtctaactagtagtcaataaagtagatattaaaacaataatcttcacctgtcaaattagtgaaatacatatatatatatatatttgtgtgtgtgtgtgtgtgtgtgtgcatatgatgaaacaggcacattttaaaaatactgctggtggaagaacagtgtgataggtctttcagtaaaagtaactggagctatgtatcaagagcttcaaaagagttcatattcaggttcagtaatttcatttttaggaatctaccttaaggaaataattagaaatttggtcaaatactcaaaacagaaatgctcaacacaacatgatttataaaagtagaaaattgacagcttagatgaatggtaaaaaaaaaaaattccatgaattatcacaaagctctgtgctgtatcataataatgcaaagaatatttaaggatgtcacaaaatgtcaaccacaattaattctcctgaaatcttggaagaatgtcatcactcttcatatggtagaaatggtgggtgacaaggggcttcctccacacaaggcagggagggagcatggggctgaggaccagacctggctgccaccacttactaaccgtgtggccatggcaaagttgctagactgcccagagctcccaattccccacagtgtcccttacacctaccttagcagacaaattgtgagataatgtgtatgaaaacgttgatgtggtaaagaagctagggcagctgctgctggtagcatagaatgcaggcactggagagaaaaaactattagtgggatggataacaggctgcaaaagtactttatgaactaaattgcagtatgtgtctaaagtaatattttaactgattacaaattttcattctttttcacatacagaacattcatatccccagctgccctcagtatcttaaacattccaattgcctaattattcagatgtcctccaccaacacagtcctgagtcctttgatcatccccatccacaccagcccccaaaggtggctccaaaaatcacccagacccctgcagggtagccctatgtcaaaggactagctctagggccagaagacctgattcaaagcccagttttgtcacatgccagttgcaaaccccaagccaaagtgcttaactactgtaaagccacagtttcctcaactataaaatggggatagcagcttctacctcatagggatggtgagcttttatttggattatttcatttaatcatctgtgcaatacctggcagagaggaaacagtacatggtaggttttattactactactgcctctaactcatagatggctttcagcttccagttacacaatgctgttcctcccagcactgctcacatgttctagttaaggacaatagaagcagcctccagagtgtaggacaatgtcagcctgtgcagaaagcatagatggagtcacaatgcgtggcccacagcctttggggctatccagactgctcatggatgcccccaaactgtgactggggacatctcaacctaccctgatgtaggttttgggaataggtacaaattgaacatgtggttagcatttgtaacacttcatgaagatattgggaggggtgggtgatatgacctagccctgtgtccccacccaaatttcatcttgaattgtaacacaaattctaatccccacgttttgggggagggacctcatgggaggtgattagatcatggggtagttcccccatgctgttctcatgatagtaagtgagttctcaggagatctgatggttttataaggggttttccctgcttcacttggcacttctctctcctgccaccatgtgaagaagaacgtgtttgcttccccttccaccatgattgtaagtttcttgaagcctccccagccatgtagaactgtgagtcaattaaacctcttttctttgtaatttacccaatctcagatatttcttcatagtggtgtgaaaatgacctaatacaggtggtatatcagggaagacaaaagtcactggggaaggataggatagagaggaagaaatctggtgttgtctattacacctgtggaaatgataggattctgaggtcatgttgaccaaagagcagggatttgggggtatggaataggccaccaattgagtcaaggcagatggagactggtttatgccacatgcgtacccagcttgagtggtcctgccctgagcagtgagcaagtgaccagcaaggacttccaggtgcctggtgtatttctgctggtgaggcagtcccagacctttccttcctgtcacttcattgcctttcagcttatctggacacctacttggtacttccccatgctgaaggctacatcatagtcatcactgtttcttacggttgactggtggagacctttccattttatgtttcttttcccgattgttcaactgttaggaagtgagataagggaaatgagtatgggctttgcagtcagaagaggattcacacttctactgtgccccttcctagttctgtgtccttggcaaagttgtttaatttctctaagcctccatttctaaactatttgtaacaaaaatataaaaatatgacatcacactccactgttgtaaaaatttattgagaaagaaaagtatttggaaaaaaactagaatacaatatatggttagtaagtgatactgtttttctctttggacaaaaaacatttaagagaattactgaaatattattcttgtggcattacgaatatctagtcaaatatgtttgtaaatgtcttgatgatcaaaaatatttgacagttatggctgggtgcggtggctcacacctgtaatcccagcactttgggaggccgaggcaggcggatcacgaagtcaggagatgaagatcatcctggcgaacactgtgaaagcccgtctctactaaaaatacaaaaaaattagccaggcgtggtggcgggcgcctgtagtcccagctactcgggaggctgaggcaggagaatggcatgaacctggggggcggagcttgcagtgagcggagatcgcgccactgcactccagcctaggcaacagagcgagactccatctcaaaaaaaaaaaaaattttttttgacagttacaatgaagccaagtgctaaggatataatgattaaataagacaaagttcttgtcagttggaactttgattctagttgggaaagacatcagataattaacatacataggtatatataaatatatgtattggtatatatatagataagatgcataaactaatgtatgtatagaaaaataatatatccatatgtgcttagctgtgcacttttaaatgaacatcttgccttttgattgattatcttagctggtgataaggacatgtgaatgaaatcccagactccaaagtatcaggttctaaagagattagagtgaggaggtagattttgagctaagaaggatcatgcgttaatgtctaagaatatgcatgctataaattgtgacacctctgaaagtgaagtcagctggctttcctaggccagcaaattgctggtgaccctggagaattgtataaggccacaatttaattgcacaggctttaagagatctgcactcctttatcccattaattcaacctgcaactttgttctctggtcccttttgaatattcagttctcattgatttcaatgggagttacagactcagagaaagggaagaattgggccagtgatctgttcaaagcaaagcatcatttaaagtatagttttaaagtatttgcaggcacataggtgagtcagctccttctcacgaatttgtctagaatgctttccagtttaaatggaccatcttaaagggcagtcaccttccctaaaattgcagcatcatactcatgcaccacatattggattgtgactgctgggaggcaatgactccatgttgtggtctcaactttactgcggaattgcttcagatttaagctatagcctaatcgtaattagcagcccaaagtaacattataaattcctacaatgcctattgggctctgtctgctgttccacacatcaagtcaagtcaatatagccttgccctcagagaccttttgtttgaaatagtctcggtctattggtcatgcaccaacacagaggcaaagaagcaaaatggctgtaaatacaacgcttaaagcaagtgaacttgcacagacagggaacatggtgctatgatttcagctctccctcgcctcatggactatataggttatagcacttggctgcacgataaatttctgtaaagcacatcctatttttgtactcatttccattgtgtaatcccacgtgcattagaattcatgaaagtcttatttgaatatttctttaggagagagatcccgacagtgtagactgccagacatccaactccccaactactctgtgtctgtccagacttctcagtgctgatacaagctgcagccttgggagctcagggccttctgtttactgggagctctttctctgaccaagagaaagttatctgtatcccactttgagatacccagaatccgtgcttccaacacctccctgttccttctgtctgggtatttatattgcttaggaggaccaggctcaggactggccccctgtcaggaactgcctctaggcgtggcgcaaaaaattaagttcccagttttcacttttgcaatacaagtgaagagagctgctatatacagccttacaggtcgtacagtccaaatcagaaatgtggcgacactgccaatgctgaaccttgtcagcgctttgagatggcgtctaactctgactgccactttagtggctgtgctaccttgggcactctctggatcctgactttctccctctctaaaacggggccggctgggagcggtggctcgcgcctgtaatcccagcgctttgggaggctgaggtggatcacgaggtcaggagatcgagaccatcctggctaacacagtgaaaccccgtctctgtgttgtaaaaatacaaaaaattagccgggcatggcggcgggcacctgtagttccagctactcgggaggctgaggcaggagaatggcgtgaacccaggaggcagagcttgcagtgagctgagatcgcaccgctgcactccagcctgggcaacagagcaagactctgtctcaaaaaaaaaaaaaaaagaaaaaaaaaacggggccatgatattcaccttttagagtgatcatgtggactacattagacaaagcgagcaaaacgtctgctcactatgtagtggtttttggttttttgtttgtgttgttttcaacgagagaggttatttaaatggataacatccttaccatggagtaaaagctcatatgtgattaatattttgaaggaaaaattcttgtttacttttctcagatattgaagatattcatgctaaccacattttgttcataataatgctccaaggaaaattttctgcagggcttgattcttactacagtatttcaggccggctcagcactccctcacctggtattttccatgtaaacaagtaacaaaataaataggggcaacaaaagtcactgctattgtaattattaacaagtattctttggttgattggcttttcttatgtaaaattctgtttctaataattgttaaaatagtaaataagaggtcccagaaataagatttgtatcatgtttaaactccatttcaaaatgtttattgccttgctgcaaaataaaaaaaaatctcagatttgtgtgatgtgtcctagcttacagcaatctattttttagtgtctttttttttttttttttttttaagaccaagtcttgctctgtagcccaggctggagtgtattacacgatctcagctcaccgcaacctccgcctcccaggttcaagaggttctcttgcctcagccccccgagtaactgggattacaagcgtgcaccactgtagctggctaattgttttgtatttgtagtagagacggggtttcaccatgttggccgggctggtcttgaactcctgaccaaaggtaatccgcccaccttggcctcgcaaagtcctaggattacaggcatgagccaccgcgtccggcctttttagcgtcttttctttgccttctaagtagttgtacagatctagaagtagtgctagctacattacttgtggaatataaggttaagaaattcccaggaaaagtttaaataatttcaaggcaattatttcagtaactttaaagaaataattagaatttttagaattcaccaataagtgtttatatagtagagatgtagtggggttagggatttgggaatggcaaaaggggataaaacacacagccagaacctcttcagtggtaactgctaaaacagcaataaacaacaaaaccaccagtggtcaaattgtgtagtatgggctttaggtgctaaagaagttcagaaggagagaaattttagtgtagtctttgataatcagagaagtttgctggtgaagctgggtcttgatctaggtctgaagggatgaacagaatttggataggcagaggtaataactgttccttagtgtttaataccgctgatctgcagtgggaatctgcaaattctttcacattataaggatgtaaaatatttccaaataactagcaaacctaagaacttgactgtgaatgcctaagatgattcagcaataaaacttctagacataaataaaacccatctcaaagccctgactcagcaataaaacttcgcagacataaccccataggaagaagaaataccaccactgaggtccacagttccagttgggaaccagcattgccctgagtttgtgcatcagatcttcaaaagataaggggtcaacagattgtgattatgcaaaagaggtgttccaattctactgattgtgattatgcaaaagaggtgttccaattctacttgggcacacaagtaagtaagttaacaagagaacctgaaagttagctaaattggaaagctggctgaaatgctaaataaaacatactcagtaagaaacggcgtgttcactcagcccggaggaagtgcagcagaatggagaatgttttctaatacagctctactcattataatctcagctcagagctcctcagtgataggtacagaaggcatattggaaacttcccacatgtctatttcctactaagtctatcatcaaaaactgcaaaatttaaaaatcacagtgaatgttgactggttttcttcagataaaatgatgatgaaggtattaacattctgtgctatagatgccatactgaatgtgtatatataattaatattatgtatacatatatgtatacatatgtacatatgcatacacatatatatatagtcttagtccatgggctgttacaacaaaaacatcattgggtggcttaaacagcaaacatttatttctcacaattctggaggctgaggcttcgaagatcaaggtgctagaagatttggtgactggtgagggccttcttgctgattcatggatactgtcttctcactgtgttctcacgtggtggaaaggagtgagaaagctctctagaatctcttttataagggcacaaatcctattcatgagggctccaccctcacgacctaatcaccgccaaaaggcaccacctactaatatcatcacattgtgggctaagatttcaacacgtggatttgggggagacatattcactcaataaccctgtaaattgaaatttatagttgttttaagagtctgctcacctgcctgtgtaccccagtatcctcttctcattgaagtccagtctcatccttcctaacaactcaaaatctagactcatggacagcattcttgtcacattattccccactactccatgcccatgttatgttagactcgtggttttgtaaacaaacacattttgaactctctttattttcaccttcacggatatccagcaggtcactctaaactctgccttaccagtttattctgatcttatcaggcacgtgaagttgtggtaaaatgtgttctgtcctcacctctgtcatcattgctgctactcatggaactcagaccaggaaagccagagctagtacaaacacctccaaagaagtagcaaatgactggttgtgggcaagagtaacatgaagactgtaattctgagacactcacccattccctgccagggaataatataattgtttacctgtgttatagacacccagaatctaagagaggcacaagaatccatctagccagatctggcatgagactcatttgctaaaggtccccagggggaatttgtataagaagaggagcccaaaagtgcatggaatagatttaagctgtcccttgaaatgaccttgcctggttaaccaaaatctggattcatttttactgtgtcttttacaacaatcaccttcacagcattagacggaaccattaatgaaagcaggagctcttctagtcagtacacataaaaagaagtcgtttaaacccagtattacgtagatattaacactaaaattgcaaaaaacagtttttaagagaaagaagaagttaagaagtatcaaaatatcagcacttatttctataactaatgtatatatagaagacatttaaatggaaattatctgtgaactaaaatgagaagttagaaatagtacaataacagaaatggttattgaaatcatctgaaatttccttcccttctacagtatcaaataatgatatgacagtctaagttgctcacagaataagatagcattaggaagattttagaagacatttttggagtttcacgaaaggaggtccctgaagaatagaagatggtttagataatgctattatttaatcaaaaatgtcaaataccagcaatcacaccacctgcttttgaaagtaaaggaagctagggactaaaaggggtggtttaaaaagagacagaggaagaataaatgacaaaaagagaaaaaaataattatagatagtctaaaggatatggatataggttgtatttaagcagtgtttttttgtctcagaagtttatatgtgaactaaaatgtattaaaggataaaaaagcaatatgtacaactttttgtatgtcagtcatgcctctataaagcagttttcttaaaaagataaagaagaaaactctaggaattagcaccttttttaaaggatgagaaaagagagtccagttacaataactgttaaggttcttaaattcttttacacctcttacccccatatttctggttttcactgtatgatagtttgataatacagcccaaatttaccttttagctgtagctcttcttctttgttagggcttgattcttaaggagattgctcaggtgttgagaacaagtagtagagacacctaagtatacccagtattaatcccagaagaaataccatgttagtcactttcacttcatgcagtagctaatctttttttaaaattgtgttagcgtaaagtgttggtgaacccactcatttttacatgggattatcccaatttacataacctttttgtaacaccacattttcaagtgttggaaaataaaaacagattaacttaatattgtgactaatcgagagttaaccaaaaataattgtatttcaaacctatgactgaaaatgtttcttaaacattagtcagcttccctgccttagggattgttgactcacctccagttgtagggtgaaggatagctcagccattgagactgctgccagcctcgtcacccagggctgtaggtcaaggaggtgccagaccagggcctgaaactactctgaaccctgcccccacgttcactggttttcagcactaagatttgcttgaagtgaagaaattgtctagatgcgtatggacagtttgacattgtctgagtaagggaaaatatttttattttaatacttgtcttttaggaaaactatcatttgtcaacagggatctgtatgttttaataaagcagaggaagggtggtttgcatgtagtcacttagctaaaatttcatgtcatttaaattttctgatcatgagtaacccagaaaaattaaatatacttaagataaaataataaaatcctttcatatatataaataagcaaccaggatagttttcattctatctatctagctagctatttatttattatgttttaatttctttttttacagacaggtttttgctctgtcacccaggatagagtgcagtggtgcagtcataagctcactgcagcctcaaactctgggctcaagtgatcctctcaccttggactcccaaagtgttgggattacaggcatgaatcactgtactcagcctgggaagcgtgggatagttttcgttttcaaaagtcagttaagattatctttagcagaaatactccatcagtgctgacttttccaatctgacatatgtagtagcgtaagaacatgttttaaattttaaaaactaataagaaaataagtaaggcaagttcttcatataacaacaatgtatagaggaaagagcaatatgttaagaggagaagaaataaatttatttctatagaaacaaagacccagtgggatcaaaagaatttagaatttttaacacaaggaaaatacccatgcatggtgaggtagtagatggcttattctcttcctattcctaagatatcagtgttactttagcccaccgtaaaggaatatgaataatttccatgaatcaacgtaatgtatgcatctcaaaaagatttttaatttttaaaagattattctgtagtctcttacagtattttcttgtccaagccttagctgaaggattgcagtgtttctaatgatagtgaagtggctctaatgaggtggtctcctgatttaaattattgtatcaacatcttcatgtaacccagtaacaaaatatatgtacatacacatatatacacaaaacatgtatgtatatatgtatgtagtagatcaaaaattagaattctatttttcttaaattttactttaagttctgggacacaggtatagaatgtacaggtttattacatagatatacctgtgccatggtggtttgctgcacctattgacccatctctaagttccctcccttcgcgcccaacccctcacaacaggccctggtgtgtgttgttccccactttgtgtccatgtgttctcactgttcaactcccacttatgggtgggaacatgtgtcgtttggttttctgttcctgtgttagtttgctgaggatgatggcttccacctccatccatgtccctgcaaaggacatgatctcgtttttatggctgtgtagtattccatggtgtatatgtaccacattttctttatccggtctatcattaataggcatttgggttggttccatgactttgctgttgtaaatagtgccacaataaacatacatgtgcatgtgtctttatagtagaatgatatatattactttgggtatatacccagtaatgggattgttgggtcaaatggcatatctggttctagatccttgaggaatcgcctactgtcttccacaatggttgaactaatgtacattcccaccaacagtgtaaaagcgttcctgtttctccacagcctcaccagcatctattgtttcttgactttttaacaatcaccattctgactggtgtgaggtggtatctcattgtggttttgatttgcatttctttaatgatcagtgatgttgagcttttttcacatatttgttggctgtgcaaatgtcttcttttgagaagtgtttgttcatacactttgccacttttttatggggttgtttttttcttgtaaatttgcttaagttccttgtaaaatctggatattagacctttgtcagatgggtagattgcaaaacatttctcccattctgtaggttgactgttcaccctgatgatagtttcttttgctgtgcagaagctctttagtttaataagatcccatttgtcaattttggcttttgttacaattgcttttgacatttctgtcatgaagttttttcccatgcctatgacctgaatgttattgcctaggttttctagggtttttttaatggattggggttttacatttaactttttaatcattcttgaattaatttttgtataaggtgtaaggaaggggtcctgtttcagttttctgcatatggctaaccagtttttccagcaccatttattgaataggagagcctttccccattgcctgtttttgtcaggtttgtggcagatcagatggttgtagatgtgtggcgttatttctgaggtctctgttctgttctattggtctatatgtctattttggtaccagtaccatgctgttttgattactgtagccttgtaagatagtttgaagtcaggtagtctgatgcctccagcgttgttctttttgcttaggattgtcttggctctacagggtcttctttgattccatgtgaaatctaaagtagttttttctaattctgtgaaaatgtcaatggtagtttgatggaatagcgttggatctataaattactttgggcagtatggccattttcacgatattgattcttcctatccatgaacatggaatgtttttccatttgtttatgtcctctcttatttccttgagcagtggtttgtacttccccttgaagagatccctcacatcccttgttagctgtattcctaggtgtttgattctctttgtagcaattgtgaatgggagtacattcatgatttggccccctgcttgtctgttgttggtgtaaaggaatgcttgtgatttttgcacatttattttgtatgctgagactttgctgaagttgcttatcagtttaagacgttttggggctgagatgatggggctttctaaatataaaatcatgtcctctgcaaacagagacaattttacttcctctcttcctatttgaataccctttatttctttctcttgcctgattgccctggccagaacttccaatactatgttgcataagaatggtgagagagggcaaaatataaagaccaatgacactatgaagaaactgaatcaactagtgtgcaaaataaccagatagcatcaggatgacaggatcaggttcacacataacaatactaaccttaaatgtaaatgggctaaatgccccaattaaaagacacagactggtaaattggataaagagtcaagaaccatcagcgtgctgtattcaggagacccatctcatgtgcaaagacacacataggctcaaaataaagtcatgcaggaaaatttaccaagcacatggaaagaaagaaaaaaaaaagcaggggttgcaatcctagtatctgacgaaacagactttaaaccaacaatgatcaaaaaagacaaagaagggcattacataacggtagagggaacaattcaacaagaagagctaactattctaagtatacacgcacccaatacaggagcagccagattcataaaacaagctctcagaaacctataaagagacttagactcccacacaataatagtaggagattttaacacactttcaatattagacggatcaatgagacagaaaattagcaaggatattcaggacctgaattcagctctggatcatgtggacctaatagacatctacagaactctccaccccaaatcaacagaatatacattcttctcagtgccacatggcacttattctaaaattgaccacataattggaagtaaaacactcttcagaaaatgcaaaagaactaaaatcataacagtctctcagaccatagtgcaatcaaattagaactcaggattaagaaatccactcaaaactgcacaactacatggaaactaaacaacctgctcctgaatgactgctgggtaaataatgaaattaaggcagaaatcaagaagttctttgaaaccaatgagaacaaagagacatcataccagaatctctgagacacagctaaagtggtgttaacagagaaattcatagcactaaatgcccacatcagaaagctagaaagacctcaaatcggacaccctaatatcacaattaaaagagctagagaggcaagagcaaactaatccaaaagctagcaaaagacaagaaataactaagatcagagcagaattgaaggagatagagacacaaaaaaaaccctccaaaaaatcaatgaatctaggtgctggttttttgaaaaaattaacaaaatagatagaccataactaaaccaataaacaagaaaagagagaagaatctaatagacacaataaaaatgataaagggaatatcaccactgacctcacagacatacaaactaccatcagagaatactataaacacctctatgcaaataaactagaaaatctagaagaaatggataaattcctggacacatacaccttcccaagactaaaccaggaagaagttgaatccctgaatagaccaataacaagttctgaaattgaggcagtaattaatagcctaccaaccaaaaaaaagtctaggaccagaaggattcacagccaaattctaccagaggtacaaagagggtttcagaagataccattccttctgaaactattccaaacaatcgaaaaggagggactcttccctaactcattttatgaagccagcatcatcctgataccaaagtcagacagagacacaacaaaaaaagaaaaatttaggccaatatcactgatgaacatcgatgcaaaaatccttaataaaatactggcacaccaaatccagcagcacatcagaaaaggtatccaccacgatcaagtcagcttcatccctgggatgcaagctggttcaacatacacaaatcaataaatataatccatcacataaacagaactaaagacaaaaaccacatgattatctcaatagatgcagaaaaggcctttgataaaattcaacatcccttcatgttaaaagctctcaggtattgatggaacatatctcaaaatcatgagagctatttatgacaaatccacagccaatatcatattgaatgggcaaaacctggaagcattccctttgaaaactggtagaattctatttcattcaaaaatgattaataatgtttgaacatttgctaagaatactgtgattactgttgctttcagtaacttcctttgaattttcttcataataccaaaagattaaattttaaaaaaccattagaagagaacatgggagaatcttgctatgatctaagagtagggaagtcctttccaaacaccatataaacattaagatgatctttagcttcaactatatataaaagcaaaagtttgaagcttaataaataagcatgaaatgacaactagcaaataagagaaatatttgcaatacagtatattactgttaaatgcttctttatccaaaccttttcacagagatacaaacttgtaaatgtgtttgacaatattttattgacttgtcaagagaatcagtgcacagtgtaggtgttgggaatcgttttagtgctgttttcatgctatttgttaaaaaacctaaattttcatgttatgatttagcataatctctgagctcaaactgtgctctcaaaaccttagggacaggaagtagtatggttcaggaagaaccaaagtaatttcaaagccaaactagtcagtacttgaaaaagtctaatttttgtggtggtttccaatggagaaaatgaaaataatccctcttcagaatttggctctatggactgtttgggagactgaattgctcttttcccatttgttaaaccaggaaatttctaaggctccttccagctctccaattctctagtgctatgaatatcctcattattatcattacatctcattttgcttaaagaatgctaaatcagtagtctcgtatcttacatctatctttgtgagaaagagtaaagaaaactgagtttggtttctttatgattaatgcatttgtcaaatttgttccaagtagcaaattaatttattgtgttttttcatgaatgcaaattaaagctgtgcaaactattgtggtaaaacttagcagtccttttttataaattaaagctaactgatttaatgttaatgaaaggaactatattcaaacacagattttaataacttgggtggaaagaaaatcttagacttcataagcttttccttacataaaattcatgtaatttgaacagaaagtcattaaaatgtaattgtctatagtgaagcttgtattaattaccttgtatgaaaatctgaaaagttcctgaataaatgtctgtttctatgcattccctgaagagaagaattgtctattgattagttaattatctcaaaccaagggtcccaggttcagtttttggtgatcactttcttatctttttcctgtttgaatattctgatcaaaaccagaagtaaaacagattttttttaaatagagaagtattttgcttctgttcatattgataatacaaagagtaccagtatacatatgataaaatatttttcaacttcttggttcataggacttaatcagtgtttcatgtatctgtgtttgtgggtgtgaaaagcacctttattactgggaataagattttaagaatgattttagaaacatgtcctttaaatttgattctctcatacttttaagattatttaaattcacttcaatgtgattgtccaaaacaaagttattttcaaactcactgaatccttatgttcttctttagtgttcactattcacaaagcccattttgaatactgatcctgaaaaacatgagagaatcaaaatctgtgttttcttttgatttttgcatcataattgcatttttactcatttcaacaaggggaaatttcaactttttatattgactaaataaacaaagtgtaggggctaatttatgtttttaaaaaggaaaaatttatagatgctatgtttgattacacttatttcttaactggtatttaggaatttgtgtaataataaacacttctcatttttaacatcaaaatttgcaaggttcatcaaattctgaaggtaatgcctgattggagttaatgttcacttaattctgggtctaatcatttcagctgaaaaagagaaaactaaagcataaatcctttgactcatcctatcttatatttatgtcatattaaaagtcataaaaatggacaaaacaataaaatttaaactgaaacatatccaaaatgtttttggcttatctacctacaaaccagagacatgccaggtatgaaggaacccaaggctggagtaggtcagagggtccaatgagtttatccatcctccagacatggtcactttcagattgtactttaagaaaaaataacttcacggaggaccattataatttttgtgatgaacatgtgtaatatttttgcacccactttttagtttttatcttggctgccttaacatcttctttcaaaatgtcagcagtgattaggctacattatgggataattagtatgaacttttatctcaaagctaattttgactaatactagaacaaaacatatgtcaatatgttaaagatgggaagttgaacagattgctttcctatataaacatgtttttttctaagttcaccttactttttaaatactaatccaatctaaatgtttgaggaaggttaagcaacctgtgaaagaagcaccatttgaaatttgatggtgcagttcctaaaatctttccaaagaatgtggtatagatgcttacatattaaaatattgaccttctaggaagtttaggaaatatttcctctgaacttgaactctggggctgtagctatggttgataagctacacccaattcacactttaatgccggtgctttgtattttaacattatcttaatgtgacattgtatgccttgtttatttcttctaagcaggccttttcccaaattacttaaaattaccaaacaatgtgtttttaaccacagtcattctagagatttatttggtttttttccttccccagaagttgcttctgtcatgtttgattgcacatctgaatacagaccatgctcagagttgtagtgtaaacctcttcaggtcggatcataagcctcagaacgtgtcatacatcccataaacttcagaactagccatacacaagcttcagaactagtcatacatcccatgaagggcatcataactgatactgatctgaacagttcagtccaacagccaggcaattcagccacctacaattcaactattggttttatttgaatgaaaatcaaatttggggtataattggcttagctaaaatattcaactgggtcaattttggtcacatgagtgattctgcacaaagatatagccacattttatctcaggcatctcactcaacatttttaaagataacattttttaaaatctcgtacaaagactgcagtaaatatacaactaagagtcatactggtggatggtaaacatctgggcatgagcattatgagttaatgtgtttttgtacactgactttccatctttgcagattattctaactctctagaaataatgggtagccctttggcactgaggctcactggctcagggtcagtatttttacttctccatcttctctcagttagcacttgaacaaacaaagaaaaacaactggtctgctatttccaactcctgaaagtgaaatagggaaatagggacaaaatataattaattaaaatatgcagttattcatacaggatttgcttttgttctgataattaggatcccaatttgtcaaatgctttaaaaacatagtcttacagccttttactaagggagcgggaaggggtgaatatccaggttgattataagccatatatttgtcttttcaagatttgcttttacattgctttagggaaaatgataaatatatttgcaaataaaaattgtaatctgtatttctccaattttagtaatcccaaattactaaactaagtaatttaatttaggatttcggattaagagactacgaaactaaatctgattaaattatactttttgaaacctgatagtaccgtacttctgctgcactgcactttcttagatttaatgcctctaaagtataatgatattataagtttcttttctttatttaaaaataaaatgattactctaattatgggaactcatgtaccattgggctgaaagtcagagacagctggatggtgaactggccccttgcccagacctcagaggaagattaatttgaaaactctttacagaacacagcccagagcctactgctcagaagatcttgctttaatcagccattgatcatcagagattccctttattgacctgaaagcaagtttttttcatcttcatgccagctaaggcacttactgaaagtaagtagacagcatccaaagtgaatatgcctaacgaagaaaacaaagttttccatctctccccgcaaatgacattctgtaatgacatgtgctaatagtttctatctccatccatcccttaacccatcacgttgccatcctgtgaggaacctgtggttaacaaggggccccttctgcagatacacacgtcaaatgatctaggaaacatgtcggcagggattgtggaaccggtctatgagaattctctttgtatctgaaaaataccatggagtggatgcagggcagtgtttacccccctggatataacatcagaaaattccagatcactctgaagtctgttctctctctgatttacctgcctgtggagtttgaaaggtccccactagtgctgactctttctgacacttctcaatctatagtagcttggaggccactttgattgctcccaaaggcaaaatggggcaccatgatacttttttcactcaaaagggccagcatttatgggatatactcagtcagattctcaaaattgcttcagagaatcctctgttagattaaaggaggtcatttaatcaaacgactttccaaaagtccctgttttgaattactggagagaatgtgtactatcagggtcctggatcacttagcaaacatcagaggaaaggtttcaagtctgttttgagaaatgtactgtccaactctactgctttttccttcagcaaaggagatttatcaaggataaatttggttacagacatacctgttttcgttaaaatgcctttggccattacattatctgtaataactttcagtaaggtctaagcaatttagaataatattaatagaaaaaaatcatgattctctacaccattttcccttccattttatctaaatggctagaagtgagtgtttgcataattttttctagtgtttttctcccattttgccatgatctagttttatatggaagtcataaatttgttctaccaatggagtttgttaaaacaatattttgactttgcagagatcattgtatattttctatttattttaatgccaaacttttaaaaatattgactgctaggaacttaagagagcagaaatatcactttgaaaaatacaaaaattcatttttttctagttgatagcttgtcttttaatattcattgtggtatatctgtgctatgtaatattataagccttgtatctgtctcctatactttcctataccctcacataaatactatggaaaattattatgtgcatcactacccaacactttagccttgacttaaaacggtaagataatttcttgtaaacaggtatctgagctttaaaaaacaaacaaaaacacattcctgttagctctaactttgctcagatcccttgagagagatcagaactcatatgaaaggtgaacagattcttccctttggcaagcaattccttcaggaactgagttatgcttatggtgggacttccaattagaaaagtaaattttaaaacaaacaaacaaccaggctgttcagagattgctagacacaagatcaagtcccagccaggtgtttgacattgcccagtctctttactcttgtaatgtgaaacttagagtcagcttcttcactagtgtttttggcatcatagaaaccacacacctaaccataaatacaaaccatagctggtactaccagtgcagttctcactcttgtagaagcatgtccagtccttctcaagtcatcaactaacaagaccaaatgcacatttctagcaagggagtccttgagcccatccagtcccctgacttcacagcgatgctgtggcagcccactctgctgccgcccacaagcacacatggaggggaagccagcagggatgtccaggtctttgcccatggcctgatgaagaaaggcagctgcagtcatgaattcatagaaccagaagtgacattagcagccacctactccaactgctttccaagagaaatttctcaagagacatgctgaatttcaagtcaagaacaacttggaagccacaaactcagctggcttacagttgccatggaattttgggacttttgctgcaaacagaaacaggatccacaggttataactagctactgaccagtgttacagagcctgtggacaatctcattcctggtttctcctacctctcttcattttcctgtgttccccaccatcagccctcctctgggtcttctccctttcttactctgttctttttaccagggaagcctcatccactctaatggcagagtgctagttttccaccgaagatttgcacacacaccccagccccagctgagtagtggagaggtgttgcccggcagctgtacttgctaatggcatgggaacaaagtgttttagagtggaggtaccttttccacctgctcatcttctgcctaccatctagatgccaatgctcaaggcaatggtggatgccctggattgaagatgacagaagtgtcatcggtctgaggccctaaataatgccatagaccagagctaagctgtgttcctctccatccccttccagacagcctgccaccaatcaggaacactttacatagtgagaaacaaacttcgattttgttaaacccttgagatttcaggctttaactattgcaacagctaacattccccacctatataattataaaatcttcagattccatctatgctaattactcccaattctgcatctctggcatagactttattcctgagtttcacaactgcatatccaagtagacaggtccactataatgacctgcaggtcaccaaattcactatgtctgaagccagacaaatgatccactgctttcccacacaccctggccattcctgttccatcatatgcttgtgaataccaattgtatgcacccaggtactcaagagtgccctattttatctcccatactactctctcctaaatatctatcctgtccatcccgtttatctctccttattgccacattcttatctggtttcaataatagtagcctcaccccctactccagtctgtcctccatgctacactagaggtgtctctttgaaataaaaatctgattatgcctctctactccttaaaatccttccatggctctttctgccttgcagattaaaaatcaaagtcctagtgtaacacctaaggccactttatggaccctttgctgctgacctcctgtattctctcttaccattctcccattgttccatttacaatgtatgtcctgaagtttctcaaatatcccttccctccatgctgctgattttgtagtttccagtatccagaacacaccacacccctcctgccagtgtacttcttcctcttcatcattcaaatctcagttcagagatcatctctcttgggaatcttcaacctccacattccccttagagatcacgcctctatctttcttttcctcatggcttctgcctgcttcatagagttggcatctgcacaattgttagcaaatctaggagctcttgaatctttgccctagtttgatgttctttgagaacagccagctacaacactgcctgcaacatgccctcaatacatgtttctcaatttaacctgtattgtcatccactcctaactgcatatcctgataaaatgatgcatatgtagagctgagggtaatgcctggcttattgtaagcattcagttgatgttaacagaatcaatcatagtttttttgtattattatcattattgcttttattactatcagcaattactcaatatttttgaccatagctgatttcacatctctactaagttttgtttttctttttcttctggttcacaatcatatgggagacatttgcaccaaagtagcggcttccttcttatggctgcaaatgagcggagtgaaggtcaagggatctggagtcgtgggttcaggtgccaccactgtcaccagctgtgtgggcataaactagtcatttaaccgctccgtgcctcattttggccatctgtgacatcaggacaaaaatagcttcctgacccacttcaacagaatagttttgagaaacaacctagataatgaatgtaaaagcattttgtaactctgaaaatgataaaagtcaattattagtagtatttccaatgacataggcaatattagtataaacaatgctttctctgttgaatattgtcattcctctattttgccattatcactttcggttatttttgcatttcctagtgagtggacaacacatgtaagtcatgtgtttcctcatgggcaaattctcaatttcatcatcccaggcatcacataaattctgctttgaggactgcacacagaatcccctcactgatgatgttgctctaaattgacattgtctgtttgtctttgaatctatctttctaataattgtttccttacacggcatttcaacccatggtagacatactgatttttgcatgaatgaatgcttttgcagatacaggcaaaatctttgcgtgcccagagttttgtctactatttcctatttgacttcaagcttctcacttgatgttaatgaggatgacggtgatgatgatgaagactgacatttttgaactcttatataccaggcgttttttaagccctttacatttaatcctcacgatgacttggtcaaaagaattcgtgtgctagatccactaaaacgtaaactccatgaggtacagaatctttcatatatcatcagttttgttcactgctaaatccttggggactaaagcagtgcctggcatatagtaggcgctcaagaaacacttgttgagtgaagttatttgcttctcaaatgattttttaattatcaaggctttggagttttctgagcatctatagtttgacggtgatttcttattggtagtaacagattattattgaaattattaactaaatttatataatacattatagtttataaaacactttcacatacataacctcacttaaggcagtcagtgacatttttccactagaaatactgaaatacaatgtctctaccaaatgaaaaataaaatacagccattattacaatactaccattgttccatttcttcaatgagcagtaagcatttaaattaagaatgactagggtttctaataaggattgtcaagtatcagaattgttgggggtttttttaattgaaagaagaaaatactagaaaatatttctccagttggcttagaaagaaggaatttccatttgagttccaaatttacttaacaatctggaaaggtagctgcaagtctgattctggtaagtgtttgtgtctccgaaatcagtggcaacaaaatattttaaataaaccaagtaaagtttttgagtatgtaattaaaaatagaactgatgagatcacttgccaagaaccgtgaggatttgcattaaaaacaatgatttgagacagtcatgatttattcagcacattctacccaatgagagaacaattcgtatgaaagtcagggagtgctcagctatgttatagaaagtgttgcgtgaggtgtctgtggtgctggagtaggataacattttctataacttgagcagtgtgtctctaaatgaaattgtaaaatattatgatatgttaaaggccaggcaaaattttataaccagaatacaatgatcatttgcactgaaacattggcatctgtagttgtcactggtttttagtaggtgaggggaaatatctcttcaaatgatcagacaagtatgactagtgcatttgtcattccagtgtcttcggcacttgaagtttttccatttttgttcaacaatgtaacctttggagttttgcctaataatgacttcacttgtgctggccttccaacagataaattaaaatggaaatgcatattttctaattatgcatcgagccttagttgcatattggcgagggtggccacaccgaatgttaaattaagtctgcacaatagttagagtctatgtaacatcaaagtttcccaaagtcactttcttaatcatgtgaaggatagccaagactttgatcagtagtatgtagctatatacgatcagaggaaaaacatttaaacatcccagcatggtatttccatttaaatctgattacagtgaaataaaactgtagccattaaaggtttaaaagaactacaaatacagcagtaaaagaagacagatagtaaatgaggtagtaaaacatttcggcagggcaaacagtttacagcactcattcagtcgtcctgaagcagactgtgcaattcactacagacctggcaccgttccctgaactccacttaaacctacaattaacctttcacacctaatgaagctgttttcctggaaaattaaaatatataatggtgcctgcttttacacagacttcagaggagagcatttcaaagtgaatgacttttctgaggcttttgttcaaatgtaaaatggaagtgctatgtttgtatataaagcgggaatgttctttccaaggcaatttcatttgatgtgcagtattttattactgtacttattaattgttctgcataattgtaaaaaacacacatcagtaattttatgattagattgttactgctgaagtctgctattaccatttcacttccattagggaaaactagagttttgctaacaataactaaattcctgatgtttctccttggtggttttcattgcaaatttagtggtttaaaaagacatgtttaccatttaattatttagctgttatttacattgctgtctcttcaggtcatgttttcacatgtttcaagagaaataaaattcttaaatttcaggaggcatatattgtttttttctaaggttgcaggtgaaggtctgattttggtgtatgttctacttatttacaaaatagctgtggggtactcccacattcatttcagcattattcacaatagtcaagatatagaagcagctatgtgtccatcaacggataaagggaaaaatcaataaagagaatgtggtctttataaacaatggaatattatacagccttaaaaagaaggaaattcagtcatttgcaacacatgaatggaactggagcatattatgttaagtgaaataagccaggcacagaaagacaaatactgtatgacttcacttatatgtagaatctaaaaaaggtgatctcagaaattgagagttgaaagctgattaccagaggctaggggaagggggagggatggggaaagggaaggttttgatctaagggtacaaagtttcagttagactggaggaataagttttaatgatctattgcactacatggtgaccacagttaataataatgtattatatatttcaaaacaactaaaagaatagatttttaacattctcaccacaaaaaaagatggtaagttggagaggtgatggatatgttaattagcttgattgactctttccacaatgtatacataggtcaaaacaccacattgtatctcataaatatccacagttatttgtcaattaaaaataagctttaaaaatagctgtggtaactcttggcctccagcccagggaccactgagtcgtgcccattttctgagggaatttcctatggtctcaaaggagcctgtttcctttagggcttgtcctgccctaggtgaaccagagcagccactgggcctgctctctgttagcaaggaccagtttgaaaacaccaagagaccatggaaaattgaacaggaaacagaggatggtatgttccttcctatgcggtttatacttcctatttaaataatctaaatgtcatagtgtctggtgtttaagaactaaaagtacaaaaaggtaaagcttataataactattgaaaccccagcatttttgttgaatctactggtatatttttatgtaaatcctgctagcctgcagcatctgtgcatcatctttacgtggtaaatgaaattcctttggaccatcagtctaaaataatgaattgttcccccagttaattgtattgctttgataacaaggaactatgctaggcctagagaacacaataagtgaatttcatcagatgatttgtgtgacgtcttgaaaaatgatcttctggagtgacctgattttaatggaactctagcggcgtgcagcatgggcccagcatccaactaggaggaagcacttcctcctatggcacaagaagtgcgggatcatccccagaagacctctcaccaggaaaaattctcaggaaagtcatgagaaagtgtgtgccaaaaatggcaacacaaagaacctatttctaggttgcttttcttttattgatacataccttttttaaaacccagaaaagatcgcaaacgacctttatgtctttgttgccagcgtgaaaataaaccaagaccaagcaaatgaaaataagcaaaagctatgtattctgagcttgctatagcaagggagtcagccactttcacttgtgttttggcggagactcaaggacaggcaggaatgggaaatctttatagtgaaaaaagggaagcttcaggtgtgccctgatgagaggccgttagcttgtgggagctgtagacagactaactagaagtggggcatcctatgtggttaggggtacatatttggtttcctctggctggaagtgaggacataaattagggaagctgtttattaatcaagtcctggccatttggggccagtcgtgacagggattacagtttaacttcatgggttattagtagagatagcagtctgacttcttacaagtctgacatagcaggctggcttcctgggctggttattgcagattatagctcggtttcctgagcacgttgccacaagttgtgggtcagaattctatttatacatggtctgggcattatctacatgttcagtatcttaccagaatataactgctacatttaggggacgggggaggtaatacagtctttttaaaaaagctattgacttggcttctcttttcatcagttaagaaaattagattccttacaataacaaagtgtgctgaaaggcaatgacagagattactctctctctctctctctctctctcttctctctctctctcttttagtgagtcttccatacacactatcgaattcaataagataggggctttgtctctttttttcattcttgtatctaggttctcttgtaggttgaaagagaacgtagcaacttctgatgtttttaaggttcaccttatatttaacatgaagaaatgcaaaagtagtaataacttgatatttaaggcacacacacatataaatgcagttattatgattattatcctgttcataattaaactacaaggtttataaagaagaataactcatgatgggccacaagccgtggggtccagtaaaggacctaagccaaatgaaacattgtttggcccatcaaatgggcagataagactttgggcaaatggccctgagtgttctctgtgagtgcaccacggcgaacacttaaatatctctgcctagagaagtgcaagcctttctacatacacattgccatttatgcagatctgaaaatgcagttgattgttacattttaataagaaatgacaaaaagctgtcaaattaaaaataagcatgatttgcaattttatttgtaaattaagaactgaaatatttatgattttcaactgaatgtgtttccaagtttcagaatcattagtaaacccaggacatgttgtcagagacattgcttcagttaggttctggacttcatgaaatacagcgatacagtggcagttttggattagcgtagaatttcctgttttggcaactcaagctgcttactcctctcccgatgctatatcttctgtaatgaaaacatttgcattcacatgtaaatggaaagtattattttttcagagcttctttggactacatcatgcagtagtttaatgaataacatgatttcatatttggatgttgtgatcattgaaattagtgtaagtggtctctgtccacattaaaggagacatgtattatttgtcatatttggctgtctctggattagttggtgccaggaataaaatagcaggaagttgtaaataatgacagaagtatgccagaagatcagtggaaacttacagtcagcttgaacttttagttagcaccaccaaaatctgcaattttaaaaataataacaaggtccttcagctccattaattaaacaaataatgaaataattatttactactgcagaataagtgtttaaaacatctatgttggactcttcagaagttcccacgtgctcttcaaaggtcaagaaaacagcttttatgtaaactttgaacttgtaataactctaaaacattcaggatgatatttaatatcctgaaagagcaaattacttaagagcaacccttaaaaggtaaatctgtaaatttatcagcttagccagagcttattataattttgtaatttctttccttgctaacaccataaatttctccttctccacaaatctcttctgttttcaaatgtatccaaggctcccttttcctttaaataatgcacttacataattccatgcatccacataaattccatctgaccctgctaattctgttatgtagataagcttccttatctcttcccattgctaaacatcttaaacatggaacttatgtctgctggccgtacttcctgtcactccattcgttgtttaactttcaggcttccatcctcagttagataccgaaatgactcaaagatcatcagaatcttcttggaggaagtctaatggcctttgccacaggccttaccctgctggcccatttgccactttttacagactccttgggcttggccctcccttgactcccgcaacactgcactaggctagtttgctttcctcttacagtgctcacatccctttactgtcatttctttctgtccataaatctctgaattcagttcctgccaggaaatatgtgaagcttacccagaattaactgacccacaggaataaaataatgatattctacgtaggataagatctgaaaatgatcttcctctaagagcaacatgtggagaagaggtcagctcaattcaaagtcaagtcttcaagaccttgtagaaaggaaaatgagccaaaagtccttttgtggccttttcttaagcaaggccaatctggcctcatggtttagtatggtgatttgatacatttggttttactcaagagttatatgggactcaacagatatgaaaatgactcatatgtagctatgataagccaaattatctggttgagccatggctcctataaatttaatgaaatctttactatccctgagcatcttaccaagtgttcctgtccatcattggacaaacaatgtaacaaagcagatcaacataattaaacaatatgcttcttaaattacctatgatagctacagctccgcatttgtggtcacattcggtcaataatactcaaggtccttttctagtacttaagacgcttgtcagctaaatgtcaagtggtctttcttccatgtccatttgtacatagcataactctatccatggagtgcttttgtaatttttaaaacagtttatgagaatgaaaagtcaagccatagactgggaaaaaaatatttacaaaacacatatctgataaagaactgatatccaaaatcttcaaagaactcttaaaactcaacagtaagacaacaaacaacccaattaaaaacaggcaaaatatctgaacagacacctcactaaagaaggtatacatgtggcaaagaagtatatcaagaggtgctcagcatcatatgtcattagagaattgcaaatttaaacaactgcaagatactgccacacacctattagaatggctaacacctaaaacactgacaacaacaaatgctggtgaggttgtgaagcaacaagaactctcattcattgctggtggaaatacaaaatggcacagccactgtgaaatacagtttggctttttttttttttaactaaactaaaacataagcttaccatattatccagcaatcaggctcctaggtacttatgaattgaaatgttatgttcacataaaaacctgcacacagatgtttttaacagctttattcacaattaccaaaaattggaagcaaggacaatcaagatgtccttcagtagtgaatgcgtaaacaaactatggcacatccgcacaatggaatataattcagcaataaaaggaaacgagttatcaagccaaaaagaaaaaaagagatggaggtacgttaaatacatatttctaagtgaaaggagaccgtctgaaaggctacgtactgtgtgattccaaccatacaacattctggaaaaggctgaactacagagacattaaagaaagatcagtggttgccagagacttggggaaagggggatagattggtgaagtgcgggggtattttagggcagtgaaactattttgtatgatactgtaatggtggataccctgcattatgcatttgtcaaaaccaatggaactatgcaacagaaaaagtaaaccctaatgtaaattatggacttcagttggtaattttatctcaatattggttcaatttttctgtaaatctaaaactgcttgaaatgtttttaaaaatcttaacatgactagttttgttcctaaaaaaaaaaaaaaaaaatagtaacatttaaaatttctagtacctccacagcaaactcgtgttcagacatggagaggaaggtttagggtcatatgcacaactaaatgtgatcatttgtcaaacactgatttgattgttccaagtcagagtcagttaactttcttagatctttcttcttcttccttggtgaagttcacatgcccaagtcaagaaacattttaggtaaagggcaaactacttgaaaacttccattaacagccaaacgtgtgatgactaaatgaaaagcaataaaaagcagggcccttcaccaccactgttgccatcccagaaatgtctaagcaagcatttaaatgcttttctctttccttccaggccttgcaattgccagtgccctaatagatatttcacaacagaaagcttcagatagtaaagataagacttctggagtccggaatcgaaaacacctttcaacacgtcaaggaacttgtgtctgagaaatggaaaccgctcctgtatattctgtactgttttacttcgggcttctgttaaagctgttctatggccttggattttatggaggcagatctctgtatcatccagagcctgagtacagtttccttccaaatggacaatgacccaggtggccaaagaatgttcatgagttttataaaagtattgatggtcacaggtgataaagtcagtttttaccactatcttaggcttattatagctaacattaaattactctggaaaaagatgtatattgtttcttaatgaagatgaaaaatatgtaattcatataaatcaactgtttatatcccaagacttgaaagaaagacattttttaatgcctgaatgatgagaattgtacagtttttgcctcataagcaaacttgaatcacctgtgtatgaacagggaatgaacacattgcaatggctttaaatgctcttttatctcgttgtaaaggtaaggcaagattttgatgtagtaggatgtaggtaatgtatttaaatatttcatatgaccatatcgtgtccaaactcagtctgagaatgtgacagctttccgcctaactagaatgcagaccagaatgagttcaactcattctgtgcaacttcacagggggtttattagaatgctcagtgtagaggacattcctgtcatccatgccaactacctaactcgttatcagagctgatagagcatggaaaagtctgtccagcgatcagttgttcccctccttccaaaaacagcctccaataccacaacctgaaaagagccgaaatggttattttacagcatacaagcttctgctccagtatgataatttttaattgcctaagaatcattggatcagacctaaatgatccatctgcatttttataagaatggatctttctttgcccttcctctcctagctgctagattttaactaccttttacaaatgttacaaaatgtattttagaggcgacatctctcaagatgacctgagttccttcctgccaactgttccacctagaatacaagtagagaagagcactggctggcaagcatcaacaggagtcttcttcccaacacgagcgcatccatgtcctgagaaaaagtctgtggtttagaaaatatgtccatggttgcccacagtcagcacactcttagtgactcaaaattctgaattatggcagaaaggaaaaataaaacatacttcacattagaacacagaatcatttacatcctaatactgaccacagttcactaaagctcagtagcattaacagatatagtttggaattgcagtttcctcacttcagggtgacaagatatgtataacagtgacagaaatctccaaagctgctgtatatgatatagctttgttaaatatgaaggtcctttaaatacaattgatgtttagtactatatatgtacttttcacattctttggatttctggaaggttatgacactttactgtttacagctaatgcatagttacttgcatgccatggttgtacagtagcagactatgaccctattgtgatattaagtgtttatttcataatgccatttatacatagctgaatttgatgaggattgaatgtcatatataagaggaatgatcatacaatatgtagttgcatcttatataagatttctaggttgcatctaaccatgactatgtcattattttgataattaggcatttatgaattatagtatatattcctcatgttggcatgataattttgctattttccatgcattaaaaataagacaaattcttagagtaattttagtaattttatctataatctgtggggtttttttggagggggaggccactggttgtttctacttccctgtgatattttctctctcattaaaggaatgagctaagtttgtaaatatctcctaaaaacaatcaagtaattttattagcttcttttggaccctctaaatattgacttctctcatgaaaaaataaattgatgaaactaatgattacaaagatataatcattttttaaaaagtgattgcccaatgtatttctctaacaattgtcacaagagaaagcataacaataaaaatacaaaaacatacagatttagatgtaaaatctatataagctatatttttagggaggctaagcagatagtattactgtggaagaattatcaagttttattcacctcaaatcccactgggttcttaaaacttgaaaattcaaattgtagagaattatgagacacaatgtgatgtttagttaaagtcatgctatacctttctgggccacatattgctaactctgtggctaattatgcaattaattctcaacgtatcaaagcttttcactggcagtaaattctttgccctcaggtgaagtggattgaaaagacatcaaggatcaaggataatcactttgaatctgttggtttttccccctacattccagacactttaaatttggatgctttcattttttttaaatcaaaccacacaaatatgcagatactttcccagaatttcgcagttaaatggctgatcctcttgaaaactaaccttaatggaattctaaacatttcagtttagaatgactttgaaaaattccttagatttttaggatgttttattctgccaagtatgaaaaaaaaatggttaaatacaatggagttttaaaaattaacctggggattctatttgaactagaaaattcctattggaaaagaatttgcacatacttacagattcagctaataaattttaagaggattaggattctcataattctttaaatgaaaatttgttttagtgatacacagagatgccgtatactatagtgttatgttcagtaggaaaacttcaaatagttcgtatttaaaaaggtaattgatccttgctgtacttcccaacatctcatcttcttttagctgcagtaagatagaggtgactgtatggctacagttcatggtataaggtcatttagggtgcacactggcacacaggctggaaaacgggcactggacccagctttcaggtgtgtggtgctgggtaagtttcacctttgaagcctcagccttccatctgtaaagggcggtaatggtgcccacctttcgaggcattgcgaggctagatggtaacacacagaaagctcccacagtgggaccttgatgcagcgtagctggtattaacaaccgtggggacaccaggccactctttttctaccagttgttttatgaatccacctattaattttcatccatcttttggtcgtaggtaaaggtcaatcaggtttttcaaaaagactccctgaataacttaagttcctgtatttctaagatatagggatttctacaaaacgactttgacatttagtcaataaagacttaaactcttcttaaatctatagttttaggagagtttttcttaaaattactgactgatgacattgagacaagagcatcaatgatcacctttcacgtacaaactaggcaagacagggtcagtgcttacattttgtggttatacatgatacatcttttctcagtgaacataaaactatgatttgaaaggtgtcttatatttaaaaaagattgtaaaatgaaaactgaccaaatgaactaattctacccacctatggtctttttaaatgtcgagtttcaaaacccatttgccgtatactagagtgagcttggaaacttacctgattacaggaattgcttgggttcaggcagattcccactttcacctctagagatttagattcagaaacactggggtaggccctggagagcagtactcttaacaagctcctcagtgcttcttaccattaggcaaattagggaaacactgcattgggtcaaagtgctgcctttaatcgaccattagagggagttctctaaataacaaagttattactctaattcaaaatgctttaaagaattttccaaggaatacaagccatctggttggtgttagttatagcagtgatttcattagagtgtacatttaacattttagttttatcaaaattttttgaaattaagaattagaaccagagctcctatcagtatatatgtacacaggtgtgcatgccagtgttcaaaagattgtgtaaaagttcaagcccgttttagaaagccaacattttatgttataatatgctgttaatcaggactttattaaataaaaacattggctcttccaa

SEQ ID NO: 1079 - DNA, 877 bp, Homo sapiens
tccatagtaaaaatttaatgaaaaaagcaaagtaatatattgactaaatataaagaacatgtattgttatattaaccacaaagtaaaaatacatgatacatgaaaagaagattttaaatagtataaatagttaaataattatttagacaaatagataaacagatccatcagcatgatcatccgtaaggaactagtgcctgtacagctgaacatgatgctgcttaacattcctgaaaacattttaaaattttgattcaactcatgtcatggatatagcaaaaatgagaaatggcagaattcatgaacgtgtgagatgatgtattaatcatggaaatgtttctcatttccatgttgaaccagttttcattccttcctccttaatctttcctgcaagttcgttcataaagagaaggatctcatgatttctgctctgacagcctcccaggaacaagggctatacttcttctttgtcagataaagagtgattctttgaaagtattttctcacagccaggatggagtccacattcctcaggggagtctcttccactccaaccttctacatcacacaggcttccaggtcattcagctgctggtaaagttcagtgtagaatttgtctaaaagggtcgcatcccaagtatcagatgagtcctttgtgctgaagaggttgaaggtctgctgcatcatctcatggaaaaggaagatagcttgaaccttctggaagtggttgccatgaaacacctgatgatggaaaatcaaagtcatgtctgtccttcaagtaagaaaaaggagagattctcctcatttgtgtcaggagtatgaaggccctcctgttacccacgctgtgggcctgaggcagatcacagcccagaggcag

SEQ ID NO: 1080 - DNA, 365555 bp, Homo sapiens
ccagaggagggtggagagggcggtgggaggcgtgtgcctgagtgggctctactgccttgttccatattatttggtgcacattttccctggcactctgggttgctagccccgccgggcactgggcctcagacactgcgcggttccctcggagcagcaagctaaagaaagcccccagtgccggcgaggaaggaggcggcggggaaagatgcgcggcgttggctggcagatgctgtccctgtcgctggggttagtgctggcgatcctgaacaaggtggcaccgcaggcgtgcccggcgcagtgctcttgctcgggcagcacagtggactgtcacgggctggcgctgcgcagcgtgcccaggaatatcccccgcaacaccgagagactgtgagtatgcgctcttcgtcttcccctctccccatccgggccgcgcacccctgcctccactggaggaacctgtcagctcagggtcctgtgcctggggcagccctcgctagctctcccccatgcacatcctggggttgagctctccgggagggcactggccagggaagggcctctgtccaaggaggggcgggtccgctggcagctgcgctagttctccctcccctgctctcgtcccgccactcgcagctccttgctggctagttctctggggctggggagcgggtagataggggacaagtactggaggatgcccggggcaagtgagacgccactttgttctccagagtccataaacggagtcaccttgcgattgccagcatccaggtcggtttcagagcccagtcctcgctcttgtcgcaggctggcgcggaggggatagcagggagactcaaaagagagaaacttgccttccccgattttttgtcaccctcctgggggcgaaggttaggaagaaggggtcatggagtgcctgggggtgcttctcacaggtcgcggggagaagggtgccccaggacggcgacacctcgcatagtagcctcgcgcagccccccgccccccacttctccggggaggggaagacggcgtcaggcccctagggacttgtctcagcgggcgactgcgagggaggaccgtgtcccatccgttaagcgaagttagcactggttctccagcgcaaaccagcccaaccaggtcttaccactgcggcgacccggcggtgcccggctgccccctccggcccttcctgctgaacccctgcgtccccatccacctttctggcagtttctgcgccccttcacgtggcagcagttcccctgccttcccctcttcgcgctccgttgctcgcagacgtccccgcctccctgtctttgcgagtctctaatgaagaagtaaatgcagacccggtgttgacggcccacgcgctcctgatgaggcgcttccagagttcagcgaagtggagcatggaggccgttctctttgtgaacgccgaggccgccgccccgcgccagtccggccgccctaggcacgttccgctctcgcggttgcgtgtgggccgggagtaagcgaagggcgcggggctaggccggcaggggccagcgcgtctggattcgtcccgcggcctctttgcccccggggtgtaagggtttcgggccgtggagaggaggcgctctgacccgcacgtctccacccgcgcagcccattgcacttcaagtcgcccttcttatccaacccatttctctcgcccttagttttaaggcccaagttgagccaccttttgctttgcaaatggctcttctacccccagcctcactaggttacccttactcctttctcacctctccgagctggccaaatcggggctctactaggggtgccttgtcaggattcgatccacatttgtgtagggtggtgggtggagattcgtgttatatcgaatagcccaacaattttaggaacaactgaatggtactctgcttagcatggagaagtgggttgagtagaaaggaagagaagccacgcagaattctgttttagcacttgtcatttcatgctattcagaacagtttaaagtttaagcacgaacatgtcttactcaacaaaaagggaatgcacttgggtgggtgggggtgaggggggagcgtagcaattgaatttcaggtccttgaaaaaatatacatccttatgagggatgaacaaaaagtttccagaaaatagtttactgggtgctgacttgtaaaattctatcattgaaacagtttgaatacagatttcaaacatgatgttgtagagtcaaaggtgatatagagcttacttctatgaagagcattcaaaccgcagcaaagcctggttttacttgaagtgattggaaccagggcaagtttagatcttgacctgaaatgccagaaaaggagatcgtgactcctgaaggaaaagtgctgcagaaatctgaacaaaaatgtcagggcctgaatactatttccattcttgcccctgttagtagttttcactttacaatcacagcggggttccctgagctgcaaatgaagaattaagttttaatacaaacagaattgttggaaggtaaatgcctatgaatgcaagtctttgaagtgcagttgttttgatggcactaatttttttctgtgccttaggaagtttcgccaccatgctacctaaggacagtgttctgaatttttataaaatttcttcctgaatagcatgagaaaattgggcatttaacctcctgaagggaactttttttttggggggggtgcctaacaattatagtaaaatagcagaatacctgtgaaattaatatacaatccttacagaaacaaaaatggaaaggactctcccatacacaaaacaaacgaaaacttttttgtgataatgtaaccacttcattttcttgtcatatgccagcaagaatgaaccttgtaaatgtgttgagtcatgttaaaaatatccttttaaaggttatcctcttctccttcctacatactttgtatactactttagtaattgaattaacttttagttctgatttactctaaactttacttgaagcaggtaaacatagaaataaaatggaactttcactttctggtttttctcttagggatttaaatggaaataacatcacaagaattacgaagacagattttgctggtcttagacatctaagagttctgtaagtgcatcctctgtatttttaaataattttttaaggttgcatattttgaatcattactggcctcagtttttatgactattctgatgacagtaacataaaacatttaaaaggtcatgctttccttttttctgtgtttatcattgtactacaacatttaataaaaattggggcttttattttaaggttggaagcatgccatagaaccaataatccagaaatgacctcagatctttgttataccataccctaagcgctttatgcatataaaaatgttgaataattgttttcacaaaatgaataagtaataagaaacatttgatacttttaggatttgaaattaactaaaatatttaagtggatctgtattttattattgataacaaaaggattcttatttttttgcgaaaatctaatatcaagcattaaaatcaaccattcaaattttcagcagagtttataatgatacattagtcatattttgagtttttatattttgtgtctttgtagcttctataaaattgttgcaatatgattacttctttaattagtgggttaaattagctgtgagtaaaccaccacttgcgagtcaatgtaatgttaaattgttctcacccacaggattgtaaatattgacatcccagtagccatacagttttgaccattgtgcattcagtgttctaagttttaagagacacattttggtcattacaaattattccagttgctgatgtgtatccatgtcagaattgaagtatgtatatgatgaattactgtattttgattctttggttaagttgaaaaccagtgtatcaaagaaagctatcaaagcttcagtgtcaaggattactcttcagatatactattagtttaagggtcagagttttgaccagtaaatctcatgagaaactgcatttgtattaagttttgtgatgcagacactgctatttcccttccatgagttcactcagatatattattattaaatttgatattggatctcaaatcagagcacaatttaactttataaagggaaagagtttacaagttttcagttgctgaattgaaatttattcagatggtgagtggtaacattaagaagcatgttatattttgcatttcagtcagcttatggagaataagattagcaccattgaaagaggagcattccaggatcttaaagaactagagagactgtaagtattttcaattccaaagttatgacaacataactgtgttttttaaaaatacttaaatttcaagcatcatgtcttcaatttcatgtcttagggtttgaaattttgcagaaaaaggaggatgaatgagtggttttcaggttaatttatgacaaatagagttcctgaataaaaagttctaacttgtaattaagctcaaaaatacagttactttcctgagacatgtatttccttgataatcattgctttggtacttaaagatgtacaagcatttcttattcttcatttgatttgttttatttgctcatgtaggaagaaaggtggtacttttatttgcgttaatggtgcattagggaagagagaagttttgctaattgttattttcattttcatggtggtgctttgtgtgttatcagtgacatttgatgaaatattttatattttactaataaagatttacttttttatatttagcgtggtgaacattgttattgttaataattacttttcagttttattttatttggccctagctttaaaaatatttattctggaaaaataatctaaacattatgaaagtaagaactgtgttatcaaattgtggtcattcaaagttggttttcttcccaagaagattaaatgtagacttcagattttaagatacgttttttacatattacttgaggactttaaaaatgtttacagtatatatctgcaaaagacaaaacctctgtctgaaataattaagataaattacagaccttgtaattgaagtacgaattgtatgtcttacatgccttgattattcaggtttgatatgtttgcattttgaaggcaaagaaaagctctagtaaaagaaacaacaattattttaataagttttcatgcctgccttaatagtcactttaagtaaaaataatttttttcaaaaaataataaaatctaatgttcattttaagcttaacacatattcaggttcactgggcaaaagggcagaagttaattccctgtaattgtccataagtagaaaaatggtttgtccccttccaagatatttataaatatatagactatatttttatcacctcaagtaaaacacagaaatgtctactttattttactattggtctttctctatgttaaatattacaatacaaggactataattgtggaattcaaaataaatttaaaatcactactttcaactaattttagagggaaattaaaattggtaaacatttggttgcattcataacaaagcttataagttcatagcctatctctaaatatataaaaaatactctgaaagtatttattctttgatctccttgatagactatgtgattagctaattcctagtaagtaacttgcaaagatattttaatctttaagaaagcatcaatataattcaaatgtttggtaaaatgaatagataatttaaattatcatttaaactttatgttttcaagaataacttttagtcaccacaggaaagtatcttgagtttagttgttaacttccaaaccattgaaggagttttgatggctttttatgcagtctctattttggttatattgttgttttaaatattttcagggacactagaactaaacaaactttctcattctttttcaagtcacttcagagtgttgtctgaactttcatcttgaataaattaacttttcctaaaacttattaaccagatgctatatgctctgaaatttgattagagttgtaagtaggtactattttttgacttttacttcctctgggaatgtcacttcatctcagaacaattttctattctactaagactaagtcagatgtttcagagtgggaggaggatttgtaattctgaatgaaaactaatatatatgcaggacttctttaaatcaccccagctgttggccaagagcaaatatttcatatttgtgaggaaaagctgagaaaattccttttgtttacaactgccaaatccatctgatggaagcacattgttatctgacagccaattcatttccttggactctggaattcaaaaccatttcttaggaacattgtggatacacttttcaaatatttattttttaaaaatacattaaatggcaaggcaggtttgctaaggaatgcattcaagttattgtgaaacaaactattttaaattttgttcattgtattgatttaaaaaataaaaactacaaaaaccccaaaactacccagagagttccataatcaaactgctatggcctgtggtatatatctttattttagtcagtgtcattaacaccaaaaaattgcttgctttttcaaaagctgcaagagacaatgtgagagacaagaagaaatcaataaattagctttttattatgtattgtgtaaatttatatggtttttaagaatttagttgtgaaatttaaaattggaactcaattatgaaaaaagtataaaattaggtttatgttgtaaatcccatttatatactgaatagtgatttaatttttattccttgtatgaagaacaaaataaaataaaaacattaattttattcttgtgtaatttatggttttaagttattttcattttaaaatgataaaataattctaaattacattttgtgaatatttcatagttatacatttttctttttcttttattttatgttgatggacttttaacttgatctatagaaaaatctgaaaacagaagataaagatctgtaccttttaaaaattcagctttttaatctgcaagaaacagtcatgttgttgatttgaatttaattgtagcatggaatggcaaagtcattatttgcaaatcaaaacattatagctataaaagatagttttccctttcaaagagtggatgaaatacaacattttcagataaactgtcaaggagttaatagtaaaatacctcctcctttctttcctcctcctctccctcacctccttctttttttcttccattttcttttctttcttccttacctctctaactagctccttccctcccctctcctccattctcttacaacatgagataacacatcattgtcagaatgtggttgtgcatcactgtaaaaggaggaagttgtaatcacgtctgcataccacgagcacacattattttctgttttgacagtttgtttctgcactctcagacctaacatgtgcagagtcacatttcctaggatgctctgtattgctagtggtacctgtttatctgggatgaaaatgaagccttcagtatgtgccttatatagactgtattagcaggtctcctgttgtttaatcaaaaaaattttcaaatgaaatgtactctacctagatgaccagttaattcaatggaaattcggataaaaaagtcacaaataagctgcagtaagaatcaggacacttaggaagtatatttcttttatatacctcaaggaagatacctgtgtatatctgcaataaattctccatgcaaaattattaatttgagttttttttggatgctgcataatgtcctagagggttaaaaaaataacactgggacccagcaatgctgtgggcttgtgtaaaattctcttgttcacacactgtttatgggattagatactacagtcattcacttctattttatggtcttttagggggacccagatcatgtcagggttccactagtgaaaacaatcttcttttgaaatttccttgataatacaaatgcaaaagtatgagaaagtttttgaaattttttagggttgttataggatgttttattatttactccaagactgaaaagtgaaatgcatatatgcctaggttatgttggtaagaatcagtagcatactgtgaaaagtcttggatattaggctttgtgtgaacaccgcaaccatcttgtaaccttaaaataagaaaattgtggaaataacaaaggcaggcatgtggagtgttcatcttttcccaccaatacttggtaaatgtgtgcttttaagacaaatattgctttaacttctcctagtgttagtataattgggtttgaaatgacatttttcccactagctttgtcatttgatactcatttatgcttgaaaatgagctctgaaaatattattatgataaagccatgtaaggaatcttgaacagtcaagctgttaacttagacatttaaagtttccagcaagttgatataaagaacatattctttttaaattagaaaagtctaagtccctttacagtggagcctacatttgactaaacactacattctaatgagatggtatgtaaaagacaaatttattttttttaaggtgatgctgaattagttctccctgcatacacatatcactcctaagcatgggacagacagtgtgagtgaggctgaggaagtatgatgttggtagggtttttgttgtaggtctttacacatgagttcaagtagagaatatgttgtggaacaggtctgaaagaaagcatcatttatcctgtgttcatcaaggatctggatatattctctgtttatcaaggattagtctcttctgactaatccgacaagtttataggcaacacataacacataccttttcttaacagaatgacagtctaacggtgctaatcttcttggaaaagaattcaagcccatctcaaaagaattgttttctggtatctttccacacaagtttaaaatcatggcagtcattttcttggaaagtctctttaaaggacacatcaaactctaacagaggctgagtatgcacatagcataaaatataagtgttccaaaagatataatagccattatatgccaatgatgttcacctattcgtaagcaatgtggtcaattttaaattaggtttactgacgctggtcatagaaagctttaatccctgtgcgctgttacaagtttagcagaacattgaatccatctgagagaatttctcatgcaacagtttttatgggccttgaagtttaatggtggtgagaaggcccgtttgctctttgtcgaccattttataaattctgaagcagtgagggtgtttatttttcccacatctgttttgggtcctcttttgtgacagtgtttgctggatgccgtgtcctttatacctcccctgaaatgagtagtttagtttgcactgttacaatgtatttgtggaagcagccagtgtcaaatattttacatttaattccctctctcatttcttttggatacctttctgcttgaattgtgtcttctagactgaatttcacaacttgacatggaaagagagacatttctgcatggacttcatatatattgccattatgttttttcaaaccaagtgttatctgctggactggaaagcatattgatgaaaatgctttcagaacgaaagcttgataatagggctgtgatttgatctcatcaatattgctttacgataatatttacagaaaattatttgtgtgtcctctctgcaatgtccatacactctgaatacagatggacagttctggagcattggctctttgctgcagtttgaggttctagagtaaaagcacagagtgtggattatctagaaatccctgttcttcgacatcttattttatctactgatgcttggtgtctcatggaataccaggcaaatacacatcaattgtactgttgattgtggtttctaaccagatacaagctcccctttctccttttaaaatcagaaacgctagaaaagagtgatatcagaaaatctttggttttaattccactgagggatcttgatcaccttgcttcatctttcaaaacttcaatttcctcatctttaaaacagggataatcattatatctcatagtggcaataagtaagataatgtgcatagcttcacaaaatgctgggcacacagcacttaaataactattattctgcatttcaacatacctctcatatttctcaatagctgagtttaggaattattttatcttagctgctaaagtgtatatatgatccatttgactttttacgaccatatttacatttttaaaaaatgttcttcctaacgtagtatatggtcaactgaagagatgtgaagaaaagcttaacaacccttcaatggttatttcagagtgtttctcatagtctctctgagtctatagagaaataccgggaagtaaggggataaaagagggagcaatattttgctaataagtattgacatccctagcaaggaatacaagggattaagttatcattgatatcactgctgaagatgtaaactttattttatttacataatacaaaataaattttaaaatctgtgctttaaaagtgttaaaataaaaacatttttataagagaagtcaaaatttacctgagaaggtggcaaaagaggaggctaaatagttttatgcttgatcattcatgtaggagaaataggaggttagaaatggtaggctttgaggcagcatttatcaaacatttattacagacctagcacgctgctaaaaacaccttatatttacatgtaaatatgacatgtaaatatggagcacaaaattttactggctttggtaaaactgttttcatattacgttttgaattagatggaaggttgtgaacattaattgaattgaggtgaaagtcgcaaaaagtaagagactatgacctctgctaaaggacaagagtcatagacacagctggcagataataattcaaaacaatgtttgtcaatacgttcaggctgcccttcaaattgaggttgttaagaatcagtgtttcagaggccagtggtgttttgtgcaatgcagaaagatcattctctcttctgaaagtcaaactcaaaaatagctggtagcacagagcaaacagttactggaatcctttctcatctttgccctgggagaaagtatctcagagacatacattacacacctttctgaaactgtgaattgccatctagagaattatcaagcatttctgggatgttgtgggcagattccattgaggggtgatgacacatgacttatatatcactatatctctgtcattcctttgataccattgagtgtctgtgctctcaacaatgataattgactcacctggtctgtttaacaaagctaatttatgttggctcccataaataatcctctgtgatatctttaattcactacatgctgtttcctgttctggaaccatcagatttaacttcaactcatttacgttagagatcttattctgacacgatcatcttcaagctgttaagcaaatttctgtcacaattagaagctaggctactttttctctagctctgtttagtaattgttatataccttaatagtctttaaaataagtttaaattttaaataaatgctctttattttaaggatttaatttctggtgattgcacaggcggctatcctttaaaatttttctttaatattttgaaagttttgctttttctgttaatgtttgtataaccatttaaccttagtatggatggaagagagaatagaaaaagtggagccaaatgtgtattgatactgctttaaagacaataaaagggaaacgtatactgttttgttgtatccatattaccacattacttacgttatctgtcctttttgtgcaataccaccttgtcttatcctaaaaacagaaacgtatctggtgggtttagacatataaagatcactcataataactttcatgaaataattataaagtactgcaattcagagaagaattcttcgtatatattttcagttttttttttctgaaatttaaaatacctagttttcaacaggtgtttaaaaccatgagctgaacgtagagctagcttttttaaaaaataaaactttgttgtatttacaattgcttagttcatagatatttaagaaatggatcaaataaatctatgttttgcctcagggaatacaggtgaaaaggaaagcttccgcattatattattctgaattattgtttaggaatgtttagactatattttttccagaggagtgattcagagggtatgttttagtgtcataccacctttattcaggccctagctttatgtctttgaactctgcacttctctccagaacagcagtgagaattgtacttactcatggggatgtggtgaggagtgaatgagataacttgtataaacctctcaatagtgaccatcacctagtaagcttattacttacacagtgaattagaacacatgttagctattagttacacagtgaattaggaaccactgggaataagaaagggataataattaagaaaaaaaaaaaccacttcttgtatccagtctgaaaaatctgctttctcacaatatatgaaactatactgatgtagactcgttaacaagaaagctggtagcagctgttactcacttatatctctgaatttgtttaaacacattgaattctttccagcttctaggtgatgccgagaatcacatcatcaaggatgttgatggaatggaaaggaggaaactattgtctggggcatgtgaaagcaggtttgacagccagagaatggcatcaaacccaaggcaggtgcctcagggaggatgccagaggaatgttggcttaatataaaatgtaaatgctagggccttgctgaaatatatcaaaatactaagagaacaatctgttctcattcagcatttcctaagaacctactaagggccagagattagggaatgttgactgagagcaggctgctctctttggcttttcatatggttcagaacttactaagtgccagggaagaagggagggaatacaaagatttagtctttatgcttgaagagctcacagtctagtgggaaagagaccagtacatgaataaatattacacagtgtaagggactcttgcttatcaaatgctgtggggacacagccaagagaagcactaactttttgtaggagaatcaggggaaggttcacagaggatgtaagaaagcaccatttggagaaaaggagaagcacttcataaagagaactgcctctgcagggcccaggggcttgccgagaatgcttgctctggctagagaataacaaatgaggctggtaaatctcgtggtttggattacatcatgagagctcatttctgatgttttagaaattggaattggctctttggacaatggaggtccttccaagagtggttgcattcctagaaaaaaatctcattaccactgttgcaaatatgtgtaatatatttttagagggaaatacaacaaagtaacaatctgcatttcattgaaattgtataatgctagactctggaagtacactgtcttcagaatcatacctaacagagaacaaataaatgaaagcttttgatttgactttaaattttaccttgttatgtgcttcatttaaaaaattagcgtgtaagtgggaagtaaattcactcctttaccactaattttactatttgcctctacttgtcttggcatacttttttttattagtatgcattttattaaggcctgagaatgtttctgtagatgatcaacttctttctgagttcacataaagttatggtgccatcattgcttcatggcattttttagaatggaaagaagttctgaagtttacctggtctcgcttctcacttacaggattttaaaaaattatatcattttccaaaaaaaattcatagcctctgcttgaatacattttgagataagcagttgagagtttccatttcttaatagctaattcttagaaaggtcttctgtataatcaaatttcttaggagttacaatcaaggggcccatttctgccctctggagactaaataagtataattctgcatctacccgatgacccttgcaatatgtcaagattgatatgccctcttttcctgtcccttttactatttatctttaaaacttaagaaatacctctggtttcctcagtgtgacattaccttctggaactatatccagaaactatactatataatatgcctctactcctctcgagctaggcagcttgtaagtcatttgagtgcaaaatgttacatcagctctttatcgttttatttagatttgggaaaagcagagaaatagacagttattttaaattaaatgttaaattgtacactgaaaacagatgggattgggatatgactacatcacagatagtatttacccactctttctttaataggtgtgcataccaagcatcagggcttaaattgagttacagttgcaatcacactcttttctaaaacatttaaaacattccaatttacttagacattttaaaacattactgaaactgatttgacacaactgttagttataatgctgagccttaaattcagttaagggttggaagctgtgggttgaggtttgaactctgggttggtattctcctgattttgcctatgggacaaatcatgctgacaatttctcacaccttttttttttttcctcccaactaaatgaaaagctaagaaagttgaaatttccatctccccacaattccttggctgaacttttaggccaattgggactgtgtatggattattttagacaccattcactgtggtatttctgctggatattgaagtcacctaccttaggcgcctaagactgaatcacaaaaatcctttatcattgtgtgtattctggttgactgatgttgcacaggatttcagtttaaagtttagaccccagtaatcatcatcttagtaagcacaatggaaaactgctgtaaagagtcatgtaacaaaaggtgtaaccaacttttgatttgcaatgcttgaattctcctgaatgtcatttcattcttttctgaaatacaggatgaggcatgacactaccaaatcacagtctcattgttgggtattttctatgtaacataagctttgtttttgttttctcaaaaggcgtttaaacagaaatcaccttcagctgtttcctgagttgctgtttcttgggactgcgaagctatacaggctgtaagtagacacaaatagttattgttgctttgggtagtaccttgtgttttattaaatgtattttggatctgtttgtgtgtgctttcctggaatctgttcatcaatagattaatggattaaaagtttgtgttttttctttaggaaatttatgatttgttttctagtggttccagttgttttatttggttaggatttagcggtttatgtatgtgttatggaaattggattattattatttttttggtaacgtgatgatggcgagatttacctaccttttaatggaaatgtttgattaagttctgaagggagaaaattgctactgtttcctcttaagaggaagttggcagtgtgttcttataaagttgagatttttaatgtcagcttttttggtattgtttctgggctcaagtagtcgtgtttattagtccgaaatattattataaggtatttaaagagggctgtaaatttcctcttaaatgtttcctttaaagccacaatttcagcctctgcaatatgaatgactgtatggcaaggttttcatatcaaatacgtcatagactattaaaggaagtaattccttaaaggagcataatgtgagtattagggggaatcactttttcctccctggaatgcttttgcactgacctaatgtgtaatagtgaaaacacattttgaaagcatttaaaatgagattttcagccatatgaaatgactttgtgcagatgggagataagctacaaagttttggaaaaataaatagcaatgattattgaggtatatgcatgttgtgaaaaaaactgctggaatgtatagagtaaattgctccattagcccccacctggatggtgggtgtcccatatggtactgtttgtagagaaagtgagcatagttcctttttctgaacttgtctttgtagcctactagttcaatgtggttatcaattccagaagtaggaggactgtcctctcacacccttcacccccaagaatagccaggatctttgttacatcctcctgaaaccttaacaaccttaacttactatagggagatattccccagctgacataccagatctctccagagtctttcctgactttgttcctctaaggatagctaaaatcacctgacatttttctcttcttttttgtgttccctgctgctcaattggaccaatttaagtaaattttaaaaataaaatgaagaaaccttggaattgcatttttaacaaaaattatctaataactatttttacttaggaaatagggtgtaggtttgctataaagattataggtatgcatatcagtagataattatatctaaatatttgtgcttagtttctaaaaagggccatagaattggttttgatagtatttcactttcacctttagttattggtgactgaggagatttttaaggaatcgacttggattaatttcccccagtttaaggtggtataatccattgcagaatccctcatcagcaaattatattctccttgacattttgccatctttgacaatatctcatagcagaccaagagattttcttttatgttttgttatgattttataactgtatgcagctgctgtatgaaaaaagacttgaaatctttaagtgaattaaagaaacagaatccataaaacctatgacagcatttcctaattaattaaatgcgtgttggaaaatggggaaacaggcagctagaaaatgtgttcagatttttttatgtgtctttctggctcaaaggatttgtcctggggagtaataacagctaaagcagtgtttgttaggtggagctagttacaagagggatgtgaatatttttatgtttcaggagttatataacttgatggcctagcactcaatattgacaaagtgtatccctttacatgagatttgacatcagatttaggcactggatgtacatagaaaactagaggtggaatttttatttgcatcctcacgtcaggaatcttaatttgagttaaggaactgttgcttcatctgaattagacttaggtgaattgttgagtgctttttctctcgagagaataagttataagctgcatgtgaccacttgtttatgatggtgataattaattaaattaaacaactgccattggaagtctttaataaacaaaggaacacgtgcttgtgaagctcactactggctagtgtaattatgaaaagcaagggtacaagttcacattttctcacatgatacagatgccaagtagctcacctgaaacaaatattctagcagatgggaaaatgtgcacaaacctatatgcacaacatcctttataatgctcatttaaaaacatatttttttcacaagaagaacaagtgacagaacaaaggatatggaatttttgacaaataatggggaaaaatgataggacaaggaaagtatttgatagttgatatatatatgatcgttttataaatatgtgtaaaacaatatataagtattctataaatatatatttatagaatatatgttttgacatttatataatatataattattatacatagtatatatttatatgtaatataatatataattaatttatatataatatttatatataatttatatttatatattatatatatatatatagcaagccatagttgcccctactgtctaatgcagtagaggcatactatatgcagaactcataaaaaaacaaatttaggatttacttcctctgtataggttgttccgagatacgaattaatgtttcaatttcttttcttagttattgtatactttattcatacttaacactatgttttcccaggtatatcactaataaaaaagtttactggtttaatacatagtttatacactgaagtttgatttttcgcattgtttgcttagattaaagctagttggatatactggacattgtgttgcttttctttgagctttggaataaataatcgccctttgactagtggttgaaaataagatgccaggggaagaagcacacatgcttttcatggactctaaatgcaatataaaagaaaaggagggtatactgtatatgaattatgattcgacacacttggttgctgctagcggccaaatatgcttttcctttgctgtctgctccaatttctctttggacgggttgagagagcactacatgttcaggtcaagatgtttgctcagaaatagtagtacagttgcagctgtgtttgttggagtaggagactagtttaaatagcattaccatttatccagtccattaacagaactctgtaaaataataccaactctgcataaactacaggacagtgtaataaaattacaagcacttgttgacagatggaaagtgcaagtccagggaaactaaaataagggacgataggttggaggttaaaaaaaaaaaaaataagccagcatgaagttttcttaacttatagactctatcttcccctttgctcctcctccaaaatcaaggttgcatttttattatgaacctaagagtagaggaaattatttttaaagaaatctggagctggttaactgaagaagagattgcagggaattttgaaacagttgattatgattgattgaaatttatgagtactaatacaaatcttcctgataagtgtaaccttaaaagaggcttaagagtaagtgattcacactttttgatgagtttgcgactactaatctggactcattaaagaggaatttcattggtagtactgcggttaggcatttggttataaatatttgttttgtggttttcggtttatttctttgagtatattatatttactgagacttctaacgtaagcttaagtatccaaagcactttttagaaactcatttttcacttttatctgccaaaccaaaccaaaactaaacaaacaaacaaaaagaactgcatctgtcccagggactcattttctctacttctttgaatgaaaactttttacttctggttctcaagtgccattcatgattccccagtgagttttggagcgactaaattatctaacattaggaatggtatttttaaggccaaagactctctttatggcctagtgaatacttacctgagacaaataggttttgactgcttaatttcattggccaggtcataattcattatctctcagataggatttcagattctcaaaattgcttttgataactataataattgggactttcttaagaggaaaacttaattttttttattaaggtaatcaattaatttgttcagcataacaaatatatataattaagctgtctttattttcctttccatcactgccatagaaggagacttatttttttttaatagttataagagtaacacatgctcattgtaaaaaagatctaggaaattcagaaaaaaatagaaaataggaagtaaaaattatctattatctcactacgcagatatagccattattatacttatcaattattatcttagaattatttttatgattatacatataagtgctacttagacgtgtattatgaaaacttttttttaatgtccccagggtctagtataaggcttgacctttagaagctctcatcaagtgtttgatgtattgaattaaatctctgttgggttcagggtttgtaacttgaatgagcaaatagtaactctgggacggcattataaataatggagaaccaaattaaatttaaaggataacttggtcaattaaatgtttgattcccctaggtttctcaaacattgaagtgtttcagtagacataacacaatcaaaatgatccatttttcacctaagcaaaatataccttaatttaataaaatgttttataaaacgaactccctagttcttggatgtcagtttagtctcataggtttcttggagtcaaccatgaaagcaggatacaacagaggagcccatgtacaaatttctcttgaattaatttctgccagctctgattaaagtgtggactactagagatgtcaggtgccatcgtttcctgcttcattttactcttggcctgtttggcccctgccacaataaatccgactgtgattgtgcaggaattgcaggttacagttgctacggttactgttgttcagccagaccgacatcattactcatctagcgcgctgccatgatagctaccgctgatttctgttgctgagactgccaaagagcttcatgtgctaagggtgaaagttccgtcgaaggtggcgtctgtgttctaatttggtgtaaggaaacactatctgaattatatactgatactttgctaaggggaacagattgactctgtatcgagagagaaaacttagaaaagtgttcactttcagtgattaaaacaccaagtccttcattactaaggtaactttttaattacttattgggcccaagggactatgtttttgccacttaaaaaatagaggcatacaaggagtattgcatttaaaaaaattaccactatttaaccaaaactttattttcaaatagataggcaacagacttgatatatggacatctgaacacaactcaaaatagccattaccacttgtcatgaaagaaagaaaagtgcaaagccctgagcaggacctacttctacttttattttttaaatcaacgtgtaatcctgtgatttaaacgtcctaaatccaatgaagattaagatcatatttgagattttgccagatctagtgttgatggtttttacttcaaaggaattactaatagacttgttgctaaagaaagctaacagttgtccggtttctgctgttaccaacacacagagtggaccttctgagtgtgaaatccacagcatagctcatagcataagaaaatcaaatgcaagaatgcaagaaagtttctgtgtttttttttttttcactcagctgtacttatttaaacgactgctttcacaagtgcaaatgtttctaactccaccaacaagtacttatggactgccaacttgaatttgtagaatactatgatcaatgctcagaagggaaactaacaaaatatgtggctctatataatatgtggtatttgtgggcctcagctgttgctaacgtctgacctatactgcgtgaattaatgcctagagagttcattgagagtgatcaaatatgtgaatttcagtctatcatattcatgtaaaaaatatatcgtatacacataatcaggtaatattttaaagtttttaaataatgaaattgccactacaatctcaaggttacaattttggggactgaaatttacataaacattatttctaggaataagggttggtagggttttagttatatttaggtaattttaatgtatttgctttatgttttaagacactgaaatcaatttactttctatcttaagggaggttgtgtaaaatgatagtgtttaaatgcctactcagatacttgcagttctgttaactttggaagtcagtagacaaccgtattgttgaggtttcttatctgtaaaatgggaaggatcatacaatttactttctggggatagcacagtaaaatttagattccatattcaaaggaacattgtaaattttcaagtatgatagaaactataattatattattgtcatcctttcattgcaagcaagatggaaatgatagtcactcagatgtccttgcaacttgccctcagtcagcaaagttcctgatactattgcacagccctcttgcatttatccttactgtagtaacacgtaaatatgtgtagtcacattaattatcttaccacagcaaattgacataaaatgtgcatttgtaccatgttatttctctttacttggctgcagaaggtacattagggccaggatattcttaatgagatctcttcatgctctcccagttgatgattcatatagttttaaaattcatctataaaataaattacagatagaaacaaaaagactgtgactcaggaactatttgttagtgcatatatttagattgctgttttaatgatgtgtttttctgaatgacaaatgaaggaaaaatacaaatgttagaaaatgctgagtaaactccttaaactataggtaaagtattctgaaagttgttcagaagatttacatatgttgctaaggaacactttcactactaataaaaattttattttttaaaataatataagattactctgttagctttgtaatatgtacatatgatttgatctatggaacattgtcatctttatataaattgcataggtgattttaagtgtatttttagactactaattatgtcaaaatccagtaaaaattgcaaatcttttagcactttaaatctaaataatgttacattatgagacaagtttgaaccagaagtcgttttgttttgttcttttttccacaattccagtacttctcaaagtagcatagatctatatggtgtatatccactcattacatgttacctataactgagttgattataatcactgaattttttctggagggttaaccttaaaatattttataaattttgatataagaaacctttggatggaagttttaaaagaaactaaatcttagagaaggaagcagtgaagagtaaaaagaccagtccttgacaacacctatggcctagggtacagcatagaggtgtgaaatgttattaagagaacatctgtgtctcttgaaacatcccccaaatgaaagtttatagcaaagtatggcaacttgatttaagtgttaaaaacaaaacaaacaaacaaacaaaaacttaaaagagaaataagtaaatctggaaacagaattggaaaaaatagctttgccccatcatgataggtttcttctgctagtgaaagattaaagctcgaagtatgtgaatagctgagaacagcacagagaaaggttgattgcttcccctccgacagttccaattgattgaaaaaagcctaatttaaagttctgtttgttctatgtcttaaaccatcagaattctcttttgggacctgaggaatgctctggaggaaaaagaatccaaggataaaaagtcattgcaagccaacaattgttcctaatcctcacaaaatgctggagaaattaaatttattctttattgctcaaagtgttacctaggtcactgggcgatgggaaaattggactggaagtcgagtaggcgcaagctttgttttgtgtctagatgcttaaccttagacacgacaaggcatcttagagtgttgtgggaacttggttcagagcattaacaccaagacttttattaccccggatttataataggctgtgctgtcaggagatgaaaatgttgtgtttacatttcagtgttaaatgatcatttaattaacacctaaggggaaaaaaaacttgtgaaattcttagcagcttttattgttggtttcctgggaggttttaatatccaagtttcattgagaatttttttgtaagtaaagacacaaaagacattataaactttttaaggaagacaaacagtttaaccttgaccctttaaaaaaatattaatttaaattaaattttaaatctggtgttcttctcataagtttctagactaatatattaaaatacattttgattggacactacttttgtgtaaacagtatataaatatgattgaatttacattatacattttctagggtaaaacatttgaaattactgattagtttatcttaagaagtttaaaatgtttagaacactgacttaaacattttgcatctgttaaactaccactgtagttacattgtttagaatctgcctcaatgtaggtattcatatgcaagcatattctattggtaagttatgtcattattctattatttttaatcattaatttggatatagctacatcatgatgaaagattttcatcatgatgtagctatatccaaattaatatatatatatatacacacacaaacacaatagggaagaataatgccattaatatgaaaactcagattcacttaattagaaataactaaaagattagacgtcataaaatgcttttatttactcttgctcttttatgagacagttaaccaaaaaggaatggtcttgaggcagagtgataacatttggaagatgtaatgtgtactgtcaagagtagctgcatagttagtaacactttaagggtacctctctaaaactatctttaaagtttacatcttttttattcccattttatctgaatatgaagctttatgttcaaatatatgaaacttaaaaaaaatttaccagtttacatgctgttaaagtaaaatctttcttaatttttccagaaatgaacatgtcattatgatgtagtctttttctaaatacactgtttatgttcacactgaaacagaaatgcttatctgtttttttttttgttgttgttgtttaaattcaaatgcctcaggataaaacccactctctgtcttattcatgataaagaagtgcatggaaaatggaatgttgttaaaatctctcaataaaaagccctgcttttaactaaggattataccctcacttacaaaacactactgagcaattatgtaggcactttttatgatgttatatgctctacttacttctatcaagtttcaacctttctgcaaactttcctcattttttttaacacactttgatctttttcttcccaaagcgacttttctacccagcctcttgtcacaaaaacccagaaataggaatatcgctttaaacattttatcttctttacgtaaggaccaaccttctggttgagttagttgcaagacaaaacaaacaaaaacaaaaacaaaaaaaacacaaaacattgtccagaagtataaaagagtgaaagacaagagaaagagaggagtaacaaaacctggttatttaatataatagccagggtattctaaatggtatagtttgtcataccaactgatattccaagccaattgggtgatgccagtggtggggggcggtggggggagggcgtgtggagggggaagcgagaggtgggcatactgagtgcttaagaaacgtacagaagaagaataagtatttagggaaattataggaaattccatttaacatagatacatgtatttcttttatactaaggaagtcaatgctgtgcttttatacggagaaagtcagtgttaaaatttcatacattccttttttgaaatctctgctcagaaactaaaaagaaatatttcagtatttattttagataaactctccaggcttgcctcttaaaaaaaataggaataacttctaaatacaatctgtgctaacaaatatatttgacagttactctaagtcatttcatgtattgaggttgggaaataaaatatcgagaaatactctgtattgtacttggcagtgattagttaaaattaacctcccatttatatcacactctttcacttggctttgatgacccaccataatgtagttctgcattacctcttcaacgttatcatgctatcatagcagatctaccgtatctcaagcaagcagattttcccattgctgcctggaaattcccagcattatttctggacttctttctttcctccttcctcctcatatgggcctcagctcctctactaaagctttctcaatggttttagttacctccacatgatcattcattataatatggtacagactattgattctatggtacattataatgtggtacagatggttgattcagaccacctgggtttgagtcactgaatgtgtcatcttgggaatatcactcaattacctgccaagcgcctcagtttttccttgtgtaaaatgaggatactaggagtatgtttcttatggaagtgatgtgtggagtaaattatttcctaaatgaactgagcttactatggtacttggcatataataagtggcatgtacttactttttttgcttccttttatcattaaaactgtatcactgtttcctgtcccatataatgggttgtcacatataattctttaatcgtaacctgtgtattaactttgccaagattcctgtcttatatttgtccttgtttcatatgtagcatccagcctagtacaggtcggctaataaatatctttttgatgaaatagttggaaattaagcctgagaaagacactaccaatagattgaatttgggatgatatatgttgaggtgtgaaaaaagcactggatcagaagccaaaaggcttttacagctgggcatggtggctcatgcctgtaatcccagcactttgggaggcggaggtgggcggatcacgaggtcaggagatccagaccatcctggctaacacagtgaaaccctgtctctactaaaaatacaaaaaattagctgggcgtggtggcgggcgcctgtagtcccagctacttgggaggctgaggcaggagaatggcgtgaacctgggaggcggaggttgcagtgagccgagaccgcatcactgcactccagcctgggtgacagagcgagactctgtctcaaaaaaaaaaaaaaaaaaagaacaacaacaaaaaaaaaccaaaaagctttcactagttacattcctagctctgctgatcactagctgcagttgctgagcaaagatactggcttttttttgaggatcagtttctgtgtttatatatgagtatgtagtaagtcagataagagagggaccttgcccaatgtgttcaccatcctattaccagaatttagcagaaggcctccaagcctctagggaatgtgtgaagataattgagggaaaggaaggagatcaaaatacatctaagatgtgttctctctgtttttcaaaaatttacagggaactctacacaggccctggaataattacagtggtggagttattcatggtaataaatcaggaattagataattaggttgtggataagtgatttgagattattctctctattattagcttacattttgaatggctttgctattaaatgtgaattgtttgaaggcttatattaaaaaaatgttttttttttttttttgagacggagtttttctcttgttgcccaggttggagtgcaatggcgtgatctcagctcactgcaacctccgcctcctgggttcaagcgattctcctacctaaacttcctgagtagttgggattacaggcatgcgccaccacgcccggctgatttttgtgtttttagtagagatggggtttctccatgttggtcaggctggcgtcaaacttcacacctcaggtgatccgcccgcctcggcctcccaaagtgctgggattacaggcgtgagccactgcacccagctggttaaaaaaatgattaaaggagatttgatgcttatgccttattaagtggtgatcttgatacttgataatctctcaatatgaggtaagtggtgtacaactgaggtagttttaataatcacctgtctctcaaacatcgctagtggtagcatgaagaaataagttaaaaattaaacagggcaaatcaagataatataatggatttggttaataaaggtttatatgttcatatttgcgttataattttttttgtaataggttggaagcagggaccatcattttctgtaattctccctaggaaatgcattgtgcacccgggacaattcattttcctgactttttgaggagaacagaatgtgtggaacctgaataccctgaaggcaaaggaatctggagtctgtttctaagaggagagcttctctctgacttggtgtgggttttctttccctctgttgaaggggaatgaattccacacctaatgaatagtttcaaggaaagttgttaatcaggtactccaagtgaccaccctggattcttcttttattacacaggaacgtgagggaatgagaaagcagcatagttacatttgataaaaggaaatactctttctcctctcccctcccaccacaccatcccttggaatttagttgatgtgggaaattactgcagcaaataatgtgtttgaaaaagcaaagttgtatgaatgagaataacgcttgtagctacaataattatgttaaaaattcacaaggtatatccatcatcatatttcagagcaagagttttcgtctaacgaggttggaaaagaatttttccttagttcttgtcaatctcccagggaagcatggcatgcaggaataactgttgttaccaacattatattttgtgcttttctgattcatcagaacctttctgttgccgtaaaatgggaaacttcatcaaaatcagatgaagaacttcaagtaaatgtgacagaggggtaataatgaactataaatataattgatttttattcagatggacaaatgttattctttaatcctttcccatttagaagccatactctaatttaaaaagagaaaagtggtctctaatttaaaaagagaaaagtggtttaaaacaacaacattacagtccagatatttctctgtcttctaaattaagccacctgggttgaagaacactattcaagtgtgggtaaacatgttttgataaaaagttttgttatttccaaataactattatacccccaatcataagtgtgatatctattaccagatactcatttgggttgttttttaaaaataatatgattcagttttaggtttttaaaagtatagttcttatcttcaattctcaagaatatgtaataccttttatttattactatactaattttatattatatttcaaagaagtgatacctccagtgtgcactccagtggttcaagagaaaagtgttctgtggtcaaatgtgttgggaaataatgaaagtcatatcacctgtggtggctacagtgtacacttgtgtgttaatcttaaaggcatactacaataaataaatctgtttaaccttttaaaatttgtttttcaaagttatttaactatagaggcctctcttctttcttaactattcctgtttgttcttgttaatccagagagcaaaaccagtttttagcttttccaatgaatagttactttttattacttctgattgagattttattaaagaccatttaggacatatagggttgacatatattattttttttgtgccagcgttgtcacgtgtaagacttttaatagtgcattggcttataaatctgttcttttcaatccatctttgaaggtgaactcggcattctgttgtagccttgagaaatagaagaacttagaatattttctaacaatttcattaacttagcaccactatttgctttaggtatttgtttatatgtgtgtgttgcctgtgtgcctgtgtgcgcgcgcgcacacacacacacacacacacacaaagtcattcaactactattttaaggactttaacattttatagcttaactgtctctctcttccctgcctcagccaattgaagcaccagaagtcctttgtggaacacctgctgtgcacagcattctttagcaacacaatgaggggtgcatcatctaagctggtgtgaacttgcaggagtctttctcactctatagagagggtgttggagccaaaagcttttattttatgtacaatttggagatgattggtggactttgaagtcattgcaaaactaatttgttcagtatttttgccaagaccaatctttccagtattagaagacaaaataacttagatatgagggtttagacacaggaaaaaaaacaaatggaagaaatgattataaatctccaaaggcaacttttaaaaatacacctgaatgatgcttctcaccaggacacttaatattaatcattactgaaaattaccatctcatctcttagttcccccagtaagttgctttggggtcaccaatttttatttattgttaatattgagagaaaagacacaaatgaaaacagaatcataaaattagagtatgactcagtcaaaactatttcaaagcttgatattaaataaacaatataaataatttacttcaaattatacccaatatttgcacacacatttaatcttcagcttttactgtgcctaaagatctattcttaatcagttttggctccctcttcttaaagaagcagaatacccaaaccctcccattccccttccctgatctattcttctcctttggtttccataccatgtatatatcgcagtgtgtattttgcttatgttgtctttcaattccaattaatgtggaagcgttgtgaacatagacagtaacagtagatgtacaagaaatacaggttgagtgagtgaatgagggccttccaacaacctgccagaattggaatcctagctccagtgtttactaggtgggcaacttgctgccattcagagaatgccaccaccctgcctggagaatggggcccctttccttgtgttgctgtgcagtaccaaatgatggacaccttcccatatgcagatgttttcacttactttttaacataatgaatccacaaacctctagcctggggacttaaaaatgtgctgctttagttaactctagtgtattatagaaactgctaattcttatattgtcattattagcttactaaccaaatcccttccataggttatacattctgtgagggtttggacatacatatgcctctcccttcaccacagagcagtattcacatgcactgagtgctcaaatattcataggttgaaggaaaagggtagggagaacaaaggaaccatggaatcatccttcatggtaaataagcgaaagacagcatgtgaagcatcatctttttaatatctttgcgtatgttctttcttgatagtgtttgagtttaaaaagaatagccatcagtacacttgttcagtcaatatatctaagcacttatgcataggtgactttttgtaccaatgctttgactgtaatatattaattctgtttacaaaatcctgaagaaagggctgtcctacaacactttttatattatttgtcagttctctcccaatgtttttacccatttatgtgtgtgagagattttgttttgcttaatttgcaaataaaacaatattactacaaaattactacaaagttgaaattgctaatgtagtaggaaacaaatgaggcagatggtttagtctcatcattttgtgtctttacataggtttctaagggatagcttacatcatttagtgtgcttccaccattctttgccattctagggcatgtacttctgacatttttattaggcttttgtgtttggtcactgtattacatccagcaatttattcctttccacttaaattgtcttccctgtacaaggggtggagaagaattcagtgtctgcacataaaaggccattatcttatcttagcaactccagccatacactcctctgtgaatcatgacagctcagctgggaaatgcagaactgtatcataagagggcgagatcatgggagtgagacaatgatgaggcctatgacattggaaggtggtgagttcatcatctgcaacaaagattaacaaccctttgctgagcctgacctgataggccatttagtggaaagaccaaagcttgcatccaggaagtgtgctctgcctatgatcttgatttacctgtagcttgtaaagactactcaggtgatctcattgttatttttcttgccccaaatcagaacacctcctttatcagaaaactgagataagcacactgacactgatacttcatatgtattgcagcaggcaggctgtagggcaaatacatagaaacttttgcactttactcttttatttttattttttctgagacgatgtcttgctctgttatgcagggagtgcagtggtgtgatctcagctcactgcaacctatgcctcctgattcaagtgatcctccctcctaaacctcccaagtaattggaactacaggcacacatcaccacgcccagctaatttttgtatttcttgtaaagatggtgtttcaccatattgcccaggcaggtctcaaactcctgggctcaagcaatctacctgcttcaacctcccaaagtgctgggattacaagcatgagccaccatgcccaacctgcgttactcctaatacagtcttcattctacaaagagaactattttctgactggaggaagtggtgatgctgaggatggagtcagttgtgtagctctcataaaatgagaacatgatccagaggctcttccaagtgccttatttatattaatagtgcttcattcgtttttcaataatatggaggaggaccaaattacggatgagaaaactgacacccaaagagatgatgtaatgcccacatggcaggctagcatttgaatacagtgcagtgttctttaccatgtatattaactgttctggggataagagggtcttttaattaaataaaaacactatacaatgtgtaatcctcatggtaatctcttttaaatcctcacctcactttatgcatcgttaattgtgcataggtgcttacagggagcttgttatcctctctcccccaccctcatcccatcattttccaaacttgaagtttaatgtcactcttggctccttttcccttccttagctccactttcaacttctgtcagttctacctccacagttggttcatccgtcttctcctttccctctcagtaatttgcttcctaactgtacttcctgctcctgtatttctttatctatacagtcctctgcctaatggccagaagtatcctcctaaagtacagctaggaggccaggtgcagtgactcatgcccgtaatcccagcactttgggaggccgaggtggatgaacacctgaagtcaggagttcgagaccagcctgaccaacatggtgaaactctgtctctactaaaaatacaaaaaattagatgggcgtggtagcgtgtgcctgcagtcccagctactcgggaggctgaggtgggagaatcgcttgaacctgggaggcaaaggttgcagtgagctgagatcgtgccattgcactccagcatgggcaacagagcaagacttcatctctaagtaaataaatatagctaagatcacgtcccttgcccaaagatcattttgtatacaggcacagcagtttagatttaataaaacatttttccacgcattacactcaaaggtactctgataaatatgtatcaccatctcagttttatagatgaaataactgaagcctaaagtggttatcccacttactagcccacctttctagggctagtaaataataaaaccattattttcctgtaaacttacccagctgctgttgtctaaactcctacactggccttcaagttgtctaagtggtctcaagctattgttcttatttcctggtgttttctcactgtaccatggacttcaggagtgactcaaggaagctagctactcttgagcctatggacatgcctctgatatttcttctgccttcttcaccagtaaacgtgtattcactgcccaagaactagatcccgctttctctgctctactgacctacctgattgaacccaagaagctgtgaccccatttatgaaatcaatgccacaggcaagcaatgcgccccattaggaagcctctcacagtggagagtctagcagagaatatctctcttccctggagtgtttcttcctgctccttcactgcctgacaacacctcccatccccttttttgttaacaggatgtcttatacatctcaaaggaatgttctaacagggttcatatttatttatctcattatcaccttaggtcttggtccttagttggaacttttttgttgatggaaagactgtacctgataaactcaaatgtgtttttctcctgtgaggcttgtttggagggtttaatctgagcctattcactcttcagttgtgcctagaagcatctctccattgtctccatagttttatgtaaaaatgatcatatagtgagtatatccctatctctctccttctagaattcaagctactggtggcaaattctaagtatttttcatctttatgcttcccacagcacttaatatagggctaataagcacataggagaggctggataaatacttgctaaataaattcaataaggtcttttcttaaaaacaattttctttaaaaaaaaagctatgtattgatgtttaagttttataaagacttctcattcttttcctccaagtcaaatttcttttattgaaacagaaaacttgcttttgaaatgaaacaaaatttcagtaacatggtatctgatttttaaacagcctatatagttgcacataacagagtgtgtttatgtgtgcaaattagtaagtcgatagaatttccaggtaaacaatcatggctgttattgtatgccatcacgtttattatggaaacatattattgtaatttatctgggaatttaaaaaaacagtgtgtgagtcagcacgctgtggtacagagccaagtttttgtgggcaaacagggtgggattccgatcttggcttcagcagtgtggtgtgtaggcctgggttcctcacctgtggatggacgctccttacctcattggcttgttgtgaagatcgaatgagtctgtgaggtcagtgaagcacttacacttagtaaattctcaataaatattcactgtgatgttttttattagaaacactgacacattactgagtgcatgtgctctgcacgtgtgcatgacaatgaggaaatttccctttaattcctgaagtgctgggtgatgatctatacccaggataatttttctagtaaatcagcttattggggatgcctatggataaagcccttcacttttaaggtattccctttaatttaacaataagacataaaacattgaagtatacaaaatgaacggctatggttaatggattacctgcaaataaatgacacctgtccaaatctggcttcaataataagggaattcatcactttacaaaaacaagaagttcagaggtaggtcaagccatagcttttagttactttctccctcttcatttctccagcctcactgtcagtgtccaaaggctttgctcctggtgtcaaaacagccatcagtgtgccttgtgcttcctggttcatagtcagtgagagagagaagggaagaagggagggcaaaagagagcataggagatatctcccctcaagatggacttcaagtctctgttttcaattgaattgaaccaacttaggtgaagttgccaaagaaagggcatgtgttgattgatttaaactagttgagatacgtctctagacttttgcatggttgtgtaagtgaatcaggtcaggactctaataggacagagaaaggtggggcagggggtgctgatgcatgtggggaagtaaccaacaatgtccgtactctccaattaagaacttaaattttaatatttcatctgatttttgccacaggaatttgaatcagttttctgttacagcatttttaatttttgtgaataaaatggaacctcttagaatttggtttctttgtgactcatttcctcatagagggataataaaactcacatttccagttttgagatgactattaaaaaaaatctgtgtatgacccagtgccagcaagcccagcttgctttttgagtagttactattgttgttgccattgctattttcttggtcaggatgtctttattttattttgtctcatctagactccagttttctatttccaaatttttacattatgaatccacatgggtgccttatcacctcatccaagaaaaaaacccatgaaggtgtgttttctttttaacattttataaattatatgctcatacaatctcatagagttctcacagaaaccctatggtgcagatgctatttgtgcaattttagagatctctttatctgcctcctttaaactatgagcttcatgaggacagagactttgttttgttcactgttgtatccttagtattcaaaatagtatatcacacaaggtagactggcagatgctcaatcagtgttttctgaagaaagggagagaggggaggagggaggagccctttgtgacctacagaggttggagggctttcccagtttgtgacattctagttaagatataaaccctcattcgtagtgggcctctgaggcctgtataccctgcctctctacagcttcatcttgctttcttcactctgctgtctctgtctgtgctccagctgcacaggcatatgcagttcctacgatatgcctccctctacaccgccacagggtctttgcacatgcagattctttagcctgtggaactgcttgctctacctgctcatctcccagttgcctccctacacctggccattctcccatatccctgctttactctgttgagaaccttcatattccagcttgaacacagttttctgggaagccttacctaatcccccaggttaaaccatgttccctttataaatccccacagcatcaggattctttcctcaactgtttttaaatacagtcagcccttcgtgtctgtgggttccccatctgtggattcaaccaacagcagatcaaaaatatttgaaaaaatgaaaaagaaatgaaaaataaccattaaaaaatacaaaccaaaaactatacagtataacaacaatttgcatagcatttacattacattagttactgtaagtagtttagagataatttaaagtctatgagaggatgtgttaggttctattcaaatactaggccatgtaagggacttttgcattcttagagtttggaatccctattagcctagagcacggggtcctggaaccagtgtcccatggataccaagggacgactatatgtgtgtatttgtgtgattacttatgaataccctttcttcactagagcttgaaaacaggggtgggttttcactcatcattgttttgccagtgtctggcatatggtggttgcttggtaaatatgcgttgaataaatgctaaaaaatactgttttgtcagcctgttttcatggttttttttttttttctgattacactcatgatttacagaagaaaggttagcatttgtattaatatcttatttttttctgtatcatttttcgtaataacctatatatcagaaaatcataaagtctgcagggacagcttctgtgtccctagcttaaattattatgcccatttccttcttttagggctaagcttaaaatttatcttcactggcctttactcagtcaaggctggattgggtgtccctcccaatccaggggtggcccagcatcctgttaatgtggtcagcacccaactatttttttttcatctggctctccactgaacttaaaagtagagactgaatttagttcgatatgtttgcccattgcccagcacaatgcctggcatattagacaccagagatacttttccaaatgaatgaattaataaatgcatgtcttgcacttgtgtgatgttcctcagatatctaagtcgttcctggaaaagcattcagtaaatagttgtaattcagtgcgttcagtgtggtatgcacattcttcaaggattgtccaagttaatctactttttagtgatcttatcactggattgcagattgcacactacatacgagtatttggctgaggaggaggagaatggggcctgaaatccagcatgcactctgaccattatggtatgtctgctcctaagaaacctcatatatatatatatatatatatatatatatatatatatatatatatttttttttttttttttttttttttttttttacagcaatgctatgtgtaattgcatggtcctaaatgtaggaacaaaaatgttaaaaattttctgtttaagttctattcacattttctctcaactttgaaatgtctctattttaaaaaatgtatcgtatattggtacaataatactaatctatacaaatagaagtaatttataaatggtgaaggcgtatgttcaaaaaattttgctgatgcagtaatatgtaatcaaaacaattatagagaactttgatttaatctctaagccgagtgccatggtagtttccaaaaataatttgcagctttcttttgatctcattttgagatggctgaagaagggactaaatgatcttagggtagaaacatcctagagctcctgcacacctctgtgtgtgtgtgtgtgtgtgtgtgtgtgtgtgtgtgcatgtgtgtgcatcctgtgtgtatcaggtgttcctgcgtatgtgctgaagaggagaatggatagactatggctggactatggctgagatttgtcttcaggtttggtgcaaatccatcccaatgcagtccattttagggaaagcagatacactaatttcaagatttgttagccaattctcctttcagatgagtagtttatgatgaattctcttttccccattcattggctttctctaaattgtagatctaaaacaacctcttcatgtctgctctgcctctgggatagaaataatgaattgtaggtttctaataaaagagacacgttttgtgtctgaacatcttgattagaatcgttgcagccatttactcaacgtgtgactatttaggaaaaataatcattctgagcttcagtattttcttttgtaaaatgaaagtaatattaattaattcatagatttgttacagctacttgggaggctgaggtgagaggatcgcttgaggacaggagtttgagagtagctttctgggtgatatagtgagacctgtctcaaaagaagaagaaggagaaggagcactgagacggagaaggagaagaaggagaaacactctgacatagtactaggtagacagtgtttatggaaattttttagttttgagctttagaagtcttttttattagcaatgataaaatcacagctgtttatgtgctgtctgatgtgatggttactttaaaacacatgtattatttctctatatcaaactcgttaaaataagattatttggttagggattagctaatgtatttgtctgttttttgaagagtgacagcttcctagctttttcttttttctttattttttggtctacttgaagctgccgtatttattatatgattgagtaatgatacagtgataatgtattatatgactgagtattgatacaatgataatgactccatcccatggtctgagtaattttgcaacatgtgggtcccacaggaccgtagagcaaaaatcctttctgaatggggtatctgcgaaggcaatagagacttcactttaagtggatttctgtagtttccaaagggatgagagggagaaaaaaaagtctgtatagaaagaggggggaaaaagtctgtatggaaaggatgacttagttgacatggttaaaaggtgtgctcattgactgggaaaaagttcataagtttgcagtattaggttaaggaaggaaagtccattcaagctgttttaaagactctgagatgccagactaagaacttcattcagactttatttgataggcaggggtgatgtgattaagatcatgccctgggaagattatgactatgaattgaaagaaacagactggaagcctagagatcagttacaaaaataataccatagtccaaagtcataattcaggatgaaactgttaggaaaagaggaaggacatttaaaaagatatttgcaatgaatagctgttgtatattgtatggtgggtttgggtgaaactagactaaaatttttaacaaagcctaaataaacagcaatgagagctggttccctcagcgttttgtttgaggtactagtgattatcaagtgaagttcttaacgcgtagtaatgtgaacttaagaaaggaagagcattactattttttcagggtttagcatcaattcttagctttcttcctgaaaccatttcccatcttctactatttgaagaactagaggcatagatgtattaatgtggcctttatttttcttgtgagaataagaaggataatacacctcccatgctggaaactaccttagaaacttaggtgaagagacaggtgtcagatatattatgtgacttgcccaagattgcctggcccgtggagagagagccttcactgtggctcagggatgtgggcttcctgtgtgaaggtcctcccaagactctgtgctgcctggtctttacctggtccacggacaccaatccttttttacttttttttttttctaccatttcatggtgtttgcatttgtcaatatttaaagacacctacctgaaattcacagaactgtatatgatgcttctcatttttgtttgtttgttttttgtctttagaaagtacccacatattgtctgggtgtggtggctcatgcctgtaatcccagcagtttgggaggctgaggcaggtggatcacttgaggctaggagtttgagactagcctggccaacatgacgaaaccctgtctctactaaaattgcaaaaattagctgggcatggtggcatgtgcctgtaatcccagctacatcatgagtctgacgcacaagaattgcttgaacccaagagacagaggttgcactgagccaagatcacaccactgcactccatcctggatgacagagtgagactctgtctcaaaaaaaaaaaaaagaaagcacccacataataaaaatgttgtgctgggcactatataaagccaggtaaatatacaaaggtctcagcctccactgtgtatcatgtttcatacacggaagattatatcctgaaatcactggagtaaatgttgaagtatcagagtatcagtttctcccccataaattctccggttacacttagaaagttttttgtttagttgtgttttgtgtttagttttggctctaagaggaaggaaaggaaattcacattttgtttgtctgacacttttacgagaagttatatatggccttttaatttacacatgtaaaattaatttgtaaaagcagctatgatgtaatttatggatgaaaaagctgaagattgactagccttgttaatgaaaggtagatagccatggttggaattcatgtcttctgaggttcataaaacaggccatcttttaaattgagaagtgacatcataatagcaacatgggcaacctgaaaggcagtcaaagaaaaacaaggagggtattaaaaggtctgaatggtatatcacacgaaaatcagttgaagagacttgcactatttagaagaaagagataaaacaaaggtgctacttaatcaaaaatttttaaacagctgaggtgttatcctttcaaagaagtatcaaagactagttagctcaaaaagatgaaagtaatttgatattggaagtgactttcctttccaaggctcatgtcaagggtttggggccaggtatttggcaggacttcactgttgggaagattgcaaaagaaccttgccttaaacatttataattttaacctttctgccactgaattcattttaatagtgaatctgatacaaaataattacttataaaatagattaactggaatttctttgcttaaagcaaggatgataaagaggcccctactcttgaaagttttccggggcccctttctgatacactgtgagtacaatgattttaatttgaaaacctttgttggtaaaaatgatttccaaattccattcctgtggaaagatgctaatttaactttaatttgaacaaagtcgacttatgctaacaactcctaatttggtcatgacttttgggggaaatcttcactcaggtttgggcagtgaagttactgctaagatagctgctcaagtgaagggcagatgaccgtcagctctcttagtagtaagtcaatccaaaccaactccttcattgccaattaatccagtccctgcgtcatgcccctggaaaggtacttgggcttcctgagaagttattcatcctgataaagtgaaataaaacaaagcaaactcatagtattttcaggatttcaaggaaatatattgaaagatttttgctgtgcacaatgatttatttatttaaaaaatttaaaattgatgctctgccgaaaaggcataattgtaagggaatctataattgcagccttcatttctcttgagtactaggaaaaaaaaataagaaaggaaaaatggaaggacagatattattaaataaagtgttactagcatcacatgctcaaattaacatgttctttgccacagtgctctaaaggagatatttgcactttatctgtatgatggccagtgccatatatgaagtatattcaatccaagaaaatgtctgggagtcagaagtatgttcagacaagttttctatcatgtgttgtctaccagccttttacatactgtagatattctagaaagactaacaagctagacaaattaatttctccttttgttatgcttatgagaataaactgattaaacagttcctattctatctgtgtaaacagagacatattagttaacttactgcttattttattttcccacatacttacagtaatttcaaatgttgaaaaatgaggagagcagaatatggcattaagcaaagagaatgaaataaaaaataaagcaatgatctgaactagaaaaaaaagttttaaaaatgtaatttttcagttacacaaaagttaccatggcattacctttccttttgtgtctgttggtgatttaatttagtagttttagaaaatgtgtctattgctgtatttaaaaattctaattacagcaattggtaaagaagtttccaagtacaaggggtatttgtagagaacctgtaggactgacaagtgattgacaggtaaacaaccccactgtggccttatattccattctgtgatgttggactatagatactacataagcctcaggaagtaaccaccttccaatttttattaaatgcttggcgtcatggatgtaaacagtattgtgccttagttgactaaatgtggcactttcttttacactgccgcaccaccctgactcagtgtgatggaatatctgtgaaaagaacaaatgggaacttttctttaatgcgtttaactgaatgtatcccccgaaaagaaaagcaagtgcagatttcatcaaataaattgaaaccatctaaaagtgaatgaaagaggatagcatttctaacttcaaatgttctgtttatgacttactagtgccagtgtgaaattgccctttcttctctgctaatgcaaaggctgacaggtcagcatgcacacacacattatgttatgcgcaatcggaagctcttgagcttgtccttgaacatgctttacagttaatatatcttgattttcaaagtgccattttttcccgttttgaacccagactttcttttccttgcttccttacaaatagtttccttaattcgtatgcatttcttactgtacttcttggtactcatttcttttttgaaaaatctttataatagcctgctttaataaaatattttaaaatagttaataaaattggatgaatgctgtcatcaactgtgattctttaagaaatagttcgtatgtttactaataaattcaaaattaatggatttgcctgatgtgaaactttgttttcctgaattttaaaatgtggaagcaagtcttctttttgtaaccatttcatatttttaagatgttctaatgattgcctcagagtctagaggaaaaatattctgagggttttccccccttccacttgaatgctaagaacttggatgttttgaatgagctattcgccagcagatgaaaagtcattccagataaatgagaaaccaagtacagtaaaatctgtgttttctaaccagcaaaatctggaaaatcgtaattttttgattccccaggcaaaaatgtcaatctaataaataggctaactgaaatagggtagggtgactgtggtgaaatttaagttgttaagagatgcaatatgtattcttattgctaattttaaaaaaaatctcatgggtttttgtgagcaaaaatgatatatttgtgtaaatcatggcattttccttccttttctagaccatgaggaaaaacaaataggaggtaaaaagaggagatcaacacatgaattaactctgagttatctgtaacggataccctgtcttcataatgtatctcataaaagttttaataccagtgtatttcaaaggtttgcaagttatttagtacttggaacatgttttcccatagaaacaatgttgtaaatattggttcagttcccaggccagtgcacacagcctatttaatccatatgtatctaagagacagtaccaatgtttgcttgagtactggatcctaaaggcatatgtgcagaaaagagcatagtaatcggtatcttctgttagttttttttttttttttcctttttgagacagaatttccctcttgctgcccgggctggagtgcaatggcgtaatctcggctcactgcaacctccacctcccggattcaagccattctcctgcctcagcctcctgagtagctgggattacaggcatgtgccaccatgcccggctaatttttgtatttttagtagagacggggtttctccttgttggtcaggctggtcttgaactcccgacctcaggtgatctgcctgccttggcctcccaaaatgctgggattacagacgtgagccactgcacccggccctattttctgttaattttatggaaaggaaatggtcttataggaatttccagaaggcactaattttgatatttgtccttttcttttgtgcctcttattcaaaagtcaccagagttctcttgtggacctgtgggaacagcaggacccagagtttactatataacctgctctttaaaggaaaaacaatctccttcaagggattcctgtaggttggggcattttggcccctttattgctctggacttgttgataaagcttattaacctcagtgttctaaatggtacagttaaaatgatttactaagcccaagaaacacaatgaggatatgacagaaacatcttgatatgttgctggaggtttaagaaagtcttgttgcttagttgtgacttttaatttatttctttgttttccccttcacaatgtcttatttcaataaaaactttatagtttttcacagtagctctcatagtgatggtggcagagcctttgctgagctgaggcaatatcagagaggttgatagtaagctctttgtttggaaattggggattgtaatttattgcattatttttaataaatgaaaaattaccattattcatagttgtaatttgacatttatctgtcattaatttttgcaatatgtttttgtatattgcaaaaatgcaatttgacaatgtaatttgacatttatctcagactgtatgactttttacaatatgttttccccaatattttatatatataagcaagcagggcctgtatgattttctttgctcttgccacaccagttgtattcaagccaaagacaatccacccagtgggtgatttataacatagctattttttaaagagatataaagcactgtattgctttatcagtaagaatatacagacttttaaaaaacattatttctaatatatttatatatcaacaaggatcaaaacaaattttgttactggaactttatcacaaaccatgtttttagtgaagaaatagctattatactttcttgtacagttcgttcaaaggaggacatgtgttttgtcaacgaggaaagaaatcaatgctatttgtgatattatatacctcatttgaatattttatctatttcaataaattgaaaatgagttcctactttcttttccatatgctgattttcatgatttctttttctatagagaaaaatatagctgagcagatttttaaatgcagcattggcagtgttacaggtctttaattttgttggcattgttcattttgcctttttttgttttttttttttagttttgtgatgtgaggtgatgtgatggtcaaaaatgtggactttttaaggcccgacagggggagccaattccatattctattgagatttcctggcattattgcagttgtccatttgtcacggccaaaatactttctttagccttggctgtccatagggctccgtaacagatactctttgctaaaaataatacagtattttatattaattacctttcagtcattaatattgaaattattaatctattgagataatgcctaggaaactgaaatagggtcattattttaaaatgtatgatatcatcattcaaggtaaagttaatcttataaatataaccttttcacaataaagatcaatgtagaatatatggaacattttaatgctcataaaaattctttagtataatattttatggttagattaataaacatgggaccatctcttctcagatttttaagcaaatcaaatttataaaataattaaaatcacatgactctattatatgacttttttaaaaccacataccttactttaaaaaaagtaaagatcctaaactaagttcaaggtctaccacaatgaatcatttaggatggtattgaattcccataattgtttggttctgtgttttgttctcagtaaagaaagtggaatggttttatttatttgaattatatagggtatatcttatcaaaagacattctaagattacaaaaacattcaatgtgatacatttatcttgacaaggaacatggaattatatgtgcaagaacattcatttgttttcatagtttagaatatataaaattttataatttctgtgcatttatcactttgtaagccttaattccctagttagctacgtatctatatatcctaagatataatatatgatgagtgcattttagttgtctcgcacatgtagacacgtgcagacatgcacacacacacacacacaaatatagacatcctctttgtttttatttcctgtatattcactaacatgataatggacatatattatgtgataaattatattgtgtgttaaataactaccatagattacctattttaaatttcaagagcaataaatctctgttgctaaaatcaagcactaggcttttatggaactcttcctattttttaaaaaacttaactttgtttctgctagagcttcgtttgagtatgattatgctatcaggagcctaaaatgcaatagcatttaatgaatttttggtttgattttgaaaaaaaaatggatatggtatacatcgttttctaattttaaaaagtaatctcattagcctttgtgttaccttaacatatagtacagattttgccttatgctaaagacttcatgcaagttggataaatgaatgaatgaatgagcaactctttaaaggctatgctctcttgaacagtgtatctacctgttttctcatatattcaatgagatgctaattatttgctttgttcatatggttgatagggaaatcaaataagatattgaagagctttaaaaattagaaaattttaaattttaaatttatgaacaatgataacactacatttttataattcaaaatgctggctatttgggatacatctttatttttatcttaaagagataagcatgttactggctatttgaaactttctgtatgagaatgtctcttttttgcaatgctgcagtgaatcatgcttgtaagaatggccaaatagacctatgtttgctaacgttagattcttgttatacccaattacccttttgttcttcatgccattctgaatgtcattttgcaccaatggccaggcattaacggggcatactaactctattgtacctgccacttatgcagtattagtttcagactccctacttttaattgaagagctatgtagttaaattatcatgtcatgaattccaattcactagaagagctaaggaagaaaatgctattgaaagctttcccaagtaacatttcttttaaattgacaagtctttagactaatgagatattagtagaggaggatgtattttcatttgtaaataaaattgagattaaaaaatgttaaagagaaccattttagaataatcctctctctcctgagaaaagttgtcttgacaacagtaccatttataattagaaatgatgaatattttatttctcgaaggaaaattctccctaactatgctagacagtgatcgggctaaatgttcatcaggctcaatcattttttggtgcaaaaatatactgtcgattttttggctcagtaataatcaagccttgccttgtagtttataaggactgggttttcctatgcatttcttaatagtaatctgtgaaattaagaaaaagagatcttattgacctaattttacagaaagagtatgtatctaataagtgacaaaaatagaactagagaaacgaagattaatttttttgcttttcatcattttgccaaaggggcagaaacacatgacacatttcagagttgtgctttcactcatgttcgaatctattcttttatatcatggaatttgtatttctttcaatttaaaatattttattttctttgcctattataagtgaagaattggcttaaacttaagatatctgatatagatttcagtctttctctagtgttcatgaaaataaagccatttaaacaaatggctattcaaattaaaagatgtgatggaaacttcatcttgtgtcatcatttattccatcagttatccagtgtctgctacatgccaggcaatgggggagggacaagttaaataaatcataatgtctatgggggggatggaaggacacatctagaaagcagtgaccagccttcagagtattgaaattgaaatggctgcatgatgtcagaggctagagcattcactttgagataaagcgttcatgaggactgtgggaggagatggcacttgaggtgtgtcatgaaaaagggggatatatttaaggagggaggttaaggagagggtgtaacatccaccagaggaaatgactgtgcaatccagtgaccaagagaggagagtaatcgattggaggatgcattggaatgttaaatggggcttgattctagaaggccttggtgcaattctaaagcaaacgtttatcatccaatcaaatctattaccttgaactcagtggtttagtgaattacacagttgtttgtatctgattgtatatgacgtggaactttcatgatataaatttaccttctgtcttcacttttatgacttcgttaaaatccattcactgatgaaatcttatcccattatctacattaaatcttatcccattatctacattaaatcttatcccattgtctacattacacttaaagtttaagacatattttattattaattcaaataatatacttttgaaacctttattatctatatctgtgatgacctcaaagttcaagtagtgttacatggaaaatgttagttttatactgtgcaagacttactttaatacaggttcactctttggattctgtttgtaaaagagtagaatttaattcaagatttcctgtggctggctggatttagagagccactctcagtacccttacaagccaggcactttgcagatacaaggctttgaaacaaagactgaaacaaagtgcagtggctctttatatttatattttacttgttttattgttttcattgaggaggaatttatttattagcttccatttatcattagaacacatttcattttagagaagctctgaggtcttaaagctaatatggaattacagttactttttttttttattttgaagatcatatatgaaagacagtacatttcatagaaatgaaagacagatgcctcttcctctctttctttcttttcctcctttgtaccaacctctgtgttaatagaaaatgccttgtggtgtggccatgagcatggtggtcttgaggagcccacgctccactgaatggataaacaaacaacagtgacacagcatcaggcttaagtcagaggtaggatcaccgtctgtgtagacatatgtatgtggtttcttctttctgtctatgtgggtgcctcatagcagagtgtacgtgaatgtggttcttaaataaaattatatgcactgggagcttaggactgaggaagaatattccagctagatggaatggcaaaaataaagacatagaactacaaaggtgagtaggtggtaagttcaagggaaatgataggagatgaaccttggaaggctggtctatgccacactacatgaggtgataactgagtttgaatcacacctgctaggctgggaacagcatggaaaatatttaagcaatgttgagacatgttgaaatctgtaaaatagaaacataattaccattttgagggtgggtttgagggcctagaggcttatgtgattttctcctgcagagttttagctatgatagcagaggaggtgttttctgcagtatctcttgtgtcacaaaaagttcctaccagtgtatattattgtaaactactcaatacacatttgttcattggatgaatgatgctacttatccccctactcttaattaaaagctcaactagataacttttttaaaagaaaagaaaacgaaagaaaggaaggaaaaaataaggtaagagagaactaaaaattggactataaggcagtggaaataggtaatacagagtgtatttgcagaactcaaagatacatggttgtgaaggaaggagaggagttgtaatagactattactttgactccagtgaaacacacctctcaattttcatgcccttgtgtagtgcctttccttgaatctgagcttggccatgtgacaagcgttggccaatgagacattagcaagtgagatgcaagcagaggcttgacaaatgcttacatgttagagatggtcttcttgcttggaatacttgtggttagagtgcaccatcttggaacagctgccttgctgttaggaagcccgagaagtgatacaaagagatgcacatgaaggaaaatggagatgcagagcttacattcccatctgtgctcccagccagtcccagcgctcaggccattttgtaacttccaaccatcccctcacccccaccataccatacaaaacgcaaaaactgcccactcacaccacagaattttaagagagcgtgattggtggttgttgttttaagttgctacactttagggtagtctgttaacatagcaaagtataacttcaaaatgaatggagaatggttttaatatatgcaggttaattacttggtggattgtgataccttcatttatcttagctcaaagtacaagataagtagttttgttgctagtacactagactgtgaattcttcgaagaatgaatctatatttttactgcattttggcaaataggtattcgaaaatgtttgctgaatgtaatattgaaagcaagccatgctcatgatgctatgccatttagctgctgctaaactggtaactctccatgtggctctgctttttatttttgcttttggttatcatgtacccctgtgacccaacatacagaatggtaacaggaggtgtaaatacacacacaccccacacagacatatatacaccaaaaaaagaacagaaaataaatgtttgatgaaatggagacggctagatcacaacacgtgggaaaaattaaggtctatgtcacctgtgaaaaaactgaaattaatgaacaaatttctgtaacataagtcagacattctttctattaaatttaagctaatttatataaaacaccatgtatgggaaccccctattcaaacacacagcttgtatacttgggtaagaaaatgtgggttaccattagaatgaaaggcaaatgatgtatttggagattagttattacttccttgtaaaaatgtgtaattaagcaatcctgaccgggcatggtggctcatgcctataatcccagcattttgggaggccgaggtgggcagatcacttgagatcaggagttcgagaccagcctgaccaacatggtgaaaccccatctccactaaaaatacaaaaattagccgggcatggtggcgctcaactgtaatcccagctacttgggaggccgaggcaggagaattgcttgaacctgggaggcagaggttgcagtgagccgagataatgccactgcactctggcctgggtgacagagtgagactgtctcaaaataataataataataataataataataataataataataataataataatcctaaagaagttatggtgcccacataggttagcgttaagtgtatgttagattttcaaagctgtaagttactcctatgaagttatgcataattcttacatcttcattgcttccaatttggtcaagaaagaaaccctagaatcttgatccttctggaagaaaagggagaaaacaggtaaagtggtaaaattggttagtgaaagataatgaaagcctttaagaaaaattctgaaactgaaagcagcagggggcagtagaacattttgagtatggaacacggggagaaaggggactggtcagtggagaaggatgctggcatctctgaagaaatgttttagttttatttttaaatacacaagactatcttttgatcattacgtttcctgttttcatgatcctgcaagctagggatagtcacctgtggtcaatattaatatcaaatgaaacctgtccatttagaaaagtagcttatgctcctttcccaacatcagtatgtagaatgtgcccctatgcataatatatagcaatttatattttaattctcttttcttcttttgtataatttggcttgaaaatcctaaaatgtagggtagagggactcaaattaggaagcttgagaattacaagccaggtaatccattgagtattaatttttcaatagatttatttcccgcgatttgagatccttatcccactgcattttcgtgtgctttttttgttttgttttgttttatcaagtcaaaacaaaccagtttttattcatggagaaatcttgcctctgtgcctttgcctggactgtacttttacttaggatttcctttcttgtatatccatgactccaagttataatcagttcttcaaaacttatttcagattccagattattggtgaccacttctggtatttccccaaccaaagaaagctgaatccttgcttgcattctccatagcagtatccatgcacttaattatagtacttaattttctatcttaaaaaaatatatataaataaaatttgtatttttcttataggattgtcaacttcttgagtgcagaaattcatttctctgatatacacagcatctactacagtttctttcctccattcccttcctttttacctaccttccttccttccttccttcattccatgcctccatccctccacccgctctatttctttccctccctccctcccttcccttccctcccttcctccctccctccctccctccctccctccttccttccttccttccttccttccttccttctttccctgactccctctctccaccccctctatttcttttccttccttccttccttccttccttccttccttccttccttccttccttaaactaagggtctccttgtcacccaggcaggagtgcagtggcgccatcatagctcactgctgccttgaattcctggactcaagccatcctcctgcctcagcctcccacgtggctgacactgcaggagcacaccaccacactcggataaattcttaattttttttcatagaggcaggatctcactttgcagtccaggcttgtctcaaactcctgacttcaagtccctccttggcctgctaaagtattgggattataggcatgagccactgggttcagccagtttcttattcttgttagacatttgattaatacttgttcaatctatatatgcagttactctttttgaatcttacctatgctgcattaagacattcaagacaatggggtgaaaggacaggaaactagtatttagtaagtgcttaagtgtataccagggactctaattctttgcatctgttcttttaaaatcctattagcaactgtttaaaataggtaatattatgtccatgcatttaaggacatgaatctcacaggcagtaacttgcccaagctcacatggatagtgtgaggcagaactgggatttgagacccactgcctgtcccctgaccacctccaaagcccatgtcgttttcacaacacagcagctattatctatttggtgctacacattgctttaggaactgctgattctacattgaataaaatactctactgtctttgaaagactcacatgccagcaaggaggagattaattattatgatttttagtgataagtgctttaaaaatgtcctatggctaccaggccagggaccattacctgtgcctggcaagagacacgcttcatggagaggtgtagcttggacttgggaagtgatggggccttgagggattagcagttcaccaggtagagatgctagaaaggccaaggaaggagtctaccattcagaaacgggatgtcatagctcacttgatcagctcattggctgggaatttgtgtacatggtaaaacgagtggaaaatgccatcacctcattatggaatctctggagtgctccaaagtgccaataggtaacctgatgtattaaatcacatgacaacagaggtttatagtatatagattagatatcagagaagtgatttatactgcagtggtaaggtcagacagaaaatataggaggggaaacaacgtggtatagaaagcatgagctttgaagtcaaatacatgaagctttgaatctcagctcttgacacttttcagctacatgaccttgaaaagtaatccagttgctttgagtatcagtcactgcctctgtaaaatggggatattagctacttcaaagactcttggtgggattagagaaggaatggaatacttaatagaaggtaggtatttagtaaacagaggcttatatatacccttaatttttgtacatatgggtatacttataaaaatgttggtaaagcaatgctgtttcaaagatcctattttaaatatatcaatatatgaagtaatgtcaagtttctagttgtacatatgtacatacaaacaaacatatatttacctttattctaatttagtgacattctgatgctaaaaggacatggaaagttcacatgcttttcattttcttatacttacttgtatgaaaaagactatgtcattcttcattgagtcttattttggaggtttcgagaataagtttaattttatgccattcctaaggtattttaggattctgtcatcagattcatcattattatcataattaattcaaaattataaatgatatgattctccttgtttgtaaaccagtttccttgggttttagatatggtcaatttaacaatgatactgttcctgttgttgaaataacgtttgccaaaagttatattctagatattcttaaattaaaagagtaatattcttattgcaataaagttatttttatgtatttcacaaacaactttattgaatattgaaagtttttaaataagaacaccaattatagcattctttgcactaaaatcctctagaggctcagatttttacttttagttttagaataaagcagtgaaacctctttctgcttttaacagatctttttttttctttatccactctcttttcttcttttatagcatcccttttcaccaattattttcatttctcttatttttttaacttacaactttttattagagcttttcctctgtcttcaaatatgcttaaaattcttctgtcctcaaaaaataaaaataaaaaagaagcaacaaataaaatcctctttacttgtgtaagatcctatttctctcctctctctagctagacatcttgatatacttaatttgctatatctaatacctgatctttaaattaattgattaaaaatctactgtgataacctcagtgtcctttactgtactactaaagctccttctactaacaatctttggtgaccttctagtctttctttctttttttttttttttttttgagatggagtcttgctctttcacccaggctggagtgcagtggcgttatctcggctcactgcaagctccgcctcccgggttcatgccattctcctgcctcagcctcccgagtagctgggactacaggcgcccaccaccacgcctggctaattttttgtatttttttagtagagacggggcttcaccatgttagccaggatgatctggatctcctgacctcgtgatctgcccgcctcggcctccccaagtgctgggattacaggcgtgagccaccgcgtccggcccctctagtctcttatcagatctggtggttctatcttcatcagctactttgcacaaaatttaccaccatctccttctcatacatcactatttcctcaaatttctttcttactcttttttaatgtttctcattgtacacatgctttctggacattcttgctaattttcaggtttttaacttccaccacgagctgccaacactagagtttatatctctgtctctttttactatctgtacaaacctggatgaaacattagcaactcaaatttagtcagcaaaaaaacaattatctttctctatgcaatcttctctttcatcctgccaagacttcgttccttctgtatttctttgcagttcatagcaccatcataacccgagtttcctagggcaccaacctggatatcacactgagacttttctcttatccccacattcagtaagccttcatccctgacaactttccctcttaagtatctcttcttctcctgtcctgttcagcatcgtcccagatttgccttctctagattattacattggtactaaatggacttgctggctagaggtatgtatgcttcctttcagtgactttgccccaattgctgcagagtgctctatcctaaacccacgcccctgcaggtctttattctggaagctctttcatattatttggtctcattctgtaactgaatttcaagtaagtttccactcataaatctttaaatgaagggaatgtggctattattatctgtgttctgagagagtttatcacagtataggtaatccataaatccttatggatgaactgaactcaattttttaaattagttaattaatttattttcagagacaggctcttattctcttgcccaggctggagtgtagtggtgcaatcatagctcattatagctgtaaactcttgggctcaagtgatcctcctgcctcagccttcctagtagctggattacaagttcatgtcaccacactcagcaaattatttttttaattttttgttgaaatggatgtcttactattttgcccaagctggtctcaaactcttgcccttatgcaattctcccaccttggcctcccaaagcactggaattttaggcgtgggccatggtgccaggcctgaactcaatattttataccaaaataattttgatttaaaaaacgtatgtgtgggaaaagttgggagcaattagaaaacagttttaaactttgtatctaattttaaaaccatgctcttaaaataagattatccctcaaatatttgtgttcacaggtaaatattttagcaataacttttgaaaaatgtgatgaaataatgttgaatttctttacatttttgtgttcgaaagtcagtgttataaatgaaaaatcacataatcgatgtaacaagttattataggatttgctacacagtagatggtaattctgatttttatttaatatagattgttatggaaatctttataaaattttgctacaaaaatgtttacatatgtgaccttactggaagtgaatagtactactttggtttaaaagtttgttcttaagaataagaacattttagagttatagaaaatagtccagtcaatgataatagctgtgtgtaactattctaattgagaatggatcattctttatggaagatttggtaaattatacagaatattgagcctttattgtttgtaaaattaatttaattttgtttgaaatatactctattaagccactataaatgtgtatccaataagctatctgaattagtattcagatgaaaatatattgaatttctcagggctttcaatatcagttctatttccgtgagcattttagctttctaatacaagaaatgcaatttgaattgtttactgctgtaagccactggttattttcagacataatggaataatggtgtttagccacaatgtggtattttctaaaagcacttgaaatatttcatgagtaagattagctaaagaatttagtcttgttttttatgaccatgatagtttatgtctgcaacctgagaagtttttattttcagaacagtttctcaagagttttattttaaagaaaatgaaactttttcttataagatcagatatcaggtttccactaactgtgttaaatatttcgctttaagttacagtatggaaaatttgagttactcaaccaactcaactaacttaggcattttattgtgaaccaagaggagaggagtgtgagataattataatcaaaaactaccataaatacatgatgtgattgtaaatttattctttagtgaaatactgagaacagattattttagattatcatttttaatttatgttcacaaaacattttaatgaataattcatattgataaagtgttatatattttgtagttataagtaaaattaaaatatatattaaagaaaacatatggctgggtgcagtggctcatgcctgtaatcccagcactttgggaggctgaggcaggcagatcgtgaggtcagaagatcgagaccatcctggccaacatggtgaaaccccatatctactaaaaatacaaaaaaattagcgggtttgttggcgcgcatctgtagtcccagctacttgggaggctgaggcagggaaatggcttgaacctgggagatggaggttgcagtgagctgagattgtgccattgcatttcagcctggcgatagagtgagactttgtctcaaaaaaaaaaaaaaaaaaaaaagaaagaaaagaaaacatattttagagtagggcttttaattgatattttagtccttctttaaatggcaaatataaaatagattttcttgctcttattattttatcctaaagtgattttcatggaattttgtctataagaaattgaaataaattttatgctgtataattatgtcagaatttgacacaataaagatatttttcagttctatgattgggttaactgtttctaggcttgagggagaattttgcttgtaaaccgtattaatttggtagatcgcattctactgtagtcttgtcacatttgttgactttctgtaaaaagtggctgtattagtctgtttctgcattgctataaagaaatacctgagacttggtaatttataaaagaaaagaggtttaattggctcagagttctgcaagctgtaacagaagtatggcactaacatctgatggcttttggtgaggcctcaggaagcttacagtcataacagaaggcaaagctggagcaggcacatcacgtggtaagagcaggaggaagagagagggaggcagatgccgtatgtttttaaacagccagctctcatgagaagtcagagccagaatccactcatcaccaaggggatggtgccaagccattcatgagggacccacccctgtcatcaagtcagctcccactaggtcccacctcccacactggaggtcacatttcaatgtgagatttggaggcagccaacatccagaccacatgagtggctttctgattactttctgccttctttttttcttttttagtatatccactttactgtttgtatgtgttaaagcggtggtccccaacctttttggcaccagggactggtttttggaagacagtttttctatggaatgggtgggggattgttttgggatgaaactgttctgcgctagattctcataaggagtgtgcaacctagatccctcgcaagcacagttggcaaaagggtttgtcctcctatgacgatcttacgcggctgctgatctgaacacgaggtggcgctcaggcggcaatgctcacttgcctgctgctcacctcctcctgggcaacccgctcctcacaggccatggatcagcactggtccaggcccaggggttggggacccctgtgttaaagtcatgttcttatagctatttttaaggttacaaagataaatatttttcatctcttatgactgcaaattgtatatcatagttagattgtttctcaatccaggagcaattaaatttgtacattaggtaataagcatttttctgccaaccccatattaagaatacatggtaataaaacaggatgacacagagtaaagtacctgtttctggtgtcagaaacaactgacatattccagctctctattttttgcctgtgttatcttgggcaactttctgagttttaattttcttatctgtgaaatataaacaattaatgaaacgagataatgttaagatctgataaggattagaaacaccaaatgatagcaaagtatgaacaaccttctttcccgcttgggaaacaggtatttcacagttttagaggtttatgtatatatacacatacacacacttactcaacggtttgatatattgagtaaatgtatctgtagctatttactgagttcctgattgccaggctctgttctaggtttctgagatacatgacttaataaaacaaaacctctgtccttgtcgagcttagtattttagaaagtgaatattgtgggttttcctttcatgtcattaatatttattttaaagcattctagcagtattggctgtctatattcttggctcacaatatattcatattcccatgaactaatgggaagaagaaaaaaataggacaggataaaagttagttgtttttcatatgaaaagaggtcttatgactttatttaaaaagacaaacaatataagggaaattgaaaaaatgatgttaacaggtaattcacaaagaactgcagatggtcaataaattcatggaaagctgcccaaacttactagtaattagggaaataataaaagcaaataaaaccatggatactcttttttcctgcataaaattagcagaagggaaaaatgttaataatgcctagtgttgttaaaggtgtggggaatataagcacatttctacacagggatatgaattgtaacttttttggaaagcaatctgtattacctgtaataaaataattaattattataattaaaaattataaacatgtgatcatacccaaggttctgcatttttagtcatctatcttagagagatcaaagtaccaatatataaaagtgtgtcttcaatactgtgtatattattatttgaaatgacaaaaagctaggaataaaaccttagagtttctcaataaagagacatttcaagacaaaagtaccaatatatgaagttttgcccagaaggcataatgttttcatccatgcttgtgagaacaaggactgcaaaacgtcatgaatattcaaccacaacagagtagttcaacaaattgtgatgaactcaaagtacacagcattaggtagatatttcaaagataaactagagttgttaccattgacgtagatgatagatatctgtgatatcttaagtgagaaaagcaagtaggcttgtgatgtgcttgttataatccatttggttttaaatttgaagatactttatgaacatagagaaagaaggggaagaatgtgtatcaaattgtaaatatttatcacttcaatgtggaggttgttgaagggagaagggaaggaacacttgactttcttctgtctgatttatttattttctcattgataaaattatcagaaaggaaaaaacataagaaagttaaaatttcaagctgttaaaaatgttctatttagggtagcattggcatatgtcttacactaaagacagtacagagttctgctggaactctttacattaggtagtagatgtttagtaaatatttcagtcactcattaattgaaatatattgagaattctatagccatgggcttttaatacatacacacacataatctatgatacatttattgtgtattctatgtacttattacatattaattcatatttatgatattttgagggccattacatccacggtacctttatctatacatgattttcctacttactttgcagttttattttcttggtagtgatagtgagccaggcagggatagtaatactccacaataaagtcacctccctctggcctcctcccagattccaaaaatgtgagctaggcaaaacataaagaactttatgcattcattcactgcgttattctaaggtttattgcttgctaagtcttgtgggaggaaaaaatatttattctaagagatttattcaaaggtcttttacctacaaggagtttacacttctgcaggttataaacatgtcaacaattctttggcacttaatttttattcttcagcctagattaaggtttttttacatacttatcaactactacacaaaaatcaaaacccctccattcttaacttttaaatacgtcctcagtaaaggagacaagaccagaaattatttcacagaagatatttacaaaaattatagccaagacataggagacaatttagatatgctacactataaaaatggctaccatgggtattttgcttgttggatcccagtatatttggtctttattttagtttaacaggtctcacataaagtcatctactaaaaacacttccattctttaagtccagaattctaagtagaaaaagaaagcattctgattgattcacagaaatctctgtgaaagtattgccttttattatatttatatataaatatgttttatatatttgtagtgtatctatatactcatatgtgagaaatatgataccagaaaagctactatgaattattttacctatacattagttgttggtatattatgcatttttaatttgtgagtatatttgggtagcattattatattcctggcagggcttgagctttttttttttttttaatctccagggattcttcctattttctaattcagttcgttgttcttggtttattgtgaacaaggaaagcaaataatcaagctggctgaattatgtttaaaataagtatgaataaacccagaaggaggacctgcagtattctatgtgtaaaacacatgggattagtgggaaaaaaatgtgtgaaatattttgactgtttgaaagattaaaaaaaaaaaagtatcgtttggtttacttactagttcacagccacgttttgaagagttaaagttgtcagatggtttgcttctggatgcatgacatacataggagagtaatatctccttgagtttattaacatgctacaattcatgagactttttccccacatacctgtttgttacgcagtattaatgatgacatggtatatttacatttaatttatatagacaaaaatgcttcattgttgaactcatatttgttaaaatgaaaggaaagaaaaaaaaacaaaactgagacttcaatttcatgtattttaaggtaccaaagcattcaatctttaagtaataagaattacagtaagaccctacagcatagcaaattccacaggcagtttattgaaatacattcaattatctgaaacttctgtagtccttagaaggcactgtgagaatcagaggtgcattagctgcagtttcagtcagacctgagtttgaatcattgctcttttattaggttctctaaaatgagttatctaaggctgaacctcagattctatgtctgtaaaatgggatttaagtactgtacttctaagtttgttatgaggaataaatgatccttgtcaagtacctctagcctaggcctagggcttgttcctgtcagtaactggtggtttcgtgcttagttatcatatgccaaaattgtgtgtaatgagttactactacaaaggccaaagcttgaccctggctgtaagaatgcatttttcaaaatcattaaaaaaaattctcattagaggataaaagaacaaatactgagagaatcctaaagaatctacgtcttcttgttgtgactgattctcaagcaaaggaaaaggaattttaaataaaggatttctgttggatttctagccttatagaagaaacattttccaaaatgctgatatgttttaatttaatgatgtgctatttggggtccattttttgtacattcatcatgattctaaaactgagtttggatgaaaagcatgtagtgcttgccttgttcttacatcagaagaattttttcttttgtccattttatgcttgtttccaaaggcttaaaatgaaagctttgtttctgcaataatggcttagtgtaggcttacattgttgatcccctcagtagatgcaatgtaatccactttggtaatgtgaatttttaaacaatcatcggcctctgccattaacccttctctgctaatgataatactctacaaaaactacaaagaagctcgggcctagcttaacattagacttggagcgcacttagctgaatttgcatttcttattttagcagcagtgaattgctgagcatatgttgaacttcatcaataccaaaagtagaataggtgattgtgaaactaatgttcaagtgcaagcattcaaacacaaacacgggaaactagaagaaaataatgatgaaacgaattaaaagtgctttccagtccaaaattccccttgaaggggcttcggctgctgttgctttttgcaatattttttaacttgacctgttgctttgcctagttcattgtagtgcaaatgtctcaaataaagctgtacatgagtcatttttttttccttctcagttcaggctacttggataatagctcactttgaacacaagcatgggaacctattgaatgtttcctgcataaagcctacagagctttgctcagtaacttgacatgtttctttaggagagagaaatggtaaattagctaagagtgattttattccatgacttatttccgaactaactttgagaacacatttccacttagtgtttggattccactctggggacttagaactaaggcttcttacgtatggttaagtaatatatatggtggacgactaagttaagatgttccttagagacttatagacatttaaagctttacctaaagtagagaggactttactgcaactcctattgaagctgcagtactgtatgccttcagggctgtggatttaataaacaaaagatctgtcaccaagcttggttcacagtagggggtagatgtaattatatactttaaaggggaaaagactgttgttattattttacatttattgagtgccaacattttgcaatgtgctgtacctaacatagaattagatacagtccttgcccagtggactatctatttaaattagacacaatctaaatatttctcttaagtagttcctgtgttttcaaatttgttacccagtgcattgtatgagtgtacaaaagtattattgtacttgcaaatgttatttaaaagtataaagacttttaaagacaggtggtgaaataagatgtgattattagactataaaatcgcccatgtttttcaggtctcttcctttaacaattattataaaactaaatttgaaatgaaaagcaggaaaaatattaaatttagaaaatgatggatgcatcatattgatttttactttgaaaaaaatggcagtgtaacaataatagcacttgtttcttgcttaactaggtttggaattatatttatttgtgtggcttttaagtaattccagtatggaattccacaagggtcaagatcacattttctagaagagtacattgcacctaataggcattcagtaaaaactgttaaaggaatgaatgaaatgagtttgcaaatatatttccatcttagttatcgttttctcaggactcttctgattttagagtcagaggaggcagtgctggactggctttgggccagcactaaaaaacaaaacaaaaaaaaaacaaaaaccataacatccccaaaccaaaacaccttcctgggagtatctttgaatagccctggtttggaatgcattctttctaataaagatgtttcttgtctctcagcaagaaaaagcatgactacccagcagatctccgacgcccgtgagagtccttagagctgtcctgatcctcatcagtgatcaaaggatcttttcacactggattcctggtttccagggatgtagtcactgtacagtgtagtcagtttactggtctggtgtgtagtcacacacaattcttaccatctctattataagtcaggctgatattaggggaaaatctacagataaacatgaagaagaatctataagttggtatatttatgtatgtgtcctggatattgtgactattttataccaactgctatattcccagccccaacattctcattcagtttcttcttggtcttaacagcgcacgtcagttcccagttgcatgactatagctattcatttagcagacagaaacaaggatccttggtgtcatggtggaatcactcagctttcagtttgactctctggactcccatttacactgtgttatctaagttattcaacttattctgagccccagcctccttagatgtaaaatgcaggaaacaattgtactgaacttgtcttctgtttgcttatcacatactcactgttctccctgcctcttgtctaagattgtgttccagaaatgcatttgtcatgttctcgtcactgaatctgatagtctcttcagccacttccctttccttatccccactactccctttactcatccctgttttgtcacttaatggaaggattttcctggacagttttaagctcctttcactctcccctcctccttcactaatatcacaaaggggttaagtgttaactattacatttttgtacaggatgtacagatctgcatagcccactccaacttctatctcaagctttacgcctttcatctccaactctgtgctagaaaggttcatccttctgtttttgagacaactccatcaaacacataaaagctaaatttaggccaggtgcagtggcccatgcctgtaatcccagcactttgggaggttgaggcaagcagatcacttgaggccaggaattcaagaccagcctggccaacgtggtgaaatcctgtctctgctaaaaattagccagatgtggtggtgtgcacctgtaatccagctacttgaaagggaggcggaggttgtagtgagactagattgcgccactgcactgtagcctgggcgacagagcaagactctgtctcaaaaaacaaaacaaaacaaaacaaaaaaaactaaagctaaatttaccagctctcctccaaaccaatgtcttctcttgcttttgctgtttctgttaatgatcccaaatttctccaaagaagcccaggctacacatcactcagtcattggatagtcaattgccaaaattctgcagattttcccaccacactatctttcgtatttgccacttctcttgtttcctctgtggctggccctcactaacgcttggctcccctgctagcaggaaaatcttcaggggctacaccatttctaagtcttaagtaaaaataggagtatatgagtaaagaaggagccataaaattcaagctggtgtgtaggaccccagtgactagcttctgacccagtggccaagagacctaaacacataaaggtcacttcctgactctagagctcaatgaggctgcagaaatgagatgcctttctgagagaatccaggagaagtactgtgtaatactggttcactgcattggaaccatgcgggaaaattcataaagcatgaaatgcgtgggagcaaatgcctctttgtgttcctagttagtgccactttacgttagaccttaccgcctcatgcccagattttttctattagtcactttcattttgcattctctctccctacaaattatctgccagaatcatttttattcaaatctgattcctaaactcatgtttaaactttatcagtggcttgatccatctgaagggacagtggttctcaagtgtggctttgggaccggtagtgtgaacatcatctgggaattgttagaaatgcagactctctggcccagaccagatctgctaaataagaatctggaggggtggggtcctccagttaattctgaggcactaacaactcgttgaaagccagtgctttagctaagatagttataaacatagctgggctttcagcatcctactcagtacaggccagccagattccagacttgtatttcctgctttcctctatcaccagaacctccatttcatatgtgaacctccaaatctcagacaggtttcagtcaatttaagaagtgtattttgccaaagttaactacatgcacccatgacacaacttcaggagattctgatgacatgtgcccaaggtggttggagcacagcttggctttagacattttagggagacatgagacatcagtcaacacatgtaagatgaacattgattcggtccagaaacgcaggacaacttgaagtagaagagggacaactcgaagtggggaggggtcatcaaggtcataggtagataagagacaaatggttgtcttgaggcccccaaatttattttcctttcactcataatttagccctttgtgaatgcaggctcctctgtgcttatcaggtttttcataattttgagtttttttcttttgcttctttagtccagccattttttcaagtctgtgtttatgcctcacttccatgaatctcttctgaagtgaaatcctatagtatttatacaatagcaatactatttaagagtggtcatgcattattccctttgatcattatactttatgtcttatgccccaaaataagctctagggaaagaaagtcagtgtctctgccccattttaattccccgcagtgtctagcacaggacttctttataggtttcggtgatgaatttcaggactacagagactaatggtattgaacactctgggctctttattactccatgtcaatacaacttcaccttctaaccaccagctcttagggacactgtttgtaaaaggagtcttctacatcagtggattagttgagtaccattttaaaaatgcttcagagtttgcaaagtactttcatagaaatatgtcattagatcctcatcacaaccctgtcataaaagtgtttttattatctccattttgcagacaaaggaactaaaaccggtcatgtttaaaagtactgctgtctgtgtgagagtggaaagactatggaggttagagcaggaatctcctatctaggcaaagatagtaaaaatttcagttccttttgtaaataatttcagctaaaaaatgtattgtaaccttggatatgcagggtatttattcgtatcaagactctgatatcttgctttccaggcaaaagtaaaaccaaccttttcagttaactgtagttgaagagaaaagagtggattctgtctttggatgaggatattaacatttaaaggattggaaacaatgatcagaataaatgtttatatgtgcacacatgtatacttacaattaatggcagagctttaaattgaattgaaatcaatttattgaatgaatcatattcaaaatactttataagaaattttatcattaaggcaaatacacatggatatcagtctaaatctgatcttttttttttcccctgagattttccacaagggaagtggaggaagaaaacagtagaatataacatatacaataccggcctccagccacagtgctacttcccttaaccgtctaaggaaaataaatatatattatgttccagttcagttatctgtagcctgtagttagagatagaaaacatatcagattgggcagagtctaagattggctggcataggaaaaaacagaaacttgtataagctaaatcaagttatgtcactcgaactaccataaaatagtttgtttctgatttttcctctttaattatccccatgtgccttgcacagtatattgcatatagaatgtgttcagtttgtacttacaaaattatttgatgtatacctaaaacaatattttaaatttggaagttcataacatgatcctgaaggcactttggacaatttttgattaatgacaactaaaacttttcaaggcagaccactaaacacttaaaagcggggaagaaacaataagattgtgaacacttgcggggtaaaatcaaaaagcaagtcaagagcataggggtggcgaaacagagcttgctgaagggtaaggctagccagtcatcacagcacgagcaaaccagactgaggactgaatcatgtgacacttgagatccttgcgatagagtctttggagcctgggcatgacacaaccagcttgctatgttgacaaccccagtgcattgagacaatgtattggtgaggtgctgatgttgtattggtgaggtgctgatgttgtattggtgaggtgctgatgttgtattggtgaggtgctgatgttgtattggtgaggtgctgctcaccccgaccaggccatttccctgctctctttgccattggtgttaaagcagaggaagtgattatagagatatccttttaaaattcttccttaaagtaacggaatgatgtaaccaaagggcagaaacctgcaagtcccaaatcattcctgaaaatggaatcaggaattgaaaagacatgggaaagagatctgttgtacagcgtgatgactatagttgatgacaataaataattttcttgaaaaatgcaaagacggtggatattgcattctcatcacagaataactatgtgatgtagttcgtgcttttgttaactagctaaatttaaccattccataatatatatacttcaaaacatcatgttgtaaatgataaacatatgcagtcttatacaaaggacacaaaggaactgttgaagctggtgaatatgttcactactttgattgtggtgatggtaaacacagatgtatgcatatgtccaaattccccaaatgtgcatcagattggtgcaaaagtgccacttttaatggcaaaaactgcaattatttttgcatcacctaatacgttaattatattttgctttttggtctagttttcaactatatcttaataaagctggaaaagaaaagccataggaagtcaggcaggctttttctcaccctcagctcctcttcctccttctctccctttcctttttgctttctcttttcttcctctccctcctaagctctttttccctcctactttctcacccctctaaccctgtccttcctctgcttttttctaccctcatcttatctttcgccatatacaaaatcaagcaatggtggaagatggctttcaaactgctctcaagttgatcttacttctgctcaagggaacagcctaaacccagtaagaatactcagaaaaatgttcttggagaaaaatatctctgggacagctttagtttggtgaccaactctgagccactcacctgtggccaatggcaagattagtagtaaatgcaaactcaccacaacatgttgtagaaggtcaggggtagggtgggggtggggggtgggaataatcttaaaaaaaaaaaaaaagaatagaaagtagaaaaagcctaggcttaataaatgccctggaaaatacctgcaacattaacaagtgccttagaaaatacctacaccattcattcttatattcttacaaatttttacatcagattaccaaaagagagcatacctaacgcatgtacttattttaaagcactgcttttatataagtatgataaaatattttgccctaacttcatcaaagtttgttttcagaaacagccctatctagaacatttgaattttgtttttgctagaaaggacaccattccttcatcatactgtttggtatctttcatataaatctcaaaacaataaatacctctctgagttcaaagctaggaaagaaaaactcttgatgagctattgtttctttttttatagttgaccataattttatacatgcaatgtgaccaataaatatttgctttgtggtggaatacagtgatgaaagaaatatactttatttagccctttctctggcagccaaaaatttagtgcttggttttgtgttaaatggcagtggcttttcttagttaagtgtttctagtatattcttgttcaccccgatttactattttaatgctcttttatgattttactctgtctgtgcccttaaaaaatctgttttggaagatgctggagtataaatagcatagaaagtgaactgcatattctgacatttacagttctaaggataattctattttaaggatgattctgtctgcaagtaaagttattagctatctatatactatatgttttagacaaattttgattgtcatataccttttctcagactctatctactgtgtcttgtttattgttgttgttgtttttcttcccataaaaccatgtctcttttacacaagaatgtgtaatgactcagtctgacttagtttattattaaactgatgtttcaaagggcatttgattcttctgaacccttccataggccctaaattttcttaattgtaccaaatcccatatggatttctataccccagaaagtatggctacccgtcttgctcatttccaactttgtgcttttattttttctggttcttgttgcatgtgcttgcattttttccttgggttttcaactactccacttctgccttgtctttcaaagcctggcttaagactaacctcttttagtaagacttacttaatgaactctaagtgactcttattctgagtcttcttggaattatctactcagtttttgttctattaatttgcccttatttgtttgacatgttgaaagcattctgaaacctttttttttttttttttttttttaagtacatgaatgagttctggctccagttagaaaatttgataattgtttcttagaatgtgtcttcttttcctttttttattttccccaaaccacagagtttaatgtgctcattaaataatattggctccctaattcttagaaagcatagaatattgattatgtttgtcatagcaaacattttattaggaaataacaagataattatttttgtaaaatttaaatttcatcttaaaacggtgaaactcatttttgttgtagttatacattaaagcatcccaaacagtaggtttctaagccagtttctttgttttccctcctattattcatattctttccagattgaggcatatggctttaattatcaagtatatgctgaggatatgcagagctacagcttttttcctgacttttctaatgaagccagttcctaacagcaacatttgccagaatattttgttgtattatgacattaaacatgggccagcagaggtctggctaattgagaatgatacctttccccttccaactgcttatttactttccacgaagctaatttagttcagttataaaatcaaacctcataatacagtgtaaatgagtttgttcacataatatcaattgctaggatggggaaaatcctaaaaataaataaacaaaaattccaaaaaagttattttagaaaaattaataaatgcagctttgttgcttttatttactacctgcaagactggaaatgacatagagtaattgtttttcttccttcttttaataattggcaagcattatttgtaattagtgggtaaattgcttataggcaaagacttgctaaagagctttaaaatcataattttatttcatttcactggaaaatagaattatttcttatgtgaagtgataaaatgttttaaacttttataaccaaattaagtaataaatattatagatatattttatacttacgatgtatgaaaacttgaagccatgtgcacttgccaccactgcccattccattaattatcatcatccatctcctttgaattatgggactctgatttctgtcaaagcagaacctgtgttgcctatttcatacatgttggaaatctaaatgttgtttgcaaatttggacttttgaattttgctctaatggctgcatactaattttatgaacaatgccaatgactatatggaacatgatgcctttggcttttagagcatattctacatcaataagttacgcaatgggagagtcaacaggactcctgagaatgcagtggccatcaaagtgtgttttagggaacgtaagagtttcttagaactaccctacaaggtttctgggagaagaagaaggttattggtcaagttagaatgtccatttcagttctttgaatgtttttaaacaaaatgcagattcaaattgtaagtaaattttgaataccactgagttcaaaagcttctttcgtagataagaaattattcaaacaagtaatttgatgaatgacacataggaatattttgctaaggcttgaatttgaaccagtactataaattcttagaggatttatctttcattgcaagttgaataaaattcgctccataaagatgtggaatctattttgatattttaatgttaaacaaataattagtttttgaatttaaaaggtggaaaagtaccaaactcctaaaatttgctataaggttcaaaaatgttagttaatgtactccatattgtgtttgtagattttctaatttgtagtctttatctagctctaattgccagttttgctgcaataaaaacaatagaataagaggtttacaatttgaaaaaaaaaattatatttgaaaattgagtttgggtatgtgggacttcaagaaaaatatttttaaaacgttattagattttacttatgtcctaagcactccactgtatattgtggatttaaaaatggagtcaaataaggactccacaattaaagaattcagaattcaacagaagtgacaatctaaatataaactgtggtatgatggtgatgctattgtaatggataagtgactttgagctgggccttgaactgaaaatgagaatgttccaaaataaatgtgtgtatgtacatgtgtgcacacatgtgcacatgtctgtgtgtctgcatgtgggagcgtggaaagtggggagagaagagaaaggcagaagaatgacagagagacagagatattaattcatggtgatgttaatcaagttatggaagctggagaataggacagaatatggggacatttgtgtcacagatatcttcagctaacgaatgtccactagatagaagatagcttagcattcaggcaagtagttaaggctggggatagttacctgtttattcattcattcactatatattatagggtattaactgtgcctcaggcattgtaataggaacaatattagggaaggaaatacgtagatgaaatgacatggactatttctccaggaaatttacagtccatcaaggagacaaatataaataaacattataacttaattattataataagatgattatattagaataattagatgaaataagatgtataattaaaatatatgatttataatcatgttagaataactttaatttttataattctaaatacctcattcttattaaataaggagaattgttttaccacaggtgtttgttgagagtgtttattccataagagaagatcaatgtatgtatactatctagaagtcttcacaaagaaggtagcatttgtgtaaggattgacagatgatgttggaagtcactgctagcatactagtaaaatcataggactagagtctatttaaatataccagttaagcatatatttggattggaaagtggattttgctcacatctctcaaagttaggctttgaatccttgatagcaaatgcccctctgggtaacagtctaagctgatttgatcatacatgtccatgatgtttgatgttttcatggcactgaaaataatcagacaggttctaataatttgctgaggaataatatgctagcatcataaccagcctcaccagttgatgatagtttttcattgtatctcaaccatcctgagaagtaccatgggctagttttctgaggcctttttctgctctcatgagggttttcttgacctgcgtgctcttttcatggcttttccaaattctttggctatcctaattttatcattttttattttcttctttgcctcttttatttcctttttctttaggttttcattccattttcttattgttttcccatgtaaaccttacaccatagcactgtattacatactttctcattttacacttcccttaccacaaatttggcagtgttgattgtgcaaatctagctgaatgatcaatttattctgtggttttttttctttatcaactggtatgtagatttttcttttcaactagtttagaataaatcaatattccaggaggcaacatggctcaaattagaaggtcccaccaaactcctttcctgcatataacttattgttggtttaagatctccaaacaccactgaaatcttaaatgtaactgtgcaaagtatgaaataaaagtagtgtattaggtgataatgatgtggtcggtgttagactagcactattgtgaattactcctcactataacacaacatcagttttggattttgaaaaattagttatttttcatttgagtggtatcttagaagtttagagagttataacttatgattcatagcatgtttgcaaggaaaaatgaattaatagttttaaagcatttggaaagcatgaagtgtcaaatacataataattacatactctcagaagatagatatttatgtttgttagcatatacacaccaattctaatttctcacagttggttttgtggattctttgatttgggaatggtattttttttcctatttccagaaaattgacaacatggggggaacatggatagtattaattcataccacaagtaaatcatttagaatttaagtgtcaagtcatggtcttacagagttagaaaaatcttgcagatcatatacttcattacttgttaaggaaagagacatcctaatatatagataaattcattaagtggcttagccaaaactggttcccatgcttatgttaaaattgggtctttaattgcagttctcttcaaagtaagcctgtaagaaagtcagaaaataaaccaacagacaaatattccgtagacaactaaatttccgtatctaacaaaactcagctttttattgaggaaggacacatgactgtgttgtaaagtgattctgcaaatttgccaaaagcattagaggaaatgtcctgttgttatgcagtctcttttatgatactagacatgcctttttgaattttcagtaaatttcataaagatttctatgaattcacataggaaaaaacagagaaataaattatgatggcataggaaaatattgatgctatctggaggtaaaagaaatttacatcagaaaaacacatttccaatacattttccaattattgctatgaagtgatattcgtttacaaaagaagtgttattgattgatcttcaggagtaaactagtgcaacagtctataagaatgttgcattctccctgagaaaaggaaattttgtgtccatattgttactataattttcaaaatctattttgctaaatacatttgttttcaaatagtaattacagataattatagctaacatttctttaatactgtgatgtcagtcactgtactaagggattttcatgagtttgctcactaatattttcttacatcaatctttgccactagattttttaaataagagctttcttgaagtataattcaaatgccataaaattcagccttttagagtatgtaactcggtggttttattatattcatagagttgtgtaaccatcaccccatctcacttttgaatatttgcattatctaacaaaagaatcccagtacccattgccagtcactttttactcttctgactcctcctggcaaccattttctgtctccatgtatttgccaattctggatactttatgtcattgaaattgcacaatatgtggccttttgtgaatggcttctttcacttagcaaatattttcaatgttctttcatggtttagcatatattggtaagttattcctttttactgcagaataatatttcattgcatggatatgccttactttgtttatccattcaccagttaatgatcatttgggttgtttcctctttttagctgtcgtgaattatgctgctatgagcagtcatgttgaacttttgtgtagaagcaattgtttccaattctcttgtgtatatacctggaagtgttacttatttcctttccaatctggatgtcatatatatgtgtgtttgtacacacacatacacacacacacccacacttttgcctaattgccctggcaagaacagaacttttagtaaaatgtgcaagtgaagtggagagagcagatacccgtgttttattcctgttctttggggaggactatttttcatagacaccaggatcatgagccagttgatttccaaacctgccctggagctggaaagaggggagtagtaatagacaagttaaaacgaaataaagggccaggtgcggtggctcacgcctgtaatcctagcacttgaggtcaggagttcgagaccagcctggctaatgtggtgaaaccccatctatactaaatacagaaaaattagctgggtgttatggcaggcacctataattccacctatttgggagactgaggcgggagaattgcttgaaacctgagttgcagtgagccaatgttgcgccactgcattccagcctgggcaacaaagtgagactccttctcaaaaaaaaacaaaaacaaaaacaaacttgctgtttttattgatatttagctattttatttgaataaattatcctcagattgttgcatgactgtgattttcagagatctgaaaaagttgattttgataatatttgtcattgcttttcttgagtaaaggacttcaaaatggttcttaccttaccattctggacgtggcataagtttttatgagacatattttaggggcagaaaagggaaaacttagtgtaaagagaggtcttatgtaagtattattttctatttttaaaagaaaggacataatattttctgcagaaatatttcttaacatatattatctcctaattttcttgaaaattttagtatatttaagactatcagtttggagttaccacatgatgtaagtttttttgtgctttagaaattgtccttttatttgcaagaaaaagtagcatatttggaggagaatacccttatacatattgaaatgaaagccgttaagctttatagcgtgcttttagattcttctgggggaaaaaaattcaatggactaataattgactgagacaccttttatgttttattatgtgagctgagaacttggatctgtgctaactttctcgtcatcaacacactgtatttttaaacaatcagtttctttgggtgaaataaatctcaagatagaattcaatttcttactgctaatccagaatatgcccttgaatcattctttaagcactctttttttaaatcattgtatgattatgcatatgtttcacctccttgtttctccctctccctccactgaaaacagattgactttgtagtactctgcaatttgctttgccagtcacattctagcagctgaaaatcatccttgcttactttgttctgaataactctgaaccaggaatttagcttgtttttaaaatctgttaactgacagatgtttctctataggcccctgttgtcacacagaacaaagagaaagatgctttagccagttcaatatgccaagaaactgatttttcactatttggttcaagctttgagccatagacagttcctttattaatttgttttgaaaaataacacaggtcaaggatacgatgttgtattgcttttatttcatgtgtaaaggttgcaattatttaggagaaaacattatgaaaaatggtttcagaagaaactttattagggactagttagaaatgtttgtcaattgcatttgctttggattgttgcctaatagataacaagaaataggtacctactgcaaagattggtgccaattgatgcaattagttatagctttgaagtaattgttcagcaatgttttctaagctcactgtgttctccttgattagtgaatgagagaattcagtaatttgtgtattgtattttccctatgtctctactttagatcatttttaaaatcatcatcccatctctagagagaaaatatggttatccctcgctagagaaattaaatactgagggaaaagattatgttgcactgggttgaactttggaggccacaatcgtggtaatatgtaagacttttgcacccccaagaactgtttgcttcattcgggatgacattgtccctgttgagtatgcatgccttgtattgtctcttttaaaactatgttttaaaagttcatgatttcaaactagacaaatgggattgcatcaaactaagaagatgacacagcaaaggaaacagttaactggaactgaaatccttcttaccctagtatctcaaaacctactttaaaaggttgccaataaagtataatataaaactaatttttaaaattgtttaggagagatatctgcccttaactgggtggttccttttctaattggtatgaactcagttaagacaaattacataatcctacactcagaggtaaatcatttctgttttgtctgcaaaatatcaccttccttgaattcattgtaactccctgaggtaaaaaagtccatgttgaatttatctttatatgtccatgcattcttcttcatactctttgtacctcagtttttcatagtatggagtccaggaattagactgtctgggtttgaatccttgttacacttattactactaatatggcaaatcaattaaaattctagaagcctcagtttcctcatgtgtaaaattaggatgataaaacctcatagaatagaaaggtaatgcatgtgaagtcttgacatagaatccagcacactgaagtaaggcttttcatatgtatagtaattaataaatatgtttcagggatcgaataaataaactcagaatcctctcatgcagtgtcatcaccagttaaataaattaaatactagaactttcatcttagatatatgcaatggtgttctttctgtgtagtcccaaagggctggagagagagcacagtgttaccaaagcccagtgagagttgatgttgaggaatgggggtccctcccaagtcacctgggaatttgggagctacaattcaagatgagatttgaatggggacacagccaaaccatatcagggagcttgagtgattcatctgcagagtcaggattatggtgcacaaatcagggcacagaatggagactggagctgcagggtgaagccaaacagaatcaccggtgtgcatagtcagtgtcagtactctctagttttaaccacagaagttaaatcaatataaagtagaaatgaaatggcatggcttattattcaatgaatgtttgaaatgttacaatgccatataaatgattacctttttgataatatgtgtaaaagaggaccatagttgttattgagcttatattatgtaacagggcgggttaaaaaatatgagttgaaatattggagctgtgtacccttccaaaaaattgttttgaagttggagcacaagatggaaatatttctccttaaaacacaattcaggagtcaaggaaccagcactgggtcatcagatctcaggttggaataatatttgttgtttgtggctgagtgtactggagaggggtgataaaactgctcaagtactcctagtctcaaagcaaagtagatttgagtatttaaatggggctataaccatcagatggaaaaatcagagaaatattactgtctaaggactcataggccatagtcatggtaataccattaataataatatacaattaataataataactaccatttatgggggactacatacatgcccaacatgatggtatacctttaggtaattttataacaatgtgctgccaatgacaactgatagatgtagagaggtagaaaactgagtttagccgaccaacatgttattcttgttgtatctaggatagggattttcatgacaaaaacctaccaagttatattccaggtgtgtagggtgatacagtgtaactttccattccatgatgacattctaggatatcaaagtgggcacatagcccaagcaccttcatcaaagtaacacagtctttgtgttgcgtttctagccacctcttctcccaggagaagcctccccaaatttccattttaatgagctgaaattagtttttcctttaatatgtgaagacacacaataacaaagacttgcaaccaacccaaatgtccatcagtgatagactggattaagaaaatgtggcacatatacaccatggaatactttgtagccataaaaaaggatgagttcatgtcctttgtagggacatggatgaagctggaaaccatcattgtgagcaaactatcgcaagaacagaaaacctaacactgcttgttcttactcataggtgggaattgaacaatgagaacacttggacacaggatgggaaacatcacacactggggcctctcatggagttgggggaggggagagggatagcattaatagaaatacctaatgtagatgatgagttaatgggtgcagcacaccaacatggcacatgtatacatatgtaacaaacctgcacgttgtgcacatctaccctagaacttaaagtataataaagaaaaaaaagaaaaaaaactgaaatatgaagacacagagtatacagtgaaggcatagacacaactgagcaccagtttgcacatgttccaagtgtgaggggctgcctgcagcccatgaacttttcagtcacttactttcctccccagtcattaccatggtcatttgaaccgcatttgcaacattttaattttaaaaatgttgacaccatgtgggaattccacatgattttctaaacatttttagtgcctgataaaatttttgtttggatttggctcctgagaatacagctaagaattttatacttttcttcaggggtccaattgcttcctattcctcttataagagttttcagagtattttattagaattcttttagtaaactactgcaataggaagtagttacatatttttatcactttttagcaaaggctaggttaagtagtgtattagtctgttttcactctgctgataaagacatacccgagactaggtaatttatacaggaaaaagggtttaatggacttacagttccccgtggctgggaaggcctcacaatcatggcggaaggcaaggaggagcaagtgacatcttacatggatggcagcaggcaaagagaaagcttgtgtggggaaactccaccttatgaagccatcagatgtcatgagatgtattcactatcacaagaacagcacaggaaggacctgcccccgtgattcaattacctcccactgggtgcctcccagtgggatacccagcacagtcagtccttaccacataaagacctgcccccatgattcaattacctcccacaacatgtgggaatttaagatgagatttgatggggacacagccaaaccatatcaaatagcaaagagcttaagtaattgacactggatgaactaggtagataattatagagtcaggactgaaacttagataacttgacatttaattcaattgtctctctagactagcttagtactaaaaggcaatactgacactccacataaactaagccaaaattgggccactaaatagtttcaggctcacatatacatactgagtaagaagcacagaggttgatctcaacatgtagcagatggcttctatattcttaagggataaaactttgagatttttcttttgctccttgtgtgttaagaagaaccaaaacactttagaggtcccagtcaatttgtgttttaaaagaaaaaaaaaatgatgccactaaatacgccagatttttcagtggaaaaaaccctaagttcacagcaattgcttgaaagctgctttaaaaattagttgtaaatccaaggaaaaggaaggaaacctgaaaaatgtcactcatttgaaaagggatgttcatttttgataaattattaggtaatttttcaaggatatcactcacaagtaaagatttttttggtatatttaaatgattcattttcagtctctcatacatttttaaattgttctcattcaagttgtcacatcctgacagggtttcttataaggatttctcttcccttgtgttagaattacagaggatgaaagtattttaaaatctctgttgctgaacagggacatgtgctaggcagcctacaattgtcagttttattccataggtacgttagtggtcagaatgacttcttttttgatggcacaattattttcataatattagattgaattaagctggtgagacaatctgtccctaaaagattcagaaaatgacgctttgatgttagctttgaagcagggtattcccagcatcacatttagtcagaaatatggaaggtatatgttaacatgatttacatatcctactctggtggagtctaaaggtaaataacagaaataagcaaggagctatgcagcaaggcaaattcacctttgtttcttgacacaaacagtgaagcttattttgggaataatgactgcatatgttcaggaaaattgggctcatgagtctactgtcagaacatttttcagaaaagagaaaaatgaatgtactgctgggagacagcagggaggggttcttttattatatacacaatctcttcttatgagaacaaataccaacaatctattattgttcccttaattaataaatcattactgtgggctgggcagagtggttcatgccaggaatcccaccactttgggaggcccaggcaggaggatcgcttgagtccaggaggagtttgagatcagcctgggaaacagagagagatcccatctcaacaaaaataaataaaaattaggtaggcatggtggcgtgtgcctgtagtcctagctgcttggaaagctgaggcaggaggattgcttgagccaaggaatttgagcttatggtgaggtatgatctcactgctgtattccagcctgcatgataaagtgagacactctcaaaaaaaaaaaaaaaaaaaaaagaaagacattgtaatgattaaatatttagaaaaaaatcacatacactgtacattctgtatggattacaattatttctagtattgaaaaggtaataaccaactctttaacatgataatataactgaacctgatttaatttgtttttttctttggataagggagtggaggattacaatttctcagtggtctacttggtcacatatatttgttaaaagccattgtatgactgaaacaatcttagtgccggggtgtacacagtaattgaacacactccctgctttccagatactcagaatttaatttcaagaaaggcacagcaacaagaatttcaggagcaaaagggtatggtactaataacgcttgggctgtttggaggaatcttcagaggaaatggttaaagagactcttagcaaatgaatttctatgtgattttcatgtggactctagggcaaaggacattcccagaagggatggcaacaagcacaagtttgaagtgtatgaaatggcattactctttctaggtagcacaagggattagatgtggctgaagcatagattgttttgaagacattaacaagatctaagtttctaatctaaagacaggccatgttgtgatcatgaaatggcctgtagactctcctatggtcttggatttctatcctgaagaccccaagtcattgaaagaaagggaaagcagtgtgatttaaaaaaaaaagaaaaaaatctaattgagtttcagaaacaccattctggtttttaccacattgtatatcatcgtatgtctttgtagtatggtacctgacacattgtcaaattaatctaaggatcattctaattgcctttaagtatagtaatttgttcatagttcattactaatcccctccatctataatctgaatacctttcccatcaatcttgccttctccaaaactttcttttctcctttattctctttctctttttaaaatttttaaatttgctttctgttttaaatttatgtgggaacgtagtaggtgtatatttttatggggaacatgagatgttttgatacaggcatgaaatgtgaaataaggacatgttggagaatggggtatccatcccctcaaggattcattctttgagttactaccctttctttctcttaatctaagtgtttcccttctgtactaccttctttatttaatattcttctaacccttgggaagagaaggagaaataataaccacaaaaacaaaatcaaaaatccctggacatattaatttatgtgtgaccattcttcatttatgtattataatccttttaaaccaagggagtatctgtatcttgttcattcattaaatatttattaaaaaccttgtagtgctacttctcttctggatgtttaggacatattaataaacaaaatgatccatgatacctgccctcatagagtttaatttatggccagaagagatagacaaaaacagtaacataataaatattttttataataaatatatattttttgagatggagtctcgctctgtcccccgggctggagtgcagcggcgagatctcagtccactgcgagctccgccttccaggttcatgccattctcctgcctcagcctcctgagtagctgggactacaggtgcccgccactagacccggctaattttttgtattttttggtagagatggggtttcattctattagccaggatggtcttgatctcctgacctcgtgatcggcctgcctcggcctcccagagtgctgggattacaggcgtgagccaccgtgcccggccaataaattttgtaatatattagaacacgttaagttctatgggaagaaaaaagaaagacggaatgaggagggtagggatggttggtttcaatttcaaatagatagctagataagccttactaagaaggtaagatgaacaaatacagagagatacagatgcctggggatggactaaaaagacagccagtgtagggccttcaaaacaagttgccactagtaccccaaatgctgaggaccttgcactttgtaggagtatttgaaagtatattgaaataaagagcaaggggtcactggccttctgctcagacgcatagactttagcaaaggagagctgaaggaattgtgttccccttcagtacccatggagaatgtgtcctctgttgtgtaagaaagaattggatgagatattatactgagtcaatgtttgtaccataacaccttatttttccttagacagacagtaaagcaaccactaagggtgcttaggcagccccacttactgttttgtttactgtaacttttagtgttcaccaaacacatcttcaagggcattttaaatagacttgttttcaaatagagtgaaagaaaatttccgcaagacatttgtcattccttatttccacacgaaccaggagcagcaggagtgagtggagaaatccatctgcgagttaatctagtggaacaccactgagtctgatcatttgacagaagtaattgtatctaggggaagtattcaggtctctgctttgtggtaaacatcctgccctcctaaaactgtgaggttgaaaaagatcaacaaaacagccatttaacgcattattgacagatacaagttttagagaattaatcactattaactaactgtattacatactcacacttaatactagaaataattatagcttctttaggtatgaagtagatttgtgtctttacttctaattctctaatcattcatgaatttgctgaatttagattctgtttcagttaatgtttgtcaaataggatgttataattttcgcatgaaattgcatttttgtctacatggttaacttcctagagtttgttcttttctggtagtcaaaatctatgatgaatttattaataatgatattagggtaaaaaagtcattgaacatattttgtgttcagttcagtgagttgaattcagttgctagatttctttgtataactgggcagattaggacataatttttagaaagtgtaccatttattattactagttaattaatcacatttctaggaaattagtgatttcctttaagtttatattccactgtgggataaaataaaattaacatctgtttagcattgtatgccaagtatggttgatgatgcagatttcatggatgattttactaatagacacattaaaataataaaaataaaagtaaattttctaataattccagacaatatattgataaatactaaaatggaaaaatgaattatagtgttgtttatttgagtgttgatatctgggataatcaaaacccatcatatatgctaacagggttttaccacatcatttttcccatacagaatctcacatagctttacatttgagaagaggtggaatttgactcacgctatttctaaatctgacttttatatcataataaagtattacctaggatagaacttttagcataaatctaattaatctatgatttagaatctagatttgaatatgctactttaaaataaaaatattgatttatttattccttttttaacctcttaaaatagatatcttatagttatttgatttgattctgccattcatcgactatcgcactttttttttttttttttttttttttgcacaaatacacgttctaatgtcggtccatgtgctggagatacaggcataagcaacagcagggttgactagctgtggatagtggtacatgattagaagcctaaatgtgtaagtcaggaaactaataaatcctgcctgccttgcctgccttttcttccttcattttctttcttttctttctttttttctttcattctttcttttttccattatttttgatgcattatacttgtacatattttgagatacatctgaaattttgttacatgcatagaatgtacaataatcaattcagggtgtttagggtatccatcaccctgaagagagggtgttcctctcttctagctattttaaaagtacagtacactgttgttagctactaacacttatactcttctatcaaaggttaggatttattccatctatctaattgtatgtttgtacccattaaccagcctctctcttcatcccccaatccactcatacacccttcccagtctctgatatctatcattccactctccattacttcgtggggtcaacatttttagctcccacatataaatgagaacatgtagtattttctttatccctggcttatttcacttgacgtaatgatctccatttttattttattttatccatgttgctgcaaatgacatgatttcattttttatggccaaatagtattccattgtgtatgtatacgcaatttatcctttcataaccctgtattgctgataatcacttagatcttcataaaacttttttttttcttgagattaagtctcactctgtcacccaggctggagggcaccgacagcatcacggctcacagcaccctcaacctcctgggcttaagcagtctttccatttcagcctcctgagtagctagggctacaggcatgtgccactgtgctaagctaatttttatatttatttttttgtagagacaagatctcactatgttgctcaggctggtctgaaactcctaggctcaagctaccctccctctccagcctcccaaagtgttgggattataggcatgagtccttaaaactaaaaaaaaaaaaaaaaaaaattgacattcattcagtaatctattattattattagtattatttttttgagatggagtctcgctctgttgtcaggctggagtgcagtgtcatgatctcacctcactgtaacctccgcctcctgggttcaagcaattctcctgcctcagccgctccagtaactgggactacagatgtgcaccaccacacccggctaatgttttgtattttggtagagatgaggtttcaccatgttggccaggatggtctcgatctcctgaccttgtgatccactcacctcggactcccaaagtgtgggattacaggcgtgagccaccgcgcccggccacaaagtatccttttaaatatagttgaaaccacaaagggaaatgtggtgtttttgctaccgtggcttacaatccaggagagtagacagacacctgatgagacagatacccctctgataaagttgacaatgatgtaagtgctataaagagaaaatgagtttctctgggattggggaagtgagaattcattttgattagagcaatttgggaagaattcttggagaaatttttttaggtattatacacgatttcatggtcttctccaagattttgatatttctctcggtctctctctttcattctctctgtctttctgcctgcattgaaacactgctagcaaaaattttgatgttgccagggcatataaggctttaaatgaaaggaatagccatctgttgtgactgactgaggcagggagagtggatatgtagtcaatattttctctttcctttccttttacttccaaagtcttcacacatgatttgtatcctttttctgtctccctcattgatatcctggaatcttttgctctgtccattctagtgaactgctttgtgaatggtcactgttgaacttgacttagtcaaatataagaacttctaatcatactaatcccctttaacctctgtgggttaagagatactactgataaccctagcttctgaaaatcattttctcatgagagtttctttctgttattttttctgcacttttcttttgtttaaatatgaaagatatttttctcctctaatgcatttttggaagagaacatgcttaattttaaattctgtagtgcttaccttgccacgtgtatgtatgtaatagaagctctataaagatactgagattaattttgggagtgattatattggtcatacccaccattaattattgatagtaaaatacataagttatgtggatagaattaaactaatatttttgtgaaataatacaaatatctatgttttaaatcaaattaaatttgattttaagtttgcatcctatgaggcaggtaagaaattaaatctcaatcattatggcacacctccccaaaaataaaatcctgtgagaatagaggatattgggtagtactcagaaaataatggcaggtcttctctctttagtctgtcttggtctgtgctgatatatttttatccacatctccttgaaaacctgtagctctttggctttgtgcctcaattagagcacaggaacttttgccaaggttgggagcttgaatgtccaggtccagcatcctattgcacacttttccctgcagaaaccctgctattcactaatggtactttaaaaatctggctctttcctggtctggaatacttatttcttttttttttccttttttctttttctttttcttttttccttttttcttttttctttttttttgagatagagtctcactttgtcacccaggctggagtgcagtggcgtgatcttggctcacggcaacctccacctcccgggatcaagcaattctcctgcctcagcttcctgagtagctgggactacaggcacacaccaccatgcccggctaatttttgtatttttagtagagatggggattcaccatgttggccagaatggtctcgatctcctgacctcatgatccacccacctcggcctcccaaagtgctgggattacaggcgtgagcacccacgtctggcctgaaatacttatttctatgtgactcttcttgatcccctttctcctatcttcatggagccagtttcctgaaaagaagtaccttgaagcaagatatctgtagactaattctgcatttgcccttgtaatccaaagtttctcaacctaggcactatttatttttgttgttgttgttgttttggagacagagtctttctctgccacccaggctagagtgcagcggtatgaccatggctactgcagcctcgaacttgctgattcaagcaattctcccatctcggcctcccaagtagctggaacgacaagcacgcaccactatgccctgctaaattttaaaatatttttgtagagatgggagcctccctctcttgtccaggctggtctccaattcctgggctcaagctatccgcctgcctcgtgctcccaaagtgttgagattacaggcatgagccatcactccgggccactcttgatattttggaccaaataattcttgtatatgagaagctgtcctgtatagataccagtagcatccctcaattgtaacaataaaaaatgtctccagaaattgccaaatatcctctgaggggcaaaataacacctggttatgaaccactgttaaaatctgaagttattgaggtatgaaagactgttaataaattacgctgtaacagatatagtgttggatgatgtattagggttctctagaggggcagtactaatagcatatatggatatatgaaagggagtttattaaggagaagtgactcacacagtcacaaggtaaagtcccatgataggctgtctgcaagtcgagaagcaaggaagccagtggtggatcagtccaagtcccaaaacctcaaaagtcaggaagctgacaatgcagccttcagtctgtggccaaaggcctgagagcccctgactatccactggtgtaggtacaagagtcttaaagctgaagaacttggagtctgatattcgagggcaggaagcatccagaacgggagaaagatgaagaccggaaggatcagcaagtctggtccttccacgttcttctgctgcttttatcctagccaagctggcccctgattagatggtacccacccggattgaggatgggtctgtctctcccagtccactgactcaaatgttaatctcctttggcaacaccctcacagacacacccagtaacaatactttgcatccttcattatgatgaagttgacactccgtattaaccatcacagatgataccaattatcctttggaaaatatcagaaaatgagtcagattagtagccagatggaagatggtaaagaaaaggaagcggattggcacttatgtgtcagcaagatgttattgccattttatagagcactgagggattgtttgccatggatgcttctctgttaggtaaaggaggcagggctcaagcccacatctattcaaccttagaatcccaggacttttcatgataccatatactgttccagctatgtaactcactttgccaaatatttaagtacataattaagaagactgaattcttttttttatttgtataaatttaggggtacagtgcagtttgatttcatgagtctattgcatggtggtgagggagaagactacattatttaccttacttattcctgtggcattttttagtaggcactgggtgacaggcatcagtgtatttcaccaaagataagtcagaatataaaacaccatcagttcattctgatatgagtggcaaatatgtcaggaatccttaagagttttgccttttataaattatatgcatggaaacatccatcaggcttagctaaaagcccatgctatttactattttgctaaactctcattcttttaagccaagttaggcaactgagaaggcgagagagcagtgatgaagcagatatgataccctttcaaaactacacattgtgtaatacggcagatgcaacagaagcaaagggtgaaatgaagagaagtaaagctcatagatacccagggacttggctctagcatctttttatgctgtgtataatgagctttgactttattctctaacacactagaaagccatggaaggattttaagcaatatcattgtttcatgaacaaatctttgttttaggaaaacaaaacaaaacactagtactgttacaatttaaacattgaataaaagtctggatgctgttggtataatctaattttaaaaagggtgtgtaccaacaccgtaccagtggtgaccatttatgtatttacgtatttatttatttttgtatttgactaaagtttttaattttaattcataagttttcagagtttagtgagcaaccaaatcacctgttaaaatgctgagtctgatacattgggtttagatgaggcccaagactcatgttttttgtttgtttgttttgttttgagatggagtcccactctgttgcccaggctggagtgcagtggcatgatcttggctcattgcaacctccacttcccaggttgaagcaattcttctgcctcagcctcccaagtagccgggactacaggcatgcaccaccatgcctggctattttttttttttaatatatttttagtagagatggggtttcaccaggctagccagggctggtctggaactcctgacctcaggcaatccgcctgccttggcctcccaaagcgctgggattacagacgtgagccactgcacccggcctgactcacatttttagcaagcttccagatgatgccaatgcctctagttgggcaaggctatgagctgccaagttctaatgacagccactgtgctagacaaggggagaataaggtagtggcatgtagtattgcaactgtaatcccaggtgactggaatataagtgctctgtcattaagagttcgtttgtcaacgtcttgagtcttaaatatcctgtgttggtttcattctgatttcacacagtggccttctgcagctctgggagttcatcctcccagattcaagttttacagaaagaaattacttggcactttcacagaaatcccagtgagaagcctcattgcatttgttccagttaagtcatatggctgcttctgaatctaaacaaatcactgtggtgagaagactatgatgttctaattagcctgactccactttgccttttcctagaatcagtagtagagtcaactccatctgaggtgcttggactggtaatatggaaattgtgccattcccaaagagaaagtgaagatgttgaactacaaaggtgattggatatctattacatataggaattcggtgtggacaagaggtttccatactttcttggtttcttaggaaatgttcatgataccctcaagtccaaaagaaatgcctgagagttgatttattcggcagttagttccaaatgatgtaagatttacgtccttactattaagtagctgtttgataaaataatacataaggacttgaagaaaattaatatttttgtttccatcttatataaacacaatcacttcctaacaaggatgtgcacagctattgggctgtacagaacgtcttgcccttagattgagattggatactgtcaccctcacttcctgttctgcatggattttcatgcagtagttcccttttttattctaatggtaaccactaaagcccagatttataaagatatgatgctattgaaagaaatgtactgtgagctccacgtttcctgaaactgcaaagtacttgaagctagtttttgatgtgaacttcaataaatgttcagtatcattgtgtttccctgaaaatgttaaagtatcacgaaagccccatgaattccccaaattgcttttgtgcacagattgagaaccataatcttaggacttttatatttgaatttcttattagacatctttgtagagatgtagaataaaatgttgaccctatgggttcagttctgataagagatctgggctggtgaggcatctcagcacaaaggttggattcctttggtatcatggcctatagtgctctaggcatgcactacacatctttctgtctcttcaagagaagaataacatatgtctgctccactaccacacaactttacaatgcactgttttattttttgatctgaatctgtataagtaatattctacttggagtaactcatcctagtatttgcattctacatgtgcattcacatttacagtagactgcaataagagtgatttttatcctaagctctggatagttcatatattggcataaattactaagaggtaggcatcatgtacttcttgttcagattgcaaaccctctgaagtttaaatcttgttccttaaaacgtaaccatctgtgggatagctcaattaataagcactgagcagagcatacttttgattctgaagtgattttttttattaaataagtcgatatagtattttctcagtgattacgcttttctccttgctttttttttttaatgctgagtacaaatatcctccaacccaattttaaaaataacttatatgtagtctggaaccagtagatttcccaaagcatgagcaaattctattttactggagtcaataatgtttcaatctctcaagtccatgtgtgagatatagtgaatcattgtcatattatcattatatcactatggctcatctcataagatcccgcatcatctgatggccctatcattactgcttattttgcagaataatatgtaagtctcttcctaaaatccagaaaacaaatggattgaaaatattaagtacatcattattatgtaaatatttaatttttgaaataaaaatatggaagctagtaacaattgttcagttactagggaaacactagttagatttttctgtttaaatattcaaattgctgggtttggtagctcatgcctgtaatcctagtgctttggaaggccaaaacaggaggatcacttgaggccacgagtttgagaccagcttgggcaagaagtaagaccccatctctacaaaaaaaataaagagttaaataatttcaacttttacttataaaagtaatataatattaaaatgcgtattctttctattaaattatctttttaataacttttaatactgcaaacaaaatatttgaaaagtattagtgcagcattggccattgttcacagtagatctggaacacacaacttcattatacatgtttttgaggtttgatatagtctgtttctttttttctttttttttttttgagactgagttttgcccttgttgcccaggctgaagtgcaatgctgcaatctcggcttactgcaacctccgcctcctgggttcaagcaattctcctgcttcagcctcctgagtagcttggatttcaggctcccaccaacacgactgtctaatttttgtatttttagtagaaacggagttttgccatgttggccaggctggtctcaaactcctgacctcaggtgatccacccgcctcggcctgccaaagtgctgggattacaggcatgagccaccacacccggcctatagtctgtttcacaaatggcagaaacattgcttggctatggatgtgtagatatgacattataatatattaggacatagaaagtaactctttttctattgcaatttccctgtcttcataaattggcctttctgggcagtgggcaagaagaacccaacacttatatgagaattcccaccctgattcctctctaccacagacagctccccaggttactcaattatcattactgccaggtgacaacctccacttacaaagatgaggacactgaccatcccgggcacaagatcagtgagtggggaagcagggtcacatggaggtgggaagagtggatgggcagtcctgggcagctctgaagtgggacagtatgaaaggaaggccctgggctttgtccctatgagtacctattgtgtcacataaacaatagtgtgttaatggggtgctgaaaaagtctcctgcttaagcaactcagtttgtttatgattatgaatgtcagcagaggtctataaatgacaatgcagtttgtgttttgatgattgtctctctgatgggggtgttgatagcttttcttagttcttgtctcagcatttattcttgattggcatatgacagtcatattcttgggttctgttggtgtttttaaatcatgcacatgcttgaatttctcttacagagcgagaatgacattatatctgctgcttgttaaatagattctcagtttatgctggcaaagtgtcagtgctgtatgtctctatgtatgcaatttttcttttgtacagtcatttttctcttagcattctaaagattgattgaactcttgtgttatagcagtacttaatgtgtcacttactgaacttaaaatcatcactgtaactcaatgcataacgctattcatcatccattgaacctgtcactcctgctgattgtgcagaataaaagcctcttctcacctttttttttattataacagatatagtttgtgcattttttcttcatgttttaactgatattttgtcatcagttctctgatgtttatcaagagttaactttttttccaacccagattaatacaggttagagagtagaggagtttgttaatacgtaacaactactaatcactaaggctagatttattacatataaatatgtcaaattagataaacgctacttaaaattttggctgttggaaaaatattaacttgtaccttcaaatttattagggctcaaggcatattaaactttatagcagactttggatgttttatcttttaagaaatatttgaggccggatgtagtggctcacgcctgtaatcccagcactttgggaggccgaggcaggcagatcacgaggtcaggagattgagatcaccctggctcaacatggtgaaatcccatctctactgaaaatacaaaaattagctgggcatggtggcatgcacctatagtcccagctactcgggaggctgaggtgggagaatcgcttgaacctgggaggcagaggttgccatgagccgagagtgcgtcactgcaatccagcctgaaaactgagtgagactccatctaaaaataatgataataataatttgacttagtgaacaaatttgcagtaaaacagaaaaaataatatagattacacacctttataaaatctgttgtataatcatctagagatgcaatttgaatgcagcagtataacggagaagcatcagatgaattctcagagtatatcaatcttgcctttgttctagattagagcctggtttttagctagaggtgctgtagtaggaaaaacaggtttgtattgattcagattgtgtgtgcattcatagcagatgtggaatgacatatttctgccagataattatcacttagcaaagggtaaaacattagaacatcatgaaagttaaagttttaacttcacaggaaaaaaaggagctttactttaaagcatgatgaaaattatagaatttatgcataactcagttattttgttctgaactttaagaagaaactttcagaagacatccctaaaaaagcaagtataatgaccatagtatgaaacttaattgtgatataataaagctttttgctgtatccagacatgttacacaaatattctttatgaattacataaacagaaaggcaggagctagtacaaataatgaagaatatttatttaaaaaaaacaaaaagcggttattttatgtagaacaggctgcatacattatttattacaccgtattcaaaatattgtacaactctgttatgaggaattttacttgcacttggagaatacaggtaaatacattagaggcttatagatcctgaatgcagctgcagatagtgtcccttaaaagaagaaatgcagctggtttcctatttcccactcttttttgtgccagacaaggaagtgactttctttagaaaagaggattataatagtcatatccttaaatgaggaaactagaaccagatttctttttagaacttgcagtggggattagaagaaatgttgcaataaactttaggttattctaatctcagtttactaagtttttggtaacactgctcatttaacattggaaagagatgggatctgcataataaagtatacttcccataacttaaaagtaatcatgttcattgcgtaggataaaatcatccgttattccaaaaccagaggaaactgcaaaaaaagagtgctgtgttagcagtgacttaagtatcctttcacagtttgctaaaaatttttaagaaatttttgcaatttccctcaaattaactaccaggcaggcatcaatttgtcatttttgtatattgcattaaagcatttaatgctaaattaagacggaaaggtaggttttttttctttttttttttaacttttcctttctgcaaaaaaaaatcaaacatttattaactgctctctattgttgtctttctctttagaaggtaatttgtggtcagtggagcccagcagggaagctccttctcctccagatggcagtgacatttgagaaaaccttggaggattaaagacactctagtgagcactcactgcaaagtcctgacacaatttgacagtcctaatctgggtcctcaactgattggatgaccaagggcacaaaattctcatccaactgtgcaatcaccaggcacattgttaagggcactaaaaatgttccaaagttttggtgactgttttaaacaaaaatatataaaccttttcttcatggcatgtttttggaaaaggtcttggaggtaccttgcatggcttttaaaaactgactatatttttgcatgaatgagcacagcatgctataaatgtctttactctttattaagtagggtttgcaaacaatctaaatggttaaatggtagaggaaactatagaaattgatctcagtgagcaaagcctaccaaatctaattatatattgtcaccatctgctgcaatatgataacagaattaatacaattactttgagaattttgaagaaaaaacttttgaaaaaaatggacacgtgtggcaagtctgcgtgtgtgtgtgtgtgtgtgtgagagagagagagagagagagagagagagagagagagagaagcaagggcaagaaaaaaatgccatcttagctgttctttctttttctgtttcttttttacctttcctcatttttaagttattgcttaaaatgatttgaaatatgttttcctaattttcgtgttgattaaagttatcaagttttggtaaggtgattttatgggtttggaattttaattatatccactgcagcttctaaaatcaccatggcaacaggtgtgtaattatcaacattgcacatagcttcaatgtgtaatgcatttcttctggctgaatgaatattaaatcatactgcttaacacctcctctactagtaaacagataaggctttggccatggcttgcaaattgatcttgcttctgtagatttctattactgcagagccattgaatggggtaatttgtgcctttgagggttttctgactttgctagagcatgacagaaagtccagttttatttcatgtaatgagaaaaaaaacatgtttaattattactcacatttccattagtagaattctttccaagagaatattctccttattgttttccatttcaaggtgtgtattcaggacagatgagatttttttaaaaaagacattttcttaaggaaagcttacattttaaatgctacttttcctagcaaatgcaggtggtcattgtatgaagcacatatgaaatgaaacctttgatttaataccaaactatagcctactgtcaactctaagaaaactgtatgatccataattttaagtaaaccaaaactttactttgtttctaatattccaggtggtcttttcagactgatatctatgtagaagtacgcaagaaagtgacgtgattatctgattatcagattatgtttatatgtctctgattgttatcaagctcaaaattttccttaaatagctatggaaagagatagcagtttactactactactattattattaggtcatctaatgtaattcaatttataaatctgatgcatacatttgactgataggatacagacttttaaggacctagcattataaaaaatataatttaaatacatagatcaaatagagccatatataatattgttaaatagggaacaagataaatgattatgaagatgtatagatcttttaatcattcagtgtttgtttttagtggacattttattttgggatgccattcagtaacttgaagttattaaatgaagcataatcaatattagaacaaaagccagcataagaagatttatttaaatttgatgtatttagaatttggagtctggtcactagaattttgaggctaggtgattctatgaaaggctgtatgtaaccaccttctactctattccttcctctccacccaggtcaaatatcccagaatatggtattatttaagtatcatcaacttttaattttagtgtgtttccattttcaaactaagacaggtgcaaagttgaggttaccagcggtacaagatcagatcacctagttagatattgatgcatagtaaaatgtagcctaacacactctattcataatgtggattgacaactaagaaaaaagtgaatgctttattcacacaaataggttaatattcctgaaatagtgtccaatgcatttaaagccatttaaaagaacatagagaatacattatttttcttagcttatttctccagtatttctccctgtattactctagctcatatttagactttttgttaatcttagaaaaaggataaacacacacagtgtatttctgcagactcccctttaatggatctctgccagtgttagccattgtttcagttgcctgtggctgctcaactgtgcaaggttgcctggaaacgctccttcttcagtgcaaagctctccggccactttccatacctcccagcccagggcttaaagattcagggactccagccactggtgtttctttttgaaatctccttagtaaactaatgatcttgtaaatgtagaaaacagaaaaattacttctcagtctgtagggcgtgcaagtttaaaacaaaacaaaacaaaaactttgaaaaaaatatgtatttgttacaagttaaaacaaatacaatttttcttctctattgaatttgatttaaaattttgttaaaccagcattttgtaatgtgtaatatttttggcaaatattttaagttaacatctaccactgtctttcagcctggaaattgtgtgctattcccatcaaggttacatcatgtttccattactcctttaattgggggaagtttcaaagtcagacaccttgatttggaatttcaatgcttttaacaaattttaaagcaagtaccactattaggtaacagaatattattattactcacttttttccttggttaaatttgtttgttagtcctaagaggctttaggaatataaaatgaatgtgatgtttgatagtatcaatacagttgattttacttgtctctgctattttctcttttcatattataacttaataacaacaacaaattagagatatgctatttttccacagttagttcaagtttctaattctggagtataagatggggatatcactgtgcatgagttaaatagatgcccctacataatacctatatatcattactagttttaaaagaaagattatgtaaaaagtggtagtaggtagtaggtagtctttttcttttgttacaagtgctttgaaattactggtttgtgatataggatgtgaaaagaaagacaaaatccgtgatgtttgaaagacatactattatcagatatggcttacttaaaattagttattagactttggtctcctaacagcttttattccccccaatatactttcaaattccgattttcagaaatcttaattgtacaatattaatattgctacagacacaaactttgctagccctttattggtagattacatagactacattggttattagattttaaagtttattaataacatcatatccattcaagtttattttaatactttttccttatttatttaaggaattacttcaggtgatatgtggattttaattgttacataaatgcattttatggttatttataacattcactttaatttaaaggcctataagacctgtggttggatgacggtatgtattaatgttgtttttaacattaagaacttacataattggtccagaaaatcagacctatcccttcatgttctctttccttctgtacttcataagcctacgtgtcccttaggatagattactggatctgcttctcgattgctgatagacctttttcagttaaggtaagttatatgttagacatcatagagtgatcggactggttttattacatagcatattgggagcaaagcaaaagaataaagcagatacatatttctgcatgtcgatgcatgtatccactgtatttttaacgcaaactaattaattgtgggccaaaagttacagtaatgaatagaagtctgttgttcttactcacatcaggcacgcagtcttacttttttgtaaatttaaattgacgaggtaggtagagtatcacgataagcttaaaatggttattttgaagaaattttcaagaaaaatattaaggaaaaatttgggtgtctactctgtgagacaatctgtctctaaggtgctttacatattttatctcacttaatccgaggaaccaccctatgatttaggtagcattgttcctattttgaagtttgacaaactcatgcaccttgaagttaattaaactcagggttgtcttaatcatttctaatttcagtgaatatactttcccattggacatttaactttctaattaatgtgaaaaaaagacagtatttctgatagcatatacagcagtcactttaggggcagataaacatgagatgccagggatttggattgttcaagtcaatagtgtcctgaagaataatatattcactgtgtgaaacaacaacaacatcaactagatacaaagtttctgtaaaattcggacaatcattttgggttcttaacataaatagacaagattgatatatataatggtatttcagtagaaaccaggaaaatatcccaacttcgagaatcgtttcttgccaagcccacagtaagagttctaaatataagttaaaataggttctctgccaccatgaaactggtacccaacacatatcccaattataaaacgtctttatagtccactatggcaattatgaaggcagagtataatatgggagcctgaaaagctatactaaagaggcgacttttgaatggggtctggagggatgtgttcaccaaggagtgaaaggaggaaaggaacttaagttggtgaaaaaacacagatggatgtgtgaacaactccacatggccaaagaatggtgtgttttggtgtgtagggagggatttctggttaggtccatgagccagtattacaaagggctttgcatggcatgagaaggtattcggatgccactttgttcaatacagagatctactaagcacttaaaaattagagacaaataatattcagattcatatgttgaaaagattgcatttgtgccaatggagaggacatagcaaagggagctagattagagttagcagtgtcacttaggatgccattacctttgtctagggatcttagactcaaggtaagcaaagcttaggtcttgaaccaagcagataaagactagagaagaggtgctcagaaatgttgaatcagtacattttgttatactttaaaaattgttacaaggccagtggctgccacacaagacattaagcttttttgtttttgcttaatgaatgagtacaaatgtgggggaagtaaggaaaaaggcagctctgaggtttgctggaagttagctaccctcatgtttagcagacctacaaagtcttgaagcaggaagtagatttatcatggtgggagggagatggcttgatagaatgaggaagtgaaatgaaatggctcttcccaagagtgacaatgcattttagagaagatgtgaagatgatgcggttgttgagaagaaagagtattcagtgagcagcacagtggagaaatggtatggtacctaggtaggaaaatgaaaatgaaggattcctcattttctcttccagatcaggtcatgtgacaggactctgctcactccctctctacactttaatcttcactgaaagatacatagggataggaaaatttcctaacattctctcttttcctctgtattaagtcattccattaaccaaaaagttcaataaatatcaactgaatacctattatctgtccctttttaattttctttctgccctgtaaaaagctgaatagaggaatgcttatacgttagtgggagttttagaagtctctgaaagtgagaggtaagtcgtttgtcattttggctagatcttcccctaggaacttctaaatggtttcatgacctcatttcatcctagacaaatgcaagagggctttaatatgagaagagcctcaggaatccaacttgtagatataagcctctcttttaacaggttacttagtaaattagttttctttgtactgtgattcattaagaacaataactttgatttcattttatactttacaggaagcatagaatgactcaatagtagaaaaatacaataacatttttaaaaattatgtaaattaaataaaatggtatacgttaaaattgtgaaaattgtgtaaattacataaaaaatatatgtgattaaattaaaaccaggatttgtggggtggctgaattagatttcttaataaaatttatgaaaaactgtgcatggtacatactattctttcagaagcaataacagttgtaagagattattttttaaaaaatagataccatttattgagagcttactaggtgtcagccagtgctgtatccacattacatgtatgaattcatttaatttttaaagtcaacctgtgacttaccctgtgagctcactatgtgagccatcacccttgttttgcaaacaaacaaattgagggggagaaatgaatccatattcttattttatatcagccatatctctcaacaaacgctaatcagagctgattaacaaattataatcagcatgttcaatatttgatatttcatttaccttgcaggacatcctttgttttacagaattttttaaaaaccttagtagaatttttcttttttaactattattaaggctccttaggtgagtggttttcaaacgatatcctaaaggtctccagaaatttcttagagaatctcatatcttcttcaaccagattcacttgaggtatagtcatttcatatattaggttttattagagcttttccctccttctcttgctctgcctcgcatccatccatccacccgtccacccatctacccatccatcaatgaacttaatttttttagctttaaataactaaatcatgtactactaataaaaaataaagctaaaactggaggacaacatattaaaatattagatttcaggatctctctttagattgtacacatcacttcatgaatgttagcagtagcattaaatccaaacttataaaatgttagtgatgaagtagcagtgcattaaatataggcaggtgcattactttcaattaaaagtaatggcaaaaccacaattacttttgtacaaacctaatatgttggcctttcctgattgaatgtatattagctactttatacatattgttataatgtataacattaaaatggcatattgaatttttaaagtagctaatacctttaaagattctacaacataaaaacaattttgcataagaaatgttaggtatctctaagtatattttatttttaattttttatttcttttttctcttccaaagaaaaaactcaggtttattgatgtataatttacacaaaaagcattcacattttttgggtgtacagcccaatgagtttctgtaaatatgtcctaaattttttttaacaatcatattcagaaagtttaaattcaaaaaagtttaaaattattttcgaccttaattcaaaatacaccattcaggatgtttcctgctcattttgctacactgtattaagaaagaattttcaaaatatggctgcgttctcttggtgaaaagtactttccaagggacagcctaattagcccatgctttccctccagctccatcttgtcctcctttcctgcgctggatggcctttttcctgaggtaggtgagagtgcccaggacaaaggacacactgatttctctgggaaatttaaaccatgttatcaaggatggttctgtctgcctaatttgtaacttttggttggggcttggagtcagttgtggagcacagggtgggtgaaggcagaggagagagctccataacaggaacgcagagcagcaaggtctcaagggaacctgacaaggatacctcggaagaggcaggctctcagtgcgtcaacttttcattggttctatggactgtgggggaaagcaaagggacagcttgtttttcatggattgattttccaagcagctttatgaattgttacaattttgatctgggttacatacattcagttaaatggatgtttgtattaatataaacattaattttatattatttatgtaattaaatatttgtgtttaattatataaatttttatattctgtgctgttttacttttttgtattttttaaaataacgtgtatcttctttttagcttgcataaatatgtttattcacttaaaaagtaaggtttttatatttaaaactatattaaaacaaacgcacaaacatggatttttcttgaaggttattctggaaggttttgcttcatcttaatctcaaagactttgctttgttgtttactttttataaatgaatatattttagcctaatacttctgttctagaacttaaatattggctgtattatttttcttaatattaaaatgtttcctttaaaatttattttccaagaggaatgaaatttttttttttaaaaaagggattttaatgtttaaaaactgctttgggactgggtctgtaggttcagtacaccttctgagactgaaacaataagagcactcgtggcttattgaaccatgataatcaaagcaaccgaataacagtaaatactagaactggattctgcttcttatacctaattaaaaatatatattgttttaaatggggaatttatagtgaatctcatgaacaagtaatatagactaaacaatctgacattaaaattagagaatacaaatatttgtgatttatgtccttttcttaatttgaaacacgtgtgtgatacataacatgtacagcaaaagataaaaataagattaagccagaatgccattttgaaaacaaaatacaaaaaagatatgttccattaatccacagatataaactatagtagtgtttctgcattaccataattatttctgcagagcaggagaataagcagaagagaatttacatctatgtttgcttaatattgtttctgtctttaggtttcacttctctcccatggtaatgtaaaagtaggaccacctgttttccattgggcattcagtttgggtaaattcttacaacacagcaatgtatttctaatcagaattttctggaaatctgagggaagttaattataacaataatatttttaaaaactgcagtgaataaaattaattccaggaagacacccttcctccccaccaaaagagaaatctaggaagaaacacacttcctatgcagatttaaaagctttgggaatcaaggttatgaataaaaaaaatcatttcacttccataaggatccagaagggaaatatttaaatgtaaaatttgatctataaaatctaggcagcatgtattttcctgcaactatttataagagaacggggcattgtagaataaaatttgtaataagtggaagtatttctgtcttcgaaaggattgctgtaaattgtgggatgtgtagaaaaactgctcctgcttaaaaaattgcaaacgtgtttttaagcaatgtttctaagtttctattttaagtcagcaataggaaaagttattttcttgtatatatgtcaaaaaatatcaaatcagaaaggccatctacaattgatttttctacttgaaaggaacgaggaagggaaagttcgtctttgctcttgtccatcagagtattatgcctgccagcttgtgtgcaaatgatttattctgaaaagcagactttacacttagagaaatactgggatggagcatttgtgccctgtggagtgtttggaaatggaataatgcatccacaaagacagctttctgcatcctttctgcctgcacatatgaaagggtaagcattaatttcaataatggttcaagtaattgaaaaagggcctgcatttcaggatagctggacagttcacccattagctctctactgcaaagagaaaaagaaagctgacctgcccattttaacattttaacagataattaagaatgacaaaatctaaagatatcaaataaaatgtaaaacttaaaagtcagtcagtaaccatactctaatagtttgttttctagttcctacttttcattaactccaaaatttttatgcttaataccttaactgccatttggtgtaattatacttaattttttttcatgtaagtcattttcctgctctgaaggttatttttagaaaaacttgatccatcttttctctcattcacatatatttgcaaacagatagtttctgtgaaaagccaggtgttttcagtgatctaattactataattacaggctttgaattttaaacccaattcttaacttttaaaataaaactttggagataaattaaaggcactagaaggtcacaaaaccagtattaattgtaatatactgtgaagttcctcttggtttacatactaatgtatagaagatttttgaaggctctttttactcttatcaattgactcaatggactcatgactgtagcatgtcttattttcacagatgaaacatttcagatgcaccgtaccaaataaaatcatactccttagcatgatttttcagattatccacagtctagtctcaatctctttccagcttcgactcactgcttcattcccccagttgcctaaactctatgttattttgagtgtgctcgttctgcaagtatttcaaagtttcagtgcaggtcccagctattcagggcagacatttgaacataaaagtgtttaactgctggacagttccagtttttcatcacacatgctgttattcctaacattcccgtatcagttaagaatggttcatataacagaacatacaaccctgctgttggtgttgatataagaaaaagtccacagggaggcggccagttcagaggtagtgtaactcctcagggatgctgttaaggacccaagatctttctgcctctcagccgtatcatctttactatgtgaacgtttgtcctcatgatggttgaagcctcagttgaaggctgccgcaccttcaactctctgccatgttccaggcaagcaaaaaagagatgtggaatggggcgtgagtaacgggctgtacccgattgttctgtccttccccccaccctcccgtcacttctttctttttttcaggaaattacaagctttctcagaggctgacaacagtagtctttgtttcacatctcattgggcaacacccagtcatggctgcccctacctggaagatggctaagggagaaaggaatgcgagtggggactgggccagtgaaagaactgtgcctgccacactgcttttcactcgcacgcatccctccacttgaaatgccttttctcttatcctttatgtgtgttcatctacatcttgtgtggaggctgtccactttctccagttctgtgtgagctcctatgagctgctgtttttattttcctatgggatatcatttttaaccttcataataaaaggcaaaatgactgtcattagctttatgtagctgtgtcttaacactgaggtcagaaattgtgctatatgaattaggaatctttcagtgacaagcgtcaaaaaattatgttaattagtttatcccataatttgttggttcacttaacatggaagtccagggaatcgctggcttcaggcatgtctggaagcagaagctgaaatgatatgctcagtgttaactcctgtgcctcttgtcattcttaatctcatccatcctccctccctctcttattgctcctctctactcctctttgtccttctttttcttcctctctttctcctactctttattctatatccctctattttgctcattctgaaactggttctcaacacttcgtacaatgtataaatgataggcattcacagctcttagcttacctgacttctcattatgccagagtcaaggaattcctttctacaaaatgcatatatcaaatgtttctggaaggaatatgattagccttggttggccacatttctgttttttgaccaatcctaccatggaggagaatagaatagtaagattggctatgaataggtccattctagttgcccagaagtagatgaggcagtgtatttgataatctcacccaaaccatatgtgttgttgggagaaaattctgggaatgcaaaataataagtacttatcccagatctccttttacctgtcatcattcattgcatgtgcctatctctatctaagtaataggagctcagtagggagatgaggaagtgaatggataaatgggagaggggaagaactgagttgacctataagcaaaagaagaaaacggcagttttagtgttttatgagctgtatttagatcatgcaataatattttagggtttttttagtttagtttattttttttaatttttgaaacagggtctcactctatcacccaggcttcagtgcagtgctatgatcgcagctcactgcagcctcaacctcctgggctcaagtgatcctccaacctcagcctcccaaatagctgggactacaggcaaccatcaccacccctggctaattttctgatatttttacagagacagtgtcttcctctgttgtccaggctgctctctaactcctgggtttaagtgatcctccttcttcagcttcccaaagggttgagattacaggcatgaaccactgtacccagatgttttatgttttaaatttatataaatccacagtggctgcatcattcaaattacaaaaataaggaaatgtggtacaaaatcatattcaaaaaatgcatctgccattgctccttcagaaaatagttattgcttgcttactctgtgataaggcattaattacatggtgcttcatttttttagtgacaataattgagatgcttctctctgttcttagagaacatcttaagctgatagaaaaactaacaaatgggatacatagtttgtaagtaaagtatatttgggaaaccttttgtctttttaaagcatataaaactaatagtgtgttttcaacttcagtgtatggatgtaagaagcttaagaaaatgaattcatatatttagcctcatttattttaaaccatttatggagacatttgatatatttttaagtctcccagaaaatatcctaagcataagcaaataacttcaaatacaatgtttatatttggacatactagttctctgctgtcatcttgactgattcagaaaagttctgaagtgaaagattttagcatttatttctcctggctttcttccatctgccaggaataactcagttcactgaaggcttctgacaggtccctgaccttggcccctatctttgccatcagtgtttggggtgaggagagaatgggctttgaggatggttgcctctttttcactgctgcacctcctcattatctctccaggaagcaggttgattctggccggcaaagctccctgaggtgggatccattcagtccattcttacaggggtaatagggcttggggctcatttcagtcagccttcgttggaagagagaggtccctttcctttccttttgaagattgattagtttccaaagaaagacagataacaccactctcattctcactttctctcttttttctgttcttgaaaactcaatagttgtgtacaataagaagtcttgctagacaaattgtgcctatgctttatgttctgtaaacatgattcttgaagctgagaaacttttaatggaaccctttagctaagctgaaattacttacataatccaactctgtattagttttcctggtttttgaaatagtgtcacaaaatagcaaaaaaaaaaaaaaagaaaaaaaagaaagaaaaaagagaaagaatgggaagtagagaatttctaacacagtcatctaacagactgactcagatgtaacaagaaagtataataataataaaatttaaaaaaaaagattaacagaaaacaaaacaaaacaaaaaaaagagaaagttctcagtagccctctggaaagagaaatttctaagcacaacttttttttgttaaagataattgaaaataattatatgtgtgtttggtaaaccacaacgatctttctatattgttaacacctaaagtaggtgaagaggttaatgaggaggtttcccagcaacaaatttaattgtagtcatgtaaaaattacataaactcaacataaaatttgaacacctgtgcaggaatctgaaaaaatttcattctaagtaattcttataatttggactctcagtctagtggtgagaatttgaaaaagtaaagaatgctcatgataaagtttgacaggtgctctgaaagcagtaaatatgaggaattaaggcaacctctacttttgacatcgtttgctctgaggaagtattgtatatcctgactttaattttttcaggaccctgtgcacttacaggatgacagaaatgatatttcttctctcctgaaaccctggggttgatatttacatatcacactcagacatacaaaaaatactattctgctttatttatcaataacaagaccctgtcctcaatgatggagacagaaaacaactttgctaagttaagctatttcagccactacttctggtttttattgctttatttcagaggaattcaattgcagttgactaaatcctcagtcaatttaaagttcatatttcatgtgaggaatgtttttctctaagtgagtccacattcctttctctttctttcccaagatggtccagggaacagggctgaattcccatgttctcatgatgagagaggaagttccttctggtttgtgtgctgtctctgtcctcattgatgtcctctgggatatagttgcctggtatcttgtgttcttgcccaccgaggtctggccattacagggttgtaatgctcatacatgctgttgaggcagaggttccttttcctctggtttttgagatttccatagcaggggtcggtaaactacagcatacaaggaaaacccagctgctgtgggctaaatccagccatttagcttgttggctaaggctgtcagttttcgttctacaacagcagttgtgagtacttgcaacaaagactgtatgtcctgcaaagtctaaaatatttactctcaggccccttacggaaaacgtttgccagcccctgatctctctgagtccttggattgtccactctttgtttgtccttcctcttggcatgtttcatcttttccagagcacacaggaaccactgggtctcctgcacagaaactcagggcagacagagtcactgtctagggacctccccatccctctcctatgtcactgctttggcatcatgctgtatataaaaaggtagcaggggaccagccctatctcagcctgtctattgctcaccatatctggaggtatttgaagtttctgtgttttaggtttccaccctcttgcctgaaggtctttgatatcttcttagagactcatgtatcattttcaagctacctttctcccttgcaaatcccctttcttctttcctcgaaagacttagtatctggaaagaactttccttacgtgaatgattcttgaagtgttttctgtaccagcaattctgcatcatatgagaatttgttaaaagtgaaaatatttggtctctaccccagaccaactgaataagattgtcagagggagaggcccagcaagctgcattttagcaagctcttcaggtgatttgtgatctgataaagtttgagaaccccctaccttacatcatatctgccactaaaaccagatgatctgagtagccaggtttcctgcttgatgtgtgaaagggagctttcaaaatatagaaaactcctttccctttccacaaagattggctggagtagactcaaaaattctgttttgaaaattgaatatttcaatcgattatctttttccttgtctttctggtctactaattcaactcctccctgaggcggccaatgcctctggttaaacagagagtgtataggaagtgctcttaaggagaaacatctggtgcttttgaataaatgctcttctatgcactcatgatgcacacatttatctaaatagcacagtacatgcctgaaaccagcaacactatttgctgagtcagaaatttaagccttagcctgtgagacagagactccaatactggattccctttagatctccatggacatttcaaacttggcaggtgtgaaaggaaatttactgattccttatctttctcctcaaatcattctccatttcccaaattcttgaccttggtaaatggctatgaggaagtgactataaagtactgatttggaagtggactgatctggattcaaacaccaatttcagcatccattaactttgtgatctgcaacagccaacgtttctagctatacattttcctgtaaaacagaggaagtcccaaatcccatgggtagtttttaagctttggagaaaatgtatgccggatatatgatatttattatcctatgcttgcccattctcaactccacttagtgaccaaatcactaggcatcgttgtgcattctcttttagaaatgtcttgaattgatcatcgtatccccttcctttcaacagattgccactgttaataaaggtcatcttcattaggggatggcatagtttcttatttcttcctatctctagttgggtcacttcttgggagagccacttatggttttgtgggtttgggagtgcacaagaacaccacatctaaggggcaccattcagatgttacccagaccttataaaggtccctctgcacacttacactaatgcaccaacacacattctcacagtcacacatgcacatgttctcacacagtcactcatacactaacacacactggccttgatgctcacacagacttaacacaaatgcacatcctcatagagactcagataccactccaccacacacacacccactcacattcacacacacttttgagtgttgtgtattattacaacaaaacagtaaatcatgtttctccaatagaagcagtatattaaaacatgttcctgtaaccatattgaagaaggactatctttctttaaatctttaaagcacatggaggtgtcctggggccgctctgctctccactcccatcttttcttcaacagttgctaggatgattctatctgaagcccccactttttcaggcttcctgtgcctaagttcccattgcagctcatgcagactgcattttggccctctcacacagtgcatggttatgccacccgagagggaaaaatgcactgtgatcatcactgataaccaccattatacctggtcaaaaggagatgtgtaagaatgtaagaagttattttgcctactgcatgaataattaatgctagtggcctgttttccatatgtatggaaatatagagagattcagccaaaaatactgtactcttgtacttttttttttaatttggtgattatccatttacctattttaattacaaggaagagctccaaagaaataggaatgttttaggaagaacttgatggaaagtgcctaactgctttttaggactattctgtgcaatatgtttttaacaaaaagagagattccatttatccagcactattttcatcattctgttgcttcaagtggatgagagggttctcttgtctttcttattcttcacccacttttagagtttaacatcttacatttactgagtactctttataggtacgacacattatgccagttgtttttgaagccttgatttcatttaattcttcagaccagtcttagaggtgggttgattctatttccatttcacaggtgaggaagcaattattttgagaggaatttacctgacattaagtggtgcagaaagggcagaacatggcttcaaaactagttttgtctgctttgtgagcctgtgatctctagaggcgtgattattggactttttttttttacctccttaaattttacaaaaaactaaagtgaggaaaagaaacccaaagagaaaaggtaaaatactgttgaataaaacctgttttctgactttttattaaaaagaaatgattttatattatctattgttaattttctaatttccaaaattaactttgtcctgtttgtaaattgtctttataatttatatctttaactgtgttctatagcatggatcctgctaaattctgactttcatgctgggaaggaccctattttccatttttatgatctttgttggtttctttgctctgttcttacaattttgcatatgaattctagaaataaccagataagagaaagcaaagcatagactaggagacttttaagcccactcacagcttcaagcatcatgataacaaaattgaaagcaagtgtattgatttgggtggtattatatttgtctctagggcttgaaaagacctttaatttctctctttttacacaccattttttgttgtaagtatgtttacaaatgaataaatgtcatatttaataaacctaatggagagaagttgcctttaaagaaaccaacagatatgagcatcatgttgtgagcatgtttacatttacgaacatattattttctcattacctactcagttatttagaaatcataggagttagatgctaaatgtcattatatttatatgtgaagcagcatttctaatctccagtcacttctttcaacttacacatctgactttgacctctcacttcccatggcatttcagagttgttacagaatttataatcaaaattagtttggcagcttagaacttattggaagaaaaacatcaccttattctgccgctattatcatactcaagaaaactgctttttcactttgtttaaactgtatttttgacttatagtagatcaatttctccgcatttcaatttacaattatatgtaacatgaatctcaatttttgaaatacctaactcaataatgtatgaaatcatttataaaataatttctcctatttgctttgaaggaaattttaaagagataaaagtgcttccactttcacacacaagtttaactcataagtttaatggtgaccaatattatattcttggtgtaaatcctactaaaattttatctatcctgtaatattaaatatatataaattacacacagtatgtgtgtgttattaatatgcacatgtatatgtgttggtgtttaataaagttggtttctacaaaatttcttagagctacccttagcattaatttactcacttgataaatatgtattgagtccttttgaggtgccaaactcacttctagggaccacaaatatataaatgactaagtgaaacccaattgcatatcctgcaggagcttagaatctactggtagaaacatacaattcaagagcaatgataatactctgtggtgtttctctggtgtagcacatggaagaggcacagtccatcccagggaaggctaaacaagaagcaggagttagcttggaatcacagggggaaagaagattttcagtgagaggaacaatgagcagcttatagaagaaagatgtagtagcagaacctggtgatattttgtctcttagaaattgctgtcatctgtgagagacagtgtgtgtagtggctaaaccaatacaatttaaactgcctaagtgtgaatcttggctcagccacttttggattgtgagtcattagcatcacttccctgtgcctcattttccccatttgtgtgaaagtgggttttagaataatgcctacttgatgaaggtacagggaaaattatatgcgatgatacatgcagggtgtctggaggaatgaacaccagatatgaagagagtccttgtatgtgtttgctaggattgctatatcaaagtactatgaagtgcatggcttaataatagaaatttattgagttactttttcctagcctgcttattatttgtgtgaagagaaggacttcttaatgaatacatgaagcaaaattgttctttaatcttttgctttcagttttacccttactgctttttgtgtttggactttttatctagattgtcatttctgttctttggcatttaaatggcctgctttaagcagtccagacctttctttgttgtctgagactcaatagtttcctgctgaccatctatctgataagttgagtcttttgctaattgtgatctcatagcctactccttcaactttcttcttatcccttctcccaatttttccaatctgtattctttttcctcttctctccttctcttccctttctccttctttccttcctttcccttccctttgtccctatttactgctttgtcacttattttcctgtttcttctgcagcagtaaacaggaaatgcagcttcagtttgctgctacatgttgttataataatactctgaagaaattaatgcatggtttcttcgctgtgacaatataaacttattaaaggcttacgttcactcgatacattgatcatttttctgataactctaaaaaccacaaatgtcaataagtcacagagttgaaacctgtcaacatcactacagttgttagatttgttgtttagccttttttattattgctttttttttcttccttatagctcattgaaattctagttggaaagaatggagcagtgaactatgaagaaacattaattaattttacatgacgtgtgtatgtgtataagtggattttaaataattagtcacaattagtatggtttttaaaaattttagcttagtgatctagaccattatcatcttggttattatgtttttaatgttcagattgtaagtggattaatagtagagtgcacattcatccactgaataattgttgaaggaagaatggtatcatcagtctttttgaggagttttgttcgtccagttctgccatctcactgtaaataattgtagaaatggtacaatggatggctgatgaatcggtaaaacatggagatttcctatagcaaggaatatgtacacctgtcacttaaaatctattattttcttttttctggtttataaatagaggcctgaaaatagtttatacttaaaaatatcctaatatgataattttgttgattatgaataaagagtattttatctaagtcgtatcacttgaagagcaagggttagtagaactaggctctggatttagttttgcattaactaacagtttgatttatggcaaaccatttaatcagtcttgaccttcattttctcatcataagttgaaagtgttaacttctgtgttcctttagggccctttaaatttcatcagttgatattttaatatttttaacaacctggtcattacaataacatctgcgtatgaacccatcaaaggatctaattttagagtttaattttatactttgtagatgtctgaaggaaaaaaaaagggacagtgtcatacataaaaatgcactatgtgctttcattttaaaaatattttatatcactgttcttcaaatattgaagcatcaggatccctttatattcttagaacttgtacagaaccaccacgagcttgtcattatgtgcattatagataccaaatttagcattttataaatttaagcagtacatttagagatttaggaatttattcaaaaacaatagacccattatatgttaacataaataacatatctataaaagaaataaaaaatttttcaaaacaaaaaacaatgagaagaatatcattgtttaacttttttttttttttttttttttttttacaaatctctttagtgtctggcttcttacaagacacctggattcttctctctgcttttactgtattcatactgttgtaatatcacacaacatggacctctgggaactccactgtacagtcatgagagattgagaatgaaaaaggcaaatgacatttcagtattgttacaaaaatagttctaacctatagggacccgttgaaaagtgtctcagtgacccatagatgaccctggaaatcactttgagaactaccattctatattttttaatatgagataattccattgtagaaagcatacttcaaaattcgaagttttgatgtatctttcagttacccaaaaattcaacttgacttttaatggtgcaatgatgccgaaatccccctgtccgtgcatcagtttatttttctactgcctatttgcatgatggttaaaaatatgggtgaaatgattttcttcccttttagcccctgcaagagaccttatctttacatatgcatcttctttactcgactataaactctgtaagaagagggagtattcctgggcagccataaaaaaggatgagttcgtgtcctttgcagggacatggatgaagctggaaaccatcattctcagcaaactgtcacaaggacagaaaaccaaacactgcatgttctcactcataggtgggaattgaacaatgagaacagttggacacagggcggggaacatcacacaccagggcctgtcgtggagcgggggttgggagagggagagctttaggagaaatacctaatgtaaacgactcgttaatgggtgcagcaaaccaacatggcacatatatacctatgtaacagacctgcacgttgtgcacatgtaccctagaacttaaagtataatttaaaaaaagtaaaaaaaataaaaagagagagagaaagtattcaatactgtatcctatctaatttctcaagaaatatgtgttaaatgactgaataaaatagaaaagataggaagaagcaaatggaacatattaacaatattaacaaatttgaataaaatgctaattcttgagaaaattggtaataaatgtctaaatcattctcaaatagaaaaatgttatcaaaatttaattttacagtttgtatatgaatgtattatattctctcaggtacaattgaaagaaacttactgaaagtgaatacatctattaagattaaaattaaatgaacaaaaactctaacaatgtagaagtatatggacttgcttgaaatgatggaaatgcttctaagtatataaaatgggaggtattatcagtattataaactagtaatcataagccctaccctcccctgtcatgcagagttataagtagggatccatagaagacaaataaagagctgctcatactccatttcgaattggaccgcctggattctggtgttgattgcatatggcagtcccatcataaacttactcagcccctctgggcttctatatcctcccacagagaaactttgtaacaatggaaacctaaaatgtaacagctgtttacttacattgagggagtgaatttctcactacagaaggggttcaagtccaagtaggtaggacagttccccaactctcagtttatttcatttgaaggaggtagttggtttctcagactgctccccttagtcctgcccatatctaataggtgtggtatctgtaatgctaaaaattcatacaacgagtagcaaaagttgtgcctagaatttatatgcatagtttgtaccattattttaaaaatgaagaataaggaaaaactatattgaaatcaataatcaccataatggtggttttagaaagttgttcttgtgacctaataatgtggtgaagagattttgataagtccctacacccagcgtgtgtggatataatgtcattatgatatgtattattatactgagatgcagagattcatttataatttacaaataaattaattatgattgaaaaaggcagaatattttggaagctgtgtcccagtgactgtacaattttcccagaatctcctaaatgataaaagtgacttataaaaatcagttttacaaaaggtgacactgtttagtaacatacatttgcaagtttcacataatagaaaaaaataatgtattctttatttgaggagtgaagaaatctatctgcatgtaaacaggatatgacattccttgttgctaacttaacaatgtgattacagtttacatatttcttcggatagtggtgctttactagtaaatgactatttatccttttgatacacaaacaagggcttattttatatgtagatgccataaggattactcatggagtttcagaagattttgagctttttttaattaggaaaatgatcagacatacagaaatattggaagaatgtatcatctatatagttatcacataaactcagtagttgctagtattgtgccccatttgattcatccatacatttatttcatgaaccatttgatcacctgtattttcagtaactggaaggttaatctaaatatgtgataacgaccactttggaaaacagttagccagtttcttactaagctaaacatctctgggcattggtatttactcaaacaagttgaaaactcatactacatgatcacctgcatacatatatttaaggagctttatgcataattgccaaatcttggaagcaactaatttacccttcagtatgtaaatgaataaataaactgaggtacatctaagcaatggagtattattcagtgctaaagagaaatgaactgtgaaaccatggaaagacatggagggaccttaaatgcatattagtaagtgaaagaaattaatctgaaaaggctacatacagtgtgattccaactctctgacagagtacagaggggttttaggccagtgaaactattctgtatgatactaaataatggtagatgcatgttactgtaaatttatctaaatacatagaatgcacaacactaaaagtgattcctaatgtaaactgtgggctttgggtgatagtgatatgtgtcaacataagactcatcagttgtaataaagatactactctgcatggggatattgatggcataagaagctctgcacatgtgggggcaggaggtatatgagaactctgtaatgaacataaactgctctaaaattaataaagattattaaaaataacgacatttattataacatttttgagaagaatactttacagatgatattatgtactttattttatgttacattagaggatatatgtcgccttatccaactattaatgatagtaagtgtgagtgcttgatggatcatcttaatacaacacataaatattgatactgatttcaatttctttggtagcaatttaaatatctaatcctccagttataatttccataagcaatagaaactagccactgtgaatgtgtgttctttactgacacagacctgcctttgactattttgagtggttggcattttaaagacttccagctgcattagaatgacaggaatgggatttactctcctgctttaactagaaaattaatgaaaatatatggaacaatagtttcagagattgaacaataataagcaggacaggagagaaatttatgagagatgggaaacaaggtgagctccgcgactccccaagcttactatcgggaaggaatttcaaaacagtgcggggaaggggagcccaaacagaggtgtagtatttttaaatagaagagaaagacttcgaagttcagggaggacgaggcagctggaatttgaggggtaaaatagcatagaggaagaaactacctagagacagctctggaacactgcagaggggttcagtcaagtgtttggtagattactgatctatgcttgactgtgatgaaactaggtaagacgagggaattgatcaatgtaaaggagtatgtagagcaacttcaagagttcatgcaggaagagaatgactttgttcttaccagcaataggacaaaacccttttatgcaagacagcaggtagagtcctcagaaaagtattacctcagtagtatggtcaaattagtcccagatcaaatgctcttctggacttcccttaacaaatcttataagcatttctcaaaatgaataaacaaatccaaattgcttagctatatcccagaatatagtcctataatatttaaaaggataaaccaaaagtccccaaaccaacattgtacaaattgcagtatcttacatgcaataaaaaattactaaacatgcaaggaagcaggaaataagacccataaacagaggaagtaaaaatcaatagaaaaagtttcagatagcactgaatagaagaataagagacaaagatgataattaggtattgtaattatactccacatgtaggacatggaggaaaacatgagcttgatgaggagaaaaatgaaagataagaaaagatgcaagtcagtctcaacagatgaaaaatatataaaaattaaaaatacactgtatgtgagcagtaatagataaacacttaagaagaaaaagttagtgacttgaagacattacactagaaaataaaaaaatgaagcagaaaaaagtactgaaaagaaaatgaacaaagtatcttctgtgggaagatgttatggtggcatatcatacatgcagttgaggttccaggaaataagggggacaagcagaaaaataataaaatacgtgtaaaaattttttccaaatgtattgacaattacaaacccccaaactaataaactcaatgaacaagaaacagaagaaacatgaagaaaaccataaccaaagcacatcaaaataaaattgctggctgggtgtgatggcccactcctgtaatcccagcactttgggaggcctaggcgggtggatcacctgaagtcaggagttcaagaccagcctggccaacatggcgaaaccccgtctctactaaaaatacaaaaattagctgagagtggtggtaacgcctgtaatcgtagctactcgagaggctgatgcaagagaatcacttgaacccgggattcggaggttgcagtgagctgaggttgcgcaactgggctccagcttgggtgacaggtgaaactccatctcaaaaaataaaaaaaaacaaataaaattgctgaaaaccagtgatgaagagaatattttaaaagcaggcagagaaatcaatgcacaaatcatacagaataataaatataagaatagcagatttcttgtcagaaactacacaagccataagacaatggagtgactattaagtaaatttcttggtcaacacagttttagctgtattttacaaactgtaatgtattttcgttttcatgttcagtttgaacaacttctgatttcccttttttcatgtcttctctgttccatggataatttagaaatatgttacttacttttcctgatacctttctcttgttagaaatctcaattttccaaaaatagatagcatgtagtataacctgtattgattaaataaatttcatagtttaaaatctttctaccaaacaaactaacaaaactaacaaatgatgagcaaacaaacttcaaggctgtatgtcttcattggtgaattctgctaacatttaaagaaagtataatgtcaagtctacacagatttttttagaaaatagaaaaggagagaatacttctcaatgtattttatgatacaaaaatcagaaaaattcataacaaaaacataaaactccagaccaatatccttcataaatacataatacatatgtatttgtataaatacatatgtatttatgcataaatacaaaactgtatttatttatacataaatacaaaactcctttttaaaaatttaataaatcagtatatcaataaataaaaaatgtgatacatcatgaccaaataggatttatcccaaaaatgcaaggttggctttaagatttgagaaatcaagcattgaaattcaatatattaacagatttttttcaaaaggaaaaaggatttgactaaatttaggacccatccatgatcaaagttctgagcaaactagaaatagaagggaacttctgcaaactgacaaagggcattattgaaaaacatgtagttaacatcctccaatatggtgaaatgcttttcctccaagttcaggaacaagacaaggatgtgcactcctatctagcatttttccagatgtcctagcctgcctagtaagtttttaaataactaatacagcttgaaaaagaagcagtagagccttctaacatgatcgtttttgtagaaaatcttgaggaattacccaaaatctactcagacctacaaatcggtttaccaagttagcagtatgcaagattaatgtataaaaaatatatttttgtgtgctagcaatgtaattaaaaatttaaaaatcaccattgacaataggatcagagaatacgaaatatatacacataaatgtaatagaatatatattcagtctgaacactgaaaacagcattgctgcgaaaggttagaaaagtttcaaataaatagaaaaatatagcatactatgagttggaagactcaatactgtatcagttctgtaccaagtgatctattgattcaatgcacttccactcaaaatatccacaagtttttctgtggaaattgacaaactaagtataaaattgatatggagatgaaatacaaagtttgaatagccaaagtaatttgaaaaaaataaaataaaattggaggatgtacaaaactgattttaagacttaatgtaaagctgcagtactctacacagtgtggctctggcataaggtagacatagattagtggaatagaaaagagagtcaagaaatagctcatatataaccacatacatggttagtcaattttcaagaaattaccaaagtaattaagtaaggaaataataaccatttgaaatgatgttgaataattgccatccacatctggaaaataaaccttgattctaatgtcacaccatatgcaaatatgggtagctaaaaccttgcaacttctagtagaaataatggaagaaaatcttaactttggttatagcaaagatttcttaaatagaacacagaaagcagaaacattaaacattcgtcctctccaaaagacacaggttaaacaaaataaaagccacagactaggaggaagtattttaaaaatacatatctgataaaggatttgtgttcagaatatgtaaagaactctttcaactcaatgataaaaagataaatgactcaataaaccagtgggcaaaatatttgaacaggtatttcaccaaaggggatacaaacaaacacctgaaaatatgcttaacatattactcactaggaaaatgaaagttacaaatgcaatgatataccactaagcacacacttgaatggctaagcttaaaaagacttccagtccccagggttagcaaccatgtgaaacaactggaactctcacatatcactaaggggagtgcaaaaatggttcatttatattggaagacatttcagcagtgtcttataaaatgaaacatatacttcctatatgaccagtgttactattctttttttttaagctggagcctcactctgtgttgcccaggctggagtacagtggcacaatctcggctcactgcaatctccatctcccggattcaagtgattctcctgcctcagcctccagtgtagctgggattacaggcgctggccaccatgcctggctaatttttttagtatttttgatagagatggggtttcaccatgttggccaggctggtctcaaactcctgacctcaagtgatccactcacctaggcctcccaaagtgctgggattactggcatgatccatcacacccagccagtgttcctattcttaagtgtttttccaacagaaaagaaatttttattcacaccaaggcttatatgcaaatattcagagcagctttttttttttttaacaaaaaataatagtcaaaaaccagaaaagaactcaattgttcattagctttttgctgtggtaagcaaatgtgatatgtatgtacaatggaatactgctcagcaattaataaaaaacaactatcaatacagataactctcaaaagcattatgttatgtgaaagcagctagctgcaaaagatcccaggttgcattttcatgtatataatattccaggaaaatcaaaattattctgataaaaaacaaatccctggttgtcaagggttggagagagattaagagcaaacagatgcaatggaactttttggggtgacagaagaattctgcatcatgacagttttagtggttacatgacttgtaaacttaacattcattaattttactgctcataaattataccgcaggaaaaccgactaaaaataagatataagaatctatcttcagacaaatcctaacaattatactgacagttgtgtcactaagaatatttctcactaattggttcagagttgtgggctgctaaatggattaaagcaaaccaagaaaagagcttaatattattttagaaaggaaccgttgaaagataatcctggaatatagccacataaggagattagcacatactcgccaaaaatttaaatcttttgctatttaatgaaatcaggccaagcagcagcacttgtcagtaattataccggtggtgacaattcatatgtatatgctttatggttttgaaagtaagttaaaatatgtaagctgaaagactcaagggcctgagacacattctggccataggagcaagtaaacaaaacattttcatgggtgcaagatagatggcatcaaaaattggaatgccgttcagaatgcaaaagaacttccaaaatctttacagtcattctgctggtctgtctgcttttcctgctcctactttctgacgatctcttcttgggtatcttacagtcttaactcactgagactagatttgctggactaagtaagtcactgtgatatagaggacctcattgggaagagttcttggattagatcacctttgccagggttaggggttgtttggggccaacagtcctctctggtctacactgttgtaatgaaaatcaaatggcgaatgaacaaacaaggaaatatactagcattttataatctacaaactatttgtaaattatttcatctaattcctctaacagatattataaacttttctttaacagttgtgtattttcagctctttgcacagtgagctagtcttggtagatgctcagtaaatatttgttaaatgaattcattaggagattaatgaatggattgagggagatgtgaatatatcagtgatgtcctcaaaagttgtatagcttggccaagttcagagagcttggcacatgttaaaggaaaggcagtggaggacagtaagcaactaattatacaggttttgcagtcatatctgcaccttcacttgctgagcctctgtttatttcatcggtgaaataaagtcagttgcatttctcttcaggattttaagaagttttaggtgataaagggttgctgtttgcaaacccaagagcacataccagcacttaggaacttcttaattaaaattcaggatctctgattataattcctgtgattcttgtcattacactgtgcttctgaaatatgagtgttcatttagtatatcaaaagaagaaaatgaacacaattttcatcttgggagaaataaaaccatacagtttctttatttcatgtttcttctgcaaattttgcttattactgtttttctacttgtggttgcttatgtaattctcttctttgataactgaatgatgtatcttcccaaatttagtaaaatataacttatctagaaactacatacatttaatttcaactagttataacggccaaagtccaggatgtgaagaaaataagcaaaatacactttcacctccccccaccaaaaatgccataatgtgtatgatatatgtataagtgtataaaagctcatgcatttgactcataagagaataatttgggctttacttagagcttgttgactctttttgcatgtaattgtattaagctgaatgatctgattttcccacaaagagcagattaaaactagccaattaaaaggaagcaagagaattgacagcagtgagaattaacaataatttcccacaggtattactcttcagtaactttacaatacaatgtttatggcttcatctaagatgtaaaatattaattatgctaaaaatgcttctttaataacgggttgtgtttgtgtgacacaagtgtgtcacacaagtgacacattgtatcttcttaaactatcttaaacataaataactcagaaaatattcctttgttgagcagcatttatgaagccctgcaaattgaattagacttgttgaaatatggataatgatgattctgcaataataccaatgtgcaagcctcactttttgatttttcagaacatactgaaattctattattcagtcctcaaccactgatttattgagagctatttatatgtgtcatacagtccagtctctccttagcacagatattgggacagactgattccaaggcatactctagaaatgggaaaatataaatgtttaatagaataatctgtaatttataacctacaaggaacaaatagctatgtgatgcatgatgacctctcttgtatgcagatggtttttgttctaactggaagaacggaattgtagcattttctaaataatgaaacatgctcccatgaaccacggggtatgtggtgggcttttattatagttttaacttctcagcctcttatgcacatttcctttgggggattcctctcagtatgatttgtggtagagacggggtgtggcttcagcagtggttatcagtgctgttctcttagtatttccagctttctgtcttacaggacggaattacctgaccgccttctggtagggtgagcctgtgactgctgtgggtcagtgagatgtgaacagcagtgatgggttttttccagctggattatccgagtgctggtgtgagacccactagagcagtacttaacctttattgttgttctcagggctcctttacactgttaaacatttttgaggattctaaaaggatgtagtttacgttagttatatctattgatatttattgtattggaacttaaaactgaaattataaaaatatttattaaattatttagaagagtaaaataaacccattccacatcaatgtcagtaacatattcatataaaaataattatgttctcaaaaaaaaacagtgaaaagaatagtattgtttaccatttttggaaatcttaatttttaactcaaaagaagacagctagattttcgtatcagcttctgcattcaatcttgaaatatctcagtgtcatgaagcctctggaaaactccactgtgtgttaattagaaagctaatggagaaagtgccatgggaaaatactaggtacagcagcaaaagaggccaaagagctgtggtaaaacgagaggaacttggccagccagtgccggttcccagatggaggcccacgggcaacaaaaagagaggcctctgagagcagagggtggccaccagccgacagcagcaagacaatgaagacctccatcctagaaccacgtataactgaattctgccaacaacctggatgggcctggaagtgggttctcccctatgcctccagtagggtatgcagctttactgacaccctgatttcaaccctggatctacagggttgtaaggtaagaaagaggtgttgttttaagccacttctaccccaaagcaagcaatgtataataatttatcatattaataaactaaaaaacaaaaaaacacgtttcatctctatacatgtagaaaaagcatttgacaaaacaccaaatccttccttcataaaaatcttcatgaaactaggaagtgaagggaatttccaaaaactgataatatgacatctatgaaaacccgacatagaacatcatatttgctggtaaaaaatgcaaagttttcttaaatatggtatcaaaagcacagttctaaaaaactaaactgaaaccttgggcttcattaaaatttaaatcttctagtctttgaatgacactgttaaaatttaagccacagactacaataaaatatttgcatatcttatatttgataaaagacttgtatccagaatatataaagaatctgcaaaactcacaaataagagcaaataagccaaggaaactcaatgacttgagctaaattttaaaatagggttaggttatggactgaaaaaccaagcttaaagggagaagtgaattataaggaagaggagcagcattaaaaatattacggagatacggccaggcatggtggctcatgcctgtaatcccagcactttgggaggccgaggcatgtggatcacctgaggtcaggagcttgaggccagcctggccaacatggcaaaaccccatctctactacaaatacaaaaattaaccaggcgtggtggcgtgtgcctgtagtcccaactacttgggaggctgaaggaggagaatcgtttgaacccaggaggcagaggttgcactgagtggagatcatgctcctgcactccagcctgggtgacagagcgagactccgtctcaggggaaaaaaaaaaaaaaatatatatatatataacatatgtaaaatatatataatatataatatatataaaatatgtattatatataaaatataatatataatatatataaaacataatatatataatatatacatataatatatataatatataatatatacacacatacatgtatatatgtcaaaaaatatatgtcaaaatatatatatgtatataggagatatgaacaaagtcaaagtttaaaaatatatagttagttcaccatagtttatgcttaaaatatctgttcttagtcttgttatccataaagttaatgggtatttgtggtgggtagacattactatttatttttcaagcgtatgataatcaaatgagatcatttctttcagtttataactgtaaattgccattagagatattatcatcactaatatgttattgtaattattatagggtattattatcatcaatatattattgtaattattattattgaagaactagcatatcattataaaaatgcaacagaaacaggcaaataacatctaaatattattatgaaaatagttttgaacttgcagatatccaggaattcccagactccactttgaggactgctacgccaggagttgttctttctgacatgataactagatagagtggctatctcttctggagtgaacacaacgtgtggcagagttcccagctaatgtataatgggacatttaaagagagtgagaaattaagttgttatgtgtttttttttttaaccaccgagattttgagagtgttttgtggctacagaataatctagtttttccttttatagtttccaaaacaaaaatgcaaagggccagacactcacttttttgaagctttagcaaccagaggtgagcataagacttatctgcagccaattacatactcctatctggtactttgaatgaggagcagatgtgaagaggaggtacagatgagagtttattctagtagttgtggtagctgtagaaacacccaggtaccagtggcagcaaagtcagttatcattagcaatggaggctctattgccagacatgtattaatgtctgatatttgacaaaacaagtatcttctcttagttcttatctgcttgtgaccttggttttccaatcatccgataaatactctccttgcttacattatccagctttctattctttgcatctaagaatctcagctagctttgtgcagtccgataaatgaggttttgctctataagaagttaaaattcagaactctccaggggtctccagacttctttgatcatagtccgtatcaagaaagaatgtgtacatgtaactccaatatatttctctgctagagacttggatcacttttataggtcagacaagtcttgctgcatcagaataccttattctaaaatgtaacctcactattctaattaaatgcaaagtcagctgtctgatggaaatgtaaaatattgtatataagtaatatacaaaaaaaattgccgtgcattgaataattgacactattgattttgcttcaccaataagcatcttaaaatataaattacaaacatgcgtgaggcaagtactatcacagaattttcaagactgatgctttgcagtggatgataggaaaaataatacagagataacattaggatgcaagctgtataggctttgatattttctgacagaggggttctggggcatggagtgagttcctaaaaccactagtagtttgagttgaaacgtcatttgaaaaagacatcacaaagttcctatggcactgtcggcctgctgcattgaagaatgactagtttccttttttgttgtattcttcatttagaagtagtgctgctttaattggcattttaggattaaaatttattaaaaggagtatgattaaatgtaaaagaaaatatcaacacattatttttcaaagtcattattttcaacattttagaaaaagatcttattttttttttttaaaaaaaaatatatatatactaagacaattagacttccccaaataccataaaacagacctttggttttttacttcattgtaaattactgaaattcattacttaattgtatgctatgaaattctttgaaagttcatgattactttcaagttaaatttcaagttcattggaaaaaatacacaaagtatctgaatgcataatcttacataattttttccagaattttaattttacggtgcccataaataatccacttaaagatggaaaacatactgtgcttcagggaagtatgcatacaagttgcttttatcataaatatctatttgactctaaaggccaaagagcctttttgtaaaaacggttagaattgtcggggtaaatccttttacctatgtaaattacagaacttgttgcagaataatgtatatgtttctccaggcttctctggtgggtgataacctgatagtttttaaaagtgcatcagccacaatgcacataacccatctcaaaagcatcttgatattcctgatgcatgaaataactgttttgaatgactggcaaagtgtatgagatggagatacaacagtcagggaaatacacacgaacagaaaccaccaagaggactgccagcaatttcattgcaccaagtgtttattcaactgtggaaagatcatatttggcatagaaagtacattctttacagaagctgactatattgttcaacagataatttgcctttatggctgatccatttagacttaagctggaattttcatgacacaattcatttgctgaaagcatattgttgaaaatgtgaatactttgaagtgccaggttaaaaacatgttttagcacgatttctgattcaaccatacaatactggatggtggaatagttgagtaaatgattggcgacctggttatctttctgagttgtaggttctgatggttcctgacttgacttatgttgtcagaagaagtttctgaatgagattatttaaaaagatagagttagtaaagatggcttgatatctatatggttcttttctttgttttgaagacaacgtagtcttcttttgaaaaaaagtcctcaaaatggatatcattgatagtactagtgtgccatcttctagaggaagaaaccaagtactaggtaagaggagaatgtgggattctcaacgataccagagatcactcatcagttcagtgcagagtactatacctatgctcttcaggagaaattgatagtatgccagttgttagcatgagagaattttatatacggtaatatgacacttaacgatggagatacattctgagaaatgcatcactaggcgattttgtcattgtgtgacatcatagagggtacttacacaaacctagatggaatagcccactctacacctaggctatatggaatagcctattgctcctaggcttcaaacccatacagcatggcactatatggaatactgtaggcaattttaacacaatggtaagtatttatgtatctgaacataccgaaatatagaaaaggtacagtgaaaatatggtgtaaaagatttttttaaaaaggtacacctgtatagggtgcttaccatgaatgaggcttggaggactggaaattgcatcgttcattgaatgagtgagtgatgagtgaatgtgaaggcctaggacattactgtacactgctgtagacttcataaatattatatacttaggctacactgaatttatttacagttatttttctgcaataataaattaactctagcatactgtaacttttactttacaaactttttaatcatttataatttttgactcaagataacacagcttaaaacacaagtacattgtacagctgtataaaatgtttttctttctttatatctttataagtgcttttctatttttaatgttttttcttactttttaaaattttgttaaaaactagaacacaaacacatatattagcctagccctacacaggatcatcaatatcactgtcttctccctccatatcttgtccagctggaatgtcttcagaagcgataacacacaaagagctgtcatctaggataacaatgccttcttctagagtacctcctgaagaacctgcttgaggccatgttacagttaactttttttattagtaggagtacatgctaaaataatgataaatagtatagtatagtaaatacatacaccgtactgtaagtacataatattaggtgctagatttttatatcactggtggcacagtaggtttgtttacaccagcatcaccacagacacttaagtaacgcattacactaagacgtcacaatgactaccacatcacggggtgacgggaatttttcaggtccattataatcttataggaccatcattgtatatgcgatccattattgactgagacgtctttatatggctcataactgtatgataattaaagatacatatgagaactttcttgctgataccgtttggatttcttctgatctcttccattttgagagcctatgaagcagcaaatagaagcctaattacatttctgttctcctcccattccccccagaatcctgacccttgggaatgggatctggagccagtgggaagcattctccgaatatgataatgtggttatcttctgacgagtgctggcattatcacttgttgctagtgagcattttttaataaataatttttgctcttgaatcttagaaatctttaatatctttaaaaccttgactaattgatttttatcatatgttcaccctcttggttgatttagaaaaaacaccaggcttgttctgaggttcacccgactccactgcatgtattacgtgcatgtgtaccttggaatggaaaatacatgactaagccctgtaagttatgagctttccagacactataattcaggctggcatgctttcattttgtcccttctttcattcttttctttctgcaagagcttcctacataagaggatgaagccattgtcattttatagactttgaaagcttatgctcatcactgaaaattcatggcttgtcaagctgaactgcgtgggttgttttgccttgtgagccacgtgcattaacactggctgtattggtgatcacagagactgagggcagcatctttattgggatagccagcagtgctgaatcaatcacgtcctgttgtggttggatctgtatgcagattgtctttgcacagcatgacttaataaaagctggccatggtggtattttattataattatgatgacttagttgcattagcatcagcctcaatcacacagtaaaagaatatttggtggctgaactaggaagtgtgagaacctccatcatttgactacttcagatggtgtattcatgatccttgaattaaaatcaggcaggtaaaagggttttcaatgaaaaaaaaacatgaaaaaggagtttgaaaatatataactactaaggaaaggaaaataaagccttgaaaattggtatcgcataagcttacgtggtatcattttgtcgtttaaaaaaatgtgtctctcagtctttacttagaaatatgtatggaactttatttaaaagtttcccttaaatgtgaacttatgtaaaatccttgtttagagtctttgttaggctaccatttcagaataataagattttacccccatgcatgtgatccaaagcattacacctctccaagccacctactaatcttgtctattcaaatgggattttttttttctaaataggagacaactctgcactgtatcctgctattcttccaactgcaggacctcatggagcgagagatccaaacctttctgaagtactttaccttctacctttttcatgctactcaggattgaatcaattggaagccaacaaagccattctgtgttactgtgcctcctgactgtcagcacgctgcactgtgcatttagataattctgccagaaggcatttttataaaaacagctttcaaaatctattcttgaaaagacatttgtatactcattatgccattctatcatttatccatagggagttctgtaaataaaacactgaggtctaatactatagtagctgatggcagtaatcttgaacagagtaatttctttttctttatttatctcgatagtgcacagctggttatgaaaaaataatcacaaggctttgttgttggtggtggtggctgccttttttggacagtaagccgtgatgactcagagtctctggtagaaataattgctttttattttttgcatacacctgtcccaaacctcttttactctaagataaacaagatggaaatagatttaccttaaatagatgaccatccacatattgccattttaattacataattatgatttatctatatcttctaaacgttaagcatttgtgagtgggtgttttgctatatgacagaattagaaggtaaatcctgggccgagatgtgaaggacgagcagagctttgttgccctctcccagcataaggaggaatacacacagagatttggagtatggaaaggaatgtggttagggaaatttaacttcttcagatggctgttttgtcaggtacctgcagggggcagagttgctgaaggttcaaatgcataggcaggaacctgattgagggcatggaacaaaggatatggattttattcaataggattagggaccattgaggtattttcttcaggaggtatatgatgtgatataatttacctattttgaagagtgttccagcaacagtatggaggagagctattatttaattatctttcctggtcagtttaaataatcatagcatcattggctgaagtgcaaataaatagtataccaaaaaagcattgggcaaaatgcaaataaaatacattacctttataaatagctacatgctagctcttaacacagatcattattttttaaaatttaaaccactcaactgatctcatatagaccaatctttagctgttaaaaatatgaatgttacaagctaacccctaacttatacctttattaaaacacaagtattgaaaattttaaaagaaaactaacagtaacaaagacacacattttttcaagcaatttattatgtgatgctgacatttttgagagaccttagacaatgatttttatttactaatgttaaacattacaaagtaaaattaatataagtaaaatagtatttttaaaaggtagatcacaagaatatactattagtagtaaatatttaaaagtacccccccaaactacatttcattactatattctgtcatccaggtacataccttggaaatgttttggcacagagtatataataacaaaaacaaaattggataatggcattgttctacctttatatctctgattttttaacacagcagaatttaataaatgctatgtgtctgcatataaatgtatgtgtgtatgtatttaacaaacaccatgtaggccttattatgtgcaagatactgtcatcagcactttttttcagttattctcatatatttaaaagaataaatgaaggcacaaatgaaaataaagaagatatggtaatcatatagctcattaatgttcagatatttttctccactaccacaagactgatcactttgttgtctgaattgccatgctgtctacagacccctcatctagttacaaaactggatgaaatgctttatgcttggttgttttcatatacttgtcatataattctgtttctgggtgttgttattaccagaaaggttgataatttgcaaaataagtacagataagtgaaaagagttcttttaaaaacctaatcttttttcttataccccagggagaggcagggctagagaaagagcaattcagggtcctctgagtgttctcttcattgcgatactcatagaattaactgtgcttttttctcttttctggattttgtatattgtatgactgacaaaaccacccctatttatctctttttttttacccctttgtgtatgcatatgtggttttttttgttctcatatatatgagaacatatttcatatatatttaaatatttaaatatatacatctaaagatatacatattaaatatacacacctaatatataaatacataaattatatttatatttgtaaatttatataaattttactcatggtaaatatatgattatcattcaatcaaaatatggaatattaaatgattaatttacgcatatatttccataatattagtcatctaattatatattactctttgttaaaacttaaaaggcctggaattaaatcctggcttgatgtatgcatgaagtgattaattaattcatttattagttaaactcatattttctgaagacttgtttcatgctagtgggagcccccagagtatcacaagtttagtgggtaagacaccctgtgtattaagaattattcaagtgctcttgtgcagggacctacctaactaactttcacaaaatcattcaaataatctaaagttcattgtctttgtttccctttgataaagtgaggataacagtatttgtcctactacctaggaacagagttctaatgctaattaaataggataacagatactacaaagcacttcctaagcctgaaagtgctgtgttgtataaatgatttagtagttcactgcttctcaaagctgattatctactagtttgttctgcataagaaactgaaggctgcttccctggagtttcttccagggaatgctgcgttgttttcatggggtaaaccacacacatcttccttttcttctacaattttgcaaggcagttataaattgtcataatcttctctgtcaagatgagcatttcaggtgtatatacctgttttatacataatatagttttaaatatcttgcagttgccaataatatcctctgattattcctgttttaattttttaaattgagactatttttagagcagtttacatttacagaaaaatagaacagtaagtgcagagagctcccatatacccactgtcctcccacacacggcttcaagtttgttttttaatcacatgtggttgtcggaattgtacacattatcccagatgtgatctagaactaactttctgtgatgctaagtagagggagaagtcaaagatgatacccatggtgtgcagtgccattgggatgtcagtcatttactcatttcagtctccaggaaaaagtacagacgagtgagtagagaatgatttcagtttttatatattatgtttgaggcatctgtgagatacccatgaagtcaggtacatgaggtacctagtgtgagattgtggctctcaggaaagaaagctcttaacagatgaagtgatggtggagttattagtgcaaagacagctgagatccctgaaaagtggggttgagcaagagaacaaagaggacccaagagagggcatagaaaaaactgaaggaacaacagaagatggagatgtttcaagaaaaatcagagttgtatttgtttggtttggttctctgcagaggcaaaatgaggaaaagggtctttgcatttgatttggccttactggcttcagtggtcttagcagagcattaacatcacagactgaagctggttcgagagtcctgagacatcaagaaatagagacagttgctacaagtgagttcagaatttggaatttgaaaaagagaacagagttatccgtgtttgcaaatagcactgaaaatcaggaagttagaagttaactttatggccagaattttggaggatgttttatctactttcagctggactctcttttatcatcgcaggtttcttcttggcactttcctcgctagctgccagacaacatgctctgatttttactcagtcatgtattgtttttgtctccccaatactagtagaaataaacatcccatccatgtttatattgattctaggttttaatttttctgtttgaatgtatatttcatttgcttatgtgtggattatagtgtcatttatcaattataatttccattaattctggaatatttaattatattttgttaacatttgtgatatattttaactctgtatttagctccgtcaataatgtctatcctttcgacaatacaaaattctaatgatattataaattcatgcagttatacttcaaattaattggacatttaacccatgaaaaacctatatataagacagtcattgaattcaaaatacagaacattcaataaagcgttagttttaggatgctacaagtgtacgatgatacaagcgtactttgtggtattcaagcaatcttgtaaaacatgccaagcagcttaaatgagcctactaaaataaaaaatattaaatatggtaaaaaaattatttaaaaaattatttatatcaaatgttgcactaatggggtaagtaaaactttattcttttatgctatggctggattataaaataatagtagcataatataatttttcacaattataatttatataagaaaaatattttgttcaagttacagaagaattttaattgagataatattacaataaaagtgcctataccacagtcttaagtctagaaccagtcagggtttcaatccaggctttgtcatttaggagctgtgtgtccctgggcgaaccataaactctctgatcctcagtttctgcatttatataatagggctaataatggtaactacttcataggtatttgtgaattttaattacgttaatatatgtaaagtgatcggaataataattgaatatgcattacttgaatctaatctctcccctatttttgtttattgactcagtctacaagtgttccttgagtacctaatgcatatcaatcattataatatggtcttaatacttaaaatggttgcaggtgtacccttgagaaagctcacagtctggtaggtaagagttatatcaaacaattaattgctacaaggaaaaagttacagtgatattacactatgtaagagggtgtctctcctagaactttatcacacaaaaaccacccttactgaagagctatagtaaactgagaccaaagtatgaaggttttagccacctgagagggataagttccagggaatgtcccaggtagacagtagagtgtctgagcattcagaagatgcatcagaagatgatggatgaggataatgttgttaaagataaatgcactgactgaagagaaatacaggtgtgatgtgaggcaggagatggaaaagagaatgatctcatagaacccagagttcctgttaaggatagtaacttatgtaccctaaatcattttggttttgttattgttctcctactatcataaaggtgacattattagatttgtatcttttaatggagggggactttctactttattgtgtgaatttggcttaatgagcatatgtataaatcctataagtcttattatgatggttattctgactgatatggtcagagtatgatatggggaagattaattgaatggtaaaagtgggtgtggagaaatgaggaggcaatttagtaatatagaagagggatttttagcatcctggcatagaaggatggccatagaaatgaagaaaagaagatagattttagaatccctagaagatgtaattggtaaaatgtggtgataggtaggtagaaaaagagatgagtatactatgttttcaaggtttctggtttacacaaatgagataggaaatataggatgagatatagccttagctataggggagttcataagttgagcatgagacttttttttttcaaattagttcttgattactctagaacttagagcaaactatggactgtctacataaatctaggagtcataaaatagagatggaaattgaaaacatagaactggattgagttatggagaaggaaagaatatggaataacaaagaaaagcgcttaagagcacctactgccctaaggaatgcgggcatttaatgatcagttaaagaaggaggaactaataaaggaagctaaagaggaatccatgggaatgtggtgacttagatgtctaagaaagagatcagaagtttgagaagaattgagaatttcagataaacatgtggattgccatgtgttagtatatcctgctcaagggtggtatccataaattttatacagatataactgaactctgagatttttccatagtacttagaagctaagatgatttgtatctgtttagggttggagctacttagggcacatgtaacaaaagcttgaaaatataaacaagtttaggttaatggtagagatacagctgctttgatgaaccactgaatctaagttgattggtctttcatcattattctcatccatcatcttctgactaaggatagaattgaagtcagaaagcctgatagaaatgaataaagtctaagttgttggtaaaaggtgaatgattttcccatctcatcatgtctcaatcaccacaaggacactgtcttgaaagaacgttgtctctccattcagttcttgggaagaactataattaatcatgttgatcagagctggacatttgttgaaacaagttttgctagcaagctaaaatattgtacctccaaagcaagagccagtttggcttcttcctttttaactatctggcttcctgctttgtgcttcatttgcttctcctctgcctttggtgaatgatattttgcatcatgtctctctgtgagagacaaagcttgtgaagagggctcttcagacacaaaacatgctgattctgaccccttcatccagcaaatctgcatgcttagccacgcagctgggtgggtaggttcacttacctctgtgagcagttccaagacctagattcagagtgggaagatccctttcaacctcaagtctaaactacattctacaacttgacataatgaagagattatgaatggtgttcctgcctgtgtatgatcccaaatagtgagaccttgactaagttacctaacctcacgattcttcatctaaaaatgggaaatgaataacactgtcacaggttggtagtgaacattgaacaagttaatacagggaaagcatttacgcagtgcctacagcatcacacttaataaatcttagtttataaaaattattgttttatcagagagcgttttatggcagtttagagagtccttagatttatttttaattttttaaaatttttatttaaagtattttgttttattctttctcatttgattggcgatccttgaatacgtattcctcctttgctctaggggaaagagggatagtgggaagtgtggacactctgaacctctaagagcagtggaagaacaggtatcctaaaggtaactgagcagataaaaggaaaagacaggaagttggtcctggaagtatgggcagcatgaatacgtaccatgctagagtcatatagctgggaagacatggaacccaaatttgaaccaaagactcaaaaggctcctaagtcttactcttcccccaacactatttttcagttgttttcagtgcacctaagaaaattaagtggcagtcatttattaagccagaataaaaaacaaagttgatttatctgcatgaaacttgaattacatcaactagcttaatttttttgttggagtaaaaacaaagctatggaaacagatgaattcatcgcttatttaaaaaaccagctcttgaaaatttcatgtttgttatatttattgttgtagtactttgtaagttgtctatattcagttatttaactgagtatattacctattcagcctaaagaaataaaaggaatatagtattattgtgataagggagaaaatttatttatctaggtacaaggaataacatgggatgttaattttaacatgtgcattacccaactaatatagcttttgtttcctttatcacatttttccatacttcctaccctacacaatttgcctcgagtatttaaatgtggaaaaataacggggtaataaggtaacatattttttcaattaaagcgtggtaaaggattttgaattttttaataaagaattttacttttttagtattaaacaacaaaatattgagatacctaagaaggtaatataagttgaagtactttataagctttaaatagtgtatagctgtaagatgatactgctattaaaaaaataagtaatactatttatataaaattctcaaatttctcgagatatatctaaattattttcattataatagtgcatttaataatcatatcaaattacatttatatccaaagcttgttggttaaacaaatacatgtttaaaatagttgagcttgtgaaaatgaagtttggctctatttaatcttttgggatccagatgcaacttgaaaatggaaagaaatcatattaatttaaaatattgctatgtcatacatttttttaagttgattcagaaaatccaagtgccatcaaatgaaaaatacatctagattgtaactatattaatctagatatataataaggcaatgctgcttttattttgccttacaatgaatcattgctcagttatcatatattgaaacatactattggcaaaccatacaccaattcccagcagttttcactggagacagtgttacaagaggccattgaatttcacttttttgaacctccgttgctggggcattggttgctggattgttattctgttagcatgatgaactaattgacctagcagggctccctgtagaataacagcttctgcttagttcatcaggagtacaatttgttgtttcatttcctcttctagtcccattggggaaattgaattgagaaaagactacctactgggagcgttcagtgctcatgactgaataagtaactttatttatgtatttatgtatttatttatttggtactgtcttaattagcaaagaaggaatgactctattaggcaagagtcgactgtgtttttgatacaaatgaataagctccgttagcaaaacatttgattcacagagacttgtcatagtcagggccccttgcaggtgcagatcttacataaaattttaatttgctatggtagagcagttttctgttttataattgttattcattcaatgaagacattgaagacaagttaatggctgttaactggacttaaaaaaaaaacaaaaacaaaagcaaacacccataagttggaagtttggaagatagattcattgggccgcatacaaacatgaaatgtcaactttgcctcaataaagatgaattatttatctacagcagtgtccaaatgtggacttgaacagtttgtcattaaattttgaagcctttacaatttttcagttgcatcattgtttcattagtgtgtgcattcttagtcaacaacagagaacatactatctgaatgtaatgaagaatgaagtctgatgatacattttacattttttaagaagctattactagtttctattgtgtcttagcaaattcttaagtgtattaagcagatgttctaggctatgatttaaacgtcccctatattacaatctcacatattttctagaacactgttcaatttgttgcttagcctgagagtaggggaagagtagcatagtcattataaactcttgctctgaaataagatatccctgattcacatctctgctctatccctcacttgctttgtgaccctggacaagcagcttaattctccgagtttcataaggttaagttttggataatgagtgttcctataagggaagctcttggaaaagtgcctagcacataggaactgctcagtgggtgttagcagttattacatgtatttcctaataatccagtgcaaaacctggtgcaaggtgtgtgctcgaaaaagttcaccaacgaatgaatgcatgaatgaatgaacaaggggaaatcttgcccagaaaacctagaattattagaaatccttgtctgtcctacatatttaaacaaaacagcacatttctgtatagttataaaattatacccaaatgtagaaaaggctctaaatagcttggaatctgtatttatataggagaaacttaatatccacaaaatcattacagtatcttgtaaagaattgagagtttactcacaagatcgtatgagtccagatgactagaaatagcatttaaagggtctaccattaatacaatattgtgaaatactggtatttttttctggagtatgatttataacatttttatgaacctctgtaaaagattttatttgtatataattctctgatttttgaagtgagggagaaagactcttcttgtgctaagtttgtacatgttctatgccagatattctgaatttaaaaaatacatataacacatgatttctttgtccaaaaagtttataatctatctacttgggttggcagttgtgatgcataataattaggatttaacatatacactacactgcctattatatatatatatagcattaaataatgtatcacatactctaaatccatacattaggaatttaagaaaataaagaaattttcttcaaccactgagtatgtcctgcttccctttggattgtatttatgtgaaactgttgaagtaagataattgtctaattggatttcttagaattctcagaaagttttgaaatctaggaaaaaaggtgaaaacacagaatttgtattatgggagttgttttatattatactaagaaataggaggacagaaacatttttttcttttcatgattgttatttaagtaataagatgtgtgagagtgtaaagcatagtgtctggcacataataatctttgtgcttgccgttcttcactcctttataaatccatgattatcaacaggaaaacatggaggctattgtaatcaaatttaacccaaatggaaggtggtattagtagactcagtggtccatggtggccataatgaagcttccataagagatgttatttggaaaccaaccagttatttctgtttttggctaattcttcaaaaaaaaatctccatttgggttctttcttttagaggaatgtggtatttttaaattaatttaatttaaaaatttttctcaatattaggacataagatgactcgaatacatatattcatatgatagaagagtaatttttatctttttaaaatatgacagcaacaataatattcacaaacattaccttggctgttcttggtcttcttacaattagtaagaagttgggcactgtgactggatctggacaatagtatatgatgtgtgtcacttttgagctaattcagcccttgtatgatactacagtctctttccctgccttaaggaaattattatcttctcaataatggtcccaggtcaatagatttacacaggtaaacaactgaatcttcctctttatctcagacctacaaaaaaattaattacatgtagattgaatgttgaaagatgaaagaccaaacaataatatttcttgcagatatcatagaatagtttccaaatccttggttaggcattattgttttttatataagacatgtgaaacatcaattataaatgaaaagattgagaaactcaactttattaaagtttaaaaacttatcaacgatactatttcctgaataggagtgggagaagggatttgtaatatatgtaaccactgaaggatttacatacagattctctatctttaaaacctcttacaaatcaataagataaaagcaaataacccaataaaaacgaaagagaggaaccaaattattgaataggcactcaaaatgagaatatacaaatggctcataaatacattaaaaagtgctcaacattattatccatcaggaaaataattaaaaccatagtgacataccatcacttatctattactatgactattaaaactttcttaaaaaataaactgacagcaccagtgttagaaaagacaatacaactacaaggactctcaaacattgccactgggggcataaatcagtacaattagtatggaaaactgttttgtagtatatactaaaattaaacttattcattccctatggtctagcaatgccacttctaggtatacagtgaacaaaagcatcaatatttgtatatcaaacaatgtactggatgttcattacggtggtattgtttaaagcccagatggaaacaatgtaactgtcctatcaacaatgaaatacaaaaaaataaacgagaatattcgaacaatggattatcatataacaataaacaaatattgctacatacagcaacacaaagtcttccagcataatgttgaacaaaaaaatatccaggcacaaaatggcttcctttatataaattttatttcttcaaagttcaaaaatggcagaactaatctgtaataacatcaaagttgctttttcctttagggagataaatgactgaaaagagttataggggagggagttgctagtaatgttttgttttcttgctgcaaaaacacagatgagtccattttgttaagcttcattgagctgtatatgtatgatttgtgcacttttaggtttgtttattacactgttctaaaattcaacacagtctctaagcaacttatttaaaacagctcttttagtaactatactagaaacagaaacaccggtcaatataatctgggaaaaataattatttttcagttcatgaagaacaaaactagactaacaaatgttctagaaacgcctgccttttgttatttatccttgacttaccaaatgatatcttccccctccctggccctgccatctcttcgactaccctccttcagcgttgctacttggcaggcatttgtgaggaacttgactttggagtctcagtagcttagtcccaaacaagccagcacaacatcagcaaactcaattggcaggaacataaaagtatcttcagaaggccaagggatataatgtgaaatctctgtttgcctaccttttttgtttgagttaagctaaatggaagtgatttcagcaaaatatgagatgtctcaggcttttgattgaattctggatgtggaagtagctagggaaaactaaaaatttttttggaaagttcaagcccctaagtttccaatgaaaaatttgcatagtggaggaaagccaaggaccaaagataatatctactgcactgtgaaaggcctattctgtgatcaaaagcaaaaataaaacaaaacactttgattggcagtgctcaagataaccaagtcttttcaagcagatgctgtgataggggaacccatatagaaaagcagagaaaaaatgcgagaaccgtggtgatcagcaactattgttatctccacctgcatcaaaatagtgataaatgtaagtaaattataaagttccatacaaaatacagtgagttgtatgcttaatattaacgggttttactcatttgtttaacagaggcttattaaacagttttttcatctcagcgattagctgggcttgtaatatccagaccatcagacatctagctccaaggactcataaccagatgataggagaaagaagctgagattataatactgcgataaaaacatttatataaaaatgtagttattccaccagaagaatgtaaaccacagcccctaagcccttgccaaaccccttctcagaccttgaccttccattaatttgtctgtttgaaccctaggattttgcacattttgattttttgttctaggtgaaagcttgagagttccttgcctctactatgcccagatctcagcccaaagccatccctgatcccctttcccctgcaggacgaaatttcagtttgctgactctgctgtgctcaaagaaccttcgttttttgtgattatgtgcttatttttagtttatttttttacctccttctagcgctactggattataagttactttgggatcaaggccatttctatctcactcattgtggaaacccagcttctatcgctctaatagtccttgagtaaatgatgagtgagctgcagtctgagaagcctaggggacagaatgactcagctgcttggaggaaccaagaaaagcttggaacagaacagagtttgcatcgctgtggctcatggtgttgctctataattacttaagtgacagttttcttatacagacactttgtcctagacaatatgtaaatggaaagaaagaataccatctacttctaaattaacagctcctggggctgcttctcccacccccacctcccatatgcacttgtgctcatatgcatttgcatgtaatttctgtagtaccacagatctgctaaagcccatcagagactgcagctcacgaaagctgccatgtttttccttttaatttccaacttttgttttaagtttggggtaccatgtgcaggatgtgcaggttggttacataaatgccatggtggtttgctgcagagatcatcccatcatctagatattaagcccagtatccattagctagtcttcctgatgctctccttcctctcacttctcgccctacaacaggcccctgtgtgtgttgttccccaccatgtgtccatgtgttctcctcattcagctcccacttataaatgagaacatgcactatttagttttctgttcctgtgttagtttgctgaggataatggcttctggctccatccatgtccctaaaaggacatgatctcattcccttttatgactgcatagtattccatggtgtatatgtaccacattttctttatccagtttatcattgatgggcatttaggtcgattccatgtctttgttagtgtgaatagggcttcagtgaatatacatgtgcatgtatctttataatagaatgatttatattcctttgactatatacccagtcatgggatttctgggtcaaatggtatttctgcctctaggtttttgaggaattaccacactgtgttccacaatggttgaactaatttacattcccatcaacaatgtaaaaccattcctttttctccacaacctcgccagcacctgtgttttttaactttttaataatagctattcttactggtgtgagatgatatctcattgtggttctaatttgcatttctctaatgatcagtgacgttggattttttttcatatgtttgctggccgcatgtatgtcttcttttgagaagtgtctattcatgtcctttgaccactttttaatggggttgttttactcttgtaagtttttttaagttatttgtagatgctgggtattagacctttgtcagataaatggattgcaaaagatttctcccattgagtaggttgtctgttcactctgttgatagtttattttgctgtgcagaagctctttagttgaattagatcccatttgtcaagttttgcttttgttgcaattgcttttggcatcttcgtcatgaaatctttgcctgtgcctatgtcccaaatggtattgcctagattttctattagggtttttatagttttgcgtttcacatttaagtcttggttttttttcttttctttcttttctttttttttttttttttttttttgagacagagtcttgctctgtcacccaggctggagtgcagtggcgcaatcttggttcactgcaacctccgcctcccaggttcaagcgattctactgcctcagcctcccaagtagctgggattacaggtgcctgccaccatgcccagctaattttttttttttgtattgttagtagagatggggtttcaccatgttggccaggctggtctcgaactcctgactaggtgatccgcccacctcggcctctcaaagtgctgggattacaggtgtgagccactgcacctggctcacatttaagtctttaatccatcttgagtttatttttgtatgtggtgtaaggaaggggtccagtttcaattttctacatgtggctagcctgctctcccagtaccatttattaaatagggaattctttccccactgcttgtttttctcaggtttgttaaagatcagatggttgtaggtgtgcagtcttatttctgggttctgtattctgttcccttggtcttggagtctgttcttataccagtatcatgctgttttggttactatagccttgtataatttgaagctgggtagtgtgatgcctccagctttattcattttgcttaggattgttgtgactatagggctctttttttggttccatatgaattttaaagtatttttttctaattctgtaaagaatgtcaatggtagtttaataggaatagcattaaatttataaattgcttttggcagtatggccattttcatgatattgattcttcctatccatgagcatggaatgtttatttgtttgtttgtttcatctctgatttctttgagcagtggtttgtagttctctttgaagaagtccttcacttcccttgttaactgtagtcctaggtattttattctttttgtgaaaaagcctgatgttttgaagcactggcttcctcattttttgtgtgcccagacacagcttgtcgaggcaccacattcagcttctatgtacctttaattaactagcaatattagtagataacacttactatgcatctagcatattgtttcatttaacaatggtaaccaacttatcataagagaggtccacttatcttcccagtatatagatgaggacattgcactagagagattaataacttggcaaacacccacagcttttaaggattggagctggacttcaaagccagggggtctggcttctgggtccttgctctcatccaaacctctaaactgacactctagaatcttgctgcatttcaggctttgtgtcttactaggaaataagtatgattatattcattttatagtcaaagaaacttgaactcagcaaggtccagtgacttgttttaggtcacttacatattagtctgtgatagagcttcaagataacccaggtgaatcttactacaaaatccatgatctttacactacattagaattcaaagcatctggcacatagtaggtgctcatctctgaaaaggcaaagctggaaaaaggcaaatgcagggtggattgagccaatatgttttaagatgtttggttttagtgtgtcattttgacacaaggagtttgaaaactcttcggtgtgcactcccttgccagcgcaggaaagtgaggaagagaggacagccgcataagaggagagtgtgggaaggcaagaagctaccctactgcaaatggagagttgtgaggaaccatcattaatgttctttcatacaactgagagttgtgagaaaccatcattaatattctttcgttttatactattttggatatgggctttggaagacaatattttcagggttattatgactcagacccagtttgtgccatggccaaatgcagggatgcacacacacttacatgtctgcatttatatttaactcttgaaagatggtcaaaaagatggtcattttcagcttggttaattaaaaaaaaaaagaatgctcacgttcttgatttttcaatgtttttatcaagaacaaatttgctgactcttgattctcacctctactatacagtaggtttgatgtatagctgaataaaatgcaatatttgctatatgattgatttattctcttaactcattaagtgtagtttagtgtaaattaatcatcttataagagaaattgtttttccaacaacaatttactgcatattttatttttatcctcaacctatatcagaactgctgatttaatataaaagaaaatccaaattaattgttttgtatgctatgataaaatctttcatatttatactgtaaactaacagagtagataggcaaatactattttgtcatgcaagcatcattttatttcagatatctgaggcctgataagttaccttattactcataatttttaaataaaatttttaaataaaaactttattgatatggaattcatataacataaaaatcatgcttttaacttatacaatttagcgattttatattttcatagagttatgtaatcatcaccactatctaattttaagactattttccataaccccaaaaagaaatcttcagcccattagcaatcattattaaaagacaattatttttctatggaattgtcttgggacctttaggaaaatcaatcatgaatgtaagggcttatttctgtactatcactttcttcttctttttcaagtttgttttgtcaattctggatcttttgaatttacatgtgaactttaggattaagattgtcaatttctgcaaaagcatcagtttacattttaatagtgattatattgaaactgtaaatcagtttgagtagtattggtattgtaataatggtaaatatcctgattcatgaaaatgaatgttttccatttatttactttttttctaagtgctgcatccagtgttttgctttctctgctatgattttgttttcattcaccttaaagtattacataattttcttttgttctcttcccttaaatcactgcttatttaagtatgttgttgaatttcacatatttgtgaatttcccaaattttcctttgttatttatttctaattttatttcattgtgttaaaataacatatttcaatattatttcaattcttttaaattgagacttgttccggagatgttccaggtgcatatggaattaatgtgtatttttattgctgttgcgtaaagtattctatagatgtctgttaggtttagttgatttatagtgttgtttgagtttctattttgttactgattttctgtccaggtgttccattcatagttgaaagttggctttgaagtctccaactataatttataaattgtttatctctcatttcaagtgtggccactcttgctttttattttggagctctgtttttacgtgtcatgttaatgattttcatgtctgcctaatatattgatcattttctaattatgaaatatacttctttttctattaacagattttttcctattactccagctttcctatgggtactctttacacaataggtatttttccatccttttattttcaatctatttgtgtttttgaatttgaagttagtatctttatatggcatctaggtatatcatgtttttgttttgtttttccattctgtgaagctctgccttttgatttcattatttaattcatgtactttacttagtaaagtaatatttggtccatttaattactgacaaattaggatttatgtcagtcattttgtaatgaatttgtcatgttttgctatttgaatttgttttccatatgttttatgtgtttttctctcttattgcttccatagtcttttctaatgtaaaatatgtattttctaaggtgcaattttaattcccttgttatgaaatttgtttttatatttgtttattttgctttgtttgattttctagcttctgctctgcagattacaattaacctcttcatttataataattgggtttgttaaattaattaaataccaacttgatttcatttgtatacaaaacctgttccaatacagcttgtgtccccctagctactttatgctgtcattgttatacagattacatccttacccatcctaggtctaacaaggcaacttgtaactgttgctttatgcagttgttttttaaattagatgaaaaaaagttgtgaaaatatatttatactatcttttatatttacctatacagttacctctctattttttcatgtgatttgaattaccctctagtgtccttttatttcagcctgaatgactccttatagtatttctcttacagcacatctactagcaacaccttttttaaaaatttttttgttttgttaaatatggaaatatccaagcttctccctcaatgttttggaggatagtatttttctgaatgtagaatccttgcatgacatcttccctcccacccttgaagaatttcaaatatgttatttcattgccttttgacctccatggtttcggatgagaagtaaactattaatattcttgaagatcccttgtgaatgatggtccgcttttttcttactgctttcaagagcctctccttgcctttgtctttcagcagattgtctatgatgggtctgtgtgtggacttcattgatttcatcttacttggagtttgttgagcttcttggatgtatagatttatatttttcatcaaattttggaagttttcagccagtatttatttaaatatttttattctattttttcctctcctctacttactgaattccctttatgcatatttttgctcagtaatggtgttcagcagatctcaaagattaatgaattttgactgaatatttatataagtgtgcagtggaagaaggaaatattttgtttcagataataaaaagtctttatactggctgtgcgcggtggcccgcgcctgtaatcccagcactttgggaggccgaggcgggcggatcacgaggtcaggagacagagaccatcctggctaacacggtgaaaccccgtctctactaaaaatacaaaaaattagctgggcgtggtggcgggcgcctgtagtcccagctactcaggaggctgaggcaggagaattgtgtgaagccaggaggcggagcttgcagtaagcccagatcgcaccactgcgctccagcctgggtgacagagggagactccgtctcaaaaaaaaaaaaaaaaaaaaaaaggctttataaatatttagaatgctgggaggtacagcttggagaagtgaatatttaatgttaaaatgtgtcgttattataattatagcagatataattttgatcacttaactaattttttcaatattaccaaatttaattctttacataggaataattacagaagctttattaatgggttaagatccataaggcaatttgtaaataaacctatttgtctcaaagttccaggttgctttactacagctttattatagctatcaatatgttttggctgagagcagggtcagtgcactctttccagagagcatgaaagcttgaaccttagtagttcatatgtagagtgattctgtattcccattttatagatgaggaaactgaagctcaaagagatttaacatttttaacataatttttgttatattatcaaagatacataaaattatgttccagactggtagattataaatagtttgtgagcggggtctttgatttattaaattcttatcctcagttccaagaacataatagatactcagttagtgatgacacagtattagaatcaaccaattttacaatatatcctggccattgttgaggcatttatttcctgtactctatagattttatgtgtataaatctttggaaaatgtatcaacatgatatttgtatattgaaaatgtcactcttgaatgtattattgtcattctttctggattcgtccactagggctaccatagcaaaataccacagactgggaagcttcaagaacagcatttattttctcatagttctggaggctggaaatccaagttcaaggcaccagcagatttggtttgacatcgggttcctgactttggcttgcagatggctgtcttcttgctgtgtcctcacatggccttttctctgtgcaagcactctataccattcctattggattagggccacatacttattatctcattacttattatctcatttaatgtagttacctccttaaaggtcctatcaccaaatacatttacgctggaggtgagaacttcaacatatgaattttggggagacacaatttaatccataaaaccctcttttgtgtaatgattctgagatactgagaaaaatgctccatttcaggtatttttaaatgaaaaaaaaaatcgtatcaactcctgccctttaactttcaaagttaaaattcatgttagatgattatttgttttaaaagtgcttactctggtgtgctttttaaaagactataaatcccattaataaagtcgaacagaagcttgaaaacaattaagaaatttaagaatgagctaaattgttctcacaaaaagaggaaaactacaattcctgctgaacaagtctttcattcagttcttcattcaattcacattagcctcaattggaaaaatgtccctgttcagttaaacaagttaagcctgatcttaagtgtatctgacttgccttctatgttcttccagccacaggaaattcctccatgccaattttttaaaactgctatcaaatcttttttttttttttttcactcaagtgcgacacatttaaatgtgaccacaggaacaaatggaaagagattgaagccttgacttgaaatgtgagctttcctctttactagtcagtaaggtattgagaaagttacttgacctcatccttcattaccttgtctctagaattaggagatcagcatgtatggtgatcatggaaattaaataaaattatatgtcagggcctattgcatttattgtctgactcatcctaatccccttattcctttcttagtgtttctttgtttgttgatttatttttgtccatagtctcatgatttggagatagggctccagctttctctgctaatgtatttcctacccctctcttcctctgtcagtgactggagaactatcttcttctgacatgcccagctagcttctacttcaggactttatatgcctgcttcccgcaatcatatatatatgtgtgtgtgtatatatatatatatatatatacgtatatatatgtgtgtgtacatatacgtatatatacatatacatatatagatatgtgtgtgtgtatatatatatatgtatatatatagagtcttgctctgtcaccaggctggagtgcagtggtgcgatctcagctcactgtagcctctgcctcctaagttcaagctattcccctgcttcagcctcccgagtagctgggactataggcgcaccaccacgcccagctaatttttttacttttagtagagaagagctttcactatgttggccaggatggtctcgatctcttgagcttgtgatccgcccgcctcagcctcccaaagtgctgggattacagcctgcttcccacaatcttaaccagtcttgtctcatcttcacatagccaactccttcttatccctttgatgtgtacaaaaatcacttcttcttgtggcccttataatcactcacatcctaaatggcatatgtgttcctactatgctccactgtagcccataactatctttcaccttgttaaattttcagcactttccactgtatgaaatgatcttaaggggttgtcctgtctctcctatagtagagtgtaccactggaagaggcagagacattttctgtcttaatgttggtatgtagtggggtctgaccatcaatatcagttgaattggcatgggaatggatgactctgtacataggaggccaaacaaataaaaattttaaaaccgcttatctgacaggatcacgcttttttcacttcggctgttgttagttttaattctctgaagttatacatggttagataaaatggtctatgaaagtcctgggtggtgatgggactagagacaaggattcaaaatgtattatagcaaatttatgtgtagaaaaaaacacgtggttaattaagacttgctttctgtcattttatgaaggtatctatgtaaggtcctagttttctccattatacatagctgaaagaaacaccagtaatgaaacgtttttgtattattctcactccaaaagcctagttatactgagggcggccaatagatctactatgggatacaatgaatatttaatttactttgatgaaaaggtgtcataagagcctttgacaacccacagtgaaaacttgaggatgattttattaactcaaacccgatagcatatgttgtgcaaactaagacatcaaagactttttaaattaatacctgggaatttcttgggagaagtaactgcatattaggattgagaacaactctaagttgtcacatattgaaatttgtttttaattactgaaaagtcattttctcttatttctggctcgggtaaatagtaggaaaaataacacacacatacacatacacaaatgatatcaaattaaaagagagaaaacaaatgtgaaaggattatggtgtgaactgtttgctttccagcatattaactgtacccatgaactctcatctcccgccccacagaaaaaaactaattattggaattttttagtgaacaggaaggatatcagagtacgatactttctgtttcccttaaatgcataccattttctctattttcatagtttaccagtttcccagtagatggcaccattgtgactcacaatgttgctccaccttgtaaggaagtattatacacactttcaatttcaaaacatttgtaaatagtgcagtatagtaacacttgcggtggtgtcttagaacacaaatacttctacagtatctagaagacatgtcaactgttgaaagccaataaatgtcacaagaacccccgtaattcctttgtatatgtgtgatttcatatcttataatttttatacatttaaattattttaataaaaatgtgcttacatacatgtacacacatatgtgtatgtatgcttataaatgtctaaaactgtataattatttaatgatttacttactactcttactatttctttctacctggattaatgtgacaagccactcagagaaactgaaaattcccatgggcttctccagttgttcttgggaaaaaggagactagaacagtgatttcagatctggaatacactggactccaacctcagattttctctttgctgcctgtattacctaaagcaattgacataacctctctgatattcaattttcccacctttaaaatggggaagatggcatatacctggctgtgttgctgttaagggtaagttttaagctgtgtgtgtgtgtgtgtgtgtgtgtgtgtgtgtgtgtgtgtgttgcaaaaataaatacagtgactgttatagagtagaagttcaaaaatggtggctgcattccgattacagcttgcattaaagttgaatattaagaacaggagagatcgatgatggtgtgttttgtaaccttcacacggttttctatatcataggatgagtcctagctttcagagatttccttgcgcctatgtctaccctttcttttggtcctagaaaaggtcacagatttaaagtaagtcaatgtggaacattaacatggctcatgcaggttctgtgcagctgtctctatgggttcttgaaataaaatagggccaaaccaggcacttcaaatggtagatttgaacaataaatgataaccactgtctctaatatccaaatcattccctactcatccttctttaggctcatagttcattgcactgtcttcttaaataactacccgaacacaactccacttttctcacttctaatgcgtacatttttagcaataggttttggttagggtcttctctgtccacatactacaactgtgagtacatgactgacccacacttttaacttggtgcttttggattcaggcagatgtttagttccaagaagcctttgagaatcatgttgtacttacagaagcactcactatgcttccttttccaagtgattagtctttcactattaattcattcaacaaatattgatgcaacactttgtatgccagttactatgcagacactaagttgtgccctcatggtccttcaactttacctgaaaataatatattttatttatttaaccaatattaggtatcaagtgttttacaaacattgcctaattttatccttgtagaaccctaggaactagaggccatagattaaagatgtggaaactaagacacagagaataagacatttacagaaaaagaagtgaaggaaggagggaaggaaaaggagagagaaagggagggagagaaagaaaaaagggaggaagaaagggaggaagagattcaaatgttgacaccctaacctccaatgcagtggtatttagaggggggtacttgggaggcaatttgatttagatgaggtaatgggccaggggctctcatgatgggatcgatgtctttataagaggagacaccagagagcttgttctttctgtctgctgtgtgaggatacagcaagaagaaagccaggaagaaagcccttgccagaaacagatcatgctggcaccctaatcttggacttcttagcctccagaactatgagagaataaatttctgttcttaaagccacctagtctgtggtattttctgatggcatccctagcaagttaaaacaccattttttgattttctgaaactggtacctggaggtagaatggagggaattaaaagaaaaggtaattagtagtgtcagcattttagcccagatattaaaatggggatgaccttcagtttcctaaatttgatgaaggatttggtgaaggatgagggatgtcattattgaaaaatatgtatcagactttcgccttttccaagaagtcagtcacagctttcagatcccaggtatgtttgaaagtgactttagtctgatcttttcatgccacttagaattcccaggcttgccagtggaacattttgtagtaacatttaaaaatataaacttttcatttcttgcctgcagtggagagagctgattcacgatgagttcctctgtccctcccttcaccatatgtctcttcttcattgttgatttcctgttgacattaaaaggagcaacatatgaaggagttagaaggaaagctttaaatttaacgataaacttttttgaaagcatggatcagattttcttacaaagccatttaaaatgcattgtaaatcatttctttcatattttgtagagacttgttttggaagtatcgatattcccttctccccagcccccaaaagattaagaaaaatataaatagatttatttttacaatgtaatgagatgagagggatcctgtgagcaagctgataagtcttgcaattcactaacatagcccatgaaatccagctctgatgtcaagaggctctaagcattttgcaattcttaacggaatgttttctttgcctccctccttccctttctccatttgacagcacctgtgcatgtgcatgcaagattgcttttcagatctatgctttggttttttgttcatttttgtcagaaaagtcagcctatgcttattagggatctacaggaattgtttccacatggttctaatggatgcatggacggaacacctccacaacatgttgctgttggcctggtgctctgtcactaccaagatttcagagttcatttcttggctcctttttgttcttcctcgatccaagttcacacttcataatacgttttaattgtcatctcaatgagatgactcaaatttatatattgatatatctgtatcacaaaaaaattgcaaattgcgtgcattgtcaatgtgaattatagatagtatgctatgaaaacaaaaatattttctaatctgtctgacttttagtagagaagtcaagatgagatcataattaatccaggcttgaattaacatagctggaatagttaacatgggcatagtccctcatctgtctttggctatttgggggaaaagaaatacatgttaaagtgaaaattagtggaggaacttttaattagtcatacatttttactcagtttcatacacaagaatattcattttggccataggaaattgccactatttgatcattttgattgaccaaaaaaagctggcaatttcaaatgatgcaatacaggtcaccatcactgcttccaggaagcttacatcctaatgttaacaggtaaataacgaaataattaagatggctttagtgtaatgagaggcagtgggcagaagggggcatgagaggctctttcagatggtctgatcagggcaagtctctctgagaagacatttgcacagtggcctgaatgagatggagccagactgccataaaggtgactttacatctgggagatctgaggcagcaacgaggcaggatttttgagcagcagaaaggaggccagcatcaatgaaggaaagaagggtggaaaatgagaatggaaatagaggtcggagtgaagtggatgtgcagaatactcaatatcattctgatttttttccccatgtggcactattaactttagccactctatttaaaattgcttattgtggtggggggtgggaggaggtggttagaaaatgtatgtttaacctattcacttgcctttatttcttgttccttaagttttttaatgctttctatgacatcgctatcccaatctctactatgcttgtgtcttctggtttacccccatgtttctttcatgccttctcccagaggagtgactcacagtttgcatatactagacccaaatttttagactacagccaaagtaaatccacgtacagacataggggaaacactgagattggggatgatcttattttgtttaatttctagaaaaccaagttaattgagataaaggaggcatatttaaaaaccagaaaaggagacttaggacaatggaaagatttaaatagatacccttagtgaacataattgaaatactcattatttacattttctgcaacatccccgaatatttaccaaagtaaagaacttattaaaaagtatactataatttataatttcaggaaattataaattataatttataattttagtgtgactaaattagaatttgagaaatacaaagtttaacatgtttacacaaatttgtcgtttaggatttaaattatatttcaaggtggaagaagagagtgctcctgattacaaatggagaagtggtagaattctcactgaccacaagaggtctgcctttgattctcacaatttcacatgggacctttctcttaaaccttcagtactatgattggcatttaagggtcagacagtaaacatttgtataccgaatgacggaatcaaatattgaaggtagaactcataaacataatgcaaatataaatgttatatgttaaaattatctttatgagtaaggaaaattctaagcttactctgtatttacaccactaagaatggatgattatgagttcatttaaatgtttgagttttaagtgtcactttgcattacatgtgtttccttaaaggaatgtaattttggctcatgtgatcaacttgatatacgaatttcatatggttaaagaatctattggcaatctctctcttcattggtttacttttaaagattgattcttctagaaaagggaatattttagattgcttcataaaattagtaaattaaatgtgtaaatgaaaccatttgttcattgtcatgttactcagagttggcatagaacatacgtggaactaatgtttttattggcacacttttccatcaactactgccaccttccaggaatgttaaattgatcaagttagtacaaactaaccataaaacacttttatctgcttatcaatttcaaagcaccttaacttcatgaaaatgacaaagttttattgttctctgacaggtcttctttctgaattagattacttacccatcataatacctatggaattccagaataaaattctagtgtagaaaaaatgtttaaagtaatttgagaaaatacatcaagaagttcaaatgattcaaaaagcccatgagtttttccataaacttcaaaaataccaggcatgttataacatctcatacaataaaatttcacatgtatgggtttttctcaaatactgtagtaaccatttattcacagaacatacatgtcattttctatttgtcgtctaatttttttaaaatgcttagatttgacaatcaaaatacagaaatctagcatgattccatagaaatctattttctagttgaaattgttttaatgccaagtgtgtcactaagaaacaaagtcaatgtgcacatctgcttttgggcatttgtatatttttataaacagtcacagaagcatttgttaacattctgtgagaggcccccctgctttcagagatttaccaggtgttcattaccttttgttttcatctctatatatcccttagtggatatttctgtatttatcaatccacctcagtaccgtggtaactcaaattttaaagtaacaatgaatgagactttactaatatcagatttgcaagtccaaataaagtgtgtctatatatttttggtttacatatttattctttctaaatatttcagttgattgataaggcataatttgtctcatgaaaacccttgtctttttcccaaaggatggtgtttgcttattttccctgaacttttggtatgttttaaacagtgtttgaagtttattatgagtgctcatgaagttttagtttagctgtagcaatttctggattgtttttgaccttcagactttgtggatacaggcaaaccttatttttttaattaatgactttgtatttaaacaataagttttaattttttcacaaagttttatgctttgtcctattttgttgtatttttgcagagttattgttactgttttgtttaaggttttttaaatgtcatttttaaaaaactcattgtccacattccagcctgggagatagagcgagacactatcaaaaaaataaataaataaacaaataaaaccattgtccatttctcctgagctttcaccaagtctttttttctataaataccttccaagtttctaatggctattatttatatgaatgaaatagtctcagaaaaaataagtttatacacgtgtgtggtgtatatctactgtagagaacaaggatcccgtttaaagaaatgtcatattgattagatacaattttaacttgctggaaattactttctaaaaatattattttccaaatcttcctgtccataaatccgtttgtaaagggaaaagccactcttaatacatagaaattccttttagtgagttcaactttaagcccctaggaaatgctttagtctttcaaatatccaaaaagttaacagattttatatgaacactttacatgagaaagtggtacttttgctgaaaacttaaagtagtaaatggagaaaactcaagtgtagcattatttccagctgctgcagattccatgctttttcatatgtccctttctctgcctgcctctccctcctatgccaatcctttgtatgaccatgagtttttcaagactcttctgtgctatccctgacaattcagtttgggatttgctgtcaccttaggagcttctctgtaaacctgtgatttttttcctattagactaatgtgtgaatgagtgttttgctcagtgctcccttatagactgtgagcttcttgagaacagggttgctccttcttcaccattgcatcctcagtgtgtagtgtggtacctaacacatggcagctgactttggcttaaccaacacatgcttgaatgaagcagctccaaacctggaatgcggaggcagtagggaaggaaaggatatcaccaggactgctggcagatgagcacagagttgagtacaactttcactgtgtaggaggcagcatagaaggggaagatttataaatgatgtatacaaaaacaaattcaaagctagtaaaagaatgagtggagaggctggggaatcagattctttagaaaatagggagttttgtataagaaaaggtggtaggggaaaaacagttttgcaaaatagtcatatttcactagatttagcagtgtgttatccaatcacagatgacctgaaaagatgcactgtgtaagatgctattaatgagaaaggatctagaggttgacaggtacggccatttgcatgctgatgataactaaaattgtaaggaacacatatttagagtagctttaggttttggaaattgattgaagagggacagaaaaagaaggagaaccttaaaccgtaacttaagaaatgagagctgggatctacagagcaggaaatgatacttggctgaaaagctacagatgcataataaaaagattacctgttatttgataatgatgataaaaaaatacaatgataagtagtgcatatgggctgggcttatattctttcatttaaaccccaaaacaactgtctggggaagatttcattgtttttcccagagaaataacagttacagagaggcaggtaaattgcccagggtctcagaactggtaaatttaagagttaggagtagagtccaggtagaggcactccaggatctgaatcttacctgccctctatagtctaagctttaaccaaacactatgtaacatttatggtatagctgtcctgagcttaagaagtatgtttatctcatttgatccttagaaaatctgcaagataagcagacttcaatcctcaattgaaaggcaaagacaggcttaaagaaaacagagattttccctgagaatccacagcctgtaaatggttgtgatccggcctgaaccaatagcttttagttttaataacatcacaggttctgtgaaaccatgctacttccttagatggtgctccttcaggaaaaggatatcaatgttggtatttttatataaaacattaagagtatgtgtttctgttaatgtacatatacatgtcctgtagcctgttagaacccatttttttcattttcaaaggtcataggaaaaattatattcttacacaataagtctgtacatccacagaatcaaagatatttggtcaaaagtttgtcattatggattctaaaagttgaaagcatatggctgcattttaaaaacctatctatatgatgtgcttatgagtatggtattttgtgtccaaagttaattaataacggctgcaggccagtgttcttgtaggagctctcattttttccaacattgctggtgtctttgaacaagtgaagtgaagccatccagggaaagctatgaatttgcattctttttttttttttttttgaaacctttctaacaatggctgataatcactactgtcaatagtcttctaaaaacttcccagtaatgattagatactatgaatagattattgctttttctcttcaggtctttttcccccaactacatatagaatgttattgaaattcatgtgtcttaatcagttgttctctatgctttttaccatgcctctcttcatttctaagtcttctgacctaaattacaaacctgaaggactgagaagagaagaaaacccattttgagttcctaccctgtgatccatactgtgctaattacttctcactcatctcatccacactaccacaatgcaaagtcagcacgttcataattgttcacagcaaagagaaaactgaggactaagtctcacagggagtaaaagaagtagatttaaacccatgtttgactcttaatgtcatgtgtttgatctccgtacttacagctcttggattcaaattttagtatgtgtttttaaagtccatattgtaaatgtaaccatgatcagaagtaattactattttgcagagcacacacacatgtacacagaatatcaaacataaatatacagagtaaaagaaatgcccgcatgcctgccactcagggcgagatggagccctgccatcatgccacatgagtcccctggtgccttttctgtcatacccgctcttgtctacctaggggaaaatactatcttgactcatggtagtcacttacttgcttttcttttcctcaaaatgtgttttgaggttttttgttattgtgaactaagaaaacgtagttgtatttgtgtgaggggaattgatactcaataggaagatatgccgagatatacttattatatattgtttgctgttctcacactaaaaaggttgggttctataatttggactcaaaagaccatttctaggcctttgagtgcccctaagtggccataatagaaaatacagtattttacaactcttggatgatctctccttccatctaacagctagactttccactgggttcctggcctgacttctgtagtattctgcatcgttttttccattaaacaagggcttccaggactataatttgactctgctaatggaagggcatttgtacagtattaattttaaatgggaaattgctgacacgttaaagtggcatctgtcctgctccccacttgaactccgctttagccctggtcactgcagttgtcagtatcaattggggattaggagggcctgtggcctgagagctgctggccagcaaatgacatcacttttcctccatactcacagagctttgtgtcttaggaagtaagtccatttgctgtggttttgttatgagctgtcacgtcctctatggcacagatggacgtttcgactttgactttcttttgaagctgcttcatggggatcaggctgcctcttaaacacatgaagtttgtggacatatcctgggcacacagaggtgcttttcaaaatagacggaaagtaatttaatatcattaaaagacttgttctcggtgcgagtttatcggttcctctgcttgattcataatcaaggcagaaattatttttttcatatgtttcaatgaagtttcctatgcaatcccaatttttgtaaatgttaaaatgtggattataatttaagtccttattctatatttggaaagacactgtcttttctaacggtaaatttagttcattcacatttccagcaaatatttatggaagaccctattctatttcacagttattgacataaatgaagcaacaagttttctgtcttcttggctcttaacatttgatgatggagaacctggaagtaatgattacgtacacaaataaatttttaagaggcaaatgagatcatttcagataacaggaagtaacaggaagtaaataaaagagggtcatgggatggagtgggaaaaggggagagctatttcagatgggaggatcagagacagcctctttgagaattgagtatttcagctgagtcccaaatgcagagaaggaacaaagaatcaactgcatttgagagagagaaatcaggaaatggaaaatccctgtgccataaatttatattgttgtatctgagtaacagaaatagcagtgagtgaagaagagggtagcaagaaatgaagctggagggtgaagaggaaccaggtctactcgatctctttaggccatgcttggatttcatctgctggcagaggacatcagtggagagtattaaaatcaatctatgatgttctaaataaataaggataacaaattatattttcatttagtgctttttaataaaaactaaaattaagctaaccaggaaaagtttatatgagtttttttacaattgtatagaacataagatgttggctgtatcatactgaaaaaaacacagactaagcagtccaggaagtacattgtaagaattactatttttagattagtatacatgttttaaaaattctttttttcttattgcttttcacatgttccgtgttgtcatatattacagtaataattttcagatttagggtatatcttacaagctagaccattggagttgcaggctcatgcttagctatgtgaatttggtcctaacataattacttgctattatgcccttgactttcttgagggatattctaagatgctgctgggacatttactcttgtatttatgtagaaatgtttttgaagacattatgcactgttttctcatgtggcctctcaggcagatgcactctctactgcagcgtcagggaaaaaaatgtgtttttcctggatagctggtatgttttaatatcaaagacagaacatgttttctctttgccaagaacacaactaaatttatagttcacctcttacttgggacaaggcttactgtgaatgaataacccttaaccttcaccacaagttacttacctatttatttatgtatcctgttgtataaaacacatttccttaaactacctagaatcatttctgcatccaataacacattgtataaataccatacaacttgctcatcctcccgcccatggggcctcgtattctcattacagtttactgctaacaatgacatcacactttctataggcctttgccttccttaaagcagcaggccatgtgtatcccaggagtgatacacacttcctttttaccacaggctctacattgagatccatatctacatgtataccatcgacacacacgcttgacactcactaactctttcctgtatgccaagtaactgtccagaagaaacccaactttctgtgtcttaacagactgtttggttgctaaagatggcgacagatcaaaatagaagcacttagtatttgaaccgtgttacgttggcagcctgagatccgatctaaggaatctacactttcctcatgtttgtaatatttttctcaggccccagaaataatgttaatgaatgggttttcctctaactcatatcgtatcttcttcaaggtcgtttctaaaacaatactttcttttactatcagaaacaaataatgcaataaggagacacttttactaatggaaaaaagttgactttacatgtcaagaacatagacttttttggaaggggatggagtaggaaggcaaggtagactaggaaaattagatgctaggaggtaacagtgtgcctctatatttaaagtaaatatttgtgttttatttttatttttatttttattttttttaaagacagagcagctatccccagagcagcctgcctggcaaaagcaggaatggaagggctgaacgcatcttttatggaagtcagataaatttcatgctctttaacatcgactctgactgcaggcctttcgctgcagtctggctccttccccagtgggaacaaaaaaggaaaagtgattaaagttccctcagtaatagacagcaggaggcagtggtcttggcatcttctacagagacagagagagagtgctttaacaagacttgcgagagttctttgaagaaaagaagttaagactggaagggctggtcgaggtccgctgtaacatttgttcatttcctctacttcatatagcttatttgacttcttggaatagcgtcaccctcttcgttaaaatgtccctgataaaaggaggaaagtgaagttgagctcctggccggggccagggttcagcatgttctactgtgagtaggagtgtttggaacttgattattgtaagacattccaactgatacaaatgataactaaatctctctctctctctttctctttctctgtgtgtgtttgtgtgtgtgtgtgtaaatctctcactctctgtgtgtgtgtgtgcttgtgtgtgtgagagagagagagacagacagacacacaaaatgtgaatgaatgaaggaaggaaggaaggaaggaatacaggagagaaatttttctgtatgttaggtggctgcgattttggctggccaaaactgccttttgccttcggtgaactggctagagctgctcactacaacccctccccatcccctaggacaaaaccactggacctttctctctttttgtctctctctttaaaaagacagaaaggaaaataaggtttgcaatcagtattcagacattcttatgactaataggattaggggcgttacgaagggatttgaacaagataattagtttactgcttagtccacagtgaagcaagaaaaatacttctgagaaaaggcagacaaaataggtcagaaaatgtgtgggaaatgaggtaagacctctcaacaaggaccacgatcaactggaatattatgaaaggactcctgagccttcattcatagctgcagactgtctgcctttttttttttttttttaatacttggccaccagaggtgtgaagcaaagtgacttacttaattttagagttaataggtgttgttcctggaccctgagtatcctgttccaagtgcataaatgctgccttcaaagtatttctcacaacgtgatgtaaggggaatgttttggaaaatctgaagagctcttatcgggcattttacaagctggaaaaaattatacaattaggagaactctttaaaaactaaaattttcttgaatagattcattactttaattgcaaaaataaatcttgaaaacataaatgtgaggggtgtgttctttgcttaattaaagtacttaagtgtttgtgctctaatttgcacagttttcactgcggtagaatatgcttaagaagaatcatttgaattttaaaaattcacaaagatgatatttttttccttcatagccacattacattctcacacttcctcctccacttcctaaaagctagtgctgtcaactgtactgttgctatctgtgagttaaggtatgcttccaaaggaatgctagaaaaaaaaaataccttcaaactctgtgtatgtgtataccacatactttatttagttagcttctgaatcttacagcaaccaccagccagatgaaagccactagaagctgttagaatgcctttggcttggtatgggcactgtgttgacttaagactggtagaggaaacagtcggcatttctgcctaatgaactaccgagtgacacaacagaggtggcctttcattatctatctgtgggtgaaaggttaactgacaagagaacttgttagacacaaaagcaattaaaccctataataacatattgttaacatatgacataatgattaacttaaataaagaagcccagatacatgttttcagattcccggagtgtggtgtgtttatattcctgtctcccatttagaatggtaggctgcacagtgttggacaagatacattgcatattcttttcatgtcacaataaaacgtcatgttattttccttctgtaaatatacgaagctattttttgccattgtatcctgagactgtggtttagttttaggaaacagtttgaaactaacctcttaaaaagggaatagtaattcagggccatgttctgttggtgggcaagttactccctgaacaaaggtgcccaaccagccagtgagtttttaactctggttttccctctgtttgcagaatcatctttgcaatttatctgcctcttcgtaattaactcacacatgctctatatactatggtggattttaagttataggtactcatctttaattactgtgagtgatacatacgtttagagggtcaagttccctaaaagactaattctgacccccccaaatctttctattaatagatggttttagaaagatttttttaaagcttcacttagtgaagactcaggacataaaatttgcttatctaaaattttaattgaattaaaaggttctagactccctttaggataaagctttgtgtcccatttggagaaatactaatatgaataacagtgtttctgatctccagggaatggccgtcatcgggggaaggcaggtaccgaccctaaagggtatgacacagcacaggttgggatgcatgcagggagtgggaagaagtgaaatacgaaaatggggaaggaggctgggcgtggaggctcacacctgtaatcccagcactttgggaggccaaggccagcagatcacgtgaggtcgggagtttgagaccagcctgaccaacatggagaaccctatctctactaaaaatacaaaattagctgggcgtggtggcgcatgcctgtaatcccagctactcaggaggctgaggcaggagaatcacttgaacccgggaggcagaggttgtggtgagccaagatcgcaccactgcacctccagcttgggcaacaagagcgaaactctgtctcaaaaaaagaaaaagaagaagaaaatggggaagggatggcttttatagtgtctcaggaaaattgcacttcaccattaaaacaagaaaagagtcttacgactacaggtagatgagcagaaaatgttgaggggtatggggacagtggaaagtattttcagtaaatggttggaatggatcatagatggaaactggcaagatataagtggaaacgtaggtagatgttttaattgggggctgaaccatagagatttgaagaaataaataggaactagaaagtctgtttagaaagctaatatggtagcccaggggaaatgtgataaggcctgaccaagaggagtgatggttgaaatgcaaagaaatgtatgaaagcaaggtgcatgtcaaagttatctaaattccaaaaattgagaacatatggcatatagaattatcttccacatatttgcttaccactgtaccatgagaatatttccatattattcattatttatagaattattaatttagttactgatggtactgaactacaatctacatatcctatcttctattagtggacatttaacttgttttatacatttattaaaataaaaagtttttttgctcataaaaatgtttggcaacattgctccttattttcttgggctaaattcctgagatcattcattcactttttcactcattagttgtgagaaagtgctgtatgtgcaaccttttgctagggaaaggattataaatgctctctggagtgtaggtggctacaatttctagttggtatgacaaccagtggtccttgcacacagcagatattgattgatcccctgcattcaaggcactatccttaactccactgggagaaaaattaaaaacatatggtcttggacttcaaggagtttgcagtttaataagacagtacaatttaataataaaatgagtatggctaagagaatacatgcttaaggcttttgagattagtgttaaaaaaactgtaattaaatgagtgtagttcaaaggatagtgctgtaagattttagagaagggactaaacatcatggactggagtggttgagaagggccacattgaattggctctggaaaaaacagacatgccttcatttagtacaggacaggaaatttcgtttagtgcaggcgaaggaaatttcatatgaaaagaacatgaataaaatcttaagaaattttcctagaaagtttttatttgaagaataacagggtgttgactctagctagatcagagcattccaaatgaagtcataggtgtaagcaaataggtaaaaatggattgtggcatgcctagaaggtcaggctaaatgttaactttatcctgtcatgaaaagtcgaccaatgtagatattgtgcagataaatttaacttgcatttgtgggatgactaggagtacatgtgaggatttataaaggtctgaattatagagtgaattaaagagttgaatacaagatagtttttgaatgagtgagtgaatgagctgatgtttactgagtgcctgccttgtaccaggctatgtgccatgcttcttacaaagtataatgcactcagttgaacttagtcaattttgttaccttggaatcttcttgaatttggtaaacatccaaaagacaaaagtccagatgttgtaagacttcagttaagtagattatcagaaacaattattttccagagtaaaggattaagaatcaaaataataagattactctccttgcacaaaatctgcagtaacttcccccaaagtcacactacctctttaaacatacaatctaagtaaaaactatatgcttgttaggcaaacagtgcttcagtacatgtacctagcctgcttccttctaccgtatttccatggctaggcctctaatgtatagaaaatctggagtcatcccaggtgagggccaccaggccatgtgttttccggaatttcctagatttgaggatgctctaaattttaagaccactgtaatatgaaatctgtaagcatcaaaacttattacccagagtggcttgcttactggaaaatgttgcactttttagggtatttgtcttcgattttatcaacataaaacatcaaattaattcaaatcacgtatttagattgaggtctacaaactgtaacctaaagtgaaatccagcctttttcctggatttgtaaataaagttaaattggaacacagcaacagtaatttcttcatgagtagttgatgactgctttcaaggtacaaccatgaagcggagaaattgctacaaaaatatggcctgcaaagcctagcatatttactgtctggcccttttcagaaaaactttgctgacctttgatttaggggcaagataattttgttgcactcttttggtcatgatcaataatacttaaattgatgagtaacagcctcctttgtaaaactaggcaaagtccaaaaattagagggaatggaaaatgcaaactattcaatcaccacagagttagttacaaggattaatgagataacatatgtaaaacatttagaaaattgcttggaatgcagtaagcacttaataaatgtaagcattttgtctcattcacttagtgatctcatataatttcttgatttttaattctgtaatgactcccaaatttatctttagtcaggacctgctctctaaaatccagactcatataccattgcctcccccgcatctccatttggatgtctgctcggcagaatctccatcttaacatgtgcaaaactgaatttctggtgccatctcccaagctggcttctcctgcaaatttccttctcatgaatgtcatcctctccttgttgaaggcaaaaaactaggagtcaggtcagatgcagtggctcacacctgtattcttaacactttaggaggccaaggcctgaggatcacttgagcccaggagtttgagaccagcctgggcaacatagggagaccctgtctctacaaaaaaattaaaaattatctgtgtgtcgatgtgtgcctctggggtcccagcacccagagaagctggggtgggaggatcacctaagccaggaaggtagaggctgcagtgagccatgatcacagcactgcatcccagcctgggtgacagagtgagaccttatcttataaaaacccaaaacaggccgagcgtggtggctcatgcctgtaatcccagcactttgggatgctgaggcgggcggatcacgaggtcaggagatcgagactatcctggctaacatggtgaaaccctgtctctactgaaaaatacaaaaaaaattagctgggcatggtggcgggcacctgtagtcccagctacttgggaggttgaggcaggagaatggcgtgaacccaagaggcagagcttgcagtgagctgagatcacgccactgcactccagcctgggtgacagagcgagactccgtctcaaaaaaaaaaaaaaaaaaaaaagtaaaaactaagagttatccttgactcccctctttacctcataccccatgcccaattctgaagctagtcctgaatactctacattcacaatatatccagaatcatttctcaacatctccattgcctgattcaagctacctacagcactcaccccgtttctggaatactctcttttctggtctttctacttccaatttacctcccttcttatgattctccaaacagtatccagggtgatcctgtttaaaacataagttagaccatgttaccactctgctcataactttgcagttgcctctgtattagtccattttcatggtgttgataaagacatatccaacactgggcaatttacacaagaaaggtttattggacttacagttccacatggctggggaggcctcacaatcatggcagaaggcaaggaggagtaagtcacatcttacgtgaatggccacaggcaaagagagagtttgtgtggcgaaattcccatttttaaaaccatcagatctcgtgagacccattcacaatcatgaaaacagtacaggaaagacccactcccatgattcaatcatctcccactggttccctcccataacacatgggaattatgggagctacaagatgagatttgggtggggacacagagccaaaccatatcagccttcaagcagcctactggctcccacaccagcccttaccttgatcttggctcccacagtctccctgaattccccctctgatttcatttcctgctgttaactctctgatctctctgttcaacaacacttgccccctttctgttatcacaacatgtcaggaatatttccaccctggggcctttgcactggccattcgttctgtctagaatattcttccctatgcaatgtgctacctacttaatgcggtttatgtgtcattttccagatgtcatcactgctgacaagtctatataaaattatattccttcaaccccttattttatattcaccttccctgtgtttctctccatagtttcttattgtctgacatactatattgtttacttatctgctgttgtctctcttctctcattagaatgttagctctgtaagggcaagtcttaacagctatttccccaaaaaatagagcagggcgttgcacatgaaatgtacttaataaatatttcttggatgagttattatttcctttgtcattttcaggaagctttaattgaacatttactatgttttaaacacagttccgaggtattaattatatcttacatgtaagacacatagaggtgaaatgccttggtctaggccattgtattactttgctagacgttccataacaaagcacaataagctttgtaacttaaacaaaagaaatttattgtctcacagttctggagtctgaagtccaagatcaaggtgtccacagggttgtctccttctgagggcttggaggaggactctgtcctatgcctctctcttagctgctggtggtttgccagcaatctgtggtcttccttggctcatagaaaaataatttcaatttctgccttcatcttcatgtgatgttctgtctgtggtatctggctctgtgtccgaattatcccattttataaggacaccgataatatcggattaaggcccaccctaatgaccttgttttgacttgattacttctgcaaagacccatttaaataaggagatacggggagagcaagtcaagtgatgtgaattgggaggtgtgaggggagcacaattccatttatcatagccattgacttcattaatggtaggcctttgattcaaacttggattctaaaactcacaatctactaatatctgaacccgtacaaagatttagtaatatgtattaagtgcctgctttgtgctgtgaactccgttaagaaccatagataaatagagttcagctcctgcccttgaggaactcaccacatagcaggagaaaaagacatcatagagttaagacctattgacttaaaagcacacagaaagcagatcacttgccatttttaattatataaagttttccatctattaggtttattttgccaaagccttctaatgaaatagttacaccatttaatttaaatttcagtggggttgccagaagtgcaattaattgttaaaagttccaactatgaaattttgctttggaaagcagtctgccgtatctttatataccattaaatttgatcatatgcttgtcattctggcagaacatcttgatatacttgaagaaacatagttaggggaaataaaaaaaaaattgttggtactacactgtagggtttccaaatacaaatgttagcatgattgggttataccaattcatcattacgttgcatttccctggagttgaaactacatctgggcttggcagggatgcattatcaccagtcagagtggggaccatgtgtcagtctctcaaagaagatatatggtcttgtgtaccattaggattggatatgcttatgttgcagactttaaatcaacttctgaatcctttctacagatgttgactgctgcaggtctgtaaatagcacagtatattctgaacttcagctgatatatacggccctaaaaaaaaagcaacactgagatacacggcaatagaaaacaacgcaatgaataaaaatgggacagctccaaatttgctgaaataatctcatctgtttaatgacattgtttaaacaaaattacctctgaatttgaagttgccattttctcagatcagtgtggaattgtagtaattttaaaattctagaagtttcttttgtaacctttattatttgatatgtattggatttatttgtaagatgtcaatagattccatttcttaaatatccaactagaaagcatttaattgttcttttaacatttgcgagtgtggtgggcataatttttaagagactcacctattgaggagtcatcgtacccaaacactgatgaccaggcctttacaaagcattttggcctttatttacattctgggtacaagatttttcactgcaattaaaactataaccccaacttcactgaattatctttctgttaccaagactttttattcagagccacaacgggattaaatgaaaatgaccgaagcctccaaaaaaaaaaaaaattccttcataaacagcaaacttttaactaatacacaatgtgcttttaatactgactttaaatcctccctcaaccaggaactcgtgaaaacatgtggtcagtgtggcaaaagggaactgctgggtcctgatttagttgacattctctttttttacaacctggattttatatcattcactgatgcctttctttaagctcatacatttcgtgcttgtggcacaggatactgttttcttaacatcaaatctttatggcactggcaaaaaattttcaatctcctacttaaatttggttcaactacacagtttcactatagccaacagtttgtctggataagcttgcttgcccccagtgtggatttgctgcaaaataatgactgcattaagctgaggaacgtgttccctcatccaatctctctctctctctctcgcccccccccacttctgtctctctctctctctctctctctctctctgtctctacccagccatcccagatccaacccgcacttgcaaaaatacatacatacacacagtatgcaaacacatacccatagtcagcaccctttctgtctttctgagttaaggctgtgatggcccttggggtttgctcggaaacagtcacttccaagatccagaaaggctttgtaaacatgggtcctacctgcacacaagtcagactgtgatcattcccttgtagattatcaaacattccatctactatacagcagcccagaactttatactttaaccattttattctcactctatgaggtctataaagtatttttactggggaaaaaacattatctatgtaattatcatgacctatgcaaaatttagcctaataagagagcccaacacatatttttttaaagtaattttaataaaacaagaatatggtagctacaataaaaaacatttaatcaaggtatgaatagattgctgtgtgagaacagaaagaaaaatataaatgttatagttgggggtaggagaggaaaaaggttggggaaaggcaaactgggttcaaatgagatcttggtgagtttctgtttctccaccaatggagaacagattgcggtggtgggcaggaaggcaagggagtgtgtacaaggctccttgccaggtgagggaggcagagtgcgtttagaaagggggactggttggccgggcgcggtggctcacgcctgtaatcccagcactttggaaggccgaggcgggcggatcatgaggtcaggagatcgagaccatcctggctaacatggtgaaaccctgtccctactaaaaatacacacaaaaaaattagctaggtgtggtggcgggcgcctgtagtcccagctacttgggaagctgaggcgggagaatggtgtgagcccaggaggcggagcttgcagtgagctgagatcgcgccactgcgctccagcctgggcgacagagggagactctgtctcaaaaaaaaaaaaaaaaaaaaggggggggagggaccgattttatgaaggttatggaacaaggaggaagctatgatgtgaaactcggaaaggagcgaattgtagactttgaaagcagcataggaatgtcgtgatgttactctcagtgagtaacatggaggatgagttggagagggtgtggactggagcagagttttcgtgttcggtgatgagatttaccttgagagtaaagacgaaagactgggaggccttgctctattgccagcaaactctatggaattttcctttcagttggaaggctaaagtttcacatctacttaatatgtttctacggagtgtttagatgtgttttagattgagagtttttcagatgaggaagatgactaagtaaaataaatgaaagagaaaattttgctatttcatagtgaaatagaaaagggcttttttcccccttttgctagtagtttaaaagtgacgagaataagtcacatgaatacaaatcttaaaactgaatagaattttgtttctcataggtcatatcatgcctgggaaatctccaagttctttatggcaatatatcagggaatgcagtgacattttcagcatatactgttgccattatttgtgtgtgcatatgtgtagctttggtgattagaaagtcttttattaaaagatgaagtgtggggtatggcacaaaggatttactttgcctcataaaaaggctactggaattttgacttacattttactgtgtgcagacacaagcagactggatttaatttctttccacatgagagatagctaacttcttggaacaggcacaggcttacaatatttctctgggacaaaaccttgaggactaaaagttcaagggattggtgctttaggggacaaggcatggaaatgatacattttctcataaactttaaattcattttggcccaagcagataacttttagctcagggcacttgggtttattagtcattcattcattcatcacaagtttattgaaccatagctgaagtatcaagtcaccagctattagcagaggagaaaatctaaaaaaaaaaaaaaaaaaaaaaaaaaagagtaatttggaactagaccaggaatggctttataacaatgattaccttgtatggattgaacacttactaagtaccaagcggtcttaggtgctggaaatatttattttagaaattatcctggaatgtttgagcttaactatagccttgaaagtaaatgagataacttaataacttctgaagagcctcatcatgtaataatttccctggagaagaagaacaagatgttagattgaaatggaccactcagcatggcgtaagaaccaggagacacagccagagattcaaggaggagaaaggagtcaaaatgacagatgctggattgaaaagtctactggtttggcaggtacaataccatttgactagaaaggagaaaagaaatacgagttaaacaaatgctggaaggggtatgtattaatatgcactcaaaggatgttatccttggagaggagggtacctgggacaaagattactgtggatattatagatactaatacagaggtggaaagaaggaaaggctccttcctagagggtttccattttctgagttgagaagacagacttaactttcctagactcgaggctaagcatagattgggacgcttgaaaagaatgataaaatgaagcattgccaccaattgccattgtggcaaatggaaacggataaaaataggctcatttaaggagaattattggggcccagctgaaagtgaacaccctaatgtgtaagaatgtcatcttgttttatttgtattctcctgttttgttgaaggttgtttcttaaaaaaaaaaaaattcaacttaattgatattcaggtgtaactgtcttgtgggttttactgtagttgtggtaggtttcctaataagtgaaattccttgtctccaggcttaggggtcacacaaacctatgttaaaatcctgtcaaaagcagtaacttgggaagcttcatcaactgtaaacagagaacattttgaccgtatcacagtattcattttagaattagtagtaatgcagcagtggatagcccagtgcagtatcggtgcaataaatccttgctattgccactgtcatttttataactttcttttaaaaacatagtgcttgcttttaaattccatttttaagataaaaattctttaaagttttcttggcctgccagtttcacaattctccacctctacctcccactgcattgcaacaccatttaattgtcagatccacctattccaggaagctttctcaaatacttcagggctacagatctctgcatgtgctgcccaatgcctttttctctgttacatactttgcgacttaattgcattctgtctagaaaccctaacccatactttctttgtatttataataatatcagaccttttatttgtatacataataagtgtcttctcaatatctcatgcatcaaatggagccgcaatggggtgattcagctgagccctagctgcactgatcagtcctgtcctgctaacaatcatgtcagtttctgccattcccctcacccctctcctggccattaattcagagaggtctgcacccaaccctgttattaaattatctgctattaaaatgataaattggtttctacttcagtaattgaatgtgcttgcagactattctttccagtcttgtttttatattaatgtgttaccttaaatggagatgtttcttacatgagcatcatattttcaagaattcattattttatgaatttggatccatttaaaaagaatcttaagtgatctttaaaaatcaaatgaattttccacaaatacaaactctgtagggatgctcattaaagaagacgtttaaaaggatatatagagggtcagaaaactgaacgagaattaggcctgtctcctctttgttagacattgtcatttctgcttcagagtattgtttttatgctgtaatcagactcagtttttgctgttatttcttgatccccagcacactttaatacagaggatctattagggctccctactttaggaaccagataaaagcatgtatctaatcttgtgggtatgtgcatgtatatttttccaagaaagtgtccacagatttcaagagtatccaagggttctaagctctcttttttctcttaaaatataagaaacattgcggtagtggaaaggactttttgattctataacattaagctcaaatacaagttttaccaattactacctctgcaactttggacaaatgaagcgactctcttaattatggtttccttgagttcctgagcgtgtcaagtgggctaaaagcggcaaagtatgcaaagccctggcccacagtggatgcataatacatgttactgaggcttcttccttcttgcctaaaagtcatcattcctaccaaagcactgttcatttcctcttgttcattctccatcagagatagaaaccagctgttcccatctctgtgcacaacaactgtctgtgtgcttaaagtacttaagcacacccttgcccccttaactacgggttaattcctttgacctttcttcgaagacagttgtcagatgggaattttctcagtggtttgcccacttaaggcagtttgtctctggaggcaagctgttgaagagggaagctgagaattgttaacaacagagctcagccatgagcttgatttcttctatttttccatgggagcccatattatctctactttgcggtaagggatcagctcaatgtgatgttatatggttcccatccggcctgaacaccacttccacataaaaatggggagtaagtctgagaaatcaccactttttaaacgacagatgatgtagaaaaaagagagaagcagcaatagtaggggaagcttagagaaagtgtttggaattgtatccagattttctagtgtctgtagccaagaaaagccaaaaatcagtatttgagactaacttttcagatgtctcttcccttactatcaaaatgagtcaggcagtgtttaaaagcacaggcttggcaatttcaaaattgcaaattaaggagaaataaaagaaaatatgcatcactgaaaaataaatggctatgtcagagaacatccctctgcatatctctctgttcaaataattaactaagttttaggtacagaatattgcaatcctgagttcaagaccagctattcacattattaactattaactctatgtacagacggataataggaaacttcatcaaaatagatagatgttcagaaaatcccatgtaccccaacttctctgtgttgtagcaaatgagataatgtaaatgatattatatgtttatgaatgaaatgaaattatatttttgtttaggatctgatttattgtgaatattttcactgaacaaaggcagcagagaaagtgaaaggcacaatctaggaatccgtgctatatgtggattgtgagcaggatagaaacgtcacagaagagtggccctgatcaatgcttgcctcgagggtgtaccttgcagaagggagagcgattcttcagcagaccatcctttggatggaaaacatcaaccctcttccttgttagtcacacattatccataagattctgacttcctcaggcaattaataatgaaaacccctaaatctcttggcaacaactttcaagcctaacagttttctttgtcagatgggaaggaagcaggatctgcgaggaccagggcagacagtgaggaattcctgaggctggtgagcaagggacaaggatcacacagatgcattgccttcctagaggaggcagaggttctcactgggctctgcagtgatcagttgtgagggacgccctgagttataatagcaggagtagctttatttcaaaagaggccattgttgaaagtctgttcaaggttacacttattctaacattgctctcctttgaattttaacgtctttttttgatacaaggagaaaaagatgaagttaaaaagtaagaagttatcacaggagcaggctgtagcctgtgtttcatgtaaggaaaacggttgcaaactgtttgagaaggtcatgagacctgcagcctgtctgcaggagaggggatggagtggaagagctcggcatccatattgtctgcgtttgtcaaggcctggctaggttgaagtttcagaaaaaaagtaaaacctaaaagaaccgctctctgtttctcctaaacacacggacacacgcaagtgcccacatgaaaacagtcagtgaatgcaaaagtaattgctttgtgttagcaataaattgagaatcattggagtttttcagctactttactcattggatatttgaggagaaaaaaggaaatgaaaagtagtgttaagaggtattcacagattttcctcagtagaaagatgtggaaactgaatctgaagaaagagaaaagattggttaaaaagaaatggatacttcataggctaggattttaccaagcttgtatctacatggtaatacttggagctcaaaaagtccatgtgtcagtctatttctaactacttaactgtcgttcattgtgtttttgaaacacttaaggaatatatttatttcctaatccttcgagatattaactcatactgatatgctaataatgccctagtttaaaggtactaaatatactgattgtgtgtttaaaagcctgcacttttatatgacccaatggtaatttaaagcatcccaaggtaatattattattatttatgagtttatttttttttgagacagagcctcgctctgtcactcaggccggagtgcagtgcaccaggctggagggcagcagcgcgatcttggctcactgcaaactgtgcttccaggttcaagtgattcttgtgcctcagcctcccaagtggctgggattaccaacatgagcaactacacccagccaatttttgtatttttagtagagatggggttttgccatgttggagaggttggtcttgaattcccgacctcaggtgatccacccacctcagcctcccagagtgctgggattacaggcatgagccactgcagctggccccaaagtattattattatttatttattttattttgtgagacagggtcttgctctgttgccaggctggagtgcagtggcgtgatcttcgctcactgcaacctccacctcccaagttcaagtgattctcctgcttcagcctcccgagtagctgggattacaggcgcacaccaccacacccagctaatttttgtatttttagtagagacagggtttcaccatgttagccaggatggtctcgatctcttgacctcgtgatccacctgcctcagactcccaaagggctgggattacaggcgtgggccacagcgcctggccccaaagtattatttttaagagttacttctacttcaagagtgacaggaaaaaatattccaatcatttctagagggacttacatttttctctattgaattgtgaatgtttgttgcttttcttgaaaattaattttttgttatactattatttcaatattattaaataaataattatactactaccaattaaaaacaattaaatcaattgttttcaattaaagtgattaattttactatgaaaagagtaatagttatatgctcagggactggaagaaatccaggtaggattatttggaaacttagtttcatttttctatttatgcttaccattttttacttatggggacactttgcccatgggaaattattgaatgttttaattgagttagattatttaaaaactggagacaatgtattggttttgttctattccattgttgtttaattgacagagaaaaaacagggtttttgttttgtttcgttttgatttttatgagggagtctcactctgtcgcatagactggagtgcagtggtgcaatctcggctcactgcaacctccgcctcccaggttcaagtgattctcctgcctcagcctcctgagcagctgggattacaggcacacaccaccacgcccagctaatttttgtatttttagtagagacagggtttcaccatgttggtcaggctggtctcaaactcctgacctcgtgatccacccacctcggcctctcaaagtgctgggattacacgcgtgagccaccgcacccggccaaaaaaacattttttttatttttatttgcttaaaaaaatagaacatcaacagtataagtattaactagactattgaggaattaaaactaactgataattagaaactttatggggaaaactcaagaggtatgaaagctggagtacttacattaaaaagtaatactgttgaaactattcgatttataacagttgcaaggaaaattaaaatacagtgtgtaatccactgcaatgatttcaagattgacagctcagtgttttttttttcccagattactgaaaacattatttaaaacatctaacttggcaagagtatagttagtaactaagaacctgcattctttttttcagtgtcattaactttagtttcctagttaaaggaagattacctttgataatgttatgaacttgatcaaaatatagttgaataactttgaatcttcatggtattttgatgatgcttcttttatcttcagacaatcattagagaatcaagcacatttctgtctctccatagtaaaatgagaacagtgttgcatatcctctctaaagctgtgacaagaatgagtattaaatcctattccaactgccttagccatgtggatgccctatggtttggggctacatttttttattgggacattaaaaacagtttttcttatattggaattttgtattttgtcacattatagatatttgcagttccattccattttattccacatgcatttccaatggtatataactttaatatcagaaaaagtcaatccatgattaccattgaagtagaagggacccttacgttctgccagagaacacatgactcactccagatggacaagaccatatcctatttttaaagatctactctactgaaaaactttacctagcaatatttctgatgaaggaaaacttcaatccaactgggtacactatttttaactatgcaggtaatacaaatagtatatctttccaccctcttccaattttagacagcttttctgtgagtcaaaatgctatgaagaattgcataaggtatttattcattaggtgtatttggaaaagccatagtgtaaatccaacacttggtttggagttatatcccttcgtatgtaacacaatgaaagttgtgttgtggtactttacagttaagatctagtcggtcccagcatctgtatccatgtttaggatgaaaaagttaacttgagtaacaaagtaaaaagaaaaaggagaccctaatatctggctcagaatgatctatcttacaacaaatgacaatatgcaaattcagtcaaagcagaaggataagaactttataatatgcaggtttgtgggtatgtctacagccacattgtttttaaacctccactaaggactttatttttcttcaatattataagtcacccagcagccctagccaaggacagaggtcactgttgtcccagttccagctctgatgctctctgagcatcatctccgttacaccttcctgaagttcattccactgtcagtagctgtcactcagtcacacttagtgatgtgaccgatgtgacattttccatgggggataaataaaaactttacatttccctccccaatgttaatgttatgacttctttggagttaatcgactgacttctttttccttcaactttcagtcagttcctactaattccttaaaggatgtctcctttgttccagctaatgcagctaaaaggaatgctataagtcagaaaaggctatattgaattcttttaagatataaaaaaatttccaacccttataaaatgaaatgtattcatatgttgttggttaatttcctactaatgcacacataacatatatgttggagttatttcatcagtgaatatctctcaaaaagatatactgagacagagaactctgttcaaatatgagccttgaatctactggggctaattatcagtgtagaatggctaagtagaatttttgcatatatcattttatgcagtacctttgtaacaaattgatttaagtgcctttttggaacagtagttgggcagaattgatttggtgtctaggagattgacttacacagcaaaactgtgtctaggtttattctggcatctaaatcgagtttcaagcaagtggaagggttggtggtgctggaatgcagttctccaccaatttatattgtgaagtgctatgacatacattattaaaagagattcagtgtaagtatgatgagttaaaatacccattgacagctggcaaaacaaccaaagcatttgcgttacgttaaaaatgttaaaagtaaattttgtctcattgaaatcatatgatctgacatggtcaaggtagaattgatgagatgttttaattgcaaaactttttgttccacaagataaagaagcatttgtgcaaagtggataaatagggatggtgtgttaaatgtgcatattcaatggatttgtactttcttctcattcaaactccaagcatctttttaagccagagcaaatccagcctgtgtcattttgtttagcttcctgagggcagggactttgttctgtctactggcatctccctatacttgttaaatgcttggggcaaatgtgttcatctttctaagcttccatttcctcgtctgtgtgttggagaatcgattacttcttcttagtgttgtgaatattaaatgaataataggtgtaaagcatttaaaaatgtctgagaatagaagcaccttcctactaattatatcagagaaataaaatggacagtttcaaaactctctgctttaaaaaccgtcctcttattccttcttttgcacaagttgttctttgttgtatgttctgcatctgctatcttttttcctcttattccgttcctctctcacttagtccccctttctccccatcaccctttctttctcttttgtcttttgtttcctaggatatggcctgggtatggaaagaaacccttctctttctttcttactccaacacagctttcagccatttctttgatttttcatattgtgttgaatgctctctgcacttcagccattttccttctgcccatcaaggtggtgtgcttgggagagcaggcagcctgcattgagaagcactctctgctgctgtgggaaccgaggcctttctgctgacagagcaggtggcagggatgctggaattgcaggtgctcacccccaagacctctattcatgagggcccacccagggtagcccaccaaatttaaaaccagaagttgcctttcagcttttatatctgtgcccaactctcttttacatacagttcagaaattatgatatcatgaaaatgtgacttcagttccctcaaaatatctgctagctgcataatcaagggtggtttgtgcattttgtggaaagattagcttaagattgcctttcaaaaattataatatgactttttgcattcagaacattatgatacatccggatatgggttttgaacctattatccttctttgtaattcagaaactgtatatgatggatttaaattttctgaatttaagatgtatcttaaaatagcttaatgcttactgggattgtttaaagtatttattgataatgacagcaatataattcacaaatactatgtttaactgtgaaaaagcgttttctattttatcttaaattgtactttgatagatataattggtgtgtaaaattttacctaaattttaatgcatctcccaaaacgttatttgttggtatgtatttccacattaaaatggtaatatgtaacatttattgaatgttattaatatgtgtaaggccctgtgcttaatatctcatataattttcccagcagccctatgaaatgtgttctaaatgttagtcttaatttatagattaggaaattgaagcttagagaagtttaaaagagaaagaaaaactggctcaaggtcataacactaataaatgacacaactgggatgaaattcttatataattaaagcaaaggcccagtcctcaagttatccccaaagtagagggagcaaacagaaatatgcagtattgcacacaggcttggcaagtctagcatctgtcaggcacttattctatgctgagcacttcaccaagcattgtacaagctctagtcgaacatgaggtaggcagttttattatgcccgttttacacatgaagaggtataggtacggagaggttgaatggcttggccagaaagtggcagagccagatgtggattcaggcactctggtttgagtggcatggatcttaaacccacactgtactctctttgttcacaggaaggcatacgatcttaagtcacattgaattaacattgaaatgtactaatttccacccttcataactgtgcttcccctttagttttttagaaatagcttccctgtagggaattctaaaggatagaaagcattgatggtgaacacttctcccaaggcttcaaacctctccccagtcttccctgagtttcatgctgcataacctgtgtggtacctgattattctatgcaagactgtactacgtataactagtctttctcttgaatgaatacaaatatctctcttttatgtgaaactcatttttttctaacacatactgttattaggatcttcaaatacatgaaaataattcttttccctgatatatattatttacctggatataggaacaaaaagagtttcattaagtaaatatacttttaatcaaattaggaatttaatctgtaatgacatttacaagttggcatactcatttaccgtccacatttacatttctttgcttttctaaagttaaaatctggcaaatactcatttatcattactcagtagtttccaaagtactccatggaagtacagatttatgatatttctcagtcagactctaagagaggttaaaccatgaaggaaaataaaattaccagtaattaaatttacaggcaggtttgccatctaaagcaaatttattgcttcacagtgaaacatagtttagacactttcacataaagtgaatccatttttacatgatataggtattatacattgctgtttcaatttatataattaaaattatatcattgcactctaaggttaatgggatactcaactggaaaccatacgtcgtgggcaataaaatagcagcattgcagtattggctcttttgttaaaagctgatgcaatatttcaacaccattacattctaccttttaaaaatctttagaacaaataagaagcaaagacatgccaatttaaaaaaaaaatgctctttttctctgtctttctctctattccccactccacttcttgtcaaacatatagaaacacatacatgtttaggatatatacattatatattatggaaaatgtacattcagctctgttattagcatggatacacatatgtggtgatagacatgacaggaaaatacatcaatacccattttgaaaacagttttttctcaaattcaaaacaaattaaaaggtgttcctatagtctgttcaaattctagcatgatcaaaagaatgtatcatgcattgcagagctgttgtgggtatatggaggtagaattaagggaagaacaatataatctaatgtctagaggtgaaccagaacagacaagacttctaagagaagtgtggtatctaaaaagggttgagacatccaaagtagtaggcattctttgatagccatgctctaataaatggactcttattacactaagaaatattagaccaaatacaaaagagctgcaaaggaaccaaagagaatagtaaatatgctagtccccaacagagatagatattgattttaaaattgctttacagagtctgctgcattcatcagccaagaaataaacaaaaatgtgttatatttatacaatggaatattattgagcgataaaaataaatggagtacagatacatgctacaacctgggggttagaaaagggagaactgctaatgagtacacagcttttttgggggggtaatgaaaatgtcctgagattatggtgatggttgcacaactgcataaataatctaaaaaactatgaattgtacagtttacacaggtaaactttttggtatgttaattatatctcaataaagctgataaagtcatttgcaatattttctgtctctcggccattttcttgtgaagatttgatgttttacagttttatttatgaagtctttatttctaggcattttttcaactgaagttgaacacattttttatcatgatcaagaatcatattttagttgaagtctgtaaattctagaaggaagtcatagtgattggctatatttatagaccacttttacaaagtcagaattgagtatatacatcgacatgaaaaacctgggttcaggggacagaaaacaacaagccttgctgttctcaaacagttagatgttgtgctctagttgttcttgcacaaagattcctaaatcctttgttataataggtcttgtgaatgaagggtcctcttaatttttgctcttattaactgaaaacttcttagtcctctagtcagtgttttagaatcccaacacaacctctttttttccttctaattgttaaatgcagcaaacactattttcttagccctcatccccagcaatgtcacccataacctttgtctcttctttccattgtggtctcctttttagaaataattgtccatttcttcttaccagaccatccccatcactgtccctaagagccagcttaatgccctcctctttgaaaagcacttcctgatttgcatgccacctcactcttgttaaatcccattattttatttacacatgcattccatgcatgtcatcctgggttgatgtctgctctttactcacatatgcatggctgatcttcctcagtatattgcagtcattttgatgagaaaaataggatcacattttttatgtgtcttcataaatgagtaatgcaattcctgacacaaagtcatggagtcaggtgttcaggaaatgattatttcctggttagtatccatgctatgttgactaaatatgaaactcacatatatccctggacacagtattgagagaataaaaggattttaaagtccatcagccaagactgagactgagactatagtttaggctgaataaaggctttcaaagactgtttaccacttaaaattcacggtatttatattaacttacattaacacaactttgacatcacctttatcttacctgatttcattaaagatatttggatcatgaaaaaaaatatctctaccctatcttagggaaccaaagagcaagtcatcattgttttaatttgccaaagtattagatgacattttcatataatattccctaagaaagacaccaagtacctggtaaataggtaattttcttgagaattgtaatgtccataagtataataccaattttctaatcattgatgggcattttaatttcatgttttattgaccacaaccaggcatagcattaggatacaatgatgaattttgcactgttcctagggaaatttcagctcttatgggatatgtcaacaaggcagctaatgattacaatccagtatgctatcagttgagtataatattctaccagggtgcaaggaaggaagactactccagtattaacacatttcaaagaaaattgctagaaaaaagaatgttcaagccccgccccagaggatgagtaggaggattaaccaattaaaagacatcatgtgaatattccaagcagagagagaagcatgtgcaaacccttggcaagaaaaaatgtatagatactaaagatattatatatataaatttaaactctattgcaaggtcttttttgatgatcatctgctgtccccaacacttcaagcagtaacagagtacatttccccctttattatttcaaaactttctatattttcttagtgatttttattttaatcagtgcagtggcataatgatcactttacctatctacttttcctttctggatctgaacttcttgagagcagagactatgctatttttaacttttcatttctaagtgtgttcggcacatactgccttcataaataattcttgaagtgagctaaattgaatgaatggaagtgcagaaagtaagatgggccagtgcctttttgtgctctgatgaagcacttcatagcttcacaaggaatagatcggagcatttgatcttcatgggaaccatgacacaacagtgcttggtattattttttcctagttagagaaaatgaaacatgagtcaaagaatctcagtaacttgactaagatcacttggtcaccagttttaatttttgtggaatggagccaaggatttctattcaaaattacctgttccagacctgtcccagtacacattatgcaaaaaaaaaaaaaaaaaagaggttttagagtgacctctcaaaaagtacggctttgatggtcacacaacagtgtgaacgtacttaacaccagtgaactgtacacttcaaagtgggtgaaatggtaaatttcatgttataaaatagtggactttcttatccagctctctcctttgtccagagagtgtatacactcttcttgcctttaatggggcttcctagtttttattttctgttggcatctacaatttccaactagatgcaaataaacaaatgccatgtttgtaaaccaaacaaaagctagaaggtaccatttatcagaggagttccagtgggttaccaacatggggttcaaagaccatgggcataacagttaccaggcagacttgttaaaaatatagattcctggacctcttccctagcgattctgcctaatatttctggagtggcgctcagaagtctgttttttaaaacaatgtccctaggtattttttatgggtgatcttcaaataacattttgaaaccacagctccagggtgattgaactgtaatatcagagagccagacctctatagaagctacctcttacctcctgtaagaagcaggatagcagtgcttcagaataggaggtttgagaaacaacagagcaagttcaaatcccagctccgctgcttactagctgtatggccacaggtaaataatgtaacctctccaaaccccagttcctcatctccaaaataaaaataggagaatacatcccgacttggttatagaaacaatacaatgtgttccctggaagttagtagttgctcaataaatgttagctttgagtattaccttattttatcagttgtaaattgcatactttttcacacttccatctgtggaattttacagttattgtcagtaagttattgacactttttattaacagcaagaagtgctaggatcaagacatattagagattatatgaaagagattattattactgtgttcaacaaaactgttgctgagaactagaagttcctgagggtttccagtgggagaaaaaaaaaaacagttttggtgtaggaacagtcccaataatccctaaaaaaaacctcattaatacatccaacaaagaaagcccaaagtacttattccatatcgaattttattaagatttgcaagaggaaagacatacatagaagagatgcatataaatcaagaagcaacagtcaaggtggtgataaaaacataccctgaaagaaacagaattatcataaagcaatgatcacatcagatattatgctatcagtaaatgcttttgaatacatgaatgagaaaataggagtgagggtgagaaaagaccacagcagactttctcacttgcaaatattaaaatcttgagtaaactaagcataagtttcttggggataataacctgcaaatctgaaatatattgatgtatatcacctgaaaggagatttatgtatgcagcgtgtagttcagttcccaccatgatacaaagactttaatctgtgtttctgtctctgatccgttcattgagctgtagtctcttatctccaacattttataaaacattgccattctcctctcctgtgttgccttgataccattatgtttaaaagtcctctcagaagtccagttttcttttctaatttccctggttatgtctataatgccagattttgttacttatcaggcctcaaaccacagacttctacttaacaggagtgtcccttgccttacatcttgcaaattgccatgtttggaatttttttttttttttttgagatgggaatcttgctctgtcacccaggctggggtgcagtggcacaattttggctcactgcaacctctgcctcccagtttcaagcgattctcctgcctcagcctcccaagtagctgagattgcaagtacttgccaccatgaccggctaatttttgtatttttagtagagacgagttttcaccatgttggccagtctggtctcgaactcctgacctcaggtgatccacccacctcagcctcccaaaggctgagattacaggcatgagccactgcgcctggccataaatattttttctttttttttccctgcctcccttgcgcaaacatttggcgatggtgtaccacatgccagtaattctgcagaaataagatgagttaacatccctgcctttgtttatcatattgtctaacaggagagaaagttatttaggaaaggaattcaattaaaactattttttcaaatttatttattttaaaaattaacataaatttgtagatattcattgcaaacatgatgttttgaagtatatatgcattgtggaatgtttaagtgagctgattaacaaatcaattcctcacatagtcatcatttctgtactgagaacctaatccactctcttagcgtttgtcaggaatatgatatattgtcattaactatagtcatcctgctgtacaatagatctctggaacttattcctcctgtgtaattgtaaatagctattatttgaccaacgtctccccaacctgcttcaccttaactgccccagccgctggtaggcaccattttaccctctacttctatgagatcaggtaggcaccattttaacctctacttctatgagatcaacttttttagaacctggaggacatcatgttaagtgaaataagccaggtacagaaagacaaattccacatgatctcacttgtatgtggaacctaaaaatgtcaacttaaattacagaattttactaaataacagcacaagtcaccttaagagttcaaaagagggaacaagggactccccaataatgaaaataattctgcaataattttattatctaataatgtaaacactaatttatattgttaatacaaaccttatttataactaggtaaaacaattctaagatatatttaatatgagttcatcttacagataagcaaatggagagagaggcttagtactttgcacagcatcacatagttgataggttatggagattttagcactaggctcagctgaggagttggtctgcgtcttgaacaatgtttaactctccatctcacggtgataggaagtaggtgcttgaggcaaaaagaaaatgtgcaaaagctgaacgatatggaagatcatataaaaggagaattaagagcatgaaattcatgagtgaaggaatgaggtggaaatagaggcacagcagttatcaaggaagatcctgaagtaagagaatgagagtttgcaggtaaccctaaggaggccaatgtggctgaaatagagagaatgaaagaaaggataaaaatagataaggtcaaaaagggtgtgctgatcagattttggggggaatttgtaaacctttatgacactttgagctttcctttgtaatgaggcaagatatctgtagttttcatgagaaatgtgacaagatatggctctaagaaggcaagggcagaagcagagagatggttgggagactattaggtaactcagacaagatgagatggtaggtgcgatcaggggactagacgtgcaggtaggtcagattctggatatattttgaaaacagagctgagaggatttgctagtggtttggacgcagattgtagaagattgtgatatgtcagtgagaactccagagtttttggtctgaatgtcagtatggatggtgtatccttaactgagatgagaaggcttcaggaagatgtgttttgatataaactcaaatttggaaatacaattctggtaccagtgtgggagatgccttggaaggaatcataagtcaaagcagggaaatcagtttggagtctcagtcatccatgaagagtgttgatgaggtttctaccagtgaccatggcagtggagaatggagaaagggacttgactggggacactgctggggtggttttgggaatgaattggatatagtagaagggggagggtctaaaatggtaatctacatggtttcttgactggccagtaagacacttctcagacttggctctgggaggcctgtatctttccaatcggtcaaatactggaaattaacacctttcctatttgaagatgcttacattcaccgttcttcatatcttttctttgggatgagcttcagaatggggaagcctttccagctcccctcatttctctatgatcttaaaaaatgaataaaccaggttttcaagtttaaggtgctcaatatttttaatttctttggaaaattccgtagtgtcatgcctgagcatttgcagtatcctcttaacaaaactaacctagttttcttgtcttcaatcctaactctccaaaatcctgtgcattgttagcatgctcctcttttccaaacagtttttccattgttgtttgcttattcagcaaacttgaatggctgtaagttctccctgagatgaccccatgttaaattccattgaagattttacatttgcaccagatgctaactcctaactttattacgtagtgttctctaaaaacattgcctacttcactggtgacccactgactctctgacacactgataacagctgtctgcccattttccctgtctgctctgaaactcaatttccagattaatcttcctaaaaatcaaccccaatcaagctatttccttcctctgaaacacatttttacactctattacctagtgatataattacaaactcctccatcccactgacacagtagttctgactcattttgctcattccacacaggtcatagaacagtacactcctagaaatgtctcacatcgactacaatgatctttggggaatttagcaggtatactcaggagcacataaaagagtctccaagtagaataattataacatgtatgaaaccatcacctctctagtccctactatgtgccaagtcgtttttgaacattttaaaagtatgaactcattgaatccacctaacaatcctatgaaatataaactattattgtttcattttatagatgaagcaactcaagcacaatgatggtaagcaccgtgacccaaggtcccatgactaataaatggtagaactagaatttaatttcagataatctggccctgaagtcagtgttctcaattgctctgacaagctgcctccctccttcaattcctgccacccaccacctcccacctctttccccagcgttgaaggctgaaaattaccaagcttaatcagttttaaacaagtttcacataagatctcatttgatttggaaggtggcctgggtcaaccaagccgccaatgactgttccttctttgatctgtgtccttgattatctttctcagataccactcataatttacttaccataaactatcttcattgacctcaaactgtgatatatatatatatatatatatatatatatatatatatatatatgtgtgtgtgcgtatatccatatatgtgtgtgtgtgtgtgtgtgtgtgtgtgtgtatatgtatatctcacatctctccaactagatttaaaaaattttcaaggccgggcacggtggttcacgcctgtaatcctagtattttgggaggccgaggcgggtggatcacaaggtcaggagattgagaccatcctggctaacaaggcaaaaccccatctgtactaaaaatacaaaaaaaattagccgggcttggtggcgggtgcctgtagtcccagctacttgggaggctgaggaaggagaatgtcgtgaacccaggaggtggagcttgcagtgagccgagatggcgtcactgcactccagcctgggagacagggcaagactttgtctcaaaaaaaaaaaaaaaaaatttcaaaaccataatcataattagcactccaaattgctcttttgatttcccaacttcattaatggtcctctcatctaacttcagagtgacccctgtgacctctctgtcccttacctaatccatctttacttgcagtctgtttctaagttttggttcttcatgcatccctaatatcactgttagtcttctctattttttctgtttatagtgtggacatgcctcatgcactgtcccagagtaaggaagcaatgaattgatggttgatggttgctttaggttctcattgtcttttcccctgctgtcatataagtctttatctagtcttccaaattcaataaactaaatttgaacctttgaccccatgtatctgtcctaaattccattgccagtttagttaatctaaggaagaacccgtgtcctcctcccgactatcaccttcctctccacatcattgtctgctgaaataaggatgcattccccagttggtatgaaaaaatctgaaactcaatttccagattaatcttccaaaaaatcaactccaatcaagccattttcttcctctgaaacacactgttacactctattacctggtgatataattacagactcctccctcggcagctccatcccactgactcagtagttctgactcattttgctcattccacacagttcacagaacagcacactgctgtcagtaatgtctcactcagcgcaccattgatttgtcctttccaccccttctcctgttattccactgcatacgttgtaccctcttaggaaaccagaccacaaactactggcataaaaaatgcagtgtgtttccacctccattccctgatttttgccgttcctcccctgcccatccgcttttatgtgttgacacattcacataatcttttttttcttattccaagtgctttcttgctttttttgactgtcagtattttttttaattcactttattcatccttctgtttgatattcgcctcatcttctttactcgatttgaaaattcttaaagacaggaaattggccttacccaactcagtagcccttgcaacatagagtagatattaaataacagtatgttggattgcaataactgctaaccttcagttgactatatatagaaaatatagatcattgttcaaacatagtctaatgcatcattttgcaaataacaattaagtcggaggctaggatgagttagggaaaagccttctaaatttcagactataggaaggacatactgagattaagtagctcctggaatcatctttagaaatccctaaatcttggctaaatatttacctatgttttccacatatgtattttaacaatttgtctcattgtttagcatgaacaccaaacatctctgaaactcagtttcctttcctttaaaaccaagaaacagtatctattttacaaggtggttatgaggaataaaggaaataagagtttaagtaagggaataatttctgcttaaaaagcaactattgcatttagtaggtactaaaaatttgttagtttcttcctcctgttgtgggtacacatggcccacttaactgaaggagtctgggatccacaattaatccttggcatcagagctgagaccccatagtgtggcctgtggagccatctactcaggggacaaccacacataaaccattagccttaagagaataaggaggctctgagcaagacactctaacacttttgcaaacaaaaaatttctattatcaggatttagctatttgatgccctaggattctgtcaaggtaatttgaaggactaaaatcaaatttaaaaggaacggcattctgactgtgcatttcacaattttttctacaaaccacctaaaatcatctccctgactttccgcccagcccactctacttccatgactctaagacaaaactgtgcctagggactgagcagaactgaggttataggtggggaatgacatagccccagctgttgggaaggggaaggctgcagagcctaggagcaggtaaagtctggagcaaacacctctgccgtttttattcatctacacactctttgaggcttttttttttttgtctttgaagtggaaaattataagcgattagaaaacatggaattggcgaagacagaatagtagaaacactactaaatggtttttaggaggcattgtaaacagattcaaattttcttgaatgcaaagttttcctcctcatttcttattactttcttatttttgtgtcttctatctctctttgctttctctttgttctgtagccttctctgaacactgtttctgtcatcgaggcttttaaatatatattgttaaatattattaacttgatgtaattaagcaaaggaaggaagtcagtctaaatcaatggcaaactggagaaataagcaattttttaggaaatgaaggattaatactcttagggatatactgaaactattgaaagcagtaacacactacatcactaaggaagtggaaggctgccttaactcctacataagcacattttggaaatttattgtttgaaataatttgttgtgctacagacctttactgtttaaatagactagtatttattttttttacgaattgcttagcaaaaaaacattgaggatattgagatataaatgcaattcttcgttgcttaaaacttggtgctaataaggtcaagaccacacactaaatctccgtatctgccggttctctctctctctgttgcgtggccacaaatgtatgaacaagaaactcagatcataagcagcagtgggggagaggatgtggatgagtctgtccaatatgccttctcatattggaaaatggctctgttttcatctgatatgcacctgtggttagtagcttcgtatttctttgtgagcatcagttatcctagaattttaaagataattttaataccatcattgttgctttaataatttattttatttgctatttcaactctactatgtggtaatattacttaaaactagatgagaattttctgctttcattgatatttcttgcacgtatatttatattcttctcattaaggctaataatactatgtgagctcatagaattggcattggaattctctgaaggaaaaataatgatccatttcatgagatgagcgatttttacaaactgctgtttccagctcagagtgctttgttcagtgattaaaatgtatttctcaattaaattaaaatgcaaatatagacagtctattttatgattataatagaattatttaaagaaggttttatgtaaacctgctattaatattttatgcataaactgttcgttttattgttgggccggttctgccatgttccattttcaagattactagaagtgctatgaaaacttaatcatactgtccaggttttatcagtttttacccactctactctgggaaattaagtaggatgctttcctatatactttataagttatgccaggggtgttggagaaatataaactactaaaacctcagaatcccctgaaactgaattatgaacaatttactattctttaaagaaatgtttttgttacacagatacagtgactcttaaatttacgagtaccatattttatagtttctcatgaaattaaagatctagaagcatacttcaagaagccattattccaactttttaatttatattagaaatataaaatatttatattagaaactgcatataatgctatggatttaattatgatccttttagggttttcttttttctttctggtgtcctataacttctcaaacatttggattaaaataatctttaaataatattttctaacgtgatcctttttgttgttgttgtttttagtgatctcagtgaaaaccaaattcaggcaatcccaaggaaagctttccgtggggcagttgacataaaaaatttgtaagtatctatttttaaatttatagtgttttaagtcattatctattttcaaagtcaagtttatattaaataaagtgtcagaaagaaatggtgaaaaccctgtgtatatttatgcttgcgtaggagaccttgtaacagtaagttgtcaattgttttcacaagctgtttgacgagatgctcatttagaagatgtctggaaacaagccatcattaaattcattctttaatccttgtgattaatcttttgaaacctatgaagtgatttgattcgcagatatttgtgttttttccccactttttctatcagcttacttcagtaactatgtattcagttgctgttggtgtttattagaaacaaaactgttagttttattgttgggccagttctgccatgttccattttcaagattactagaagtgctatgagaatatggactattattttctggaaatagtagataatattttcttcttagagacacctgtagcctagagctacagctttttccagagttttaagatcaccctttgcattaaataccaaaagcatgagaatgacaaaattatgtctttccctttgtgtgagtgtatttcttacactttccctcatatcctcatgaaagaatgtatttatagcatcctttaaaaaaatgaaagtgcatttctgtattttcctttgataaatctttagtctggtgtttcaattataagcattttttaagtgcctttatttctaaggatgcatatcagatttaagatctcagtgacaatcataatatcaatatctctctaaattttaaaatactatattagcttctaaaaatgatggtttttgatagactatgaatcctaggacataaatgtttttcttagcttttacattagtttggaatgtaggggagaaaagcccctgtatgctgagattaactgtcaggaatttaatatttcttagctagtaataaacagggcaggcactttttcaagaattaacttatattcagaattctccatggttggatccaatgcctttttttttttttcagtagcaaaagtaagacagatgttttcccttgtcaaagaagacaactgtttgtaaagccacagattttggcctctatgtgttctccttaatgtaaatgattttttgaacttgcactttctaaatgtacaggtaaagacagacaactacaggcttctaaggtataaatgtataaagccattaaaactatggctgtaaggtttttatgggtgctcaatttaatatgattttatttgctttctttttacttttgctagttagggcttcaagaagtcttcaggtagactcaatgatacacagtgttcaaatctacctggatagaacagtgtgcaagaattcctatgtagcatttacttaagttgccttcacttagctgtaaaaatacggcaatagctgcagttgaccatcccttagtaatgctatttgcagtcttacagtagtattacctctaattccttaaaacaggtggcttttaatcttcttagttaagatattcagggaatccaagtaaaaaagtggccctcctcccacatttaaggatacgcatggaaatagggaccagtcagtcatgatagaattcttctttatatattttatatttatccttaaaacatgtgatttcaaaagtttagcgataacagaagctagtcagtgttctatctaatgggatgttgatttagcaaagttttcaaatcttttctcccccacaggcataattttttctcagaatttaaagattttttattatcatttatgcagttagatgagtttttttaaaattattaatgcagttagttgagtttaagactggagtctcagaatgttttgttattttttggacttgcagatatgagcaaattagtcagcttcattaagccttagtttttacttttttttttttttttttttttgagatggtgtctcgctctctcacccaggctggagtgcagtggtacaatctcagctcactgcaacctccaccccccgggttcaagcgattcttctgcctcagcctcctgaggacctgggattataggcactcgccaccatgcctggccaattttttgtatttagtagagatgggatttcatcatgttggtcaggctggtctcgaactcctgacctcaggtgatccaccctcctcagcctcccaaagtgctgagattacaggtgtgagccactgtgcctggccagtttttacttttataaagtaaacaatagttatttgggtttggtatggttattagggaaagaagatgtatgaaagacctttcgaaacagtaaaatgctatgaaaatacagtatttcatttgcaagtatttgactaatcaaatgctaaaagttaaccctaaaaaatgcatcataaggggagacaggaaagtgtaacatgaaatgattagcaatattgactagaaatgactattctattgtgggtcattttgacatgaagttacaaaatggaaaaagaaaatataatagaaagtgctaaatgaatatgcacaagaccttgatttgtgaacaaggcattaaaggctgtaggtgctgaggaaacagaaaagtatcgcttgaagttatcagggaatggttagattggaagagtaaaaccatagtgcagtggagtctgtgtgtgtgtgtgtgtgtgtgtgtgtgtgtgtgtgtgtgtgtgtgtgtaatgtaagggatggaatgtgcccaaccccagtttgttttttttgttttgttttgttttttgagacacagtctcgctctgtcacccaggctggagtgcagtggcacaatctcagctcactgcaacctctgcctcccaggttcaagcaattctcccacctcagccccctgagtagctgggattatgggtgcccgccaccatacctggctaatttttgtatttttagtagagatggggtttcaccatgttggccaggctggtgttgaactcctgacctcagatgatccacccgcgttggcctcacaaagtgctgggattatgcacctggccatccctgttttttaaaggcaaagcagtatgtgtcttgaatagccgcagtggtaagaattatagggatctgaatatggggggagctgagtattgtggcatctacattatttcaactttggaagcttatgtttctacagaagaaaaggggcttcagaaactatgtggatgatgagtgatgttgatcaaaagaacaatttattcccactattctcattgccttccatgtaacaatgtgaaagacaatgagggaaatattaaaatatcacaatgaatgtataggtttattttatgaattaggatcacagctgcaatattataaaaattttacattaaaaggcattttctaggattaaaaaatagttcaaactacattgttcaagaaaagttccaatctcatggggtttgtatgaagtttaatcatgaaaacttacgaaggctatctggtaaaatatattataactgagggtaaatttaattcctattattgtgaaactggtgaacataagtcatcgtcatggctcaatacatttccattaatattagcattattaatattattagtatttggtgtaagaagaaggtacagtacttcatcccatgtgtcatgctagtatgtccatttacaagttgaaaaaccctgcatgatgccattgtggctactgttcagtgttactcagagagtaaaagagaaaaaaaagaagctgcccaggccatattttgtatagcactatgtaaaagcccagtctgatgcactgtaacaggtttatgggatttggcacattcaggccttagagcaaattccagtgttcacaagattttcactaaaagcatttgctttaatcttgtggattggctaaatatgctcaaggcggtatcccaacaatatgaaattgatgctgtggaaattttgcagattagcagatctcattccccttcctccaggcaagccacactaaaactattctaaacagatggacagttatcttgctcttaaacatctccagggaggacttcccataacttttttgcttctctctattcatttcttaactcgattaaatttttttacattttattttgctaccttattttctccagccacaatttaaactactttttcccttgacattttacacaatgagatatgctgtgagaatagcaaggtcatatgaaaatatcaactaaattatactgtttataatggtcactggtggtacatttctgtaggatttacatttgtgtttttaaactcccaaaacaaatatgaattaagtattgatagcatatcattatcaactgatgctttgccaaaatgtaaccaatatttaggaaaaattgctttagaaatgtgtgtgtgtgtgtatatatatatagatctatatatctatatatagatctatatatagatatatatctatatatatagatatatagatatatagatctatatatagatatatatatctatatatagatctatatatagatatagatatctatatagatatctatatctatatatatgtagatatatagatatagatatctatatatctatatatatagatatctatagatatatatctatatagatatatctatatctatatatagatatatatctatatatagatatatatctatatatagatagatatatatctatatatagatatatctatatctatatatagatatatatctatatatagatatatctatatatagatatatatctatagatatatctatatatatcgatatatctatatatatcgatatatatatttaaaagccttaacactgatgcagtaaagcctttgctgtcttctaaacaaatattgaacagggtcatgttacattgtgccactgatttgttttcaagtatctattaggcatttccattaattgagaatttagaaaaatgttaaaattaaatctcactttactgccaagaattgtgagcttattcttgaagaactaatagtacttagtaagtaccagaatatttcaaaagtcttttgtttttatgataaaacattcttagttatagttatcctaggattaaagaaaaaaggtacaaatatataaactttaaaattacctagatcactagtttttagtcacatcacaaaaacaaaatctaatttactttaccgttggttttttagtgagttcaatatgattacttaaattaattaaattcaaaaaggacatattttaaatgtactatgtgaggtaaaccacacctgctttctgctgctttaattttgcaatacatccacaaagtgcatcctctattccaatcaaactttactattctttcttcataaataaatatatatttttccagtttgcttgcattatctcaattccattaaccctatgtctgtcatgagtcttataatccttttccaggaacaaaatgcttcttggttaaaaaatatgttggggaaaatatttgtatttatccttttttgtacatgcattactttttagacaaggctttaagtcagtagatgattcagtatgattctctttaggtaagcaaaaatatcatttggaaaataaatatatatattcctatgacattttaggaaggaagtcacccaatttggaatacattatttattagcataaaacgatttggcaaacaggatagagagagttcacctatgtgttgttacagagctatttacattagttagaaattttgtttttctgctggaactgtgtcattttcaagttttgtatcgatggctccattagaacccatagaaggaaaactcacagttctatcccagaggcacagagctgcttacatatttcatcatatttttaattttttctcatttcaaatatctgttttctagttttcactgtcatctacataattcctaatgataagagagcaagggttgctcacttgatatagaatcaatatgtaacaaacagagaaaagagggtatgtaaattttaccaggcaaatgcaagacctcattaggtttgtcatataagttaggtcataattgcaaaatgtcttctttaatctgttagtttttctgtttagttcattggattttatttcaaatccattgatatcagattgcagctgtacatgtccgtgcccctagctctttcctagagtattttcagtaaacctgaagctgaagagactgcaaatggtaggttggtttctcatttatagggattgctatccttactcttaaattccagaggtcttcagtgtggtatagaaccttctgaacaaacctgtagggagggctttttacttagatagatagtaaatgaaggtaaggtcttttattgcctttctgaaatgaaacttaccttcatttcctatgtaactaaataaaaaggggttgtctcaggcattcatatatataaaaaaattagtagctcagcagatgtccccatcagtactatgggaactgtccatggttctgtattttgcttggttgcactgcctctgaaagcacaatgaattgtgataatccccaacaactatgacaaagtttgctaccaataacctctccatctttgcatttttctttgtcttcagagtgctttcagcagtttttcttcaataatgcattttgtcatgtaaagatgtaatctaacaatatttcttcataaatgccttctagaacaaaacaaaataacacaaaacacaagatagtctgattcagcaattgggaatccaattcacatacttacaaaatatgaattggcataatcatgccatggctgctgtgtcttcttatgatacagaatggacctttgattttttgcatctttaacactgaacagtacactttctcacctctgaactcttaaaatagcctgctaattgaattttgacctctagtttatattctcattagataattttaacaaggttgccagattttttcccataaaacattgtttattatctattactacagggtttaaaagtattcagtttatttaaaaagttgttttaaagtacctttgttatagacactatggcaaagccctgggaatagagcagaatgttgccagttctatagtgtctatagtatactagatacagaaactctaggactaggcagaatgttgcctagttctacagtatctgtaggaattacagactctttcctgaaagagcagagatgattattaaatgctgtaacatccagtctctttaggcattctgactactcctagcattctgactttgatccaggctcctagctccttcttcccttcaatctgtacagaagctctttgctcaagccagaatggcctctctgttgcagatattcactgtgaacattgtagtgcctctgctcacaactcttctttgatagacccattacctccataggaaatacccactttattttctgtctaattagattctatccattttttgaggatctgaggttttggtttttttttttttttcctttctttcatgactacatcagcctagagtaatctctgtcttttctgacattctatagtgcttttcatctgctggtctcttccatagtaatcattgatttagctgaaacctccatttggagaacaaaaagttcctgagtctttttcctgagtcactatgtattgagagggagttatggcaatacatacatctacattccaatgaaaacttcacagactatttgctacataccatgtataacttattgaacttctgtgagactcatagtctcaaaatccggatgatgctaatttctccttcccaagttatcatgaggaataataagatgacgtatctacagaccctgccatatgctatgaatttattaaacgttagcaattattattatcattttcagtttctaccacttttgattagttcacttacaattcccaggacttaatgtcaatgtagttgtccttccctcaattgatgttaaagcaggttccctccccatctctactactgctatctgttgcttcttccccccaaattgacaaacatataactttataccataggctactcctataaaaactgaaattctttattcctgtgagaaaagcaaattgttgcctgaaatattgtaaaaggattaaattctcacataatgtaaattactttggggtcctcagaatggtccataccttaattgctttctttaccagttttgaagttaatactgatgtgcttttatgcagaggtaaaggatatagttgctgaaacttatgtcaaggatgtacatgtatatggatcaatttttattcttatactctatatcataatttatatctggggctactctttaaaagcatgattggcataaatattgatatatagacatttgtattgacttgaagtttatacacatatggaaagaaggagaagagaccacgctcatatatgtacagcttttttattctttttctcccatgtggtttatatgttttatttggtttctttacaatagtgaaaaattgttattccctcatattgattttagccatttcgatgtgtcttaagtcaactaaatttttggagttttctatcttacaataataataatacgaacataaagtaaactatttctagcactttaaatgaaacaaaacaatacaaaattggagcatagttataataattttgttgagacattgagagatccagattgacttagaaattattaaagattgttatgttctatattgttaagcacattttatgtgtcttctaattcttaccaaaaaaacctattagttataagaacttataacttggatgctgcagtagaacatgaatttgctatgggtaggaacacactaattgaaattactgcagttttatatagttattaacctaagtgttgtatatgtaattcaaactcagtgtgatatccatattttaaaagaataaagcaggaaattctttaagaaaacctaaatgatggactagcatctctgtttcaggatgccaagtaagcaaatgtttaacctttttgtcatttaatatacctatttttaaaacttatatttagcaacattgtatattgtcccccatacctagaataaatcaaaatttgaaactaggataaattatttttagtattaaagagaatcagatgagcttcagaactttttgcacgtgaggcatacagtggtatctcttaatatatggagcccatcgacacactgcattatgtgagactaaatttaccagcgctggtaaaaaccaaaatgaactatctagagttattctagggcatcagaagatatacctcctaccataaaaaaaaaaaaaaagaatgttaataccgagagatcatgattttttttttttttaagacatggagttttgctcttgttgcccaggtgggagtgcaatgtcatgagttgcgattttggcgcgctgcaacctccacctcctgggttcaagcaattatcctgcctcctcccatgtagctgggattacaggtgcccaccgccacgcctggctaatttttgtatttttagtagagatggggtttcaccatgttggccaggctggtctcaaacccctgacctcgggtcatccacctgcctcggcctcccaaggtgctgggattacaggcatgagccaccacgcctagccgaggtcatgaatgttattcttgaccccatcatttccgtgagattaaagcagttcttcaaaacacaaatttacttggacagcaaaggatcacatagagaggtaatttggaatttgaacagaagccaaagggaagattggagtcagcaaataagggagaagacacaaaagtatgtgctaagttaggtcagctgaaggtctgaaataaaccacttatgatacttctgcccttagcatccaactgtctttaatgatctgcaaatttacactatgtcttagtgaatagttggagcataatattttttttgaagaagtgaaaaagtctcctctggctattttcttaattcagaataatttcgtagcacaattgcaaatcacatctgaagaaggccagcctgtcactaaaggtatggcagagaacagatcctttcctgtttacagaagccagaagtacccagggcttgaaaggtagtggagaagggagtgagcagggtgaaacaaaaagagtgcagctaagtagtccagaaaccctgaaataaattacattgttgcatagttttgacactgtttatcttgaaccatatacagacaaatgaaggtctgttgggagagattttctcatgagcagtgataccagcacaacactttatgtaaaccttcctttgaatatcaaaaaattgacaggttaatgaaagaattattcacttgtttaacttggattgccccttcatatgagtaacctcatgaaataccttcatgttcaggaaatatgtggactcagatataacagtattcagagaacttttaaggaaaacctcagtcctatggaaaccaaacattcttaatgttttagcaccaataagggcttagatttctgttaagaatatgaagaagcgtataaccatgagcaatattaaagaacaatgaaattaccaaagtttccagcagcatctcaacttctgctcctgtaaggaaagtagttggccttccattccttgtaggacaaggtttgcttgagtgctttctggcatgctggaggttcccctttgtgtattgtgtgcatgatttagaagaagctgtgtcagcattgatttatacattgacagctaaggataataagatatgggcaaacatacagctcacccttttacagattaacctggagactgcattaggcaaatttgatagcattaaaagattttgccgatttgtctggaaacaatttctcttttgtagtgtgtcaggggtaacacttcatgccattgtactaatttaaatggctttgataaattgttcaagaggttagagaatagtagtgtagatatatatatagcactttaaaataaaaaaggctattaacttaattgttaaatgaatttaatctgtaaaaatcaaaagtgctcaagaatgtaagtgttttcttggaaccacagcagccatattacatcatgagactttaaatgtcttcttcgaaaataaaatacttctgcattatgtcttaataagtagaaattatttaggctattataatagcatggatgttagctatgatttggggaaaactttagttttataaactaaggcttatacaggcaataaaattgtatcttctttggggtgcacctttgttaatagtgcacgtcctaaattgtaccatttgcatgacatcaaggtagccttgtgtatgattgtgtcccctagagaacttcttataaatgagatgtgtatttcatgagacattgtctatatacataatttctaaagtaaggaacttgaagaggcccatctgaaagtcactggattaaatcattgcacctttattcagtagtcttgtgggagaaacagctattttatagaaatgttcaaacggttctttatgaacagacctcaaatatgaattagccctttcagtgaatgctgaacttgaaacgaggacaggatgcatttgtattacgatcataatcttactcctgttcatccacattctctcacccagtgcgtgcagagctgaaaactcgcctcttccatgaaacattttgtttctatctcaagtgaaacgtcaaaatacttttttaactgaaataatagcatctctaatattcaagctactgtatttaaacaactgcttgttcagaaaaaaaaaaagagtgtggtacagatacaatatagtacttcactgttaatttcaaccaagtagaaggctcaatatgaacaagaaaattttaattctagaacaagcagcaggaaaagcagacataaccaagtttggagcattctttttttgtactatgaattttaacaaataagtgcttaagatattggagaagattcatttacttcaattatgcattatttagaatttcactgatacagcttttaggctttttaccatagatacatgtagtgtttttatgatgtgcctgtagtatatgtttcttagtggctttaaccaaaattagcatctttttaaaaagcaaaattgttatttaatacttaaaaacctattttctggagagcgatataattctggaagttccttaactcaaaagtatgctgtatttacaatgcagagcatttgcatataatgataaagaatgtgaattagtaggatagtgacacttaatatagaacaaatactagctttctaaagtgtatttctggttgggaataagagcaagctatatgggacatcagttccctttctcgatttggagtccttgaaggaaaactgcttttaaaagaaggaaacctaaaagtagtcttgctctctcatgccaaggatagtgaaattaacatgcagctgggcttctctgataaatggattctgttaggtcactgagggggtgcatgtgacattaagtgatttacagtcctttaccttaatgaaattgtttcagcaagatgacgctgaaagctcttaatggatagcttttcttgatctaatgaaattgcattcctatggcatttaatataaggtgcagttattatttactggagctttccaagggctgctatttgcacagacagttcagaacaaaaagatttcagtggcggcatagaggcgagaatggcttatgacattcgtaagcagatgagtgtgtttgtgagggcacttcagtgagtgtgtccagggtatcatagacccttcaggaaacttctcatcacctaccccagctactgtccatcccttctacatatattcttctaatctttttaacaggcaactggattacaaccagatcagctgtattgaagatggggcattcagggctctccgggacctggaagtgctgtaagtactgctatttctcttgctcttttaacgggggctttgtgtctggacaggactaatgtggaagcttatctgctagcttaaaaccttgttgtcaaaatagtctctcaagagataccttaaataactcatggtgaatacagagaagagtctaaatgtgtgtgtgcaaaaccttgcgtaccatatctgtatatttaggtaaaattgtgtaaggtcactcaaatgttctccttataaatgtttttatgagattcatagaatttgtcattgctaaatattgagataaaatcaactttataggaaaaataacataaaaaaaaacctcttagtagctgatatcttggaataatttgtcgttgttaggcaatggaaacacagtttctcattaaaaaaataaattttttaaccagctgatttaacattatttttgtaagaatactttgaaatctgcttcctaaggttaataagccacccattagatccattttcaagtcttcaccactgactttgtaatgtacaacacgcagacttgaattataattggcaacctcctttcctccctgggtaggcatgactgacaaaattggttagaggcaactaagtaacctctattgaccaatgacttagtaattttaatgaaattacaaattttaatgaaaactgtggttactaaagcattatatgccgcctatacatttttcgaattttttcagccaaaattcacatttgtaggttttttaatacacttacaattcctccaccaattaaaatatttttctctgctttatttcatccttgagaaaatttagtcagaaatctataattgaattaaatgttagggtgtttttagtcaatttattaaaagttatcgagaaatcataaaatccttccttttccccacaaaaaaggaattcattactttataaatctagtttcaggaatggaatatcattctgaaaaattaatctttcagctaaaatggcttattttatcagtatttttatatggttttggttttaattgcaagaaaatagaatttccagctgtgtaatgtactgttattaattattttaaaagattgtatgaatgaattgattgggataaaatgtgaaatataaaaatatagactactctctaacaacaggagaggccacctttgtttctattgataatggtctaagtttctatcggaaaaatattcaaagtgcttatcatatacattttagctttaagaccactatttaaattgtataccagaaccatttttaatatacgaaactcactgatggtatctcagagtcagaataattagaatgatttcacagtagtggtttcatggcaaaaccatagtcagtgtcactaaaattcatagatgaggagactaccaaatttaatcaaacagctgatcaagccaaaaatgtattattaaaccagtgttcctaactagaaatatgaatgataccaatcattttatgcaaagtttgctatcttggatgaattaaatcccataaattaccttgttattaagttttcagatgtagttcttcactgtatttattcaatatatgtatatatacacataaatgtatcgaatacctactgtgtatattttacaaggtagagtgaacactatgctaggcactgaaatcttttacccacaaatacaataactacatttgattattttctataaactaatatcgttgtcttcagaagcagtacgtttatgaaaacacaatcatctcatacattttgatcgtcatgattaatcaaaatatctaaaaagtgactttagcaagaatgaggcaacacaccaaagggtgacattttatggttcatggaattaaaatagaaatccaaaatcttggaaactcttttgaggaccttaatatatacatcttatagaagtatatattggtcagagtttgtttgttgaagaaataataaaaattagcatatgatagaagacaatgtaaatttcttctaaaaagattgaaatattttatattaaaattttataaagttgatcagacattactttaaatgtttttttttcaatcctcatactttaaacaacccctagaaaaatcagttgataaataacttaaggcaaaattggagcactgaaaagacgataatttatgaagcccaaatcacttgtgaaatacaacaaaagtttacctattacaaatgtttggtcaagagcttaagagaggttgcatgaagaagggttctagaaagatgactgtctgttttgcttatttttaccattcgtgactctttaggatgtactgtcttatgtggaaataatgaaggaacattaacttacacattgccttaaatttcagattccaagggttttagattttttaaaattttaattccttgagccatttgtgaatgtatgactatactgaagctagatgggagaaaatgaggtaatggcccttggtcattgatgaaaagtatcaaattaggatatatatgagcgtacaaagagtgaacagagtccaagaagtcaagtgaaaatctaaggtggatgaaagcaaggaagcagtttaacacttgcacgttcacggagaactggtttattgtcagattctgatttgtagaacttagaagtaactgcatattttcttaatatttagataccatctcaaaaataacattggaaactaaatcttgatcagtattttcccttctttggacactggcctcagaaatgaaatatatcccttgaattgctgcttttacatgtttatttttctttttcacagaatgaacataatttagtgtaatttaattgtagtgattcatatccactaaataccaaactctgccaaacgatatgcatggtggtaagggaataagatgactaaatcaacatacaagtgtgagaggtgctccatgattatacaggctaatatttatacatcaagatgtcttttgtattagaatactcattacaaagaaaatcttgaagttgagcacagaaatagacttacacatgggagaaaatgttcacaactaaataattacaatatataaatttccattatttcagaatggaagttgaccataaccataacatacacaagtaatcatacttaacacttatatttattattaattttaaaaataattttgttggttctgcatatttttcagtcattgagtatcagtatcagtacttctttccagcatcagtacagaataaaatactaagataatgtattcctttagttgcattatgtgaactaacattttgagaaaagacttcaaattgataactgaagtttttggcattcaatgaaagttttcctttgcatggagatataagaaactatagttcaaaattaatgcatgtctgctctctgtgtagtacttaaaacaatttattcccaaagtcatatttcagaatgctatatactataaagattttagccatattaagtcagcataaattttgaggatgggaaaagggatcatttgaaagcaaatcccattgagaagtttaacctttgcattcaaacatcaggatatattttaatggcatttgaaaaagacatctcatttcacctgcacataggaaaatgctaaaagctcttaggtaaactgagccaacaaatccagtgctctgtaggtcccccataaagtggtttattttttgtgacttaattcaaatgacttagaatagttcttatataattcaatacattgcaaaacaaggtggtaaagagggtccatgcatgatctgggtctctagctgacatgccctgttttactgaaaagtttttgtcaatctcttgacctctgaacgcaccatcaataaccgcagccaccaactggcccagagtggcctcaaaaatatattttgtgtagctcaaacataagcggtctacagactgtttgaaatgttttaattagttgccactatttaaacattagaaagatctaaaaatttttatctctagcttcccttggaaaatctgattgtttgacagccctcccttacagcaggtcagtagtccattggagctggagattatctgccacaagagagactatcattgctagcttaccatattcttcacattccccaaatgtctgctttcttccatctctcttgcccatcattgtatatttttgcacgtggcctgcttcgctcatttctgttctctgctcaggccctgcagtgaacttgcaacccctaattcaaatccttgtccagtatcaacttcatccaacaggaccactgatgctctttctcctacctccttcagaggaacttgccttctttagtcaacacctcaatgtgtacctttagtctctcccagtcttagaattgctttccatgtctacactttacttgtataccccccgggataacttctaccactttcttatcacaaccagatttttctgaagggtgatgaaagctcatatgttagccttattagtttttgtaatttgtccaatcatctccccagctggactgtatgctatcttaggacagagtatatgcctgatttatttttataatactccatgttaccataaaataatagccatttgggaaatatttgatgaatgaatgagtagtaatagaagtagtaataatcaataataataataataaaactaacaaagttgcactgggggaaaagtaaggatgttatttattttcacaataactcttcaccacacatattcctggatctgctacctcaagaaagcatgactgctgccacacagcagtaaacaaaggtgaatatgctactgcaactaaaaaccattagaatggattaatcttttaacacggtgctacagcaagttacttcatccccacctggtgcaagtaccagatgtagatatagctgtttccactcaaatttcagcagtggctgatgtctgcggtaaataatagttatcaggactctgttccaaagcctgacacgaatgattctgtattgttgctatgagaaatcagtaaaagaatattaattcaaatacgttcattgactcatggacactaattacacataatgccactctacggaaatgtaattgggcatattttccaactgtaactatcccgtgtttatttcttaaccaatatcctaaatagacatgcatgcacaaggtacataaagtagaatgtaaatagtcaaacatgctatgaatgaagccataaatttgtagtaaatgttgaataaaacaaaatgtacagtaatatgttaaattatgaaattatttatcaacttgtctatagagtagtgcattctctatgtcatctctaccaggtagctgtcctgcataagcatagtacaagacgttttctctatgttaatatataaaatgatcaatcaattttgtatctaaaaattctaacttttctttttaattctacagcactctcaacaataacaacattactagactttctgtggcaagtttcaaccatatgcctaaacttaggactttgtaagtagtcacaatatatgtaaaagtcatattaatcaattaaagcttccccttaaatagcatgttcagtaagcaaaggacaggaccactggtttacaaggtagacaaggaaaacccaactttggaaaagactagatatgatatttgtgggaatgagctattattctagaaactggaaagatttcttttaactgatatgcattatggaaactttggagttaaaaaaaaacaacatttactttgagctattgtggaggtcacatttcattaagaaatggaagactccttgattggctgtcagaaatgataaatgggaaatctttatgattttattactgtactgcaagcagacctaataaagctaaactggttcttcaacattccttataacgtgaaattatagcatcaccctctagtacttctataattaagattgtgtcagcatttatatttaaaaatatctttctgggttacagatggacattaagatatttttggtctaataaagtattgactacagctgtttcttttctcttgaagaaaaagtaatccttaaagcccagagtagcctttaaaatctttaaagcccagggtggactttaagttatagaatatcagaggtaaatctcatttgaactgaatttcagaatcaccttgacctaaaaaaatatattacatataacgtgtaggacatgattggaagcaaaaccaaagcatcaaacttcttgaaaaaaaagtgtttttaagttgggtaaatatattttgattagattttcaaaatactcctcattttctgatagcttgtaactggaaaatattaattttattttcttaataaaaattttgaattaccatctttttaatgaactaggtaataccaattttaatgtcatttttttcttactgaaatccaactctgtacataataacacatcattataatttccttggaatattatttagcaaaataaaggaattctacaagtatacagacatagctaaattttgcattcttggggctatcagaataagactaatctgacagaattaacagcctagttcactcaaaactataatttcccagtaacttcaggtattttttttaaaaagaaattgattcaagctttcaatctttgcaaaaacaaagccaatgaaattgtaaaaacattcatctgaatttttgacagtgtcccttattttcttgtagaaattcgtgagtttgtcttactaatcaggtttttccatttttacattcttttctcatttcaagttcctaattggaatttttataatgtgcttggtttagacggaaatatttagagtacaaggatatggaatgtgcctctgtggcttccaaaggccagaacttcaacttccaagcaaaccgagcaagaggtcacccatctttcccaaaatgtagctttttgttctgtggtacgccttctagttgtgaagcaaaacattgtgttccttatctataagctcaaggagaatgcaaagcagccattttacttgaaattcctttgctttggttgggtcattattctatagtatcattgctacttaaaaattccatttttatagcctaattatctttctggactgagttccatgttttaatatccattactgttattgggttagaattgaacacatcagcttaaaaggactaaaatggtattactgtgtcatagatggttctgggaatggtgctttgatttatagctttggatgtccttttctttagtttgagaaaacataaaagccagtttgaagtcatttacctaatttagtggatacatttgtctgatattttattaatggagaagtgctatttgccacttggaagcaatccatgatcttgtgtggatcctgccaacatagagcgactcacttaattccttcactcccagacatttgtgccttttaatttcagtccctgctctttgaggctaggtctccaggagccaaaggagctaatcccttttctgtgattaaacaacaaaagaaggaaatgagaataagggtgtgaaaaaagtgttttatattgaattattattctgtcttgttcagcaaaaaatgcaagtgtcctgctgcaaaggttttataagcggtttctatagagactcataatggcaggaattattgatatttcaaactgggagccacaacttttactaacttgcccctcgcccagtctccccattctcccaccccacccccattggctctcaggatgttggaactgtggagcaatttgcattggacttatttttttctctttcctcttttaaatgaacgtaagtgaaatatgttcgtttaaaacataattttatggacatattcaagcttctataaattgctcagttcagactaaatgaagagagacttgattctgtgattgtacatcagtttaatttttaggaaaaataattatattggaatctgcttagctttatctacttctatgttaagaaatacaggtatatattaatgaaataacgactttctgttttcttgctttacacttctttttttctcatttagtcgactgcattcaaacaacctgtattgtgactgccacctggcctggctctccgactggcttcgccaaaggcctcgggttggtctgtacactcagtgtatgggcccctcccacctgagaggccataatgtagccgaggttcaaaaacgagaatttgtctgcagtggtaagggagaaggaagagtgatgttattgtgtttattgtatcctgttatgtaacagaatgtgagggctgcatgcgtcaaaggtttcagtattgttcactaatgttcaattgtgcactaatcactctacagagatcctctttttcagtgaaaatatgttctgagacctcactatatcggttggcaagtactggttacttgtatctaaattatgataaaacacttttcagttttcactccaggggaaaatatggaaaatcgctaaatgatgattctacttttgattttttattttcccattaagtaacaatttatagctacttttatgttaacaattgaaaaaaaatgattagctaatcctggatccctgctatgaaattcaaagagcaattcagccatagttgcaaagtaacaaaatacttttcatgcatacatgtatactaatggttcagttttacttaaaacaaatattaaatgaccagctttaataacaaacatctaaaaacaaaaataagacatagggtcaggcactgtggcccacgcctgtaatcccagcattttgggaggcagaggtgggcagatctccagaggtcaagagttccagaccagcctgaccaacatggcaaaaccccgtcctttctaaaaatacaaaaactagctgggcatggtggtgcatgcctgtaattctagctacttgggaggctgaggcaggagaatcacttgaatctgggaggcggagattgcagtgagctgagatcacaccagtgcactccagcatgggtgacaagagagaaactccatttcaaaaaataaaaataaaaaataggccggggtgtggtggctcacgcctgtaatcccagcactttgggaggctgaggcgggcggatcacaaggtcaggagattgagaccatcctgggtaacatggtgaaaccctgtctctattaaaaatacaaaaaattagccaggcatggtggtgggcgcctgtagtcccagctactcgggaggctgaggcaggagaatggcgtgaaccccggaggtggagcttgcagtgagccgagatcgcgccattgcgctccagcctgggcaacagagtgagactctgtctcaaaaaataaataaatcaataaaataaataaataaataaataagacataggctgtgtctaatatcaatcaatagctaacgtttactgagttttttaatatgcttaagcaccaacctaagtatttcacatatatttacctcacttcacctcccttataacaactgtatgagaaatgtaatattatctctatatttggagattcaaatgctgtgaaaaagaatatccttgccaaagtttatgtagttgagtccagggatctcaatagaagtggtttgattacatatatacacacacacgtgcatgcacacacacacccccatacatagtatcttatttgtatatgtgtatatatatgtgtgggtgtgtgtgtatatatatatatgtatggttggttctgcttcagcttcagaagtatctgttcaaaatacaacaaaacaaaattttaagaaacgtataatgcatcgtaagtagttcacagatttttaaaggcagggtagggagacatgactagtacttgatgctattaaatggttatattttagacccttgtttgtgttttttcacatgttttataacctaagaaaaatttttgtataatatcatggaatgttctcaatatgtctgattgcttttttaaaaaattaaataatgaaatgactaacagttcgttactaaccacttttttctctcttcactttttcctttctgttttctagatgaggaagaaggcaagttcacatttcttttttagaccgaggatatttttgtagtttaagagcttgtttagagggatagaattagcagctggcttgcagcctcttcctggcacgtcaccaccactagggccctttcctggcaggttggaaagggcagtccccactgtcttccagaaaccatgcatgtccagatgcttatttaatacaactgtgctgatattctgttgctcacctttcaaccattaatgtctcatttaaaaattgttccaaatattgagtaataaaagtacacacaggaagggagctacttataccaaaatttaaaattacccaaagcccccaaaagaataattttttattaacaataagatgactttatacaaattattattatgatttcagataaattgataattttgaacctatcaagacatcaaattctggcttatctaatttttccccacatttattggcatatgattatttaatttgagcaacaattatcttctgatggaagtactactgttttgttttcttttttaaaagaaattacaaagtaaataaagctgcatgaatttgataaagaccaagctctatttaatcttattaggaatgaagataaattagtctgaagttgctgggcttttggaaattagaatagttttgaatgtaattctgattttaaaactgaatttagcttttctcacaagttttaaaaattagcagtcttatgaccagtttttagaatctcatttacttcctctcatttgctttattgacctgaatatataaatgcatgcctcctaaaatatattttagaaatataggaccattttatcatcatgtatttaaagagatttatttatgtgaaatgctttgttacttgagctaagtttgtctgtttcacaattatgatattcaggaggaaaaatataattcctgtttatttcttttttaggtcaccagtcatttatggctccttcttgtagtgttttgcactgccctgccgcctgtacctgtagcaacaatatcgtagactgtcgtgggaaaggtctcactgagatccccacaaatcttccagagaccatcacagaaatgtatgtgcctgaaattctttcttatctccccaccttcccggtgaaccaaactttgattttctttgggaaattctgagtttatcgaaggcacatctgatcaattggcttagacaaatgttctcttcagaaatgtattgattcttactctgattgtttaaaaacataccatgttaaagtggctgtgatgttttttcttccacagatagaattaaaaggaatacattttttaggaaaaacaaggcaaacaggattgtttatacctggttccaccctttgggcctgtacatctgtggttgtccatttctcagtttggagcagtaggaatataaaaagggaccaagctggggttagtaaaccacagaaacaatacagttaggtgatgctctgcctcctcgagagctcatgttttaaaaggcagtttcactgttttgtttgaattgatagttcaatgcaaagtgaagaaaggataacataaagtcaaatgtaaagattttttatatagtgcatgttttagcctatttgaagcagtgtctacctccattaaaagttaaattcttatgacaaactattgcacacgtattttgtatgcagctgctgaatgcatttctatgtcctcaccaaatataagtcatgtggataaaacaaggtcacataagatgtaaaatggaatgcttttaccatcttgaaaagtaagcactagggaaaattgttacctcaatattcattgacaaaaccccttttaaccacccagcccattatattattatgttataggccaattctaaattgtaactaaataaattatcttggatttttggttgaaataataggaacaacttcttagaataggcctacatagtatgcgaaaaagttgtttttaaagcgctcatttttaaccaatttatttaattatgataataaagtaacttatctaatgtaccttatatgagaataattttagttcacaggactcactgccattagtttaaagtatctaccatgtgcttaataatgtgcttagagctttgcagtataagacatgaacctctgcaggaattctagactctgtgaagatttgacactgaataacatataaacataataatatcattctcatcaaaattttaattgatagaacattactttacctctagaagacatcttttagtattttttggctgaaccttgaaagaagaataagttataacttgggaagagacagatgacattactgaaaaagaaacattggcagcaaagaacagaggtggcagtaagcattgtttgagagattgtagttgaacctaattagaataacaggataatgttgaggcatcgtgaaatataatgccctaaagaatacatctccatttgattttaaaactacagattactgaagatgttgacacttgatgggaagatattagatgtgataaagtaaagagtagaacgaaatactaaattttctcataagggaactatatagtcatctatgcaggcacaaacatttattaagtgactatttactacctaaaggcaccattaattttcctgagatcatccatcaagtggttagcaaatgtgacatgcaaattgaaaactattaaatgagatacacagtgaaaaacataataagagatgaacacatcaagttcaaggtcttacaaagggcatgaagttgagggcaaggtacgatggttaactagagtcagaaagttttagttggaaccccaggtttacctatcatttactatttgtgagaccatggacaagttacttatcctctgagaccctgtatcccatctaaaactaagggcggttgtcagtttgatgtgaaataattaacacacatagagctatgtgtgctttgcatatagtaatcattccagaaatgataactcaagcatagaagtctttgtgtagaaataacactgagctagagcttgaaagatgggtagtgaatgaaactacagagatgaggacaaggctttcagaattaatgcaacatcatgagctaggcagtaggaatgaaagtacaagatgtaatcaaataggaattcagcttgcctgatacatgagatagtaccaggaaacaagttgtaaatatacattggagtcagttcatggatggtcatgttgatataaggatcttggattttatttggaatgcatttgagcataggagttttaatctgacttttctagaataattggtctgatggctgtgtgccagtgatttgacaaaaggagagaatgcaaggcagaaggcctcttcggaggctatttctttggtccagtggagatgtcagaagagtaggagctagtcagtgacagtaggaatggtgatatggaaacagctatgatagcaaacatagtagcagaattcatgggatttggcatttgatgagataaaggagtaatggagaaaaataaaccagactctgccagagtttcaagtatgagtgatgcggaggttgtggttacatcattgtgtataagaaagtgagaagcgggaccaaaactggaaaggaagatgacagtgaactcaatttgtgaaatactaaaggaccagtgacacatttataagtacaaaaattgggctgggtgcagtggctcacgcctgtaatcccagcactttgggaggccgaggcaggcagatcatgaggtcaggagatccagaccatcctggctaacacagtgaaaccctgtctctactaaaaaatacaacaaaaattagccgggcgtggtcgtggatgcctgtagtctcatctactcgggaggctgaggcaggagaatggcatgaacccggggacaatgcttgtagtgagccgagatagcgccactgcactccagcctgggtgacagagctagactccgtctcaaaaaaaaaaaaaaagtactaaaataatacagactataataattttggagcaagcaagacaaggacttgaggcaaaaattttggagtaattaacataatagaaaacagtcaatatttgaaaccatcaactgtctaatgaaaaggagagtaagagaggagaagctcaagaacctaaataaaaacagcagagggctctaataagtaagggaggaagagacttctaggaaaaatgatctccggaggcaaatactgctgccagttaaccaagctggggtctgagagaaggtcttggaatttgacctgcatattgttcttagaaggttccattttgatagagtggtaggtcaatgagccacctttcagactgtaaagaaaagaagtattgattaatattcaagagagtagataagccgcagtttgaatagtttggctgagaaaggattttttgaaaaagacaattgttgctctgtaatggacaaatttgggttaattctaagatgcagaaacctgtcatcattagaaagtcagaatgagtttagagagaaacgagagtgtgagagttatataagatacatgtgggagcaagatcagtctggacacaggagcgaattggtcaaatccagatcatagggaaggggaacaaaaagctgttacaggttgataaaaggagaagagtaagatggagacataacatattcatatagcaatatgaaacatttaaaatgattttcttatgtagtctattttatttcttatgatcgtgattttcttctactttgtatgtgctatagattttgtataatggtgggatttagttgcattaaagttatactaaataatatgtcccgtggactttgcctaaattgagaaggtggtgtatcaggtaaagctacaataaattaaatttatgaggagagatgaaaacgtgtgaaactgcttgtgaattttacttccctgattattacattatcagctttatcagtagagcatctggtaataaataatattgatcctcaactcaacaagataattccattttcattcattatagtggcataacttactagcttagtaatttatttcttttattactcttttattttttataagaacaaagaacatcactaagattattaaatgtggaaatatctttatagatggcaggtttttattccatgatgaactgaaaattataaactctccccattttattcaaatatattttcatatctgaattttaccataaattgttggttgagtttctttattgcaagttatgagatatttcattcaataattttgacttgattctccactgtgtgatatgtctttattcttacaactgtctcatgatataattctaatgaaaagaaagtatatgtatgccatatatgagtgatcaactgcctataaatctaagtagaaaataatgactcattttttctgctttctgtttccaactacaaattcatacttctgctatttggtaacttcaattatttgttaagcaatagaaggaaaatattcctttaaagtcagaattagaataatttggagaaggaataatagaaagagactgacatttattaaatacttgcaatgttggattgcagttggatcgcaatgttggcttgtgcacatttgatcttctcattgacctggtgatggggatatttatgaaattaaataaaatagtaaaactaatgcagaagcacaggtcagataaaggctggtggttttctccaacaggcctcattatactgatcatgttaccacagtgcagaagctcccctcttgtttacaggttagaatctgcttttgactgtccctaattatcgtattttgtaattatatactattgtgtgtttatttttaaatatctatctcttctactgaagtaaacgttctatgaaggcaggaaccagttctgttcttatcactactgatgacccagcaaaaaatctagtaccttggcacatagtaggcacttgataaatatttattgggtaaatggaataatttaaaaattaatcagacatttggaacagatttgtctctgaaaagatgaagctgtattaaccaaatttgataaatagaaccagaggaacagcctattatctccctgtagacaaactggtaatttttaagcataaaatcagcaagagaaaaagtaaatgcatagaatttttaatagcatgggccaaaatgggtctagaatgctaaaaattcattaaatttccctgttctgcatacttacttggatttccactctttaaatatttctgagattttttttttttctattctcggctgaccaactcagcatttaataggtaccctattatggagctatattaatttaatcatcttacagatgtcttagacatctttctctacagtcatattccctctctaatgaagcctgtagacatttaactcaaatctttcaaagactgagaactttgttgtttaaaaaaaacttgggaaaaaaaaaaacaggctcaaaaaacttagaaattttgtaaaaaccttcaattgtgaagtggctaaaatggcttcaatcatacatttgcttgactctcaagcccatggtcctaacttgatcaagctataaaagaggtaggcatagcttggtcttgttggaatgtcattaaaggaaaaattttcaaaatcatgaagagagaatgactaatactccgacaaaaaggacaagagaaattttaagaaacttacctatgaagagaacgtagacaaggcattaagatacaggattgtttgcaaaactaagagctgttttatattactttatatctgtaactattacaatgtcatctttcctattctccgttaaatgttctcttatttccccgaatcttctccacacagcacttaccacagtttaacttgttatttgaaaatgaaaaactctcctattaaactgcagactgggtaaaggtagaccatgactttccctcaccatttctgccccaatacttagcataccatgggtggggaagacagtgttgggagcaggggaaggagatcttggacacacaatctagagagcttgcaggcctccattctttatactaaaacaaaacaaaacaaaacaaaaaacgggcgtgctggatcacgcctgtaatctcagcacttttagaggccgaggcgggcagatcacgaggtcaagagatcaacaccatcctggccaaaatggtgaaaccctgtctctactaaaaatacaaaaaattagccaggcgtggcagtgcgtgcctgtagtcccagctacttgggaggctgaggcaggagaattgcttgaacctgggaggcggaggcagcagtcagccgagatggcgccactggactccagcctgggcaacagagcgaggctccgtctcaaaaataaataaataaaataaaaaataaaatgtgacaaagcagtgtggactaatgaagaaaatatagaaggggaaaaagtagaacatataatgtaagctaaacctagctgtaaaagggaaagctgtttgctgccttggggtcatcccagcactttgctgcgttgaactatgctagttgaaaaccttattcttcaatagttgcaatgcctcctgtgagtctgtacatgatctggtctatggcaacacaatcattaatagcaaattgattctgactatcaaatcttaagaattaattacttagatcaccttttgaggtatacaattttgaatgtgatgtgatagattgctatgaagttagtatttagttctcttcaatctagttatagatttcctgtggcatattgccttttcaaaccattatacagaaatttcataaatcatggagaatatttagtaagaatgtaagttataacaatttggtttgttgtgtttgctcctatgtcctcctgcctttactctttgctgcctttttcaggggctccagctccatccatgttgctggagaggacatgatttcattcatttttatggctgtatattctaccgtgtcacatatgttccacattttctttattcagtcaaccattgatggacacttaggttagttccatggctttgctattgtgaatactgctacgataaacatatgagtgaaagtgtcttatataatgatttcttttcctttgggtagatacccagtagtaggattgataggtcaaataatagttttattttttgttctttgagaaatctctgtactgtcttccatagaggttgaatgttgaactaacttgcattcctaccaacagtgtataagcattcccttttctctgcatccacaccatcatcttacacaagtcagaatggctgttattaacaattgctattatttatctgatgattagtaatgttgagcatttttttgtttgttggctgcttacatgtcttcttttgagaaatacttgttcatatcatttgcacacattttaatgggattgtttattttttcttgttgagttgttagagttccttgtagattctggatattagttctttgttgtaggtatatgttgcaaatacaattttaaaagtgtctttttctgttcatttctgtttagataactacctcccatatacgcttaaactttttgcttgctatttctgcatttgtcccactcaaaatattgaatccttaatttattaaataatactcaattttgaatccacatatttcaaagtcatctgactttgttttttgtttgtttgtttgtttttgagacagagtctcgctctgtcatccaggctggagtgcagtggcaccttcttggcttactgcaaggtccgcctcctgggttcacgccattctcctgctcagcctcctgagtagctgggactacaggcgccccccagcatacccagctagttctttgtatttttagtagagatggggtttcactgtgttagccaggatggtctggatctcctgacctcgtgatctgcctgcctcagcctcccaaagtgctgggattacagggacatcacgccatgcccagagtcatctgactttttatatgtaaagatatgcaagttagatttgaccaacttgccttgagcctattatgtactggctgatttaaaataattataagtactcatcaaagtatgaatttttgattgattagcatgtatttagtaatatttcaatcagcagaatatctatcatgctatgcaagtagtttattttaaatatgctaaatgttaaaaaatacagtacaaaacttgactaatttttttacagcacatatggatgaacttgactactattcagacaatattgataaaataagtaaggcaaatgataccattttttaaatgtaacatggtatgaaagaaatagtcaatattctgagtttgccttgttaaataacaagtaggttggcaatttcaaagtgcaattgttttcactttgacagaactttattgtttcattgtgaaaatattttaaaacataaacatattcaacttaaggataataaaatgtaatggaaatcggcataatttagaaaatgttataaaagttaaaatttgagcaattctactttagttcataattttattagagcacttcttaacacatggagcatttgttagcattttgcagttttacacattcctgatattattgctacttcaaatccactcacaaattagctagcctacaacattactttcacttcacattttatgtttttataactttgtgcttttcaggcaagctaatatgaaaacaccctcaatattttatgcctgttagaaatatagatgacatagtactcttaaaaagtgtcttgtatcatacataataaaaaccttctttatgataaaaaaaattttcaaaaatgttaaattatttatttcacttaattcccatggaaacactatgtaggaaactatacgtctcctaaaggttaggaaaattcttttaatttttttgtagtgtagaaaatagttttgttagtttttaaagtgaaaacctggtttgagataagaagctatcatgccgatgcaggcaattagaattgcgttctcaaattttcttctgagatcctcacaatagcagaaactacatatgtatctcctatgtactatgaaagtactagtttttcctctatcaaatacaacttgcctagaaatgtcattaaataaacaatcctatgattaaacaagtcagtattattttatctctgattctgtgctaatatatatatggttagaaaaacaaaatgcaatgattcttctctagattatttttatgtgagtttagtagtcttaatgtcattgtatgtgaattttttatgtaaacatcattcattattatttttattttcttgtgtttttggattatattttcccaagttttcatattatgatttcatcaggtaatcccagaaaaagaaaatattttggcttcctacagacacagagcacctcattactcagcatacaaaatagtgttctacaatgtgtttccacagaagaagcttctcatgttaattttttttggggggaggaggttgagatctcactctgtcacctaggctggagtgcagtggcgtgatctcggctcactgcaacctccgcctccagggctcaagcaatcctcccacctcagcctcccatgtagctgggactacaagtgcatgccaccacacccggcttttttgtcttttgggtagaagtggggtttcaccttgttgcctgggttggtcttgaactcctgagctccagtgatctgcctgcctcggcctctcaaagtgctggaattacaagtgtgactcaccacacccggcagattctcatgttaattcttagttatcattagccacactcagtgtactccttatagcaactttgatagctccacagcaaaacagtgtaaaaagaattatgtaaaatacatttatagatgaaaccatgcatgtagttccgcaggccattattgagttcactattaatcatttgagtgttttcatctatattttggtaaaattcctaattgtatatgcgtatcttgagcagcctttaattgtcattgaaagaataattgaagagaaagaattatactattgaaagaatagtagaaaaattatcttcaaaaggcttcatatatccactatgtgcagagaaaccattttcatgaagactttgtgttcatgataagaaaattcttcatttatattttttttttgcaacttatttctttcttgtacctaatttcccaagaagttatttaggtaacatacatgttatacatacatatactcacacacacacaaatgttgtacatgtgtttttgttaaatcgtgtgataacttaagcagaaaactatataatgcctttctcaaaagaaaaatgtagaagatagaatcaaacttttgtaatattagttgagaagtaaaactgaatataataacattataaataaattggagaaaaagaaatattaaaataagcacagagattaaaatggtaaggacagacagaaactccaactggtttctcttcaaaagtccaaggaatctagtgagtactattgcaacacaagaagcacatgcagaaaagtggcgttttaaaaaagtacttctacatactcaacaaagatttctgagtgcttgctctgcatcaggcattatggatgaaaggggacagtctcaaccttcaaaatgtttgcagtgcagagaattgaagctttacacaaacagaattttaaacatgagataaatagtaaaatatgtgtgcacaaaaaacaaagagagagggctaccttgatctgccttggagaatcaaataatcttcaggaattaggatgtgttttgcaggtagagaacttgagggcttttttagacataagaagctgcatgtgcagagtcccaggaaaatgatagagtagtgtgtttttggaaaaattaaaatttgcagttgttagaatataaagtggaagtcaaatcttgaagaagagactgtcccgatggcgatagaatatgagggaaattttctagcaaggtagtagcatgattagatttccatgatagaaaaatcactaacatggaatggagggtggtttgaaagaaaggagcccactgagaatgcactagcagcagactctataggggataatgaaggcaggcctagcagcagatagtgatgggaagttattccaagaggtggctctagtgctcatgcagttcattcccctaaaacttctatgggaaaaaaatgcaggccccctcaaatgtaaaataagactcatgtagcctctaacataagactgaagacatctggggcatagtcacaatgttatttattctcataattggtaaaagtgtcatttgcattttagcaattatgttatagattgatgattaatcagctagaatgacaggtgaaaaattatgtagttcatattttactagtgatcagcattatttaaattttaggaaaaagatgttatacaatgtggagaataactcagtgcaggggtggagaataatgagaactactgtctgcttattgaataatactgttaaacaagtgatacgaaagatgatttttgtaattttttaaaactaaaataattagcaagctggagagttagctcagtgtctaattcatagtaagtgtctaaaatttttgttattaatgagaaataaaacaacaaaacttctaagtgtttttctttcttgggttgatttaaaaatatatatatgaaaacataatgatagtgacatattctctccccctgaaatctgtgggccatgtgcctaagcccattttttttccccgagtctacaccatttggttgcatctattgagtgtatctttgtatttgaatatgtgtccttgtgaatatatgcatgaaaattttaacacttagtcaaaaggtgcacacatagatatttttgtcttgccttaaatgcttaaagaccaaatggaaaatgaggcgtttctctcctataaaaacaccaattgaatttacactcgggaatgtattttagaatgacatcacaaaatgtaaaataaaatttaaaaatgagtacttttgaggaacaagaaatcccaagacagaaactgatgagaatcaattagtattgacacaatcctaaggcaaaacttctagctgtatgcccagaagtatcactctagggctaatattcattaagctgctgaagatatttattaaatttgcaaagttctggaaactgcaattataaaacaaataatgctgtaggctaaaatatgttggatcattttatgtagaaatatatgaaagattttaatgacatgatttactgctaaagttggaagtagcattccaaaaatagaaagtacttactttacaattatatgtaataggcaagataatccttaacatcaaagaaaaggaatattgtcttcctccttttcaaatgatgggccaatcttacctatgaggagaatgtgttggctacagtggacaacttaagattcagaagctagtcattctgcctccccttcccttaccccattaagactatgctctattctgtggcagctgcttttgccatttacgttaaaagcagatggagaaaacgcgaagaagtgtcagttttattgccatgtataatcagcatctgggctgtatgttacagacacaatcaatccaaagacatattttactgggtattataaaaactttttgtgtttctgaggcagtccccaaattacagatagtgctatattttaatcctgttgatcacagagattgcagccagttatgttgtttcagcttcaatgtgaatgatgtatgtgtgtatgtgtttattatacagttacggagttatctgcaaaactgtactgctaatttgtttaaaaacatgatttgggaccatatatatttatttcacactagaaatcaaatcatgtgtgagatttatatatacacatataattttatagtgtatgtgtgggggtgtgtgggtgacgttgcaatagtcccccctcttccacagttttgctctacatggtttccgttacccatggtcaacctcagtctgaaaatattaatgtattttgagagagaccacattcacataacatttattatagtatattgtaataattgttgtattttattattattgttaatctctttaaacttgatcacaggcatataggaaaaaaaagtgtatatagggttcagtacaatctgtggtttcagacattcagggggtcttggaatgcatcccctgtgggtaaggggagtctaccatatatgctgtagactttttattatttaatatattgtgctatatattctatttttgattgcatatacatatttttattacttcactatttttgtataagaaataaaataccatatttttttctacatctcatgtaatttttagaaaacatttatggtaagttctattctccccatttttcaggaagagaaactgagacacagcgaaagaaaatagcttttgtaaggtccagagagctaatcagctgcagatccagaatttagtccatgtctatataagtgcaaagctcatacttttaattgctaagtgacacaccttgaaaaattctatgtatgtctataaaatgtagaaatatctcttgaggagggctattgaagatttggcatgtggatgttattttatatagtttgtcaaaataacacgattttaaaacattgaaaataatgtctacgaattgaacgctagagagctgaaaatgtcatttaaagtgctaatactgtttaatatcttgtaaatgtctttagaactagttttttaattgcccagtcatacacactgcatgttgtgtagtctacttatgtaagatctgctcaccaaaaccattagtttattttatgtgttacagagcccatcagtccacaagtggcagaattagacttcattgagctaaaagatagctgcacataattaacatattctaagggtcttgtgttttaaagcagagggatatttcaccattttttattttctataatttttgaaatagacaccagaacgtgttatatattgttggtagttcattctttaagagctttaaagtcgtgaagacatgtataatgaggtagcagtaattagagagcaagagaaaaaaattgtagaagtggagacagaatgggaagaagttttttattggataaacatacttttgagttatttttattagtgcagttagaaaactgtcttcatcttctcatatactgagcatgtaactaaaatttccttctacatttgaaagagtagtaacagccattgctttggtttcatgtgtgtgtatatgtaaacacacaaacacatacagtgataaaatgttatgcaatcatttacataagttatgtggagaaaaaggtgttggctccttttacatggaaaagtctttcttgtagtatgtgatttacagtactttcttcccctaatcactttctaaatctatttttactttgaaactcaagatattgaattttctccgaaggactgacatttgaaaatctcttaattatggtggattttatccatggcatgcaaatatatcttagcgattatactatctatttttggaatcccagaatgtttttaattaggttctttatggaacaatggattcaaatttgcactctataaaattcagcagcttctatgctattaaagcacagattacaggacagcaatgctagaaaatgtaaattttatttgccctttctttttacctcaacctgaaaactttattatttcacttctttattttttataatctgatttaaatatgttttcctctttttgtaggacaaaggacatcatttgagatgtgtgttgggtttagtttatcaaatatattctaaaattcttacaatgaaaaggaaaacccctttattctaaagacccaaaagtttgcaataagtacacattagtttattgtttctccactaaataagagagaacagacattttataatatattaaaatttattgtttgacatctgtccatggtagaatattttcctgcttgagaatctgtccctctgaatgaaggatgcaattacgttttgccttaatgaactgctgagacagtgcaataaaaaccagttcgctgctgagtcagtgtgaataacaacataaactctgtttcaaatactttttttggaacaagattgaaaatagataaatgaataaaagtaaacaagtccatggtacatgtcattgtacagctttctgtggtacatgtaaatgcaatagtttgcaatgtgaagatcaggtccttggtacattgcaataacagatgattcatgcagcatgactcaagtgtgtctgaaatattgtttttgcatataaaaatataatgccattttatcatgactcttctttgttttataactttctgagtatgcagcattttcaaaaaacaaggccttatttattgtataatttgggtttttttggtgacaatcattgaaattagttgtagattaattacagaaattatcataacatatatttgagtgtcattagaaaaattagtgatcattacgagtattctagtttgagactttaaaataataaatgaattttaaattttccagggaaaatcttcagttatattaaattatagaattagtttggtcacatttgtgagttaaggttattgacatttcagaagtctctatgctgaatatagcatttaaaaatacttacattggagaaattcattttgaaatctaactgcaaaataagattatttatcaataaaactttcacaaatgtatgaacatctctgttttttgattatcattgaattccagttatacagcttaatattttgtacagagtagacattaaatatttatagggtgaatgaatgaattaatgattattggtttctttagattattttcaagaacctgaaataatatctatgaaaagtagtatatgaactagctttgcattactattaaaagaaatctactagtcactgagagctattaattttttctcatcatagcactacgttattgtgagcaaatctttaatacattgaaataatacttaattgaccaagacatgaagaatcttccagcgaatcaatattatttcatctatagctcgtattctctgtatttttattgattacattttaagcttaaaattttactataagaatgagtaaaggccaaaaagaattactcttaactgtcaatcaaaacattctaatcaataaagtaacaggcaaatgatttacatgtccttcactctatttagagcttttgaaaaaaaactccctttcttatgacctagataaataatacagaagacaaattcatatttccatcatacagtttatttactgtcttctggagtaaatccacctattaggagccaaaaacccagttagcagggatatgtgaaaacgaatagaatatagtggaataagaacagaggagttaagaggatgtccttgggtatgtaggaaaaggcacaacttattatacctaagaaaataaggaaaggatttaaaaggaggccatgctttcactgtcttaaaataactaagcattgttaatatcaatactagtataaaagtatcactaatatatacatgtccaataataagaaagaattaaggaaatagggtatttttcaacagtggaatattatgaaggcattaaaagtaatgtcttacaaaatgttaaatgatatagcaatacatgtatgatatgttattggatgtaaagacaatacacccaattctatttgtagtaatacctcaattacataaaatatgctcaaaattctatatgcagtaatacctcaattatataaaataaatatgcataaataaatatgcaagcaaaaaaacactaaagtaaaactccctgatctgagtagggcattatggatttagttcttttaatcatatttttactttttccaagtacagtgagcaccaaggagatagagtgtctcatcaaagggaaaaaagattgttagtaatatcaaatgttacagtgagttcaagagcaacgaaaactgaggaaacccattgaatggtgaaataaagaggtcagagaatgaaccctgatactgttgaagaaaaaccgtagcaccatgagaagggctttgaaatcagaaaagaccaaaattttggcaatttcatttaatgtcctagggataatttgttttgattttatttccattaaatgttacgcgtgtgtgtgtgcatgtgtgtgtgtgtgtatgcgttaaagtattaccaacgttcaataaaaatgaattaatgtatatgacacatatatggtcagtatgttgtcatgatatttattcatatttaaatatatacacatatgtatacatacatatatatataatatatatgcatatattttttcaaatccgggcgggaaagtggagctcatgccagttgagctttattttcctattgaaagtgaactctatttttctgttgaaaaacagagggatttaatgtagagaatagactgaacagttgaaggaaggtaacagggaaaaaactgctaccaacccagggctataaggacagaagaagctggtattttataaaattaggaggtggcaccaacagaaagtaaaattaggaaggagatgagaccactgctgtggacatcccctgagacagagaagggaagaaatatcctggcttcttctccccgccaacctttcaccaccctcccagtgtctgtcactggcaaatctcacagtagcctgttggcaaatgagcctgggatatatggttcactggagtcagctctttgggagacagagcagaacagaggagaaggggatgggaaatgatcataacgatgtttgtttggagtgaaaggaggctgagaagcaacatttttttgatagactaaaatatgtaccaaaagacttcatgcaatctacttatttgtgcgtttcataactaggtgggtaaaatcttgtctttctctgttagcaggaccatagaatagatgatatcagttattttcaactctgtgattttagtataccataaaaatacttcagttgtgctcaaatgcactttgctgcagtggtttttatgtgaaatattcacaaaatgaatccacagagtctagactgtcttactgaaaatatctgtagcatatatggatttataatttaacattttgcctcataagaagcttcaaaattaattttgtgagtataaaattattttttaaccgatcatatgctttccatagaggaaataaaaggcttataaaatttaatattcaacagtaatcttctttgtggaagagttatgattgtatctaaaatatgtaatagatctattcagtatttctacctatttctctaacttatattaagttaattaaaatgtactcctaagttagtttcttaaaggtattatttcttttgtacaaagtccagacttaaatattgatggatatgtagtacttaaaaatctgaatattttaattatgtttataattgcttagtttttaatcccaatttgcttcacatttagggacagaaaaattaaatttagtacttatttttcaggaaaaaaatatatcactcatgaagaacatcaactttacttcttgacatgaatcctgagcttgaattaaacatgtccgaaggttcacatttccatttaaaagttgaattttttttcattgcagacgtttggaacagaacacaatcaaagtcatccctcctggagctttctcaccatataaaaagcttagacgaatgtgagtgaacaatattctacaatatatgtaattttaaaaattatagaggtcatgagaccatgcaaagaaacttaagtatgagtatataagtgtttgacagcttaaatattaagtgatgtgactgtctgattactagctctgtaataatattttaatcttaatatctaaactatgtaatttttaaaggtctgtaatttagcatattgattcatacaaatgtgaatgtttatggtcaatatattttgcatatgaacatatgttcaggtgttctattgtcaaaaataagacatagcatcttatatgggaaagtagacaatggttattttaaaaagtatgatttcttttttaaatttctgatccttcagatgttcaatgttgcacgttttggacatgtcttgataagtacaaaaccaacatttaaaagccatacatagctttttccgcagtaaatctcactgacatttgattgaatgtaacctaaccctatttctaatcttagtgacctgagcaataatcagatctctgaacttgcaccagatgctttccaaggactacgctctctgaattcactgtaagtattcactgtgtcactgaaggaaaagagaagccacaacaaagagtggctaccttttttaaattggggtttaaaaaatgctctcaggtttttattatgaataatgaattattaataatgttaattattattaaccacttctgggtcccattatttttatggaggactgctacccatcactaaaattagccaatttttaggggtgtatattttatagtttgatcattttgctgttaggagagcaagagttagatcccctttttgaccatttttttatttctttttttttttttttttttgagacggagtcttgctctgtcgcccagactggagtgcagtggcgccatctcggctcactgcaagcttcacctcctgggttcatgccattctcctgcctcagcctcccggtagctgggactacaggcgcctgccaccacatccagctaattttttttttttttttatttttggtagagatggaatttcacaatgttagccaggatggtctggatctcctgacctcgtgatccgcccgtctcggcctcccaaagtgctgggattacaggcatgagccaccgtgcccggcccatttttttatttctaaaagaaaaagaaaatatttattttggaaagcatgtagctagtatctggagacaatatcagtctcctttgaaatgctaggcaaaatcttgctgagaacacttgaagatgaccactgagaggaaacctccactctttttcatcaccttaatactttcctaaaagaataagcttttaatctctcaaagaacaaagattttaaaatatgacagctttttaatgtcaagagaaccttcgaaagatagctatgtaaattaaagaagtttaaaaataaatgtatagcagctgttattaatattacttcacacttgtaaaaaaatcttcagaagtccaccaagtaacctttagatcagatttaaatattcgaaagtggaagtcggcacatttttattttttaagagccgaaactcagagaagggttcttattgatgtcaattcctgccaaaatatttcagatatcagaggtcaggggtagccaatgagaatgccaagatacacatgtgcgagacccagataaacccctggagtttgtggaacaacttgctggcactctttccaaggggagaactagatcggagtgctcatctgggcacatgagtgttccagttgctatgttagtctgtttaaaaacaaaaacaaaaacaaaaaacactacagttttctttaaaaaggaaaatggaaaactgttacttaaatggcagtatctgcttgggttcacttttgcttctttttgacttggagggttttgactagaagaagcacgagattaaaggaacaattgttggcagaaaatatagcgtgtagtcatgtattgctctcaggctgtactgtcaggttctaaagtaactaggttcagtgtaaaactcagatcacccagtcagattgtccataaagtactgttagcaccattctgaacagtaatactatccagagtaaacattgacaaactccctgtcatacagaaggacaaaaggcaaatcagcatgtcagttcctgattctccacaattttggtcctcaaagataaccattaaatgtcaagaagaagagaaatcagtgggaaattcttatttatatcggcttgcttgcagagtttgatattaagctcttcccttaataatgttaattgacacttctgtggttgtgagaattaaaagaaaatatataaagatatttacaagtaaattataaatagaacagtttattataatttgttacttctttcaataaattacattatgtttgttgataaacagggttcctgtaattaatgattataaattatgtaatctaataaacaataaaatagtgtgttgtcactccttttgctatttgctaacacatgtaaaataacatgcttgctacattgaaatctaaggcctcatgatgagagcactcacgcacacagttgttttagaaggccgtagaaaagctttatctttacttgcagataaagtaaactgcagttaagtcagggagttaagtcactggggtttttccagttcaaaatgtagcaacgtgtggaagatcacaaactgtttgccaaaagtggaatacctgcataatactgtaaaacagataaactggaaaagaatcaaataactgagttattttagagaaagcccacgtgttataacacgtatcattttcctggtcacgttcacagtttgagttcactttccaaagattaagttattttcccctccataaaatatataactacacacatttgcaatagctcttttcttcattgaaccacagttaatatgttcaaaagaaatgtattgggcccgattatgtactaggccctagtagagggtctagagatgcagagtgaccagaacacaaaaatccctgcctcatggaggagaccagtgataaactggcaaatgtatagtatacataaaatttacctatatttatagtattacatctatctgtagatgaaaatgctatgaataaaaattacagaacaagggataaggatagctgtggttggcggggggaagctaaaaccttaaataagatgatcaacaaagacctgaagatttgagctatgggagtgaactgtgtagataatgcagatatatagaggaaaggcattcaagacagagggaacggttaagtactaaggacgtttagcaggagtatgctagatgtttcaagaattagcaaaaaatatcactgctactggagagtagtgggtgcttgaaactgaaatgatgaagagaatgcaattgtaactacaggtctgagacactataattagggtgggagaggaaagccagtgaaagctagatttgcagagaagaattgtgctggagatcatgatagtgaccaggagttaaaatcttccagaagggagcagagtacttgggagtatgtagtttactacaaaaaccatgcaagtacaaggcaacacctctttttatttaaataaaaattttgcttacaagttttgcttacacctgatattttaataccatgtctttctagaactgtactcaagaatatagccagattaatataatcactacaattgctaaataaataaaactatttaaaggtgatatgatgccaagcacctctactgcattctacttaaaaaataaaaatttcagccaggcgtggtggctcatgcctgtaattccagcactttgggaggcctaggcaggcggatcacttgaagtcaggagttcaagactggcctggccaacatggtgaaaccccgtctctactgaaaatacaaaaattagtcagtcagacatggtggtgcatgcctgtaatcccagctactcggagagttgaggcacgagaatctcttgaacccgggagacgaatgttgtagtgagccaagattgcaccactgcactccagcctgggcaaccaagtgagtctctgtctcaaaaaaataaataaataaaaatttcaagttattagatcaccaaatttcatctcttagagataagtggacttgatttacctaatgttttttaaggcctctcctactaagaaatcctatacttttttttattaacattatcatttatttttattacgtattatataaaattataatgttatactaatatattgttacatagtataatatgcaatatattaacaaaacaaaaaacattcatgtcgttttcagggattttaaaatttctttcaatgtgacatcaacaagatttctataatatttagtaacaatttcttaagaattcagcatactagtatttttagcattgtctgtaaacagtttttattgttttctgcttattacttggaaacttccttctatagtaacaaaacgttttaagtgtagtatcattgtagcatactgctaagcatatgacctttaggacactaggtggctgtgttcaaatcctggctctagtacttactagttagaggctgagctagttactaaattccctgggtattagttcttccatctctaaaatgaggataaagttacttccctgctggctttgttacggagtaaacatcaagaaataatatgtatggccatggcaaattcatctcttgatagaaagcaatttgtatgtttctggatctcaattatcccagagaatctttctttatgccaaaggtcctcaatatatgatttttctcttttcccattcttttcattagccctttgtaaactattttaattcacttactctaatttccttatttccttaactagctcccaaattccacaggggtctacagtggaagactttaacactgtacttaaatttctggcaaccttttcctaaactgctgttaactctcctgcccagtatcttgcattttactataggttttcaatgaaaattaaaaggtagcacctctgttttgtcctctgctttatctttactgtactcttctaaaaatcactgaagagttataattttcaaatgtatacatttaaaaaaatttataagtataatttccttgacatttttttgaataataaagtatctgcccataacacctttttcatgatagtcatcttataggttgctgttttggacattttttttctcttcagtaggagttgtcttctgccagctttcttttttgagacggagtctcgcactgtcaccgaggctggagtacaatggcgcaatctcggctcactgcaacctccgcctcccagatgcaactgattctcctgcctcagcctctcatgtagctgggattacaggcgcctgctaccacactcggctaattttttgtatttttagtagagacagggtttcactgcgttggccaggctggtcttgaactcctgacctggtgatccggccgcctgggcctcccaaagtgctgggactacaggcgtgagccactgcgcctggcctctgccaactttcaataagagcacaagagctcaaacactggtcaccagctattgctgcctcttactgtcctaatgctgaaactcacaagggctaaattgtgtttaacgttcttggccttccttatagcagcaggtacaagagctaccttaaaatttccctattgttcaaaaagactagcaacaacaacaacaaaaaaatctctatcagagtatatgtatattgtacacatataatagtacgtatgtatatactatctatgtggtatgctgaacataagtcatgtataagaaactgtagaaaagatactcaattagtcattcttggtatttggatgatattatccacatccctcatgtattgattttcttttcagctgataccacttttttctttcagtttcttttaaaaatttcttttcctccaacagtgtaggacaaattctcactggccttctcttagtttatatctttatgtgatgatatttctttccctcatttttatagattttggccctatttcctgggctgtcatccaacttctctatcctggtctttggattttggtatattttaactaattttccttgctgtcattttgatctcattgctatgtaaaatactgtacccagccctagtcctgctaaacctttctggagaaatgtcattcccattacattgagtatttctttattatttttatggttgatactccatatagcaataattcctatacacatagatttcctgtatcctagtgtaatttcctccttttttgccgtttacccactttgtctcattaacaatagcatctgttactttttaacatggtcttaaagaaagcagtgatttattgaaaaaaataattacacaatataaatacgatgcatctcctagcttgttctcctttcatgctatttgggccaaccttcaaagcagaagtctcaagtgaacaacctactaaattgtccaccccttgatactcatgcaggtcctccacaatttatatacatctttgttcctttctaaattgcagtggattcacaatatcagactctttgactattcaaaattactcttttggattgccctttgaagccataccttctttatctcagtcatatcagtgcctgagacatgggcagatgatgggcattcaaaaatgacagactcaattgaattgagcaccaaccttagaatctggcaaagttacaggcacatagtaagtgcacaatctctattgttgaatgaatgaattgaaagatattgaattgaatatcccagactggtgccatcttaatctactcatttgtgtttcctaatgccctctcttctcttaatcttgacctcaaaatatatatttattcatgccttatcttttctaattccctttctaccttgttctggacaatatagaatcctctcttttgttctttgatttttaaaatggtttcttctctaattgatgtacttttctaaagaaatctatgttttctacaaacaaaatttcatgttctattttatagttatatcatggaatctaaagagacaaatggaatatctctttacactataatagcacccggctttatttattcctttgaggattttcttcacattttataatataccttacctctctctgacatcttgaaagaggaacagcttttctctcacgtattcatctctcttgtatagttattttcttccttttcaaaaagagattatatactgctgccaaacgtatcaattatttagattcacatttcagctttttctttatatgttatggcagccatttgtttatttcccaaaagaatatatctctgatctttgaaaatgatatatgcttattttagagatatattaaaatacacaaaaatatgtagatgtaagttcaaatcacctctggatggcaaatcatctgccatctaaatatgtttcccttttattttgtgcatatatgtgtgtgtatatatatatacacacacatatatatacatatacatatatatacatatacatatatttatatatatacatatacatacatatacatatatttatatatatacatatacatacatatacatatatttatatatatatacatatatatgtgtgtgtgtatatatatatatatatttttttttttttttgagacagagtctcgctctgtcgcccaagctggagtgcagtggcgcgatctcggctcattgcaagctccgcctccctggttcatgccattctcctgcctcagcctcccaagtagctgggactacaggtgcccaccaccatgcctggctaattttttgtatttttagtagagatggggtttcactgtgttagccaggatgatctcgatctcctgacctcgtgatccgccggcctcggcctcccaaagtgctgggattacaggcatgagccactgtgcccagcctatatgtatatatatatatatatatatatatatatatttttttttttttttttttttttttttttttttttgagacggagtctcgctctgtcgcccaggctggagtgcagtggcgcgatctcggctcactgcaagctccgcctcccgggttcacgccattctcctgcctcagcctcccgcgcagctgggactacaggcgcccgccaccacgcccggctaatttttttgtgttttttagtagagacggggtttcactgtgttagccaggatggtctcgatctcctgacctcgtgatccgcccgcctcggcctcccaaagtgctgggattacaggcgtgagccaccgcgcccggccatgtatatatttttaaaacaaaactaacataatactttaacatgcttcttttttacttaatgttgtatcttgaggacttttatgtcactgtatactcttctatacttgattctacacttagcattcttctttgtcatatatagtgtgctctcattacatatgaactgtgtatgcgtgtgagtagaaaaacaacttaaaaggaaacatttctatgaaacggcaatgcaagtggaaatgatatatacatatataaaatgttctttatttttctgttttccaaatgttctacagtaagcatatatctgatctgtaatcaggcaaaagacatttgcaaatggagtttgtttactcagctataacttttatgatgtattgattgcctactagcttcctgtatgcctgagtaaatatgtattagatgaatttgttatgcaggtttggtgtctaatttttttcatttaaaatatttttttcagtgtcctctatggaaataaaatcacagaactccccaaaagtttatttgaaggactgttttccttacagctcctgtaagtatttgattgttttggatctctcgagcctaataatatatattagccattttgttgtctcatatttttatggaggccttggaaaaatttgactcaaaatgatacagtttaacaaaatagaaaagagtagtccagtcaagctagtattcgtgattatttacttgaagacacaactttttggaatagtccccaaaccaattttatctacactatcatgaatgtatgcattctggcttctctatcatttaaagcttctacaatccctgtctttgtaaaacatctctgttttaatgtaaccagtagttggaaccgagaaaaatatggtgatcactttgggaggccgaggcaggtggatcacgaggtcaggagatccagaccatcctggctaacacggtgaaaccccatctctactaacaaacaaaaaattagccgggcgtggtggtggtgggcccctgtagtcccagctactcaggaggctgaggcaggagaatggcgtgaaccagggaggtggagcttgcaatgagcagagatcgcgccactgcactccagcccgggcgacagagtgagactccgtctcaaaaaaaaaaaaaaaaaaaaaaaaagatatggtgatatactcagcaacttttgtccagagaatctgcaggagcgacagtgctgcaataatttcctcaaacggatggtgtgcggtgagctgtaacacacaatagtcctcagactaaacctttagagagataattacctgtaaatcaaagaccactctgattagacaatagatactactcatttgtctcaaaagaagtatttaccatacatatttgcaaaaaggagatttaacaccatgtgttttaatgcatgcccatatgaaaagtaaagttggaaaaaaatgcaaatattaaaacttggtggttaatcatcaaattctattcatatcatcagaggacctcatttggggcacacactggcctatatgctttagatacaaagataattgtgttgtaatttttttcttagtaaatctcccttaaaatccttacgcatacaatgttattttccctctggagtgtatttatttcttggcatttatttggtaacgatttattcctaatcccacaatcttcatgtatatatataaatatattcctgaatttataaacttacgttcttaagtacatcctattatccatgtcttaaactttttcaccattatgcagaaatgtattttacattacaccttagcacacacacacccaaacaaatgaaacaaaatgttaatgaaacaataatgaaccttattatatgtagtgctctcttttctgttcatccccaccccaattctctctttattttctcagtgctacataacccagtaaatttattttacaatagaccaatgagtcatgagaaatactgattttgtaacttaatgactttatttgggtttcagatttttctaagctttccatttctgttattaaatattgctactaatttgataaaattatgctattcacagcctagatgtctgtacccattgtagatatagcttgatgctgtaaccaagtattgcctacttgtgactcacctctctgccattcttccacattcccctagacttactctccatgccagttattcacaatcactctatcactgccctatctactacaaatacgtgaagtgtcaccttctttttctttccatccacacttattggtagttgatgtaacacacatgctaataaaatatggagatctatatagataaaccttacttctaaagccatctttataaagtttcatttctacactaaggctcattcttaagcctgccagagggaaagaacggcatgattatctctttacagctagctgagaacttggtaaaattaagtgtcttagttttggttggtcagagattagagagaagaggcagggaaataaaagaaacaaaacagattgttgtttaatatttatttactgttccttgggccacactgagttaaagtgagtacaaactgcatagatgcaagatgatgcaaaacaacatctttcagtttcctcaggctccacacaatttcattgtccttgtttgctctctaactgcttcactcaattagattattaagtaaagaacaggtcagcattacttgagttgtggcccagggaggagaggtgtggggttaatcagcccctgtcacccaccatttcttgaaggcttttaagaaggtattacatataccggagggaagatgaagcttcagctcctgatggggaatcaaagagcacagccaattgagtcaccgtgagaaagtcatcactttgcatgttgctgatgtagcacctttaaaaaaaaatcaagtaaaatggaaataacccatgttaacatagagattgttttattgtcaaaggagaaaatattttttagtatgttagataatgaggcatacccaaaccacattacacatattttttgagctgttacaaatttgttaaaagttctaagtatcaaagcactgaactaaatatagctagatatagcttgatgctgtatccaagtattgcctacagtttctccctcttaaggcgggaatttaaaaaaatttctccattcctatggagaaaaatattctttctctccttatataataacacgcttcagaccatcaccaaagggaccttttcacctcttcgggccattcaaactatgtatgtataagtgatttggatcacagttgatgacattgtttccactctgaatgtaagagttgagtccattgcaactcatctataaaactgtcctgtatgtgtttccaaaggcattaggcccagcacccctttatttgtgactgccatctcaagtggccagtggattatctccataccaaccctattgagaccagtggtgcctgttagggatggagaaaaagaatattatttaaaaaaattgtccttcctgaagagggagaaactgtcattggacaaataagcaggtctgcataaaacagttgacaagactgcatagcatggaatgacattttgaggaacccagagggaggagtactctgttgggtgaaagttgagttcagaagatggttgaggaaagtagagagcagagtacatgctgaagaataaacctaagctcacacacagtcacatcaccgagaatgatgtttgccaaagtataatccataaactacagttccacagaatattgatataatacataggggaaaaaggagtttgtggggaattatgttaaaaagttaaacaggtatttataatataagactacagcctatactaatgtaccatgtgactctccaagagggttgtaaagtattcattcaacaactgatatttattgagctcccagtatgtgctgggcagtctgggaaaggaagggaaatgaaatagacatatggatgatttactgtgggggtagggaggcaggcatatagatgacagtcagcagtaacatagtaagttgtgtagcagaaaaaaaatgtatatattttagaaaatagaaatagatcaaagtaaaaggaattgagagtgctaggggttgggaaggggtcaaagacagcctgcatgtattaaggagaggggtgcgggaggctggattgagaaggcagtattagagcaggcttgacatctgggagatgaacatttcagacaaagaataggagagcctggtgtgtttaagaaaggcaaggagatcagtgattggagctcaaacagccaggaggagagaactgggaagattgcagagttctgaagagtgggctacaggtcaggctgttgtgacgacttaggtttctgctcagagccaattgggagctgtcgcatggttctgagaaaggggtgacatgatctattccatgtttagaaggatcacactagctactgttttgagaatagcctgaactacttttgcacagagtgtcctgagggattaatgatgtcttagagcatttttatggtgtccttgccagtggaggctgggtctcacccacctttgtgtactatcccacctttgtatcttccagaggaaatggttaataatgtgtattgaatacatgtataaataccactagatttaggttcatttgatcacatgacttttgttatgtggtaaaaccccacatctctagcctctaattcctaaattattaaagttaaaatgttagtgttgaggtgaaaagaaatatatttcttgactgggtttccttaaaaagcacaaaatcttgcaggtgagttaataagatgctacactttaattctacaactatttaatcaaacagattattgaatgccaacaagataaactgccttcgggtagatgcttttcaggatctccacaacttgaaccttctctccctatatgacaacaagcttcagaccatcgccaaggggaccttttcacctcttcgggccattcaaactatgtatgtataagtgatttggatcacttttgatgacattgtttcctctctgaatgtaagagctgagtccattgcaagtcatctataaaactgttctgtatgtgtttccaaaggcatttggcccagaacccctttatttgtgactgccatctcaagtggctagcggattatctccataccaacccgattgagaccagtggtgcccgttgcaccagcccccgccgcctggcaaacaaaagaattggacagatcaaaagcaagaaattccgttgttcaggtaatttcttcacgtgttatttcccctgtgaccaacaacaatggttacatgagacctaacaaaagcagctggccttcggctgattagtgaacactgtagaatcatatttctttttcttctgcccatgaataataaaataaagaggactgtagacccaattcaaataatacttctatatgtaacattttaacaccatatacagcagaagaaataggcaattgaccaagttaaaaagatgcctagatacttcatagtacctttccaaaattcaaacttaaccagagccttatagctaactcagaatacctttaaagtatgttaagtctcatgtttgttgaattgaccagcctcaagtaattaactgtgttttcatttcttcagaaagtgaattgagacttggttacatgatttgtttgggctcagaagtacaggggcgccaggagggactccagatcccttgcttcttactctgaatgcactttctcagtttgcattctcttattttgcatacaaccgtgaggatgcgttttttccaaaagctatttttaaaaatattgtgggaatattgcatttatttgtaaaaagctaaatatgaatgcattgtattgatattaaatgaaaggctgccatcattcaaatttactgtttgctttgatctaatattttccttttttatgatagaatattttatgtctttttggtactatgctacctaactattccaggcgtatttcacattcggcagttaatttcatactaaaaagctaatataagaaccaagctggttattgtccataattatagatgcatttactactcactgtacattattgtacttcagtcacagctgtgaatatacatttttcacttaattgcagtaactttagtccattcttaatctaatataactcatatctctgcttgctgacattcaggtgcatcttctattttttgtctctttttttatttagctaaagaacagtatttcattccaggtaggttttgctcggtagtaggactaactacagacaccctttcctcaccttataaaatatagcttctaaaactgatatgcatgcttctgaaagtacagtggatactctatagatagattgacttatgcatatatcacttgtagctgtttcctgaaatcctgacctttgcatgcagcttctgatgttaaacatatattattaaactccaccttttcttctctttcttttactttggcgcattatctaaaatttctcacagtagctaaaatgtttgaagctatggctttctacttaaatcattttctctccttacattgtatatctgatcttccaacctgtttttaaaatatagctaattgagctggttttaaagacagagatctttctgatgtcaaagagctagttctacatgaaatcagttacacacagaatttcattttcaatcatgaaaattacttttttatagattcttatatttaaaaactgtacttattgctttacttttgcttcactgtttatagaaaaacagcaactccctgctgaattatatgcagttgtttcttatttgtttatgactttacattcttctatatccagaattacaatataactccataaaaaagaatatttatgtgtgatgtgaaagcatcagaagttcatgggcacaaaatgccttgaataatttaggcagatggataaaatgtttctaagaaaagtaatcgcaatgttttaccacttcaatcgtaacactatcaagactgatgattctagaactagctctttaaaatacgtttctttacttatttttccttgcctgccaattgtgtaaaatgcctcttgacttgtttgttttaaaccattatgttaagtatcgattggccacattcaccgtctcttgggtatattctagactataaaaaattttaagagctatagattaaaagatatttctacagcgttagtgtacagagttagtctaactttccatattttcttaagaagaactctgggtttagtctctattttaaggagatatttgttagcttgccattattgaattacaatttgtataattttatggatttagtagatttggtgatatgacttattttgagcttgaatgatcaatagcattgtatattattatactggctgcataacaagtaacatgttgaaaagaacagttgattggccttcattgacaatgtttaatattaattactttacccaattaagtggaaagtaatctgatagctattatttaaccagaaaaagccatattctaaacaccagactacctatagaataaaacattaatatgatttaaatcctaaaattatggcagtaatgtaattggtatcaaattattcaaactatttcatttaaatatacttaattaataattggtaagtttaatatttccaattcactaaataaagaacaaaagtcaggttgttttcatatattctgatatagtttttccctgttactgacagcagccaaaataggatttggaaattatcttttatatcaaatatcatgtcttaagtttcaatttatgataatttaatttacattctttaaacatgataattgtagaagccaggactcaaaaggatcatttgggcttcctccccttttttccaaaaattttaattaaaatttgagtccacctaacaagccaccataaaataagcattattactgttccgttgaatgcagattatttgaattgcaagatatccagtgtacctgtcacttagactttgtgcactcttatttcattttggagtgaagcataaatcataagacaccagatcctcagtaaatatcatggcattaactgccaaatgtaatgaaacgattatatttaccatcgcaaacttcttatgagattctgattccatttccactaagacacattatttataagttgaaaagttcattaaaaagtgtacatcacaacataaggattaatccaaatgttgtaatgattgtccttgaggatctccatgattagtttttcattcacttttacgtgtgtacctcgctactaccattttatatggcactctacatattacagtgataaaagaaaatctgtcttgcagagagttcatctttttttttttggagatggagtctcgctgtctcccaggctggagtgcagtggcatgatctcggctcactgcaagttccgcctcccgagttcatgccattctcctgcctcagcctcaccgagtagctgggactacaggcgcccgcaaccatgcccagctaattttttgtatttttactggagatgggttttcacccgtcaggtgaaatggtcttgacttcctgaccttgtgatccgcccgccttggcctcccgaagtgctagtattacaggcgtgagccaccacacccggccttgagagttcatcttttaaaggaatcaagaacttaatttgcactatgcatcttttattacattggttttcttgtgagaccaccgtgcttcaaaatattatttataaaattttacaaagcatgacaattcccatcacatcatgctattttttcaataattcccataataaagaaagaaggaagagagcttagttttataaatatgtatattaatcttaattgggattactctttctttccttcttggtgatctttacttttgcaggaattcaccattttggctgtaagtaaaagtgtctgatctgaaacataataccctcccttttcaatcctgatgtaccttcttctagtcttggtctttggcacctttttttcaagaagaaaccacagatcttttgagcttctctgttgtccttgtagctcaccttcaacttcttcctggatgttgttcccgaaagctgttgtttccattctgcagttctgaggaatggtggaggcaccttttccatatagccccttctttgtgtttccaggaaatcatcggtagtaatactcttactgtggtcataaacattctgcgggaagaatgcatgtcatgtaaacagtattacgtttccagaacgtctgtagcttttctcctccttccctccattttcctcttggtcttacctttggcctagtggttggtgtagtgataatgtagcgagattttctgttgtgcttgatctaaccatgtggttgcgaggtatgagtaaaacatggttccgtcaagcaccatggaacgtcacgcagctttctacagcatgacaagctgctgaggcttaaatcaggattttcctgtctctttctacaaaatcaaaatgaaaaaagagggctttttaggcatctccgagattatgtgagagggagagaatagtaaaaagtccatagaaaatttaaaagcctgagtatatctatttgccttgaaagccctaatttacaatgagatataggatcatgtttattactggatatattttcaattcttgactccgagaaaaaaaataaactttttaataattaatatccattgtgtgactagctgtgaagtaggctagaatgactcagaattggatcagcagaaagtacagctgtgaaaagctcaactttattaatgttttcctgtcatgtgaatctggtcactcttttttccagaaaattccaagcctttcttttaacctttctcctgacatccattgaccaaaataccccaagttgtctccctgctacataatctatagttatcttacttttttcttcctacaaactaataaattttctaacctttagactcagtatcttttttttggtttgaattctcaataggtacagaagattatcgatcaaaattaagtggagactgctttgcggatctggcttgccctgaaaagtgtcgctgtgaaggaaccacagtagattgctctaatcaaaagctcaacaaaatcccggagcacattccccagtacactgcagagttgtaagttcatcccccaacaaaattctggttgggatggagggaatgaaagcattaaagcataagaatgtttgtcttgccatttttattattaataattgcattaattttaattaatatgcattacattggcataactctattttgtacaagaatatattagaggctaccttcattcatctttctagccaaccatacgattaagtacagaaactaatttatctctcaaaattcagtaagcacttcatactaataacaatggtatttatttgatgcttatttattgggtattatttattcccaatttgttttctaagtacttagtttttaacgtatttaattcttatagcaactaaataaagtagtttgagagcctccattttcaatctctgtaaactatcaatagattcaaggagtctgtcttacctaatttactacttcattgacttacgggcagaaggattcagtggttatcaagtattaaagtagaaaggatagctttttctgaacaatgcaagaaaagctgaaaaggcagaatatgatggtatttacacttaacagccttaacataggaccttgcacatactaagtgctaaggtgtttgttggagcacttacagattctatgcccatgcatggtttgcctttactgactttatttataagaagaggacctttaatgttagtgttctaacaattcagggaaaaaactagcaaaacctcatcattctctaaacatcttagccatgtttatatatagcaccatctggtatttgtcatttactgctttgcaaagttcgttgtctgtttgtttgtatataatccttccatctttaactagattatagctccttgatgacagggattgtgtgttattgtttatctctcactgtgcctatactcatgcctgtacttaattaatttttagcaatttgaataactaaaaataaagtaatgcctttcaaagagttgacagaaacccactatcttgtagttatagtgatttttttttttttactcctattagttgatgaagctatttcacagctccaggaattttagaaatgcatggagtccatgcaaccaaggccctgaactttattttttatagacatatagggatttatgcttattacctataatactacaaacaagtgataccttccagcacaatagtactttttttttttttgagacagagtctcactatctcacccaggcaggagtgcagtggcacaatcacagctccctgtagccttggcctcctgggcgcaagggatcctcccacctcagtcccccacccccatctccccaagaagctgggacctcaggcatgcaccaccacacccagctaattttgtactttttgtagagatgggattttgccctgttgtccaggctggtcttgaactcctgagctcaagcaatcctcctgcctctgcctctcaaagtgccagggttacaggcatgagacactgcccctggcctagcactttaaataagtttgtttgtcatggaggaattatagtggaaactagcctccaatttagacttcagcaaatgtgtgtaatgtaagagatttataatttttttaattatataataaaatcagtactgagaataaaatatttgcaagtcatgtatctaataaggcacataattcagaatatatacagaactcttataatttagattaaaaggtattttactcagctaatgaatggttaaattattcatattgacctttctccaaagaacatatacaaatgtccaataaacacatgaaaaactgctcaatatcattagttattagggacattccaatcaaaaccacaatgagataccattttagacccactggaatggctaaaaaaaaaaaacaaaaacaaaaagggagagtaacatagtggaagaaattgaaaccctcatacattgctggtctgaatgtaaagcttctatggaaatcttttttgctatttctcaaagagttaatcacgatttaccatgtgatccagcaatgcccctcctatgtatatgtccaaaaaacgacaacatatatccaggcagaaacgtgcacaccatgttcatagcagcattatttatagccatcaaagaatggaagcaacacaaatgcctcctaactgataaatggataaacaaatgtgtcatgcctgtgtaatgaaatatcattcagtcttaaaaaataatgaagcactgccatatgctacaacaggaataagacattacacaaagcaaaagaagccagacagaaaaggctacatcttacatgattccgtttatgcaaaatgcccagactaggaaaattagtaaaagcaaaaagtaacctagtggttgccaaggactgtgggggaacagccaccaggagtgactggtagtaagtatggggtttcttttgggggtaatgaaaatgttctggaattagatagcaaagatggttccacaactgaattgtatgacttttaaagggtaaatgttctggcatgtggtttgcattctaataaagctgtaatttttgttccaattgtgaagcaaacgattagggaaaaaacagtctagaaatcctttttagtggggacgatagtggaaaaaattagagaaaatttgttctagagattactgagagctggttttgatctttgtgtttttttttttttactgtgtgcttcctaacattttattttgatgattaaaatttgaataaaatgagaaaaaatatcagtatgttccacaaatcttctgtgatttatgtatttccttttattttcctggtatcattaaataatgttagaattcattttgagaaatcaaatttaatcctttcctaactattggtaataaaacttctctattccttcttttttcttcaggcgtctcaataataatgaatttaccgtgttggaagccacaggaatctttaagaaacttcctcaattacgtaaaatgtaagtcacttgttagctattttttttatttctgtagcattttttgggtgttcatttcagttaagtttcttagaaaattagaaaatactaaaaatcctgggaaatttccctatgatgatgacctgtaacatgaatttagggtaatctctgcaagggacttttctgtgtgttcagcagtgtcaatcacattttctgtagcagagcctaagcatcttactttaactcagacagctggtctgttatgtggccacagcaggaatccagcaatctaagcacattaaaatgggttcagtaatgttttgtaacttcctttactattccccaaaccatgctgttattttttttttcatgtcaactattggacttttttgcttcattaaactttcattagaagatagtcaaaattaatgattggtaaactggcttgatagctcatctgtgttactacatgtccacaactcatattttaaaataagttcataagctcagcagtttcagcaacactcagtgggttactccatgcccctggggaggtgtgacggggagacaggacataggtcaatagcatgggaccaatggagcgccctcacacatgcagaaacatcagcatcagctcactttagctgtgtgtccatatatgtaactggcccatagtcacatagactgtaagttaccgaacagactacttgtacagatggcatccatattagcctacctcccaaatggtttctgatatcttaattgccctcctttttcactgttatgaaatgtactttctttttagccataagatgatttcccatgcaacaaatatttattaagaagctactgtgtgcaattctctcagagaaattaaaatatgcataaaaatgatccttgtttgggagacactcctggtcttggagtgatcagtgagaaagagaaagaaaaagcctataaacagttgacctcaactagatactcttgccttctggcaagcattgtagtagttggtatcatacgtagtactgacagttaatttggttgtttcaacacattattacatgagacattcttctgggaataaacccatattcaaatacattcctgatgctatatataaaacactaacacattttagcccatctatctccacctagttgccttcttttagtcattaacatttgacaattttaatcagggactttttttgaaaagtttcttgttaggttttatagatggcataaaggtttgtgtaacccaatacctgacctcaagaattttatactcctggagacccttggagagtatgacatgagtcacgctggcattttttaccacagacattccctgttagtattattgtccctttgtcttgatggtgtaaggaagtggaatcttttcagagccctggcagtgctgggcagtgaaaagttggaaaacttggatcattagaagaaaattatcaactatgtttcaattcccaccttgttagaaattatttaaaacctttgttccaacaatttttatttagaaactttagcaacaataagatcacagatattgaggagggagcatttgaaggagcatctggtgtaaatgaaatacttcttacgagtaatcgtttggaaaatgtgcagcataagatgttcaagggattggaaagcctcaaaactttgtaagtatttgtacttgcattgcagttcttctaccaaaggattgcagctcattgttcattataatcctgggagagagaaacacctacttttacccaccccactccctctatctctttcacattctctgttacacacacatacacaccgctacacacacacacatgtattgtgaattcagatggtcccttaccccaatattcctgccttcgatgtgtgttacacacacacacacacacacacgtattgtgaatgcaaatggtcctttaccccaatattcctgccttcgatgtgttcatagcagatgatcaggagcgtcccccatggcttctgtctcttctacaaaatagatcatccttgttccagtgcttatatggatctgactaccctgtcctgcctcaaaatggtcattttatttctttgtcttcaaacacctctctatactatacttcttcttggcccaatgactgtaagctttagaatccccttgaatctctgcagtagaataattctaacagcttatctggagactactgttttttgcccctgcaaggtctcagtgtaaaagaaagacaggctggtgatacatcttccactgttttttcaaagaaaacatgctaagagttatgtctacttgctcaggggtagggtgtttgggggaaaaaattatatatgtttccaaagagttgttgtccaagaaatatggggattagattgaggtatttcaatcaaacatacttacaacacttttgtattacttgaatttttcatgtggcatacaaacacgcatatacacacatatacattgtatctaaaaagtatataattatgtttgacaaaagtggtagcctaaaaattggaagaaagacaaaccaaactctgaagcctttagaaggcagaaaggaaaatatttgtaaccaagaagcagtccttggtgattgtagtggggagtctgtctccctcaaacccacgatcctgccccgcacagcctgtgagagccatgtatgaccagtgggctgaaggctgagtccattgtctgctctttatcagatacggagggagaagggcattcccacagccagcaagatgtgtttatagcatcccaaattcaaatccccacccgcaaagccctccctgcacctaagagcagaagtgcattccttgagttttgcaggaatagcctgaaacctgaccacccagcaggaccagtctgggacctgctgacccatcccaagggctaacttggtgccctttcaaaatgataggcaaacattcactcagccttgtgatgaaagagatactgaggactgggcgcggtggctcatgcctgtaatcccagcactttgggaggccaaggtgggcagatcacgaggtcaggagttcaagaccagcctggccaatatgatgacatccggtctctactacaaatacaaaaattagccagtcatggtggtacatgcctgtagtcccagctactcgggaggctgaggcagaagaatcgcttgatcccgggaggcggagattgcagtgagccgagattgctccactacactccagcctgggtgacatagtgagattctgtctcataaaaaagaaaagaaaagaaagatactgaggaatgtgtaggaagaggatagaaaagagaccacaggcggctgcatctaaccttttccagagttgtctcaggtaaaatacaaatattataacaagcagaaggctcccttttcaaacagcagttaaaaggctttcttgatactggaaccttctcctggcagggaagtaccttggagtgggaggaaggcggtaggctgtaactccacctgtatgcatgtcttcaggcggccataatgagcttccacagactggattgcttacacaacagaaactgattttctcatcattctggaggctagaagttcaagatggaagtgctgacagggtgggtttctgatgaggcctcgcttctgggcttgtaaacagtcaccttctcactgtttcttcaaatgagttttcttctatctgctcatagggagagagaatgagctgcctggtatcattttcttcttgtaaggatggcagtccgtcaggatgggatccacacaatctcactcaacctcaatcacctccctaaagtccctctttccaaatatacgtatgttctgataaatgtgtcattaggcaacgttgccattgtgcgaacatcctagagtggacttacacaaacctagatgatatggcctaccacatacctaggctatatggcacagcctattgctcctgggctacaaacctgtgcagcatgttactgtactgaatactgtaggcaattgttactaacacaatgtaaagtatttgtgtatctaaacatactaaacagaaaagagcaataaaaaagatggtacaaaatatttaaaatacttcacctgtgtagggcacttaacaagaatggagcttgcagaactggaagtttctctgggtgagtgaatgagtgagtggtgagtgaacgtgagggcataagacattactgtacactaacataggctttataaacactgtacacggcctggcacggaggctcacacctgtaattccagcactttgggaggccaaggcgggtggattacttgaggtcaggagttccaggaccagcctggccaatatggtgaaaccccatctctactaaaaaatacaaaaattagccgggcatagtggcaggcacttgtaatcccagctacttgggaggctgagacagaagaattgcttgaacccgggaggcggaggttgcagtgagcagagatcgcaccattgccctccagcctgggtgacaagagtgaaactctgtcgcaaaaaaaaaaaaaaaaaaaaacaaaaaccactgtacaactgtacacttaggcttcactaaatttattttttaaatgtatttcttcagtaataaattaaggttagcttactgtgacttttttactttatgaactttttaatgttttaactttttttactcttttgtaataacacttagcttaaacacattgttcagctgtataaatttttttactcttatatttatataagaattttttattttctattattcttttctttattcttttctgttttttaaattgtttgatttacttacttttgcatttttaaactgttttgttaaaaactaagaaacaaacacatacattagcctaggcctgcccagtgtcaggataatcaatatatcaatattactgtcatctccctccacaccttgtcccagtggaaggtcttcaggggcaataacatgcaaggagctatcatctcctaggatagcaataccttcttctggaatacctccggaaggacctgcctgaggctgttttatagttaactttttgttaataagtagaagtacactctaaaataacaatagtatagtaaatacataaaccaataatatagttgtttattgtcattatggagtattatgtgctgtacataagtgtttgctatacttttatacaactggcagcacggtaggtttatttacaccagtatcaccacaaacatgagtagtgtgttgggctatggcattatgatggccatgacatctcgaggcaataggaaattttcagcttccttgcaatcttattggacaacttttgtatagctctgcttgaccaaaatattgttctatggtgcatgactgtacagtcacatttgggggttagggcttcaaaatacgaatttgagggggacacagttgaacccgaaacaccacctcaaggaacttatatcaaagtatttcttcttgttttgtttttcattcacaggactctccctgtgaaaagttatctaaattccactttctcctttcattgtatttctgtggatgtttttgaagtgcttacattttagcacctgagacagatattcacggactccctccttaatctagttaggtttcaacaagcgtcatagagcattttagaaccaaactcagggtagttaatcctagaatagttttatctgaacatacctattcttggtgtcttttgtcttggagctatgaagattttgagagcacatttccattccccctaggcttcttaaccctaataggccacttactaattcatatacatatttcagccagtcattgaattccttgacattgcaggtgaaatttgtgcatatgtgtgcttatggatttttctagcaacagagatcaaacttttctcttttttaaaatttttatctatttatttatttatttgagacggagtctcgctctgtcgcccaggctggagtgctgtgatgctatctcagctcactgcaagctccacctcccgggttcacgccagtctcctgcctcagcctcctgagtagctgggactacaggtgcccgccaccacgctaggctaatttttttgtatttttagtagagaccaggtttcactgtgttagccaggatggtcttgatctcctgacctcgtgatccgcccgcctcggcctcccaaagtcctgggattacaggcatgagccactggacctggcgctcaaacttgtcttcaacttcccccaggggcatgtgactccagcaagattaagacccagtgctcttcatcatttatgacaaaggaaagcactgataggaatgcttttctgtagtgcatttgttttctaacataaaacgatcccttcataaggagagcatcatcttatctgtgacttcgcagaatgcaaacgtttatatttcttatttattatagggcaacctagaattttaaagtgacactttgtttctttatttttacctctctttttcacattcttcaatattttagtagccaacttatgtttagaaaaattaaggaataatttaatttttcaggaattctgaatacgatttatggcaactattcatatactcataactattttcacatgggactttgagctttttgttcagtttttaagccagacaaataaataattagcaaagaattgataattgagccaaaactttagcagtaacaaggaaatgacaatagtgttaatcctataatgacaatgactaaaaaaaaaaaaaaaaaggtattttttcatggtaaaccttttaaaactttattgtggatatgggatctgttaccgttgcctctttttaagttctcaatttaaaacaatgagctaattttcataaataaaattattcgtgtagtctttgtggatattctgtccattttggcgcccctggaccatgtttgacattgactcagtgtgtaagtccctgagatgccctcagttcttcatctgcagtggctattgattcttttctgcctcccttctgttcaacctcaaatgtaatactaccctgaatacacaaatcacagggctccgaggactcagagagctgtaggtgaattaggacattatgcaatcacgcaaacataattgtagcatcaaaggaaaacattcttccctcatcatgggattataaatccatgcctagactcaccgtgccttttgtaactgagattaatcattggcaactcaaagcattttattcttgcaagatattcccagtatatattcatagcaatatctaatagcaagagaacatttttaaaaagtagtaatgaatgctacatatttgcaaggatcatttcgatcctcagataggcaaaattgattgcctgatgctttgtctccataacaatgtcctttttttcccctcaggatgttgagaagcaatcgaataacctgtgtggggaatgacagtttcataggactcagttctgtgcgtttgctttctttgtatgataatcaaattactacagttgcaccaggggcatttgatactctccattctttatctactctgtaagtatgaaaaatagcccttatgtattacttgagccatttattatatttgttaatgtatttaatatattattaagcatttcattaaaatgtgatcaagggttttaggacttaaaaaaggacaaacttgttcacatcaaatttatttaaattttttaaaaaatattacctactatcttagattaaattttaacaaaaaattatagtattgttcagtgaattatttttcatagtgatatgatcaataatgtagcttaattccaaattttagaattattataacttgatagtgctgcatataaaagaaatgttatagatttttgccagtgttctcacattggagtattttcagtataagtattataaaaggagaattgatagagttattgccaacaaacttgctcaaaaggatcagctgggcacagtggctcacgtctgtaattccagcactttgggaggttgaggcgggcggattacttgatcaaggtcaggcgttcgagaccagcctggccaacatggcgaatccctgtgtttactaaaaatacaaaaaaaaattaaccaggcatggtgacaggtgcctgtagtcccagctactcgggagggtgaggcaggagaattgcttgaactggggaggcggaggtggcagtgatccaagatcgcatcactgcactccagcctgtatgacagagcgagactccatctcaaggaaaaaaaaaaaaagaatcatttgaaatgacagtagatatattaggatgaccagatcaaaaataaaagctgtttactagagggggtctactatgatattagcaaaatattgaagaaataggttgagctgatccaagagaatattttttgtagacagcttaaaaataaagagtatttgtaggcctatagacagaattcaagaaaagtaaataaataaataaataaaatttaaaagtaaaaaaagccacacacctccaaacaatgtatttcaggtctcttatatgtcagtatctaaaaagcagcatttgaaattattaattatctaactgataagatttctcagtaacggtggcatgcaaatctactaatctaacttaaaaggaggggaataaagatagagaaaaaagttcatagctcaagtcagtgaagaaataatttgagagaagcatccatccatcaggaaagtacttaatcctctttttgcataaaatgtgacattttacatcgagtggctaatttgcacatattaaagatggcatgtttataaataatgagattgtcaataggtttatgctgaagtggtgagatgccagaagtattgaaatttgtagaagtaaattcatttttataactggcatttaatcaactcagctgtcagtttagatgggaaacctattctctagagcaaataagagatggaaatcttgagatgacaaattaatgaattagctgttgtcaggttaaactcaataatataaggtaatcagccttcatctttatattaaattactgcattatcagtgcgaagtttgacagcaagtcagatttctgacaagtttaaattatttctaaatgaaatatctatcaggatccactgtataaaccccaaattctaccttaccttattttttgcatgaaatcatgtgaagaattaccttatgtaaaagtgttgttactgcttaagttccaagcataaatattttatcaaaaaaaaaatgcatctcatatactgcatgtgattctgagtaagaatggggacagggaatgcaaagaagaaggaatcattccagcggaaatagcgtggagaagggtagctggggtttagagaaggaagaagatgaaaccccaggctaaactgtgcatcgtttgcctgtggctcttagaaacctcttggccaatccttttaactgtaactgctacctggcttggttgggagagtggctgagaaagaagagaattgtcacgggaaatcctagatgtcaaaaaccatacttcctgaaagaaatacccatccaggatgtggccattcaggacttcacttgtgatgacggtaagaaatacttatcaactctttgattgtcaggcattcacatgcctgttctgatgcagctttgcacaaatctacagcatagttcagctcagcaaataatgatcgtgtatcttttgctttgtcgtttgggttttgttttagtgccaggacacttactttcttagacttgccttccacatttgagtctacttgatgtgcatttctgaatgttttagattttctagtttccaacttgtggttggtcttacttatatagcttcattttaacttttctttattaccctaggcatgttttttagtacctaccattttcaaaggagaaaagaaattaacttacagaagttttagtaaatctgacaaaaatactagttgtcactttttaatgctctttctatatcatcacatttgattctcatatagccctatcaggtacatagaacaagttctattattattgccaatgaacagagagctaatttgagctttataaatgaggaacctaaacttttaagttaatatattcccttatgtctcttcatatctgtttccgtgccgtttctctgtaattcactttgcatttacatattgtaattaaaaatataatttgtacaaataactattttccattgtattggtaattgtaattacagtttacaaattgcaagccattttccagaattcttccctaggcagtctgaaaacagtgctatatagaacttacggtatcaattagtaaatactgaatgtcccgcaaataaatgattatgtagcttaagactcttgtgtttgttaagttaatttaaaggcataaaatcccttctagcaccttcaagaccacaaatcttggttttcctgtatttcctctgcgatttaggaaatgatgacaatagttgctccccactttctcgctgtcctactgaatgtacttgcttggatacagtcgtccgatgtagcaacaagggtttgaaggtcttgccgaaaggtattccaagagatgtcacagagttgtaagtagagcttgtctttcttttcttttctttttccttgatgataaatgtttcatacacccagaggaatggacaaaaatctttacaatcttctttacaaatcatattctaaggccagttaattattatcctgtaaaatggtaaataagtaatgcaaaagctactttagaggcccttgggaattgctgtgtgtgtgtgtgtgtgtgtgtgtgtgtgtgtgtgtgtgtgtgtgtgtgcgctataagatttctcagtgcctttactatgctaaagtgtactatgactcttcaagaaacaatggtaaaatataaggtatctttcacatttatttgttcctataccccttttctcatggagcatcttacaagactaatggcccatggaatgcactttgggaaatgctttatatttcatttacttacagtctaggatattctgtacaggaaacttttttttttacctctgtgacccctaggagaaaattttaccacatgggataaataactatctggtatatggaagaaactagcataatctcttcccttaagaagagatgctgcttttggaggcttgaatcaaagtcctttagatcctaaagggtatgggaccaattatccttgacattttcataactgatatttaaccacaaattatatggccaggatatacacatctcgaccttcttctgcactgcccacgctcccttggctgcctcatgctacagttgcagaatggaattcattagagaatatgctgccagaataatgatgcttccatgccccattcattccattcctttgtctctaaactgtcatattctggatatgcttgttctgaatacaattgagtcactttgcctgtttattttttatctatgtggaactatggatcaataatgatttaaacccaaatgtaatttatgcagatgtgtatcagttatttgtgcagatgcacacacatattccaaatgagcaggtttgacaaacttttgacagtgtgcaacataggtaatgaggttcaagggcatgtcatttcaatttttaaggatcttattttcaaatcacatgcaattctttaaaccctaagtttgatcctgaatagaacacttagaggaaaaaggcacaaacttagcacatgtgcttagaacacggctcttagatttgaactgctgttaagtgcttaggtcctctctcactaccaatcacattggttaatcaactggaaggactattttatatgtatatgtgtgtaattaaatatttaattcttatagtaatgttttttatttcagaagatcacatagggatattccgaaaccctcctctgtgggaaagctagatgcctatagaatattctgtgtccacaggatggggaacatcacacaccggggcctgtcttggtgtggggggatgggggagggatagcattaggagaaatacctaatgtaaatggcaagttagtgggtgcagcaaaccagcatggcacatgtatacatacgtaacaaacctgcatgttgtgcacatgtaccctagaatttaaagtatagtaaaaaaataaaatataaagcagagatagttaaaataaaaaataaaaaaagaatattctgtgtccaaagcattaattttaggagtacaccaatgaagaacttacactcagaccacctttgatgctaaatcccttcttctacaattttaactggactatgtattggtcactttactctattcccattaaataactttaaacatttcttactaagctccattggacatcctgcttggtgcataccctgtgctatctacagcatatttcaactattcaaaaagttgaattttcaatctattttactacaaattattaaaaagtagtctttttttccaaagaaagtttgtcatagagatgagaaaaatattagcttatctgttttgaattcaagttttaccccctggagagcttattcttgtaaccttaccaagtcagcagaatccttcttagcagtaacatatatgcatgtattagaagaatttcatatgtgtattacattaaataattaaagactttggcaaaaattagtattattggtggactagttttaacaaatggtatccattatttttaatcagttccatataacttccgccttagattattttacatataaacattcatagcgcacattctgaatcttgaccttctgctgtgttttctggaataaagggagagtgctgaactatatagggtgatgcttccctctagtggtatcaagaaaaacttaggtagaggaaagaaaaaaatggagaggggtcgaagaagaaatatcaagtcagaaaatttaggtagacatgatgagtcataacatagacccaattatttatcaaacattaattatattttctgataactggtgccttttatatcattgtttttattttgaaatattgggaataaattatcatcttagacaacttctcagctatttctatatccagaaaaaataccaacttcaacctggaatcttgaaatggaccacaacattggggtaggaacggccacatgtttaatgtcccagaagtgtctgtgggcacatgtatagccagatggccccagtttctgaatgacatttgcacccttcaccatctacgttctaggaaaaacagccttggaaggagatgaaatttattttccttattgtgacataatagatataacttcaggcattcgattatctctctgtcctgccagttagcccaaaacctattttctgattattcttctgactctaataagaagggaaagtttacttatatatggttatttgattattgctgttacatatatatatatatatatatttatacacttcatcaatttatattctataaaatctcctaatgttatcatcaccaagaagatatatgctggttacaactatttttaaacttaaacctaatatgttcaaatccgcaaatatgcctttaatgtgtccattgttattcactaagtgtattgacacatattaaggcagcaatgagtggtcttggccacagcagcaaggttttgttactagttaatgaatttcatggtattgtgtccacataaacacaagcaaactgaaggctgactaaaagtacggttaattgaatgaatctccttgcttgcacacagatggctaaatgctgggcttgccttgttagataaaccacaaagaactggactcgtggacaactctgctttttttttttctttacttctcttaaataataatccatgcttggaacacgacatcttaaagcaaaaattgccaaggggttccttgcctcagttaagagtgaagtactgtttacttattttattcaaggccaccattactttgtaagaagataatattgttccattgtttttaggtatctggatggaaaccaatttacactggttcccaaggaactctccaactacaaacatttaacacttatgtgagtaacatattgcacttttctttgacttactctatttccagaaaatggggatggcaagggacagaagatttagtgaaccttccagataatacaaatcattcacagttagatgcttccctccttgctcattgcggttctggacccctggctacatcttcattgaatatcgatcaggcgatggagtgtcttagcaagaggtcctcctctattcaaaaaagcacaaatacaacgaagtctgagtagtcagagaattatgaaaatgtataaacctgcagatttttattgataatgaatatgggttattttatgacaaactaaggaaggaaagatagaaaacgatgcctttattcttgactttaagcgaaagatggtaggtggtaatgactttcccaaaaatgtaaatgtagtttattatgtttgtttcttatacaaagcattgttaaataagttatgggtttccagtattaaaatgtattttagaaaatccatatatattcatgtagtgtttaagtaaacttgacaaagatactaacattttgagtataaatttcaaaattttgattttttagcttaaaataacatctctttttttattaatgtaaacaacctttgacaacccttaagttgtaaatacaagaagatatttaaatatacaaacatttgatctagttacatgcacaatgtttaaaaattgatataatcttttacatataatactatacttttaaagtagccttattggtaattgagaaaacttttcagaacacaaaaaatcaggaaaaagatagtagatattaatagaaagtaccgtatcatttgtttaagtctatctaattttagagtaaatattactagcgtaagaagcagattactggttaacgaattagaaggtttatttctaagtgaattctacaaacctaagtagcaaaaaatattacatgccccaatgtaaactaggtacattgaagctagttaaaattgctgctgatcactttccttgaaagtatgggtaaatcaaacactttatagaaagtaaataggagtatttaaatgacaaatgattaaacaatggaaaaagatatcctctaagatgtcttgttctgcttctagttatttatttgatagcagcaagaactgattacatacattttgttctgttaaataaaccattaaattgctgcaatttccaaagggtcactttagcagaattgggtcatttgtgggacagcatgtgattactttcaagccagctcgaaatgacaaatgaggatttgtggatccaaaaatggttttactagtgactcatgatacaactctaggcaagttacttctgctaatacagatacttttatttttaaaatttaggaatagttcttcagcagttaaaaatatgagtataaagctcctctcagattcttaacattttcacaatttcatgggtccattttactgacattttgatattttaataaaggaatagattatcctcggtttttctgaatcttccatttattcatatattttgcattttgcttcagaaaaaaattagtgaatatatttagttattataaatggtgaatatatattagtattacatattgtatatatattttaatatattttttacatatatagtgtgtgtatatatacactatatatataatgagaataagatcaagttcatgaaatgtaaattacgacccatagtacaaactatacatataagtagccatttaacattggtaaaaattcaacgtctctcccatttacttaacattcattaaacaaatatttattgaggacctactgtgtgaccatgactcagccaggggcaggagcacagacgtttttattgatgacattttgaatgtaattaatcaggggttctttcagtgatcaaatttgagtctgtgtatcagtgaacatatgtatcaatgagggtaaagtatgtgtatctgataggacttttgaagataagggtttatttcccaccggcaaaattttgtctatcgcaagtcacctccaaggaagctccctgtaaaatatcaaaagccttatggagatgggcgcagagggataagggcaaataaactctgctctgaagctgctgctttgaagtgaaccaaccccttgcacgtacactacattggctaaagcaatgcatatatatataatcactcctaatttcaaaacagtgaggtgtaaataatcatgaataacattgcaatctactccagtgggtcgttcactgttttattgttttcagataacagctgaatgctaacaatactgctatgactataagaagacccttctccttctaagaatcactaatattttcatttctgtggttaatagtgtactccatttctttttctcttttagagacttaagtaacaacagaataagcacgctttctaatcagagcttcagcaacatgacccagctcctcaccttgtgagtgtgaaagtgtggtactgagtattcattaattcaatggacaaaaggcagtctctagatgctggacattgctattgaacaagacagtctctaccctcaaggaatgtttctattgggagaaacagacaaaaccacgatacgtgaacaatgtagacattaggaaaagtattgcgttctattaaaaaaaacaaagaataatttgtgtttgtggggggcttaggggagatccctaagatagggaaaatccaccttagggaagggacggctgacgcaccaaagttgggcaggagtaggcagcgggaagcattctaggttgtatttaggaaataagtatgttgtgttagggagacaacacacaaaaaataacaatatattgtgtgttaacactatcagttaataagatgctttaataagccttaactgctttatttttggaagtatttggccatttttggatttctgaataaaacaaattgacatatgtatgctttcagaattcttagttacaaccgtctgagatgtattcctcctcgcacctttgatggattaaagtctcttcgattactgtaagcatcttgtgttcaacagaatatctcttttctcagagatctgagtttggggttgtctttttaaggatgtaactgctttgttgattcttggtgcttgaagatacatgcattaggatttattataaattaggaaatagaaaaatcatttcttacagtatcattgtccaacagctttgctttggacaatataacttcctttttagtaatactgattgttgttatagtcatttatttgattatatgtaacattaagacatatggtttatagagtttcaattaactttgaaagaaactttcaaaattgagaaactttcaaaattaatttctttagaaattacatagtatatgaaaacatttttactgtgaaatgtcctttaaaatatgtgaaataaaacatgatccttgatcctactctcctgcctcagaatttacagtttgatgtgctctctggtcctttttcagatgcatttttttctattctaatagatgtaggcccatggctatatagcttttaaaagccacagatattaataggatctgtttttgttctgccattgtctatttttgtttaacatatgcttttgaatatttcaagtctatcatatatatgaataaaaatatatatataagaatggaatagatatatatttatacatatatataactcaactgtttaactggtagagactgttgtattggtgggaggaaccagaactgattcaatcatcttcatctttactgtgatttggtttaatttcaaattttaatgagtactatacagtactctaatgaacatcctatacattcctcttggtgcaaatgtgctggcatttcagcaagaatttagggtgtgtgggaaggtactgtcaagtatattggaaggattccaaaagtaactgtcttgttattccccagacaagactttgtccatttagaagttaatttttccaccaactatttaagagtacctttttcaaaacactcttgcaaacactgaatattatttattcttttatttttgtccatatgacagattcaaagttattctgcgttcctgtcttaatttgcacttccaattagtagagcatttgaatatattttatttgtttactaagcactcgtgctttttattctaatgagcttgatctatcatttccccattttctgttgggtactttatattttccttattaatgtagatatctttatgcatatactactttactctatgcttgcaggggttttttttaaatgaaagaattaatccttatatcttatataagttgcaaatatatattattctatttcttatatggaatattttattgtttggatatattttatgttgtcaaaaatttctccctcttttccttgatggtttctggatgttataactgagcctgtgaaagccttcctcactccacatttataaaaggaagatcttctttattttcttttaatacatttttatttttacatttaattcttcattctggaatttattttgtacacataatgtgaggtggaagccatttgctttctcaggtatccagttgtaccaaaactgtttattttatagaccgtcttttctgcactcatttaaaatgcttattataaactaaagtctcggaatttctctggagtctatgagttcagaaatataggaagtttaatttttctttttctttcttttagttctctacatggaaatgacatttctgttgtgcctgaaggtgctttcaatgatctttctgcattatcacatctgtgagtacctagtttatgaatataggtttagggtcaaacacttcctaatgagtgacttggaacattcctctgccagttattttactgtaacatcataagatgtaattggtttcatctttaaagaaaatgtgaagattttcaaactggatatgatgccttctgcaagatggctttaattttcccttctggctcttattttccagtagtcgaattatctttgcttagctaaacatgtctcttctacaaatatggctctccaactttactagcctatgctttttctctcattattatctgattctagaacatcagctcccttttaattatctatcctaaccctgcttttctaagtcacatctcaagtatcaccttctctatgaagcctctcctgatttgctcaaagtggatttacttattcagcatcaactgtggcaccacacaaaaataaattcaacatggttcgagactatagtttggaagtaagacacagccaaatacttagattgggtgaaatggcttttcctttatgttttctctgatcacaacttgtttgtacctccatagtttttggaagtacagtataaccatttgaaaatatgtgataagtgtggtccaaaaaactcatttgggtcaaattccatgattttattattactaggtgtaatgttaagatcatggcaaacctagaaggaagttcagccagcagccttaggatccaaagcctccttggctgatgctgagttgggtgcttggtggcaactatctatttaactatgcctaaacagcaatgtcagttgtgccccagtttcctagaagagattgcctgccatatcctctcctggttttgcacttctctcgaaaacccacaaactccaagaagatacgattttacaaaattgagaaaggaataatcatttttcactccaaaaatatacatatgattggaattttaaaatttgccacccaaaagtctacgcttttacatcttctttgaattgaattgaagatccaatgttcaatcacattatgtctgcatttgccttatagagtctgtgttatcaattgatgttttgtacatcagtctatcagactggtgcctattaatattccttccactaaactactaggtccaggaaggcagagcctttacattttcgtgtttgagccaagaacctacctctaagtcactcctttacaaactccatggctgccacgtgcatgagctgcaatatgaaggaagctactagctcagagatgcagggctgtggtgccctcaggcagagaatgcaggctgaatgaggaggtagccgttctgctagtgttatggtcaggcatcagaaaaggcttcacaggaaaggtgctgcttgagctgagcggaacttcccttcatgttaccagcctcctcccgcaacagtgagagcaagtagagtcttccttgttctgtgccctgctctgccttgcatttctttttttttttttctttatatatataaagaaattttatattttatattttattatactttaagttctagtgtacatgtgcacaacgtgcaggtttgtttgtgccttgtcttttaccccctagatcataaagagctctgctttttcacttttcccacttcctcccctgtcacatcaaggacttaaatgttgatagagatgagatcaaatgactaaaaaacatcattttgctcatttttaatttggaagggtttgaatctgacatacatatgcaggtaacattcactacattctgattcttaaacggggcattaaaacttccacagtatcgagtattatgattctacacatatatttcaggggctacctaaaaaaaataagataactatcctgacggtagacctagtaggattactagttagaagctaattgtaaatcagaagtaagcagtttttaaatgccattgtatgcatctacggcttcaatccaacctttataaggttatgagtccaggtctcagtttcttaatctgtaaagtcaattattaattaaatggaccttataaagttactatttaggataaaatgaagtaattcttataaatggcttatcccagctcctgcatatagtaatagtgcaataaatgttagctattaccttgattactttcctgtcactacttctaatgaacaaccgtaaaatgaacgatcttgaaaagtgacagacagcacccagtgcaggtccagctcagctctggtgagctagctctagacatcttcagtattttatgttctttctttgtacttacctgtcctttatctgtatcattattcccaacctttctttctacttaactctaactatcctacacagcttagactttcttaaccaccagcctcccagaaaagttaatctgtttgttcaccatcatcttgtaaatacttctcctacatcacttctaatgaaacttctttgcatctgtgagtatatcccaatgctaatgctaatctcctctgcagcaggggttctttggaggtaagaataatgcattatttatatttgggtcctcagaaccttgcattgtgacttaagtcatcagtaaataattggtgaatgaaatagtaatgcactcggtgtgtttacactcaatataaacacgtctctgaaaatattaggagaccttctaaagcaacatgagtgttgacaccagtgacaactcactaaatcccagtgcacatcattcaggaaaatggggaatccccagtgtctctatttttttgctaaattgttatcctcaataaatctatggggattttctgctgagcatcactttgaattcttttgcccttaggaaataacaatacttccatacttgtgtgtgtgtgtgtgtgtgtatgtgtgtgtgtgtatgtgtgtgtgcttctgtggtgttgtttttccagagcaattggagccaaccctctttactgtgattgtaacatgcagtggttatccgactgggtgaagtcggaatataaggagcctggaattgctcgttgtgctggtcctggagaaatggcagataaacttttactcacaactccctccaaaaaatttacctgtcaaggtatggtttttaatcatttgtatttcttttaagaattactatattaagtaaaaaagaaaaagacaaccaattgtcaatccaaaggtatggttgaaatgcccagtaaatgattattttttcagcccatgcttggacaagacagagcagttacctgaggtgcccaagtaaagaattaggcttttcaaataaatctcagaaatagtccattggtaatgaccaagttttcttgaaagtgtatcaaaaaacgtagagttcacaatttctggaaattcctttcatagcctctaacaagtcaaatgttttgcttttgccctgtctgaacatgtgccctgctcctagggctgccagggccctgtggcttcctcataccaggtaaggagaaacaggccctccccagtgttcagcccaaaccttctgactcgccttatgtgctgcagccttcctgtgttgatgttcttgtttcttgcttgtttgtatccctttcttttccctttgtttgatgtatttgtgaatctaaatattgtcagaataacaaatattattttcctttttattacaagaataatacatgcccctaaatagaaaaatatgaataataagaaacaatttattttctgcaagaagaaataaaattaaccattagtcagcatacctggagataacgactactaaagttattgtgtaaatatttccactgatggtagtcaactatatggatttaggttccttataaaaagtgggataaagtttactattattcttagattgtggggttttgggggggcttttgttttgttttttttttgtttgtttgagacagagtttccctctgtagcccaggctggagtgcagtggcacgatctcagctcactgcaacctccacctcccgggtcccggctcaagcaattctcctgcctcagcctcccgagtagctgggattacaggcatgtgccaacatacccagctaatttttgtatttttagtagagacggggtttcaccatgttggccaggctggtcttgaactcctgacctcatgatccacacccccttggcctcccaaagtgctgggattacaggtgtgagccaccacgcctggccagattgtgtgtattttaagaaggtcactcatcattattagatggaggagagaaattcttgaaaatgttaaatgtctaatcagaaaatattgattaagcatgttttatgtgcaaaactcaatcctaggtgttatggagcatagagaacttcatggtatggccttgccttccatgatttgaaaacctaactaaaaagataagctttcaacatttgaatatttatggaggaaaaacgtacttaagtaggtaatgctgtgcggtgggttgcagtgtgagctctgaagcccagcctggctggagccaaattccagcttcactttttggtaagagttaactgtagtttaattactttactagtctgtgcctcggtttcctcattgtaagcaaaggtggtgatggttacagtctgaaaggattttgttaagattagataatatagataaaagactgcctcaaacacagaaacattcaatatgttagctgctgattgtattgttataacatttcaaaacaccaaaaaaaggtgatgtaggacacttcatggtttattaataaaaaagtaattttcaaatcctatacataccctcaacgtttttaatttggcctctaatctatttcatggtggtaaatgtttgcaaaaggtaatttgcaccacattgtaaatattgacattttaaaacaaaactcatctgagattttttttaaatgtatctggtggaatctaaatatcagagctaattttataaaaggaaaaaaacaagatcccccttaatatattgcattgtttttttcttaaactgtattttctccttgaattcctattttcaataccccagaaaattgtgtcatttttttgctccaaaaactatgtatacaattgaaattttaaaatttcctgccaccaaaaggctgtaagtttttacatcttctttgaattgaattattgctgttaatattagtgcatcactgattgaaactacataattatttatcaatattttattttatttaaagttgaaagtgaaattttattgcagtgcctctctgggattatgtgcattgattgcaagaatttttgcaataatctttcctttacgatcctagatctttattgggacagtgtcctgtgataagtttctggtgggctgagaagtatatcattattttgtaaagtgagagagagatgattgtcaaaggggaggaaaggaaggtgaaactggcataaaaccttctactcagcacattatcaggcaaatttcatggggaagttgacaaactgcaaactgattctgttacacctttctgtgcccagcgatactcatactttattttcaataatgctaatgcttatctgtatttcttaaagtttataattccctacaggtatttcttgaaaaaaaattataacacaaatctgaaaaaagttgcatatttgtactccactcttagagcatcacagtttacactaatttgtgaaatgctcttggaagtccaagataagtcccctgtctctctctctctctttcaccttgggaatcccaattctctgagacccaacaatactgaaattaggccagacataacactacagtggtctctaagtgttcaagtgaaagaaagagtctcatatctctcacattaaatcaaaagctagaaattattaacaacaacaacaacaacaaaaatgtagcaaggaaggccacgttgaaagccgagagagacccaaagctaagcctcttgtgccaaacagttagccaagttgtgaatacaaagcaaaagttcttgaaggaaattaaaagtgttattccagcaaacagaccaatgataagaaaatgaaacagccttattgctgatatggagaaagtgttagtgatccaaatggaagaccaaaccagccacaaaattcctttaaacaaaaccctaacctaaagcaaggccccaactctctttatttttatgaaggctcagagaagtgaggaagctgtagaagaaaagttggaagctagcagaggttgattcttgaggtttaaggaaacaagccttctctgtcacatgaaagtgcaaggtgaagctccaagtactgatgtagaagctacagcaagttacccagaagatctaagataattgatgaaggtggtgacactgttaaacaacagattttcaatgtagatgaaacagactttattggaagcagatgtcatctaggattttcatagctaaagagaagtcagtgcctggcttcaaagtttcagaggacaggctgactgtcttgttaggggctaagaagttgaagccaatgctcatttaccattccgaaaatcctagagcccttgataattacggtaaatctactctgcttatgctctataaatggaacaacagagcctagatgagagtacacctgtttacagcatggtttcctgaataatttaagcccattcttgagacttgttgctcagaatgatttgtttcataatattactgcttcttcacagtgcacctagtcacccaagagctctgatggaaatacacaaggagaatgatgtttatatgcctgctgatgcaatatccattctgcagcccatggataaaggaataattttgattttcaagtcttatttcagaaatacattttataaggctacagcagctgtacatagtggttcttctgatggatttgggcatagtaaattgaaatccttctggaaaagattcaccattctagatgacattaagaacatttgtgattcatgggaggagagcaaaatatccatattaacaggagtttggaagaagttgattccaatctgcatagatgactttgaagagttgaaaacttcaatagagtaggtaactacacatgtggtagaaatagcaagagattagaattagaagtggagcctgaagatgtgactgaattgctgcagtctcatgataaaacttcaatgaataaggagatgcttcttacggatgagcaaacaaagtggtttattgagatgaagtccactcctggtgaagatgctgtgaacattgttgaaatagccacaaaggatttagaatattatataaacttagttgataacacaatggcagagtttgagaggattgactccaattttgaaaaaatgttctactgtggataaaaggctatcaaacagcatcacatactacagagaaatatctggtgaaaggaagagtcaattgaggcagcaaaattcattgttgtcttattttaagaaattgctacagccaccccaaccttcagcaaccattaccctgatcagtctcaccagccactaactccaaggagacaaccttggctagcagaaagattacaactaactgaaggctcagatgatcattcacattttttagcaataaaatattttataattaaggtattgcattttaagacacatttaacatataatagtatagttaaaaataacttttatatgcactggcaaaccaaaaaatttgtttgactgtctttattgcaatattcactttattgcggtagtctggaaccaaacccacaatatctccaaggtctgcctgtacatacattcatacctacgtacatctttgtgtaactcagtatttatctgactaacttgagctttttttacatttaatgactatagaatctcatatacttaatgtagcatgaatggaaatatgtttcagggaaaattagcacttttcagcactgcccaatacaactttctatagtaatagaaatgttccaaatctgcactattcaatgtggtagccactagttacataggattatagagcacttacaatatggctaatgcaattgagaaaaataattgttattttattttatttacctttaaactgaaatatacatgcatgtctagtggctaccatagtggatagtgtagttgctacaagaactcagagggataatttgtgtaaaagaaggagggctgtgaaagatgtaatgacataagtggacaagcagacaagtgtgaggataatgctacaggtgggcataactgtgggagcagagcttgcacgtaggaaacttctggacctgttccagggccaccaaaaacagttgagctaaaacttgttaattgtcagatgatgtaaagcctaaatttatcatttcaactgtggaagttcagtttaatattcactaaactataagatcaatagattgcacgtatttcaaagtataccttaaatagcaaacagcatgcgtgtaagccagttggcaagcagagtagacattcaagactcaatcaatatagttgcagttgcgtttagaagacttaagagtttactcagtttttctgtaactgaattttagagtgataggcactgaaacttacagtgccctttgccagcatttgtctcagcatttgtcaagctattttgaagtttcattgtcctattaatgaagactctgctagttcaaggtttatgacagtttagactggatagttgccaatactactaccactacaaataataataacaataatagctaagttctattgaatagtttacctaatgctgagtactttacatagatttttatctcttttaatctttccgccattcttatagtgaaaactatcatttccccatttgagatatgaaaatattgtattttagagttattaagcaatttttaaaaatcactcagctgccgactggagtcagaatttgaaccttgactctgattccaaagcttactgcttaagtttattttaaagtttttaataaaagtattttcaaaataaattttcagtgtaaataagattgccaccctattattgaaacatacttagaaaatgaaaattctgaactaccctcaaaagctttactagaaatatttacttgtaaaaatggattggtagaaggccaagtattttaatctattaattaaaataattcattcaaggaaatccactgagtactatactattaagcatatatgctttttgagttttaaagcagcaaagtcatgtttctttaaatgttttataattgaggtttacatattttaacttaactttccctctagttatgccagtctaatgtatttttattttattcatgaaaattatgtaagtacaaactctcaatattaaggtttgtcaatgtataatttcaaaatatagcaggaagacaaatatttttaattgaatgcatgtttacatagctatatttaaatacaatttaaatgtttttttctgctaaaggatgccatgctgttattttgagtcattaactattttaataaagacaaaagtgttttctttatggtaaactctcatcattttgatgcataacagaaataaatgaacaggaagaaattgattatcagatcatatttaattaatacccagatagagcatccctgagtgggaagcagatggccatgacttgtctttataacccaaatgtcctgacctcatcttttaaatataagatgacgttagagtgattaagcagtctgcaataaaacagtttttgtcctctccagatagtcattgagaaagtcagtgtggaaagtggaacattgttaatttctaatattccctttatttctcttggttcaggaagttttagctatggaggcaactaaattatttttttatttgaaagacatttattaaataattacatatgctaatgagtgaacaatctaatggagatgacttacatgtgctgaagagtgaacagactcatggagatgaatgatatgtttattcattaattaaacaaatattattcaagttcgtacaatgttcaaggcactgtgtctaggtgataagaatacaacaataaacaattcagagtaaaacctctgtcctcatggacctgatactctactgatagatacttttaaatagataattctaaaaaatggtatggaagtctggtgatagaaatatgtgtaagatgctaataatatatctataccagatgactatggaattgtaactgatactgtcaggtccaagaggccaacaggaaattcttcttttgaatcaaatggagtataacacaaagaggggaggaggcccaaaaggggaggggtctggtagccatgagctcaaaagaaaggccaggatacgatgctgaatgtacctcattacttcatttgtaaaggccagctgaaggatcaaagaaacctgaaacattggcataacccatgataatcaacatttagcatgctgtggttgatctcttcctctaattttatatgttaggaatcctctagattctggaattcctgtgaaaaacttcacaattctcagcaataacattgtaatattattgtttttcttagcaagttgatgttttccattttggacgagtttttgataggcttgagtgggagcttttgttctgtgtcttaaaattattgatattgtcgttagtcgttgaattaagcatgaaggtgattaaataattgagcccaacctaaagcaatgaaaaattcagttttgaagcattatttagatcagttttgaagcattatttagaataataattattcaaaactgatcagttagatcagttttgaagcattatttagaacttggtcaaatcttttttacattttcagatttagtattactagtacatagttgtatcttggaaattaccttagattttggaggttttgatttgcttattggctaaagagaacattcaggtttggatatggtagtatgctaaacgtaccatttaaaaaagggggggctcttttattatactttttaaaacttaaaacactgggaaaaacttaacagatatttattttaataggtaaagagaactagcaattaatgctctgttcttatatgttttacatccatattctctccaatgcaaagattttataaaataattattgccctttccatgtaattttggctcaggaagttcatttagtggcccaaagtcacatgtaggtgttgcgaatggccaagcctggtaatccaaaaggtgtagtaatttagcctttgtgtttttagctaacgatttttacaatgcaaatttacaggattttaacctctgtcatctggagatcatctccacccctccactgaaactagaacaccagtatcttctatcttgccaatttagtggcttctttttacttatctttatttgctgtctttacatcttcgacattggtggccacttctccttcctctacaatctcttggcttcctcattccttttattttttcacccactttttcatgtagacatgtagcattctatctttagccctatcaaattctcagtagatttcaatccatgcctttaaatttctagccatggcttttcttaagaacttcacattcatatttccattcacttagtggattcttctcccttgatggcttgcagaaacttgaaacacatattctaagacatgcattctcattccccacatccactctctaattgatacatgtatgtctctcctgctaaactgtaagttttttcagaaattcaggcatttcacttgtctttggtctctgaaaatctggcctagtccctggcacaatgtagatgctcagtaaatatttgataaattaatgatggaatgttgttaacaaatatgcatttggtattattaataaaacttgagaaatgccataatgtaattgcaagtggagcgtaaaagcattggttttaaataaaaaccttcttttagttaattatacccaacatcaaatatccccaggatgttttcctgagttgcctttgatgtacctctggcttgatagaagggcagtgctagaggattttgttatttgacccatgtttccaagggatgccagaatgaaggcagattctagaatatagctagaagtttttgtctggagcttttggtaataaatcaaaatgagatacagtactcactgggtagcaatagtggtgtcaggtgcgtaactagtgattttagtcaagtaagctagtctgcctacaggctttaatggaatcgaggtccaacagttcttccattaaagattaaagtaactgacagagacagattgttaaccaaactttcttctcattttctctttgaattattaagctaaccacacctccacccatatagctaatgctatagtgctctcttaatcaaaaccaaatcttaaatcaatccagttcacctcgactgttctccttcattttagtgatgttagtaaagatctttatccctgaagctacgtttcctttcccctccgtggcacacatctcatgaaagctaatttgttaataatatgttaacatttcttggaaccagttagctttagaaaggagaaaagcttaaagattgcagttctttaccaagcagcaatgaaagaacaaagagaacctcttctgtttcttaaaggtgtactattatttctggtgcttgtccacacctaatttgtaaatcacagttgctttccctaacagcttaaagtcattaactctcagtgttgtacccggtgcccacttctatttcccatgggtttcctaatagtccctgtagtttccccaaatttgagcagctcctagcatatatagaaggctctcagggagactgtgatgaatagataaacagcaagatctaatttgcctttgtctgtgttgaaatttggacaaacaagaaaatgactgcttttctccttttaaataaaacactttttgttcctcctacctattccaactctctggaagtctaagaaagagtgtcagtacttgccgtaattttgtatttgatctcactaggttccctccttgacattcattgacatcttaaaacaacctattggaatggctgccattatcctaataccacacacttaagtagtaaatctgggtttaacttgggttggtggatttcagatcctatgcccaagattgctacatattatggacatcttttcacctaggactgatcaagtgtggaaaattctgccaagtgttggcttgctcgtggagaggtgtgcttcttccctcattttatgactttatttggcatctctttttagctctgatattatctccttattgtataaacagattaaagttgtcattctccttgattaagaagatttcaggagaggtgctctgagaaagtgtagtggatagaaaatgaatcacaagttgaatgcaaacagaagacagaagatggacttagaagggcaaaatatggacagggagatgaatgggaggagagccagatgcaaagaatattatttcaagagattagactatagaaacaagtggatttagataaaccaggtagatgtaaaaatcacattctgaaaaggatttttggttaaggagaattacaagctacataaaataggaaaagaaattatatcatatttagacctttagagatatgagaggaggctgctatgtggaatttgtttgacttacaaacatcttttgtattacccttcactcaaactcaagtgctagaaataagaaatgattgttgaataactgggttttaaaagatatgaaaaacaagaagcaaatagaatgatagctaactttaccattttggtaaagttggtagtcatgagctttaccaacctgaagaagttggaactcagtattttgctatattcccaaaccctatgccacaatcagttcagcaggtttaagaaattgttaaaagagtcctgagtgtatgagaatgcttgttatcttgattttttttttttagctaaactgaacatatatgaggaggcaacaatctcccataacaaattccagatatgaaaataattcagcataattatcgctgtggaaaaccaaatttggtctggaataaaatgcaaagaaattagatagtgattattaatcagatatggtccggtggacatttattaaataaatccccactacgtggtaaaatgaacatgaactacttcagccaggcaatgatgctgccagtatactcgattaaattcttcaaagtgtattccattttcttccctaagacaatctctttaatttctcatctaattactcaaacataatttttggaacatgtcacattccacaggatgaacttacaaactgccaaccccaaactccttttatttaaaccacagccttacaaggttgaaagcacagtaacaggccaaaagacattttttctcgaggccgtgggatgtggccagataaatgcttatagtcgttgcatttgctgacttgctgttttgctggcatacgttcttcaccgttccatcctacgcctttgttctgagttaggttctttcctgtaaactattaagggatctgctagcaatgagctattttctttcctcttgctgactcatatataactttagcaaactcaaaaccatttattgttaggtattatgctaatttaactaactgctttcactgtcaccattcatttctgcagtgtgctgaacagctaagttttttgcccttaattgataaataaattggggagggcggagagaaattaaatttctatggagcttactttacttcagaattaatgccagcagtttcccagctgtaatttgatatagagactcctttagttattgtagttaccaagacaaaatgtaagggacattagcactggcacagtctctcctagtgactgaggcatcactagaagaagtaagcaccacctctttcccttaatacggtcatcctaggaacagttaattttctcctaatggttaaaaacaaacaaacaaaaaacaatttctatgtggatacatttcaagagttttttaatcgataggaaagctaaacactacaggacactatcattttcatggattttaattcaatactgttacttgaatatgtgctagtatttcccagggtaaaggatatgaagagatacaatgaatctctgtggccaccatatttattcatgttctcttacatacatgagtttctttcagtagatcaacaacgcaagcgtgggctgtaatctgtagaataatttgatgcaggtagtttatgtgagtagaagttatatagctttttggtgaaggcaccttagaaggttagagcagtaacggtgggggtgcagagctgctctgtaattatccacataactttgctagaaattgcttgtgataaaatgttcaattagaattattgctgcttgttccagtgaagataaagaactacagagaaatactacagagtgaaatataattaatgttgacagtaagaaatgtatgtgttttatgtataaagatgtcagtgtccttttcagacacatttgccaaaaggccttgtggtgagctctcacacagaatgcacaaagtatcataggtggaacatacttttattgaggacagtacaatttccacattgttagtcatttgtccaataagtatttgtgaacaaaggaaaatggctgtggctaaatatgcatttaatcgagaccttacagctcttgaagtcttttaaagatgtctcccaaaacatgattttgcaagtaaagatcgtttcaaagatgttttctttttggagaggaagatacagaaacatcacccatcacatattgtgcaaatgaaccaacaaataaaccgaatcaaaaggaaatgagggagatgataatgaaggttacacttttggtttatttctatatgcataaagtggcactgttttgtatctcctatatgaaagtcgtactactgagtcaatgttacctgggcaggtgcattgtattgtgtatttaattacagtgttaaatttctacttatttctaaaatttgctcaccccacaccacacccacacacgtagtcttctctgggactgacaataggcatgtccatgaagcaggaggaggttaaagtacagacaatgaccaagaaacacatccacataaactagtcagcccatgaggggactctgtgacactggcaccattaacatcagataccaactcagagtcccacactgacttcagagaggctcacagtacatccaattgagaaggcctcctgttgcattcttgaacatcatcggaggatgctgatttctggcttgtcatggatgagagacacatatagatatgtgaccaataataattttatatgaaatttaccattacattaaggcatacaagtaattaaaagtaaactggaagagcgtcagttgcttatatttttgaattaattttcaggtcctgtggatgtcaatattctagctaagtgtaacccctgcctatcaaatccgtgtaaaaatgatggcacatgtaatagtgatccagttgacttttaccgatgcacctgtccatatggtttcaaggtaagtaaaagcactttaagagtcacagtttgagagcataacttttcttggtgtgcctttattattctactgtgctttctgtatgtgccaagaactacttcactcgactatacttgccccttcttctccaggggcaggactgtgatgtcccaattcatgcctgcatcagtaacccatgtaaacatggaggaacttgccacttaaaggaaggagaagaagatggattctggtaggtcattagtctatgaccatctgtgtctgaagtattggagcaaagataactaagccaacatacattttccttttcaaatcaaaggacagtatttttcaaagaatttgagagaaatggcaatatgtattggtccctctcgtagatattgcaatataaaaaataaatggagacactacagcattctcagcacaggatgctacaaaaccaaaactaatttacaaacatacacatgtgcacattatggttaatcaggtcagattagggcaagacaaagtattaatattggctccattatactaattaatagccaactagtcccctactgctagtcatatattcatctgttgttttgcttattgctttaacagacagtgtgtaatgacaagatataggtcccactgaaacagaaaattaacgatttatttccaagacacaatgtaagtagacagacttgctgtgaacgattttaatctggagttatttaatcatatggtacaattacttcagatgtacttcatgaattatgaactggagctctttattaaatgacactaataatgtcacataagaatgctaatatactactaaaacttgttagaatttcactttttagaagaaatagacttcactgctgcattctattatgaagttctctcttattcatctagactttactcaaaaattattcgatacatactcaagatagttttatgccagaggaaggattgtatttaagacaaagagaacattcacattttgtaattgcaaggaagacaaaattttgttttcggattttttttttcaaaacatcaaggacattataagtatgttagtagatattgcaattttaaagatcagaaccagttcctcttcatttatgagcaaagaagcctgaattattttattagagcacaactcaagattaagatatctagggctgtggaataaaactgcttgtgttttagacctgcaaatacagtgggtttgttgacttttaagaccatggaaccatttgccttcttgcaaccggcataaattttattttttgaagggtttctgctttggtggatattaccttaaattgatgtttacaacatgtcagttaaaagcattttaaaaaatcaatttctggtagttaaaagctctatggttgatgagtgtaattatgcttttttcaatatttagaccacatgactttaaaatgcaacaaaaagatgttttttgccttttctcctctggcattcaggtgtatttgtgctgatggatttgaaggagaaaattgtgaagtcaacgttgatgattgtgaagataatgactgtgaaaataattctacatgtgtcgatggcattaataactacacatgcctttgcccacctgagtatacaggtacaaataataggaaatattttgccttccatcagtatatctgtttgaaagcatcattggaactatgttatatatgtttagtaaatctttttttatttgataaatggtaggtgtcttgaaaatcagatgtaatgtaaataacataaggacttaaagatagtttcagctaaccaaataaaagacccaggaatctctgttcaaacatacgcatctattataaagccatgctatccagtaataaaagaagctattttgctaaagcttttagtcccacaattaaatggcatttttgtgcaaaccattttccctgtgcaaaccaatccccagtacctgtgtgtaaagaggacatttatttaatagccaaaacataattaagcttttgagatcatttgtcttcatacttgtgtcttcgctagtgagtatttgcctctagtaacccatgtccctcaaaataaaagtcaggaagatattgagcactttggatagtcttataagactatcaccttttttctaacacttttgtttctttggatgacacatctcattagagtattaattgctaaacttcctccctattcaaaccaatttgctctaaagtcaacatcaagtttatgacttgtctgttttgtcagaattgattttttatttttattttttgtggctccgaattagaaacttcatagatatgctctttttcctttaataaattacttaacattgacaaaggaaaaacaagaaagttgtacattttatttgtaagaaaaaaaatggagaagtaattttgatcactctactcaaagttgccgttttcattttctgggtgcatttcatttactatgtctgttttcatataatttaatacatagcgagaaaatcaaaggatgaaattacaatgcaggtgactggagttaacatctcataacatgaaagatgaacatacatctgtataattaaattttcccagggatttgttggaaaattattaaaacggaagcttttatggaatacccaaactgaactttactaggtacctttcttgatgggaaaatgctaggtagaataatgaggctcggttttggcaacccagatctgtttgagtgactctgaaggctgccttttctagggtcttatttttaatttttatttttttggcaccaataaagcacccaatgtcatgtaaagcagtaatagcatattaagtttccagtagaaatttgaacgtgctgtattaccaagtcttctagtagttgtctatggcccttcgactgcttagtgggtggaattttagcattatttgatattttacataaacaaagaatagcaagtatattcaacatgcacctttctagagtatctggaaagaatgtaaatgttatgtagctttgattttcacactaatattaccaatattatcacacctcagaaacttgacttggagccctttgagctgcctaagaatttaacttcattggatgggctaatttagacttctccaagaagcccgatgtttgcactaaaatctgctacctggtaccttcttaggatagaataattctcttttccatcattttcctgatcattatagacagggcttaagaacccagttaattttggaggcctccttaaaccaagccactgtcactgcaccagacaaattggacccaagcatttcaagcaagctttgcctaaccaatgcacagaaccaggaatatatatatatatatatgtatatatatatatatatatatatatatatatttcctgatgaaaacctaggctttggagcacaactgcaatcaggttcttatgtgtctttttgacaataaaatttctagaaggtggttgaggactcttgagttggtttggaggagtcctcctgctttgactttagatttgctattccttattcttatccatttcttttgagtctttgtctcacctgctcacccttcatttccccagctccctccctacacctgctcctcttgaacacatgttttctcctattctaagtgtcagttcagagcagtttccttggagaagtgttatgaagcctcacttccccaactatgtcagatctctttctttgaaacatatcataaatacctaaagcttagccaaaccattttttagccaaaatgtgacatctataaaagctgtcatctgggaacttgccatgagtatctgtcaagagccatttggctctccacaagaactgggactgttttagtctttttacttataactattgcaaatgtcagtttgccttaatttgggcaaagaatcaacaaaaatactaaacagaaagtgcatggcgtacagaacatgaagatatgaccattttatctttggaatgggtcttgtgggccatgaagagtttgacaatttggcatgagagaaggtatctaaatggggcaaatgtataactcatctattaattgtagtatttttgtgcacacatgaaatgagctcatttacaaaatttctaacaaccatctgcggattttgaaatcattgacacataagtgacctttaattatggggaagtatgaatgaggctctagagttttatatcctacttcatccaagtctgcagttaaggaggaattttcttataatgtgattatatggttttaaatttgagtttggaatctgattaatgagcatgagatctgggagcagaagccctgctatgctcagggaatataatagtgttgtcagtgtttaaaaatcatcctagtaacaagttgatttttcctttgaaaattttttattctatatcccgaaagcatacaatgagaagtgaactctgtttaataagaacaaataatgacttacagaaaaaaagcttgtaaattattatggtgacagtttttgtatttgacacctatgtcaagagtcagaacggacattatgtcaatggaaacaaattcagagatctgagagcaatctgacagagaagttatgatgtgatgaacagactacaaaacgtgactagaaatatttaaaataaaatgagccaccaatggggaatttattaaacattgtttaagccctatgtgaccaaaatatcacagtaagtagttactgatttgttagaggagaaaattctctgctctttcctgctccagggattgacagcatgaattgtaaggacaagtactgtttttctgttatttaaatattgctgtaacttcaccaccctagtcaccaaaaccattctccatatactccagttatcatctgtgcttccagttgtgtaatgcatgactgccgattactagtatattttaggtaagattaacttttgaaaagttgaattcactatgaatctaaattaacatccctatactattaagaaagtaggacttcagaattgttaaacaaataattttaaaattaaatttaaggttttaattgtagcttgagagaattttgttgattttgattttttgtttggttatttttttaaaatcatgatcatcttctttctaaagacaagacatttcttggagctaaatttccaaggaattcctgaaataacataaacctaacacctatgcaaataaaaactataaatgtggcacccctgtttttttaaaaaatggacactttttttaggctgtagtgttaacttaggtgtttaattcaaaaatgtgcttttgtatatttcccaacagtcagaaccctggatctgctgtatcaagactgtgtgtcttaattaacttttattcttacaggaccacatacaagtatgacacagttgatcacattttaagcccttctttcacttaatgggattacttaaattccataaagtgaacatctccatgcagattgggtgtgtaaagccttagaacacattttgtggaaaatattcagaccactttaaattttccattgtgtacccattttctctttgttttccgaatctctgacgcccatgcacaagccattcagtgtccatcttaaacagtaaaactgctggttgttccatcacctggtttagacgcagacctctagctccctgtgatggcatttaccttttgcctcattttctccatgtttgtgcgtgtggcccggctgtaggtaagaaatccaagccttgcttcagcttgctcgcccacccctgcttctctgttgtgaacgctgcgcattggcttcctgtgctctgctgttgtattgcaatgtaaaaagtcttttgtctcttctgtctttgtcgctgccagctgctaatctgaatgaggtggaaaaaggttagttgccttttaagtctattatgattttcattttagtctccctctttcttgtaaagttacatagatttcactgcgggtacacagtaaaaaggaatgttgacaaaatataaaatctgaaaacaatatgccaaatcagtcattcagatgtttaatctatgcatcgctatgacaaacagtataaaatgggcctctgaaatgcaatttatctattgttagaagacaatgaatagaaactttttgagtgggaagaaggggtggctagaataagggactaatataaatttttttaattttctacttgtctatattctttcactttttaaatatatcacaaacatattatttttggaatgaaaaacataggttatttagtactgtagataaggctgtagatagaaaaatttttaagtaagactgttcccataactttaagcaaatatctttagtaacatgtaacatgaaaaatatttgaaggtgtatacatttattgaaacactttatgaaataaatattataaagcccaagaagttgacttataaatttgtgttataggataccgtgactactaggtagtatgtttaagcataaaaatgccatatttaattattggcgtcaatatgggccaccaggctcccaaaatacatcagggcccaagaacgtgagtcatagaattattttatttatttatttatttatttatttatttattgagatggagtctcactctgtcacccaggctggagtgcagtggcgcaatctcggctcactgcaagctccacctcccaggttcacgccattctcctgcctcagcctcccaagtagctgggactacaggtgtccgccgccatgcttggctaattttttgtatttttagtagagacgggatttcactgtgttagccaggatggtctcgatctcctgacctcatgattcacccgcctcaatctccccaagtgctgggattacaggtgtgagccaccacacctggcctgagtcatagaattattagagtgatagccatgtctgggaaatcatcatggaatatttatgaaatgttatcttaaagactcagagttttaactaattacattggatttttaattattcagcttaccaaaagtcttcaagtaccaaatgctggcacagtgtcctaaaaggaacacaacgtgtgcttgtcttgatagctccagttgtatctgaagcatttgcagttggattatgaggataataaggaagttatagactgggcacagtggcttacgcctgcaatcccagcattttgggaggccgaggcaggtggatcctttgagcccaggagtttgagaccagcctgggcaacatggtgaaaccctgtctctactaaaaatacaaaaatgagcagggcgttgcggcacaagcttgtagtcccagccacttgggaggctgaagcaggagaatcgcttgaacctaggaggcagaggttgcagtgagccgagattgtgccagtgcactgcagcctgggcaagagagtgagactcgctttcaaaaaaaaaaaaaaaaaaaaacaaaggttattatatagcaggtctctctgtcttctcttgctatgggcttcatttcctctgttgcattgtttggatgatttactgtgtttgctgacttactcttacagtgtgcagagttaagttgaaaacaaatggtttcatattttagaatgtaacagtataacatgtgctattctctgtggattaatgcatctaataccttcctgggtcaaatggcttcttttctctttacaagtactaagcaattggtggcctgggtcagggatgtctaaggtctgagtctatctcagaaacataatagcaattattccatcacaggaatatgtccttaaattgttgtgtatactcttagaaacaatcttggcagtacaagtgttttaaatcgccatgtggtttcatgtgttgactaaatttcatgcttatgtttataaaagctcccttttatttccaagaatttgctgctgactgaatttgcttttaaaagcagtcaaatcattctctatattttcaattcaaaacttaattggaaatagaatttccatttttttctagcacctgggggaattgtcttaaataaaaagaatgtatatcattagtcgatacattgttaatttaaaagaactctgcagtttatgtgaacaacacaaaggtgggaaaaaacttctatgaaacaacgataaaccacttattcaaggatatgcaccttgtaagtagaggcccagatgcaaacccatgtctcattggccccaaagcatgcactttgaggtgggggcctctgctggagcctgtcccttctgccttgctgcctccttccaggcacggcttcttttctatctcacaatagcttatttctcattcatgatttatgccaaacaagctttccttctgctctcctgctgtctcttcagctcgctgtgcacaattgtccttatgtaaggaaagctgtacccacaaaattcaagtgcagccaagccgtctattttatctagataggaaaaaagcaccgaatgaatgcctgtacaattaatgaataaattccccccgagaactaggctaccttttatcccataaggcaggtggttagtttgtgtaggtaaggggaaaagttcgggtttctcttcctggcacgaatatttataaactctgggacacctcccagtcttttatttttcttctgtgaaagaggaataatgatatctgtcatataattcacatagacatttgagagtaacatgtaactatgtatcggaaaacactttgaattggtaaatgtctatactctggaaatatcgaaggctgccctgtaagacaggtttaaattttgcatcatttaattccagccatcatcactacagtgacatggttcagatatatttgatgccattcctcatggcagaagaattcttatgggaattctttattcaattttttataaagaaaattacctaaggtaaattatgtatagaatggaaatttctctccccatattgttcagtattgtctgtctttattattattgtttttaattgtactttgtatgctcacttcgtatagaaagattttatttagggataggtctttggttctctttgcccccatacactactttgaaacataaagaaatacacaatgctgaagagctcttggatttggctgagttggatttgtagattttgtgtatatttttagattttcatgatctcttagtaacagtgacttctgtttttaattctgcttcgagatgtgtaaggtctttatatcaaggtcgttatagttgcggacacacttgtgagcctcaaataagggaaacgttaagttgccatctgtttttactagagagaatactttggcagcctaatgatactatgtggtttgtattcatcctccaacctttcaaaactttcttaaatgcactttaatctcaaaaaaaagttttaaagatcttgtttgctctttagttaataggcagtgcccattgagcccagaacaacaatttagcctaagcaagtcttattcaatctaatttgaatttatttattttgaaaactgagttaaatattttctgaagtttcagtagctgctggaattggctatattatttagcctcagtgttccaataaggaaatgctgaaaaacacttcattttctgtttgtttatttggagaggtaagttttttttttttcatttaaaaatataccagatgcttattgagaaaatatattatgcaggacaccatgctaagtattgaaagtgatacaaaaatccataagacattaccctgatctactgagcaaaaactctttggctttgattctttactgcaagatcagatcagttcaaatatttctcagtacataaccatcacttctcacattccaagaacattaataatataatatagctactttactagtttgtaagtaaagaaaaacactccttctgaatatggacaccgaccaatctccctgacagagtcaagcaactcatttcataccacttagaaaacaaaaataggaaccgaaaactgattttccttctttgaaatgtcttaacacctacatttatagcatattttcttgaaccttcctattttgaattatgataaacttttatctcacagggtttctctatggcagcattccgattatgtacgtgtcccattttgcacctattgcacacaaagatcacatctgttaatggctaatgtatcttactgggcatctgcctgtgttactgtgttgtggtgcctgggattataaccttgagtatgtaacaaatagggcctgcctggtttagcaaaagaggagaaaatatacatacttttctttcaggtccaacttaatgaagctgccctgtgatgactcccataatctcatcagctatatccaccctgtgctatagatcatcagtctctctgccacactgcatggtctgtaggagtagagagaatgtttctgtttctataaataaagaacaaatgggaaatgtatactttttaaaatcagaattggatcgaatttataaaatttggtaatgataaacattcaggtccattcatcttaaccttcctcaaacattccacttaagtgctgacaagtgcaatttcttgataatggagctcatagtctccatcctccattggaatggtaattgttaggcataaaaatacagtagggaaatctggaaatgaacagtctacccatctcatccagcctgcaagggcacacctcgggctcacatctcagaacacaaatctgctatcagttttttaattctctctttgcttccttacattgttctttatgtgatctgggtctccattaacatttaaaaagcatttgcctgcaagaagcaatcaaataagtgctatctttcctatttttttatccagcactagtttgtgccactttactagcgaatgcaatgggaatggagaaatacaaaaatataaatataaaggtatcccatgccctcaagtagtgtacttttaagaaactaaatcatattttttatctattaggttgcttattttgatatcttcccttgctgagttaattcaaagagaataaaattagtacatttattcaaatctttcttgagtttgactgattacatttaacactagaattctggtccagttattcagattgccatcctaaatttctccttcattattatcaatattaataattatttcttataaaaaacagtttgttacaagttacagtaggaataaaaatgggctgcagtatcagctccagtaccctcgccacctctttcgtacatctatgatatccagaatggactcagatttttatctatttcaaagagagaagaagctaatctagttacattagcagaaggtagcaacagtagcaagagttacgtgtgccagcaacaccatgtactgctatctaaaattattttgttgtagacatgcccaatttgaatttaaaaagctaactttggggaaaattaaagagagatactcaacatccatttagtgtaaaacaaattaatatttttaacagtgatttgagttggaaaatttcagaaatcttaatctggggacaaaatgacccacttttttgataagcaggcttccacctttttgataagcaggctttgaggactaaataagcctagatgagacatcccattgcccagatttcttggtagatagaaagcaattaatagtccagccaaggtgggcacagtagctcatgcctataatcctggcactttgggaggccgaggcaggtggatcacgaggtcaggagtttgagaccagccttgccaatatggtgaaaccttgtctctactgaaaatacaaaaaaaaaaatcagctgggcgtggtggtgcgtgcctgtaatcccagctactcaggaggctgaggcaggagattactcaaacccaggaggcggaggttacactgagctgagattgcaccactgcactttagcctgggtgacagaacaagactccgtctagggaaaaaaaaaaaaaatagcccagccaacaattcttcaaaactttcctgtctgtaattaacacagcttatttagcaaagagaacaaatctctttggggtaataatgtatttcggaactgtataatatagtttttaataataattaaaaataaaaatttcattcagcccagtttctaggccgggatgctacacatatgtcagtcattaaggaaacttaacggacagtaggaaattagatgttgatcttatttctctaaattttccatataggaacttctccagggtaaagctttgtcatactcatccttcaatcatttgctagatctagcacaaaaaatttctcccaagatgtgtaatgaaaattacactaaagcagcttttgttggcgaaataaaaaaacctcactctgagagagtacatgtaaactaattatataatcagtaaatttatttttaaactattcttactcatttcgggaaacatttattgttaactctcatggaccatatactatcttcattattcattcatttgtcaaaaaattactatagttaagaaatttcaacaatgcttaatgagttaaagcagtattttttaaagaaaaagtacatttaagaaatttgacagtatgtacaggaaatgtaaatcaactcaaatattctccaaataatatatattatatatatatttaatatgtaatatatcatatataatatattattatatataatatatattatgtatatattatatattatgtatatattatatatatatatatatatttgagaccgtgtctggcctaggctggagtgcagtggcatgatctcagctcactgcaacctccgcctctcaggttcaagcgattctcttgcctcagcctcccaagtagctgggattacagatgcgcaccaccatacccagttattttttgtattttcagtagagacagggtttcaccatgttgacctcaggtgatccacgcacctcggcctcctgtagtgctaggattacaggcatgagccactgtgcccggttgatataatgtaaagtaataaaacactttcaggattatttttatacttaatgatagtatatatatatattatacgtgtgtgtgtgtgtgtgtgtgtgtgtatgcacataagtagttaataattgcagctgttaaagttcaagatcatctgcaaacttaccataaagctgatggcacaggcattcgactcactttctcttcttcaagacacagtagtctatgattctcttgcctttgctgtctttaagaccttgaagaggagaattgttgttattatttggtggatagcctgtcctgcaagccctaactgctaacaccagctcccctccaacagaggagtaagtgatgattggtccaagtcaagcacaactcacagtgctttgcagagagacatctggccacagcagcaaatgtagagctaatctacactactgtgctccacttacatcttgactctcttgaagcacggggagccttgtcatggagcactccttctcctttgtgcaccgcttattacagactgactgttggagaagcttatagtcctaaaagaaaacttgagacaaaggagaggacagctacatgaaataaaatgagaggaaagagacgtaaaaatgaaaaaaagaaaaagaaaaaggaagaaatagtggcataagttgaaagttttattccccgctgtaaacttccagtgatttggaatttactacctgtattgttttgctagggctgccataacaaattactgcaaactggaggcttaaacaacagagttttattgtcttacagttctggaggctagaggtctgaaatcaaggtgttgattcctgccaaggattgtgagggaaatgtctcttccaggcctgtctagttggcttctccctgtttttcatatcatcttccctctatgcctgtctttcttggtatccaggtttccctttttgataacacaagccatattggattagggcctatcctaatgactttattttaacttgatttcctcagtaaaaactctatctcaaaataaggtcacaacctggggtactagaggactcacacatattttgttttgaggggcacaattgaatcctcaacaccacatcactgtattttaaactctgtttgcaccagaaaacctggtcttcttccactgttctccatgtcaccaaaaggtaattcccaatataggtacccaaatcatagacattctagacaactccctttctctctttcccccatgcttattcagtccatcacaaagtcccatctgttttgcttcctaaacactgctttgggccatgtatatctccaccccacccctaccctgtacaagtggtcacctctcatgtgcacttgtatccccacttatgcaatctgccatcctccactggagacagagttctctctttctctctctttctttctttccagaatttcgctcttcattgcccaggctagagtagtgcagtggtgcaatctctgctcactgcaacctccacctcccgggttcaagcaattctcctgtctcagccttccaaagagctgggattataggcacccactaccacacctggctaatttttgtatttttagtagagacggggtttcaccatcttggccaggcttgtctcaaactcctgacctcaggtgatctgctcgccttggcctcccaaagtgctgggattacaggcgtgagccactgtgcccagccagagtgctcttttcaaagtgcagatgtcatctggccatgccccgactcaaaacctttcagtgggagcctattattcatagaatgaagaccttcgaccctgtggcccagccagcctctggggctcctctggcaccatgttttcccgggctcactccccatctcttagggctcctgttcttcatgctgcctcctgcagaagcctctgtcagagctcttcattctccacttcacccttgcctctgagtctcacctcttcagaagaatctctcctgtccttcttcagaggaaacagtccctttctagggccccataaaatgttcctgcttagcattcagcacagaggcaattttatgcatatagtagtcccctcgttatctgcgggtgatacgttccaagaccctcagtagatgcctgaaaccacaaatagtactgaagccagttgctatcaatcagaacatgtttctgttcatgtctttcaacccacacactgaatccctcttcatcccaagtaagcccttagcatgcatggtggctgtaacttttgcagtttgaggtatgacagcaaaactagtatgaatttctttttcccttgttcacaactttgcagagataggagattcatttttgcggtagatcttagcatcctcagtgtacaatttttctctctttccttattaagttaagaacttttaccttttcacttaaaggaagcacttgacagtttctcttgggcttgtccaaattaccaacatcactactcttgcactttggggccattattaagtaaaataaggtttccttgaacaggatgactgtgataccacgacaacagatttgataactgagatggctcataagtgactgatgggcaggaggcttcttcagccagataccctggatagagataatttacgtgctgggtgtgatggagcagaatggaacaagatttcaccaagctactcagaactcatgcaattcaagacttacgaattgtttatttctggaattttccatttaatatgttttggccgctgttaacagtggggaactgaaaccacagaaaacaaaactgccgataaagggggactactttacttgggaaattactgaattaatatctttctcctcctcctctcatacataaactctgtggaaataggaatagtttgttgttgttgttgttgttgtttaccattatacttctagcattggtagaggtccccattcatagttgggactcaaaatatatggtgatgttaaaaatctgatttgctgttttaattatttgaaaaagctataggcagatcattctgtaagtatcagggaagagctttgtagaatagttctaaaactatttcagtaagtatggtaacaaatttaaacacaaagataacaagatactaggaaggaagtagaaatgaaggcaataggaagggcccctttgtgttaaacaaggaaggagcattaaaaacagttaggttcaggccgggcacagtggctcacgcctgtaatcccaagactttgggaggctgaggtgggtggatcacagggtcaagagatgagaccatcctggccaacatggtgacacctcatctctactaaaagtacaaaatttagctgggcatggtggtgcgcacctgtagtcccagctactggggaggctgagacaggagaatcgtttgaacccaggaggcagaggttgcagtgagccaagatcatgccactgcactccagcctgggcgacagaatgagactccatcacaaaaataataataataataataaaaataaaataaaaataaaaaagttaggttcatagatctaaaatgaagcagaaggtaaggccaaactccaggtattatttctcataaaaaccatcaaagtgcattgaggtttcttcctcagtgcaataatactcacaatatcagtaccacagggggctctgaacatatgctggcactttatttttaccgctgaatgaagtaatgttattttgtacagctaagtgtgatactccctctggtaacttgctgtctgcatgatccatatcttcagaagcattttcctttttattgaaaaaaagggatttttttagagccacagttaaccttacacatctctaattccagagcctcagtttactgatgaagaactgaggctgagaacaataaaatagttctgcaaccagtcaactctcgtatattgcatacaaccgtagaaggccatcctagacaataatacaactaaccaaatgtcattttccccaataagaacagttacttcctgaggtctctttatgctgattcactcttcactccagagtattatcaactctgatgatccagctttttactgttccacctagaaggtgacccataacatttatcatccaaatcagggtagttatgtgagtgcccaggcacactattgacaattacgttgggacaacgggtataaaccaggacggttgtacaagcaagaatgaatgggcacattaccactccatgaaatttttcagaagaaacacattcacagatattcagtaagtagcattttatctccccttcaagagtgagtctgaaaaatcattcccatttagaagagtgggtatcacttttggcatgctctttcacaagttgtaatagtgttactgtagaacttggtcatttcttgtcctgttgtgtcccatatataaccgacagacaaaatcaggaagaggtgatctaagaaacagataaaactctatacctgtaatcccagcactttgggaggccaaggtgggaggatcagttgaggtcaggagtttgagaccagcatgcccaacatggtgaaaccccgtctctacttaaaatacaaaaattagctgggcatggtggcatgtgcctgtaatcccagctactcaggaggctgaggcaggagaatcacttgagcctgggaggcagaggttacagtgagccaagatcacgacactgcactccagcctgactgacagagcaagactctatctcaaaaaaaacaaaaaacaaaaaacaacaaaaaaaaacaacctctatgtcaaaaagattcctctgtttacaacatgtagcactttttcttaagaaagttctggcattcgcagatattggttaccagcaatatttattaccagttacagtagatcatttactaacctctcttatcctgaagaggtaaccatagaccccttgatggaccactctttgttttctcgccaaaacatacacaaccaacatatatacgtacactcagaatgcttcaacctcttatcaacaagagatgaaaactagaatcataaggaaaattaatttgctcatctgatcaaaagtgaaatcacaaatgccaggcaatgactgtgttccacactattgggaaattttaagggcccatggctgaaaataaataaataggatttcctgggatttagaggaatgggttgaagccagatcatggagtcaaggcttgcctaggctcctatctcttgagaggctcatagacaccaacatttaacctatattcaaccacattgccccaaaccactccaatggattgacttatctttcttgatgtcagtttaaacgtattaagacctgcttatagggtaatcatttacaacactaactctgtatagtcgaataaagaatatttccagttttcctttctgtcacctcacactttatcatctctgaaagggaggcagccattgataatattatctcaggacctgagccatcacaaaagcaaactcaattcccctattttttattatttttccactaactcagtactagctctgactacacttaaaataaaaaccaagtaaaaatggcatcatgtcctcacaatactatgaggtttgggggaacttttcaatattggtaactaaaaatacattagctgactaatgttagtcattttatctctattcttcctggaaaaccagtgcagcttttagctgtctaatttcctcttactggttgagaagtagacatgcaggccagtattcatctaaggagcttgctaagtttcccttcttatattgagctcctgaatctcgccactgttgcactcttttgaaagcggtccttccctcaagtatagcagaatccaatataattaaggaaaattaaagaaacagtccaatgaaaacattcatgttaatatttagtcagggaaaattcacagtaatgtttaaagagaatagcataagctatgttattactaatcatgagtgagtaattaagcaaaaaattacactaatctctaaaggctagaatgaaatctgagttgattacaggtcaacaagatagagctcttgccttaaaaagcatgattcctccttttaatgactattatttgagtatgtcagcataccacactctggaaaaaacacaaaagcaaatgtggcaagaattctactcttagtgattttacagtcgagaaaagagagtcagataaacaccagtaatataaaatgcacacataacagtgcaaccctaaaaccttaccttatatgcttgtaatgaatattaagtgactgcatatttatacagtgtttaaaactgtttagcatacagtagtaagcatgatataaatgctcattaagtacataaacaaatatataccatgtatatgtcataagataggcatagtcaaacacaatataaaattagagatagagaagaaatagttgaaaagatctggcatgattccataaagaagggaacatataatggatgagaaaagtgacaacagaattgtgaaaggttgttattaaagcaaaaggagaaaccattagccctggcatggagttgaaataaattcaggaaatagtaaacagacccaggtgatatgaatgtcgggtggaagattggtctttaaagcaagttaggcagtaattggatgcagaaaatgtttttgtaatatttgttagcattataatgttcggtgataataaagaaaatcaaatctttttttttttttgactgctcttgtcacccagaccggagtgcagtggcacaatctcggctcatggcaacctccgcctcctgggttcaagcgattctcctgcctcagcctcccgagtagctgggattacaggcccccgccaccacacccagctaatttttgtatttttagtagagacagggtttcaccatgttggccaagctggtctcgaactcctgacctcaggcaatccgccctcctcagcctcctaagttcggggattacaggcatgagccaccatgcctggccaaaaatcaaatcatttttgacgttgtcaacctatcttactaaggtcaggtgtatagctatgtaatggtcacaaagaagtaccatatacaatctcagtaatgattattgctattttgctactcttggagaggtaaggaatacttgacattgatgtagttttttatgttcaagttggcatgcttaatcttaaagctgttgattagagatttaacaatctggttagctaacagtttcttggaactttgtccttgttcactcctttacattatcaagtctgtggagtaattccttttagacaagggtcaactctcagttttatttttttagagatgaaattctctgtctctgttctttccctagctcaagactttctctgctggtagattaagaactgattaggagcagagtccattacattcatccttgtagctccagcctctagcacaacatcacgtagtaaatccttatggactgtgacttagattggatgaattgggttggattgtatcagagtaaataaagaataaaacatttccctttattataattttaaaacagtttcttatttaggcataaagtgaaaagtacataaaatgacatttattatgtatctcaaatggtccttctttactatcagtttttacaaactgtcttggatagatactactataaacagcctatatctccatcagatagatttggttagaaactgaaagtgatttcatcatagtaggctgataaaatatgatgaatgcatttcatcaaggtatccaacttagagtaatactatttgaaatcacaagcctttaaataaaacctgtttaaaaatagttcatcatgcatatgttgctaaaaatcttttgtatcccagaaaacttatagaagcaatatatgagacttactgtgcaattagttctttttaagagacagataaaaactaatatcatacaccagattgatgtaataactagatgaatacatttattaatttgcatcacgggaaaagactcttgaagtctaaataatatgccacatttagttgtcaagcaatgatttctaccaactagcagtgtattattttaaaaggatcatcttgtaacaaaggggtgctgttacaaggtgcacaagcctgaaattttaaccgatgctgttacaaatgacagttttagtagtttcctggaaatgaacagctgcctatagatgtgtcactttatttgtccatttattgcatataaaacaattcaaaagtaggagtaaagtagaaaaggtaaaaataacttaaaatgtattatgtaagttaatatatattatgtatatgaatacctttccagtcaccttaatactttatgccacaattgggaaagtcttctaaatgaaaattacatttggtctaatgtatgtgaaataataaccatgttatttttatcagaagaaattttctaaagaaattatcagtcatgtgattcaacaaagagtacctagaatctgcgtggttatgccttcagctctcatttgttgatagaagttctatttcatgagttagctgactttcatggaaaaaatatatgttccctgtctctgtattgagtctccttttacttttttctttatatgtcagaggatgtggctctaagaagttttctgttgagctgcggcaatgatccacaagaaggaaaccaagtgtttttcttatagacttttaagaccagagactatgaagatttgagaatatttttttcaaacataaaactatagaataagccaggcataaaagggtacatatggaatgatttcatttatgtcaagctcaaaaacagtcacagctagcctatggtcttgtcatgatagtgatcctctttgcagggaccggggggaaggcttctggggtgctggtacatggtgtgtttctagatgtgggtgctggtgacctgagtgggttcagtttgtgaataatcattaccaatttattcatcctttgggtctatgctatatatcaagaaaaaaaatccaaaataaacaacgccattgaaaagcattcagatttccttttcctaattcccatagtatattctgagggtgctcatattagtcacagatcacaatagtcctgttgtccaaaatcacaacactacttagcagcagactcagaattggataatggaccacctggttccatgccttgtggcttttgttttgggttttttgctttgttttgttttaaatcacaagctgccctaacctctaagacccatgacaatgacacagtctgctggcaggaagcctgttgacctttttctatgagctaacactgtttgccctgttgcaggtgagttgtgtgaggagaagctggacttctgtgcccaggacctgaacccctgccagcacgattcaaagtgcatcctaactccaaagggattcaagtaagtcaaaagctacctttttgctcacagtcagggtaggggacccattattttaggagcccttctcctccttcatccttagcttcacacctctgctcaggattaaagggacctattcactagtatcagtgacattttttaaatgtcgatatacaatatggacttttttttttttttttttttttttgagatggagtctggccctgttgcccagctggagtgcagtggcacgatctcggctcactacaacctcctcctcccaggttcacgccattctcctgcctcagcctcccaagtagctgggactacaggcgcccgccaccacgcctggctaattttttgtatttttagtagagacggggtttcaccgtgttagccaggatggtctcgatctcctgacatcatgatccgcccacctcggcctcccaaagtgctgggattacaggcgtgagccaccgcgcccagccccagactttttgtttagtacactaaagaaaaatgaaaaagtgtttccttttcatccatgattttttttgtgaagtcacctaaggcaatgagcagcctttgaaaatgcttacttaaatttatttgaaggcccaaccggtgacatttgtaatgtcttctatgtgcttcattgtctgaaggtaagtctgtggtaaaatagagaatttgactttaatgtaattgaagatgttacggtctgaaacaatgattggactatccaaggtgagaaagatagagtgaccatatatctcaggctgccccagggagtcccaggctatgcctgtgatgatcactgtagttattgatagtgtctcttccaacttaaatattttttgcatggggtgacaaagcattataatcccgctaagtgtactcccttaagtgaacacagaacttcaaaaaacacttcctttttcctccccagcaatattcctgaaatatgtttgctatgaaattacgtgatttctttgccaccatcctgtaatattttaagggtctttcaacagcaacttctctttttagagctggcagtagtttagagatcatctagtcttcatttaaacatgaggaaaccatggcccggagaggttagttgactgtccagagatcttaaggttatttattggcagagctagagctaggatttatacttaccagttgggtgatttttctactatgtgttacctataagaaattttatagtttattaacattacagttggtattgtgtagcaaataggctggattcttaggaattacacagtcgggtacaggggttgagctgtgctttcatcagacagctagcaaatagcattatctgttccttcaagcaatatttattgagtgcctgccatggccacagcacatggtaataataccatcttatgattttgtagtcctttatagctattcaccttcacttaattcatcttcttagagaaatgacccaagctcaattgccatagaattcagggaattaacaattacacaggtcgggatgaattttataagagaagatggaatttgagctggattgctaagatatttgtacttaccgaacagatcatcagatattttaagtcgggtgggagagtggggtcagaatcgccagatccccactgcttttcaaatatcaatctaaattaaatatttattctcaagctttcttttgacaatgtgcttttgctttaatttggtttaaaatccaaaaatgtagaatatgtaggtacagttgtagcacctgctaattccctacaatgtctttttgaaaaaggaaagaataaatttgattctattttgcattatattttagtttacaaccctaggcaaaaacccagtgttattccattttcactttatacaaaactttacattatattttattcaaccaaacactgtaggtaagttgtttttagtcttcatatcaatgatgcgctcacaatttaatttggcaaattgaaaacacatcacttacataataaatatcatttcttagagaaattagctagtaaggaaagttttccagaactgctcatctgctgaacagatgtcacagtactttgtgtattgtaagtataagataaagtattagtaagacttaactgaaactattagaaagtgagtttgtctgcaaaaagactaatccttaattaaatatctcctctcgccatcaaataaattagacactcttaaaagtgcattttgctgcattatggactaactcatttggaaacccactgttttccattatagtttgtaagctcgtttcatagctgtatgtaggtagtttagcagaaaacggttaggtcagtgtgtgtgctgttactcccgacattgtgggaaaggtagctgtggaaagaaaatagacgtaaaaatcaaattctgtgaagctgctaaagaaaatctctactgacaaatgttgtttagacaagttatgctatgctacttcaacttcattttcttattactaagctaacagagctggttttacttttattgctttattatatacctcataaatctcccaaattgctttgagatatttttagactatgatatgccataagcagtattttcaaacctgcatcttacatagccagctttgggcttctaaacagtgtattttatattctttgcttcttcctctctccttgtcagataatagagttgaaggaatgtgataggttttattgataatacaaactcaggaattcttatttaaatttttctttctgttttgaaactcagtctgaggagcaaaagaaagacaaaaatgttggacataatgtaactccaagctctaatggtcttgaaaaatagtatttggagagaagggaatataaaatagctcttagacagccgctatggtggatgtgttgttctcttatctttcactttgatttcttttttcagataaataattcagagtgtttcaaagcatttcttcttttttttaatgcttggcacttcaacagctctgctcacattaacattgatggaagttctcttctcgggccttgtccatctctttgagaatgtatatggccacttagagtctatttaacttcagacttgttgtttactttgctttgctatgatttagcattaaaaccaactggctgcaaagcaagcatgcttatgcagtgagctcattttatttcttaattcatacatgcagagctgaaagtctgtttgctactcttagaggctatatactcccatttgttttaattcttccgctctccagcaactctcaaatcctgatttagcattttcagacaaaaccttaggcattcagtaatgccacattcacttgggtgtttttaattatccttacttcaaatcctaatagctttgaaatagaaaagtggataattaatacagactaaaccataaaagcttttatagaattataaagactatatagagaattattttaaaaaccagccatttatagaacgtgcattatatataaaaactatactaattaatttacagatggatgcgtttaatctttaaataaacctgtgaggtggaattatatacgtgttaaagatgaggaaaataacacttacagagattaagtaatttagtcagtattatatatactttatgctaagtgaaataggccagacatagtaagacaaataccggatgatctcacctatatgtggaattttaaaaagtcaaacttatagaaaaagagagtacaagagtggttaccaggaattggggtggggaaaatgggaagatgttggtcagtggcacaaattttcagttacaagatgaataataagttctagagatctaatatcacagcatggtcactatagttcatactgtattatatacttgaaatttgctcagagagcagatctgaaatattttcaccacaaaaggaaaagggtaactatgggaggtgatggatatgttaattagcttgactgtggtaattatttcacaatgtatgtatgtataaaacattaccatgtacatctttaaaatataaagattttatttttcaattatacctcagtaaatctagaataaaataaagttgataacatacaattaagaatgaagccggggtacaaacacagttctgtaaaacctgaattctgcaaagcctgaattctgcagagctaagttatagttttctcatatatacacacatatatatacacatatatacatacactgctacatacacaatacatatgtgtgtatgtatatgtatatacacatgtacatacatatacacacacatacatatgtatgtgtgtatatatgtgtatatatgtacatatgtacatattctgcaaagcctgaattctgcagagctaagttatacttttctcatatatacacatatatatacacatgtgcatatatatacatatatacacacatacatatgtatgtgtgtatatatgtatgtacatgtgtgtatatacatatgtatgtatgtgtgtatatatgtatatgtatgtacatgtgtatatacatatacatatacatacacgcatatgtatgtgtgtatgtatatgtgtgtatatatatatatgtgtgtgtatatatgagaaaactatgacctagctctgcagaattcaggctttgcagttatgtgtatatgtatgtatatatgtatgtgtatgtgtgtgtatatatatatataaagtcagtgaaccctctcttaaactcaaatcaaaaacactcttggaagccaatgtgtaagcctaataaatcacaacaggagagtgttgaggaaaaggtggagggtagagggaggcttccagaagacccctcctcatagatggccatacctgtagggattctatggtcccctataggtccacagtgcagtttgaaaactgctgcacgtgccacactgcctttcttcatgcagctataaaatcctgcatccttggtatcataactagagatcccagtggtcagcactagagaagtacaggtttaaagggagcctgtggaattaattattcaacagcatagtgcagtggttagaaatacaagctttcttgttagattgcttgagtttgattcctggctgtggcacttagaagttgagtgtttgggggcaaagtacttcacctctttgttccttagtctcctcacctgtagagtgggcaaagtaataccacgaatatcacaggactgtggagaggattcagtgaatccatagaagccacatggttagagcagggccagaggaagtgctcagtgaatgtcagctgtattattactcctggttcctcaccatcaatgcagccaagaccctttaccaccatggtgaacaggctgaaaactgtccgtgggattggccccgtgaattttctatcagttcttctatcctaacccattatgtcagtcccgttcttctataatgagtatctggattcattgtgaattagggtatttaatattaatatatttgcttttcttaaaataataccttgttctgatgtatctagtctctattgtaaaattaaaaatgttaatctttttttaaatatgtttaatatttccagtaaattttacaacatagcacttttataatctcaatgatcaaatggattaggccaaactgaaaatatagggcactgtaagcaaacaaaatggggaaaaagaaaggaaggaagagggaggagagtgggtgggagggagtgaccctgctacaattaccctgttcttatttgggctgtggatgttcactatcaaggagataaaatcactatttctctggtagatcacagtgatagaacatggaacatactgcagaacagttcgattttctaggtatccattaatgtgggggctctatgagcctattctaaataagtattttaaagatggtgccattgtgtctagataaaatgcattgtttacttattttggctcagttgggtttgaaaccattacctgcttgttccaacagatgtgactgcacaccagggtacgtaggtgaacactgcgacatcgattttgacgactgccaagacaacaagtgtaaaaacggagcccactgcacagatgcagtgaacggctatacgtgcatatgccccgaaggttacaggtaaaagcagaaatgaataagacctagtgttcaataagacctagcacaacagggtgactatagtcagtaatagtgtaatcgtacattttaaaataactaaaagagtataactggattgtttgtaacacaaggataaatacttgaggggatggataccccatttaacatgatgtgattattatgcattacatgcctgtatcaaaatacctcatttaccccataaatatatacacttactaggtacccacaaaaattaaaataaaaaaattttaagacaaaaaacgtagaacttacagaagcaaagagtagaatgagggttaccaaagaggaggacagagggatggtgtttggggagatgttggtcaaagggtacaaaatgtcatttagacaggatgagtaagtttggaatatctgttgtacagcacagtgatgattttgtttaatagttaagaatacttgaaaactggaaaaacaaggaagtgcacatatataatatacagttatgttatacagctctcaattcagattggcaattaagtaaaatcgtattaactaatttttttttctccttattcttcagtggcttgttctgtgagttttctccacccatggtcctccctcgtaccagcccctgtgataattttgattgtcagaatggagctcagtgtatcgtcagaataaatgagccaatatgtcagtgtttgcctggctatcagggagaaaagtgtgaaaaattggttagtgtgaattttataaacaaagagtcttatcttcagattccttcagccaaggttcggcctcagacgaacataacacttcaggtaagagatctctctctatggagagatgatcggatcttaaaattcagcttcagagaataaacatttgtggtagcttctgaatgattgatagtatgtcttaaatagacagttaaaaacagaaaatgctccttgtgtggacagcgttagtaatttttctcttcaacatttgtattttcaagacaaaatgaaaaacaaatatttttattcattacttgataagcagacagtaaaaaaaaaaatatgtctctttgttttgtgctcagacaaaaacatttgattcatttgcttttatggctctgcagttcagcctctgcatgggggaggcttttcttaggaaatctgcagctaggaagggtgcaggcgagaaagaacacctggattcaaccaccagcacctttttttttgttttgttgtttttttttttttttgagacagagtcttgctctgtcgcccaggctggagttcagtggcgtgatctcagctcactacaacctctgtctcccaggctcaagcgattctcctgcctcagcctcccgagtagctgggacgacaagcatgtgccactatgtctggctaatttttttgtatttttgatagagacagggtttcaccatgttggccaggatggtctcgaactcctaacctcatgtgatctacccacttcggcctcccaaagtgctgggattacaggcgtgagccactgcgctcagccaaccagcaccttttaactcttcacccagaactttgaagaattgacatgaaattaacaaactcaaattttaagtctttccaccaactcactgtatacctttaagcaagtcattcagatccctatggaagaagctgcactagattaaagataataaatatagtgtacatggggcaaattatgtctacatatttgttttatctgataagcaaaatcatttaatatatttttaattcaaatgactttagccagtttcatgtagacaccaccccttttttggtttaccctgatactctagtgagggacaggggatccttttgaagtcaggaagaagagaatcctggaaggcatgattctctaccttccagtgtttgccccaccaaattgttatgagaaccacacagtgatgttggggcttaagtcttaacttagctaattaatcctttaaaagccaaaatgggccaaagagcaggataaaaacaaagatttccccctacacatggcataactgtgaagaatttgttgtttttaaatatgagatataaaaatccatctttgacaatgtagtcatttttcacagatgctataaataaagcttataacgggagcaaaaggagcagtttagcgaaaatctgcagcaaagaaagttctaagcacatccaacatgtttacttgaggatttcttattgttctttttaagtttcttcatggatttatttgcaacaaagcaatttaagaacaagtcacctttcaaggaataatttcagcatcgttttctcatagccatcaggaaaacataaaccatagtaaaacctgttcacctcacttagcagtctctttctgatcaaatacgtttggttgcgtacacatcctagtaatgccagggttactttctactagattgccacagatgaagacagcggaatcctcctgtataagggtgacaaagaccatatcgcggtagaactctatcgggggcgtgttcgtgccagctatgacaccggctctcatccagcttctgccatttacaggtgaagatctctcagttacgggtaaaggtgaaaaaaattgcttaatgaagaactgcttctcctctatcattttattatggagaggagagagactaagttggccccagcaggttttaggatgagggtattagtgaaaaacctggcaggaacagagggcatactcaaactggagagtgtgaggagggatttgtaaggggactgctatgcacaaagaggtgactgggatagtatagtaacctggggctggaaacaagggatgcagggaggtgttgctacccatatgcctgaaggatcaagaggagggagcagttatggaaactcatgctctgtaaaggctttgtagagaggcttgcctgccagaagcctcgacctttaatagacgtttgcagtaagttctcaaggaaacaaccagcttttgaaatacacaacctcactctctttcctcccaacaatctcctgtctgtgttccccacgggccacactgcatgccgggaaagaaggaatctatagactctagtaatgtagcttgcacatgagcttcctggggctcagagctgggtaaagaaagttggaagggagctccagagaatcaaatgaagatatccagcactgtgagtaacttcaggttgccattcatacctcagaggtttattgagcacttactatgtgccagacctgtcctgagctttaaggaacaaagcccctgctcatttggaacttacgcagaataagcaaatggattcatacaatgttgtcttagggaatcttgaccatccattttggaagttttctaatgattaatgatattaataatatactggagacgtgaaatgggtggtattcgtggggtataatttttagtccttattgcataagactaactatcagagcccctctgttggaacccaacaccaattccctaacatcctgcagacaatttagctatttaattttttcacatgtagaaattcaccctttagagaagggatcacaaactcctaagtagtcaatttttccagataagtaacataaatgattaaagaggtcaagtgcaagaaaataatatgctctcacccttttattctgtaaaagatctaaatttttacataagtattattttattataaatagccttgatgttggcaatataaaagaagtggttgtgactggaatgaaccaatagtaaatatttgtcaaaacaggatttcatctactcagttcttcgtggagaaaatatggacttaggtttttccaaactcttgacttttcaggaaaaaggcagaaatctggggtttttttaatataaattttctctcctttagatatcagtgtgcatttttaatactatatataatgaacaaaacatatctgtaggtcagacacacttggcaacaaaagaataggcattgattatgacataaagtggagacactggcctgcatgttattgatattctcatatgtatcaatgtgctttaaaagtctgcacatcttatttgatgcttcataatagttctgggaaagtacaagccacttgtagccatgaatggaatttgatatccaccacttgtgaatatttggagcatggaaacaaacacataattattggtttccaagttgaatacaatacttattttatctccaaatggtgatgaattagtgccaagattttagatattacgaggccttaaattttcttgcctcaatgtgtttcagcccataaaaagatttcagaaatttgtggttcattttttttaatttttttttaatttattttatgtaatggtgcagcacagaactctcagaagccatagtaaaggtttttggtttggcttattaaagctagcattcatatcacatatggcaaaatatttctaaatactttgtagaaacccaagtgattatatccaaacaaggacctaccataacgagtttgtttgagtttatgttcattgccatttcacctaacaaaggatggagtgtatcttgtgacatttataaagggactattatgttgcattttttttttttttttttttttttttggagacagagtctcactcagtcacccaggctggagtgcagtggtgcgatcttggctcactgcaagctccgcctcctgggttcatgccattctcctgcctcggcctcccaagtagctgggactacgggcacccaccactatgcctggctaatcttttttgtatttttagtaaagacgtggtttcaccgtgttagccaggatggactcgatctccaacctcgtgatccgtccatttcatattctttattagaagctgcaagcccatgtttctggtggtggatcatctaatagagatacaaaatgtgaggcctagagcaaatacagctttaatttaattattgccttttggcttatgaccaaaaaaattttcttgattttccaatccagaaaagctatgaccttattttttaataaaagaggcaacaattaccaagaattcagatatgtagatatgtataatacattttattaacatattaaatatagaatattatttttatattgagaaaataatataagaaaaaaggaagaaagaaaggaagcaatgaagaaaaaagaaggaagacaggaaggaaatgtaaggaagaacaagttcaaaggagataaatataagcacttacattttcatgtatttgcacaaagaaaaactagacacaaagaaatagaaacaagacttctgcatgaataccattttatatccatttgatttttgagccatttcaatgtcattaccactcaaaaataaaattgaaataatagaaaaagctgctgttctagagatagtctggcttgattcaagtccagctctgttatcaactaactgtgtgtcttggacagattgcttcagctccctgggcctcatctggcaaatggggataacaaataatagtgtcctttttgtgagattacggtaagaattgtacgacatgataaatgtaaaatatttgcaacaatgctaggtaaaccataaacaatgatggctactggtatcacaaattcaggatgtccaaaactgaatttatttcatttgcttcacccaaacctgtgttcccattgcattccttctttcattgaaaggcatgacaggtgcaatggatctactcttaatcctctcctttcctttaccttcaatttgcagttttacataactcttagctctgatacggctaattttttggccttttttcaaatgccagaaaatgccaagcaaggcaacctctgtcctgggccaggcctttactacagtgtaaaatctttgatgaaagatagtacttctccatccctgtagtaaaatctatcaataacagtgttgcaatcagctgtcccattagttgctaataaatattttgtctgggtgaagtacattttcaaattttgatttgtttccacttaagttcagttttattgccataattctatgttatataaaatttactttggtaaaacattgttttccaaattttgcattatttaatatattattgggccttgcacttggaaataattttatacctcaggtgcatcatttcaattgcctgcttaattctccacattgaagaaaattgattttattttagcaaaatgaaacctaataaaatgaggggaaagtaataatacacttattaattctatagggtatttttggttaaaatttattttatatgtcaactattgtttcacataaatcagtatgaagacaattattttatgaaattatctctagactggtaatttgctgcccttcaaaaagactttcttttaatctagataaggggaaacattttttacaaaagttaatgaaaaatatgtgcttctttctttaaattcaaattaatgtcattttccaaaccagacagcctctttgaaaacacagccaactatgttaaaagttaaaagacagtagttaacatagcttgaagtgtgtttaagaaaactcaagatgtagtaattattcttttagcgtagaaataaagtagtatgcatattttctcatcttatctgttacatctggatagaagatcatggcttcttgtagacatgcctgctgttaacagcaccaagcatacaggcagtagtgtagaatggttgtttccaaaagtctgcattggaatcacctgaaaaacatgttaaaatacaggcgttgggcaccacccctagtttctgattctgaagctcttagctagacccgaaaatttgcatttttaacaagtttccaggagatcttgtactccagggactacactttgagaaccccttgcgtaaaaggaatatgtactttgagagctgattgtctgcatgtcttctcatatccaagttctacaacatcatgcttgatgctcacattgaaatcagccatattgggaatattcgcaccacaaaaatcagcaaagcctacaaatccaggtttttgttcttgttttttttttaacagtaccagttgttaaacatttgccagcaacctactgcctaaaggactctaaccagcaacatagatgaaatgagctgcctaataagggaatggatttggaatatggcgcacgggcctaatatttacagcacttagagaatagcataaagagggacttagtaattgtattagcctgttttcacactgctgataaaggcatacctgagactgggtaatttataaagaaaaagaggtttaattgactcacagttccacatggctagggaggcctcacaatcatagcagaaggcgaaaggaatgtcttacatggtggcagacaagagagaattgagaactaagcgaaaggggaaaactccagtaaaaccatcacatctcgtgagactcattcgctaccatgataacagtatggggaaaaccgcccccataattcgattatctcccactgggtccctcccataacacggggaattatgggaactacaattcaagatgagccaaaccatatcagtaatagtgccatgaatgaatggaaaaatgaatggcagcctaaatttaagcagtaggtcctcagacagggctggagtattaaatttttattctcaagtaggctaataatctgctctttcaaagtgagtttcttttcatctagaaaaacataaactttttttaacaaaagttattattgaaaaatatatgcttctttttttagattcaaattaatgtcattttccaaaccaggcagtttctttggaaacacagctagctactgtttaaaaataagaaaatcagatggaccaccttactagtgtacagtttttcatatttaggcaacctgctcaaattcaggggactttctgtcacctactgttacatttggttggctacatacactctgggttgtgcaatttacaggcttacatttcaacaaaaatacaaaagaaactcaacaaagattatctttgtatctgagaagttcagtctcattggggagacagagagtagacagaatctatatggtattcttgttttcaagatgtttattcagccattcttgatatgccatatggaaagttccccctgtttactagcttataaccttgggcagattgcttcatttctttgtgctttattttccttatctcagtaaatgcaattagctctgcttttcatgtttggttatgagaattgaatgaatgtaaagcacctaacatcgtgcttggcacagagtcggctcacgatattgagtaatgctgatgattcatggatactcttcctgctcaaatatctggatactgaagaataaatacccaagtgggaattttatagcctgacatctcactgtacagtatgttcaagtttagagaagcctttctagtttagtgaattttattcatgttaatctgttttaaaagtactgattaaaatattacttgaacaactattttctaaagctttcttttgaaaaattcttacaggtatatttagatatcttttctttttggagacagagtcttgctctgtcgcccaggctggagtgcagtggcgcgatctcggctcactgcaagctctgccacccgggttcatgccatcctcctgcctcagcctcctgagtagctgggactacaggcgctcacccctacgcctagctttttttgtatttttaatagagatggggtttcaccatgttagccaggatggtctccatttcctgaccttgtgatccgtccacttcagcctcccaaagtgctgggattacaggcgtgagccactgcgcccagcctacatagatatctttaatctcatttggcttcccattccttttgactaaagagataggcaagaatacttttagtatcactcccacttcacaggtgaagtatcatcaggccagaaacaccaaaatgagatgaccagttgagtttgggttccagttcctattccaaagcgtggaatatgtcaccagatactttaattttttttttttttttagatggagtattgctctgtcgcccaggctagagggcagtggcacaatctcgcctcactgcaacctccacctcccgggttcaagcgattctcctgcctcagcctccagagtagctgggattacaggcatgcactaccatgcccagctaatttttgtttttttactagagacggggtttcgccatcttggccaggctagactcgaactcctgacatcgagatccacccaccttggcctcccaaagtgctggaattacaggcgtgagccaccgcacccagcccagatactttaaaattttaaggcaagaagttgaagctcacataaggaaaaacagtcttttattaaactacagaaatacattatgtttatcattgttagtgtgttgtgtgtatgcaaaatagagaaagaaaatcagagacattttaaagcccctcttttaagccccaagtttctgaattatttttctgtagcagaccacaaacagttggggaactgctttgttttcatgtatccacttccagtatataaactcaagaaaacaaatctcaggaaataggtgagcgtagtaaaactaaaccttatagtaacagtaataaatgcaattcaaattcccagtggaaaggcccaaagttaagtggttcgcttgtagtttttgtgaatcataaaatatattgttccctagggagtggtgaaagagagtttatcaatacttatcagaacccaaaaggatgccatgcattacatgtgggtatgtaggagacagctgctatagactgaaaagtggattatggctttctagctcaggcagtcttactatgtagcaactgatgtgtcgatcactgcttttattttattttatattttattttattttattttattttattttattttattttattttattttttgagacagagtttcactttgttgcccaggctggactgcagtggcacggtctcggctcactgcaacctctgcctcccgggttcaagcaatcctcatgcctcagcctcccacatagctaggattacaggcacccgccaccacgcccagatgattttgtttgtattttagtagagacagggtttcaccatattgcccaggctggtctcaaactcctgagctcaagcaatccgcccatcttggcctcccaaagtgctaggattacaggcgtgagccaccacgcctggcccactgctttaattttaaacgaatgtgtagacaaaggattcctggacatcctccagtttatctcatgctagaaaagacagcaagaaataccaagttagaatgttattaactctgaaaaattctctttaggtcccatgtgtaaaatactatcttaaaaaccaaattggccagtcatggtggtttacatctgtaatctcagcactttgggaggccaagccaggaagatcacttgagaccagcctgggaaacatggcaataccctatctctacagaaaaatttaagaagtagctgggcatggtggcatgcagctgtggtcctagctacttaggaagctgaggcagcaggatcacttgagtccaggaggctgaggctgcagtgagccgtaattatgtcaccgtactccagcctggctgacagagcgagactctgtctcaaaaaaaaaaaaggaatctaaaatcatgaactttactgtacttacctgttaagaggtcaagatgaggcttcatttaattccagggagatataaatggaattaatctcaatgataagtcttgtggaagttctggtgtgatcagattagacatttaaagcttttagggagagaaaagtatagtcagtctatctcactcataatctcactcataattgggaaaataaaatccaaactcagtttttaaatccatataatttatatgcattcttcaaactcttattgtaagatcattacttttattaacaattcagtgttttttagtaaatgaatcaagttttgctatcatacaaggtaatttactatagaactttattcccaggctatttgggacagaaatcatgtattaaaagcttgttagtggtgaaaacacacgccatttgtctaggaataggtattcctcaggtttttgattgtaaaagtagtgcataataattaagagcacatacacttgagctggacaacctggcttcagaactgtttagccactaactagatgtgtcaccttggatgtcctcagtgctcacctcttgttgtgaagcttacatgaggtaatacttgtaaagttcttagtacctggcccttagtatgtgatatataatcctttgctcttcctatttgcacttctcttaaaaggaagaaaaatcacctaaggtcacactaaccaaagatgacatgtctaatgagagctaggacaagctgagcaagatttatctctcagcattatccttgacgatactgccactgaaacttccaactatgttttatgaaatgaattttcagaggtcttgtcttaaacatgcttgaagtgtaatgattatctatagatatcatctaggagtattgctaaaaacaattgatatatgttattcctaatacatctctcttgtatttacttaccacatattttcagaaataaataatacatggatgatattttaaattagcttacaattagcaagagtttaagacatgtactccaaaaaagagtaaaaaggaacagaggagggaataaaggagcaataagcaaagtgagttgatgatgaaactacctacctccaagttcccatctgacacactgcattagggtgtttaaaactgtaaagtgtgttaacttaaaccacacaattgtactgcatcaaacaccatcattgatgatgacatgactgaattgactaagaccaatatgtgaccaagaatccattccttggtaatatatgggtcttttctttgcaattttaaagagaaatggggggcctcattattaagatttattaaggttgatgttgataggacatccatataaaactacttggaaagctgtgtataacctcaaagtaaaaaggaattcacttctactctctccatgtctgtctttattttaatgttttactttaaaacttttagtaacttgaacaagatgtgcccccaaagaagttgttatatttctgccagcctttaacattatcttacaatcaatatttaaaataaagctaaattctttactaaaaaagattcagaaatggtattgaattatttgtatcatgatgatcgtggttgggtgggggaccgatatgatagtgatggtgatactaatatctaacattaatttttgctatgctgggtatctttcagtcattttacatagtcctcaaattaaccatggaaggcagaaatatttattagcatttactgaagagaaaactgaaatatattagtaataaagtaacttatctaaaacaaacacttaataaatgcaggaccacgattcgaatccaggattatctgactacagagtctatatgcttaaccattagccaatgttactacttggcataccctcttagaagagagtcatatttaaaaccactaatggtgtgcaactatacttataaaataattttctggtctattttttcctctgccaattgtattgatgttaagtgttaggataattaaatgtgtaaaaggcaaaaatattgattgacatatctaacatttagttttataaagttgtttcctgagacaggctatcaaagattcctgtacacgtggactcttctaaccacctaaacagaaagaatgtcaagtgttttcacaattctgcagagtgatttctcttgttctcaaatcaaaaaaacgttttattacctgtcagcatacaacggaagatgattagactccagtggtgagaaccatgcagaaatatgttaatgcatttttctatcattccctagactttgccattttacaaatttaaatatcagtgcctagaaatttaagcagtcatcttgtatacagagtattaagtattcacatttaggaataatctatcacatgctcccatgtttccatgttggagcctttttcagtcttcccagtatcccagcatgttagatctttaataatcaccattaactttttgatctcaacttccattatgccatgtttttcctgtatagggaaaggtaagtacgttcttaacactgcaccgtgtattggtcctatttcttctttggtcctgtttcattggtctggtttgcttttttgcctgctgtaacaccagagttagatatgcaactacactttaaaaccatgtaaaacatatttactaattgcactcaacttcatcttattttttaatcctcattttccatttacctttcttcatctttttgtctttattcacttcatcaatttctataagcccttccaaggtttttagaaggtgacagtaataattgttagacctggcccttgaaaattatagaaaagaatccagacagccactgtcattgcaatatttcctagatatcactatgttaagcattttatttaatctgttattcccatgtctccactgagcatagataacttcttcacagcaatatcagttgatgaaaatgcacagaaagtaagaggatattattaacaaatttcaaaaagtactgagatcccaccaagttgtttctccttgcatttgtgtgtgtgtttgattctggtaagtcctaatctacagttttttttaagagcagaagccagcagttgcctaaggtcgatgtgttagggtgtttttggcacaggcctagtttccttgtcttttcgtacaatttgaagtaatagtatcttggtaaatggaccttttatggaagttaaaagcaaatgtataaattatcctttgaaattgttacatattgagagaatgtggctggatgatgatgaaatgtagttatttctacttcttgtcataaaagaacaaacttattttgtattcagttcctgagaaactgaaatcaatcacatctccttgaaaatgcctatttttgaaaaaaaattcaactactcgtctttatcttcattagtgttagattgccatctcttttcccaaggagcacttatcaaagtttgtaatttaactaccttgctttaatgaaaagaaaatggaagaatcagccatttttttttccgttgtagtgtggagacaatcaatgatggaaacttccacattgtggaactacttgccttggatcagagtctctctttgtccgtggatggtgggaaccccaaaatcatcactaacttgtcaaagcagtccactctgaattttgactctccactctatgtaggaggtaagctgtcttccaaattcaggtggtcctgaaaccctgtgattctcattatggacgaattctgaagtttgttaatgcctaatatatcaggatttgtcattgaccaatagtgatcaatcattgaaagatggatggcaaagacagaacagaaagatctctaggtgggtgttaagggatcattttattatcccatctctctttctaacaaatgtgtcatctgggtagagaaagacattaattaatatttcttttgtgtcaatcacatatgctaggtgatttatacattatataatttaatcttatatttgatctggtctatggaaaaggaaagttggttagagattaaatcatacaatcaagaaaatgataaaacaagcttaatgcaaactggaaagtagatgaccccaccccagctcccttaaggaggcaaaccctatcagctcagtcaaatgttaccatgctggagcttctgcactaccagttgctaattcatctggatgataggataagtatcactgtaatccaatgactgactgaatgaatgaatgaatgaacaaattaaatgtacaaattgtattagaataacaataaatagttctgttccactaagaccttaaggtgaatgaacaagagagagggttggaaaggtaggttaggacttgaaatcatagagtgaagaccctgggctttatttttaagtgaaaagaaggcagatgagtgaataaatgagggacagagatataagcaaagttctgtaggagcccatcggagaggacccgcaaaggagagaggtcccaatcttgcctctatttggaggaacaaatataaactggaggcatagagtttcaaaattctggtaaaggagccagaaagcagttaatgctgaattgagaagcattggattaaattacattgaatttatttgaattgactgattaacttattttacagataaataagtaaaagctttgaacaggttagtgtacaatttcatcaccatgacagatattttcatgagtttcacatcattttctgaaaaataataacctatgctacaccattatctcaaccactcaaagccttcttttcagtgcctctaagcctaggacatttctgttttaataatttcagtagtagacagtcttaacattttgacagagttggattgttttagaaacagttggaagtctttggttcaattctgtaaatatttattgagtacttaccacatactaggaactaagtaaatggatacataaaggatataaagttgaagaagaaatgtccattctactccctaaaaagtcaagaatgcagaggcatcttcaagtaactataatgcattataaataaagtattgcatagtgagtctactcagcaagttgacttatctgattgcttcatgggaatcacagcagagagtctcattaaaaaccaaatcttccattcttgccagcactccagtttacagggttgcttttggatgggtgaagccaagtcacaagcatacctgtgatttgagagaaaataaattatatttattgagcacatgctatgtgcccaacacagtgctccttttatagccttaatgtgcagagatcttaggaaataggtatgattttctctgttttgtagtccctgaagagcaatctcaaggattttatataacttgtccaagtacacaaagctattatgtagtagacacctcatttaagtccagatctggctgactccaaagccacctgcattgccattcacttcttcacataaagcagaaagggaacaaatctaagtgctgtggccttttgttgtttatttatggacttttcgttcacttgattttattatgttttcattagaatccacttcattaaatctttcgaagcccctttagaatatagtataaaaccaattttaaaaatacagggggctgggcatggtggctcacacccataatctcagcactttgggaggctgaggagggaggatcatgtgagcccaggaggttgaggctgcagtgaaacataattgcaccattgcagtacagcctgggaaacagagccagacactatctcaagaaaaaaaaaaaaaaaaagaatacaggatgagactgtttaagtcagaacattcccccgccccccgccaaaaaaaaaaaagaggaaaaaaagttttaaatttcaaaatgaaaagtatttatccttctgaaggtagagggcctggaaaaattcaaacaacacctctgtccacccaggcctcaaggaaaccactttcatcccagtcccactgccagagatcaccatgggcccactttctccccgcttagagtgcagtctcaagggtgactcagattttcaaaccacaaggaacctgtaagaccacagccttgaatgctgtatggcaaaggcatgagaagcagagggagaaaaggagagcaaggtaactaagttctctttaaaaatagtgactacagctgggcgcggtggctcacgtccgtaatcccagcactttgggaggccaaggcgggtggatcacgaggtcaggagattgagaccatcctggttaacacggtgaaaccccgtctctactaaaaactacaaaaaattagccgggcatggtggcgggcacctttggtcccagctacttgggagactgaggcaggagaatggcatgaacccagtaggtggagcttgcagtgagccgagatcgcaccactgcactccagcctgggcgacaatgggagactccatctccaaaaaaaaaaaaaaaaaattatgtctacagtgagataccatctcacaccagtgagaatggctattattaaaaagtcaaaaaataacagctgctggcaaggttgtggagaaaaaggaacacttatatactgttggcagaaatgtaaattaattcagccattgtggaaaacagtgtggcgattcctaaagacctaaaaatagagctaccattcaacccagcaatcccatgactgagcatatagtcaaaggaatctcaatcattctatcataaagacacaggcatgcatatgttcattgtagcaccattcataatggcaaagacatggaatcaacctaaatgcccatcaattctagactggataaagaaaatgtggtacatataaaccatgaaataccatgcagccacaaaaaaagaattgagctgatgcccttggcaggaacatggatggagctggaggccattatccttagcaaactaacacaggaacagaaaaacacatactgcatgtttctcacctataagtgggagccaaatgatgagaacacatggacacagagaggggaacaacacacactggggcctagcagagggcggagggtgggaggagggagaggaccaggaaaaatcactaatggacattaagcttaattcctgggtgctgaaatagtccgtacaacaaacccctcgtgacatgagtttacccggtttgttatacggtaacacataatacactgttggtggggagtgtaaccctcatatacccctgaacttaagataaaagttaaaaaacaaaacaaaaaacaaaaaaaaccagggatgctgcccaaggaggactgcctgaaggtgttgcctcagcatctggggagaggcagccccttggtgagtatatggagaggcagcttaacctacccttgggttatcaactacccatgatatgtgctttacttgacacaattttttttgtttttctgagatggagtttcgctcttgttgcccaggctggagcgcaatggcacgattttggctcactgcaacctccacctcccgagttcaagtgattctcctgcctcagcctcccaagtagctgggattacaggcgcctgctaccacgcccagctaattttttatacttttagtagagacggggtttcatcatgtttggcaggctggtctcaaactcctgacctcatgtgatccacccacctcggcctcccaaagtgctgggattacatgcatgagccactgcgctcggccgacacaaaataatttagttttcatgtttttctgtctgtagtccaactgaacccttattacctaatggggaagaaaatcaaaaaataagccccatgcatggaaatccatgtatatgcaacaaatgtcctccttgtcctgccacgggacagaggacctaggcttgatacttggtctctttattgccattttgaggcctgtagaaataaggctaaaagctgtttgctaagttatctgttggttgattgattgattggctgattgattgaatgatttccaactaggccaatagcatagaggaaaggcttaaaaaaaatcatggatctggccaggcgtggtggctcatacctgtaatcccagcactttgggaggctgaggcgggtggatcacctgaggtcgggagttggagaccagcctgaccaatatggagaaacctggtctctactaaaattacaaaataagccaggcgtggtggtgcatgcctgtaatcccagcttctcgggaggctgaagcaggagaatcgcttgaacccaggaggcgggggttgcagtgagccaaggctgcgttcatggcactccagcctgggcgacaagagtgaaactccgtctcaaaaaaaaaaaaaaaaaattcatgtatctacttctgtttgtcaatgaagacctagcacgtgaaaagattgactcagaataattcctgattttatgatagcctattgaaactcaaatatacgtatgatgtctaaacattttcatttacaaattactctagtcaaagctgggctttttctaattgttagctttggaacaaaaaggaacagatttactaattgtttctctgtgctgtggaactttgccaatctgtatttattcttgacatgtgcacatatgtgtgttgtgcctatatcaaaatgagctattaaaaatagttttggaagaagttcatttttaaccactgaaaaaaggaccataaatatgtggtcattaaagtccttatgatggatggatatggttaaattagaaaaacttaccccagggcaaggaattttctgtcaccagtcctttcctggaaatggtaagtttcatccttttgaccctgctctagaaagcaacccacagcgagatggacatagactaaaggcctgtactcacagaacttcacagccaagagacttcattcaatacctgtcagagtgtaaccatggactacccaaatcacctgagctgcatgtagatatttagatttctgcacctctcctgttcctacaggatcagaacctcagaaggaggggagagaggagcctgtaaagctgcctttgagcatgcactgctgttggttcttatgtatgacaaacttaggacaacttctctggtccatatgctcatggtgtatagatgacaatactaagccccagagagaagaaataactgctccaagtgcacgcagaaccagaaatccttaccgtataacctagtggtttcgtacacctagctgtctgactgatgcctgctttgaatgccaatggatgagtcatttcctatgaatgggaaaggagaaggtggcataagttcagacccagagtgtgctacagttcttggtctttagaaccaacagaccccctgaagagtgagaaactgggtcttcctcagcctagaacttccagccagtagtccagagtttaggcacagctaaagcataattacggggttgtggggatgtggtggtatagccagcactctgaaagcttccagcaccctccccccttccctggatgggtgccttctgcaggatgccttccacggactaagggtctggcttaggccatggaaagattcttccgttttgccaaaatgagtgttaccagataactgtcactagtggaatgtatatatacaaagattgcaaatactctgtttttgaagggatttcatttttatttctgatttcttggactatgaagtcttcactcttaattagcaagaaagaaaaaatgatgtgaatgaggtgctgtcctgaaaagaatcaggagtgagtttttaggcattgacatcattgaccaagcttagggacgttgccaggagtgagctgaattagttgctaacttcgaatgtgggagggctggggtgaatggtcactgtgaaccccagctgtcagcccctgaaacctggtggacctaaccctgactccagagatagaggagttcttctcatcagcctaactctaacctgaactcactgggtcaccttgagcatgtcaccagggctttctgagccctagccccttgtctttaagataaggggtagaattagagcaccataaactgagctttatggagctccagacttccaggagtgtgtgcctggaggtggagggtggaggacaaacagagagggaacattcccttcccccagtcttgcctttaaggacagtagctctgcctctaggttttatatatttgtgtacatgtaaagttttctttgaagcaaattttaaagattaaccaccaatcaactaggtattttattctagttgtggattagaatttcctggagcatcttccaatacagaacaaaacaaaaacacacatctctacatctcttctccacttcacttccctaccaccctgcccaaatatcctgccataataggttggcagtgaggtcccaagcatcagtatttctgagtagcaaatggctcagaaatccccagagagcctgacctctgacctggtgttcctccccaggcatgccagggaagagtaacgtggcatctctgcgccaggcccctgggcagaacggaaccagcttccacggctgcatccggaacctttacatcaacagtgagctgcaggacttccagaaggtgccgatgcaaacaggcattttgcctggctgtgagccatgccacaagaaggtgtgtgcccatggcacatgccagcccagcagccaggcaggcttcacctgcgagtgccaggaaggatggatggggcccctctgtgaccaacggaccaatgacccttgccttggaaataagtaagttcctgctgcttgggagttgagcacacacctgaaagcctcaaagccaaaccaaaggaaggaaggaaagaagaaggggaggggacgggaagggaggggaggggaggggaggttcgttaggcattagcactctgtccctcatattttctcaatcatcctccattcttatatcacctccgttcattcttacctcctcttctgaatgcattcccactcctgtgttcctcctccctgtagatgcgtacatggcacctgcttgcccatcaatgcgttctcctacagctgtaagtgcttggagggccatggaggtgtcctctgtgatgaagaggaggatctgtttaacccatgccaggcgatcaagtgcaagcatgggaagtgcaggctttcaggtctggggcagccctactgtgaatgcagcagtggatacacgggggacagctgtgatcgaggtaagccagccccactgggcacctcattctcttggcaaagcaagaggggtcccatgtctttgaaaagagagggagaaaaagtgaaaaaaaaaaaaaaaacaggagcaacagagacagagagaggggagtgacaggagagaatactaggtcttctcactacttgcagttgctgctattgatttattttcaagtattttgaaggcaccagctgtgaaatgaccttaaacctccaccgcaagattgtatacagccttcagatgcttctcacaagttgatttgttgtaaaagaaatgctcctttttacctgatggagaagcacatttactttactcctgtcttacctttaccggctgttctcatccgtatatattattaattcatcttctggcacagagaagatggtcctcttaattctgctctagttttagtacaaaatgacctttggccttagaatcgactgatttatcacagcaaatcatgtgggtgagaggaacggaaacaggctgacttcttagttcaccttcctccttctcctttgtctgcgtgatcagagctcgcctggcctccagctggcacggattttgttttgtgtgtccaagggacgagacaagaggaacgtgcccatggaagcttttagcagatgtctcttttttgaactacatacttcatactggggtaatttatgaagttaatggaatgttacttgtattaagtaacagattggataatattaaactccaggtctaataaataaaatggcatactctctgaaactgctccctgtggtaaacaaaaccagctgttagtagtgtaaaaacagaagatgtgtactttttttccttttttgcaatgaaagaaaatatttaggaatccaattttcttgtcactgcaatagcattgtatttatactctacataatagcattcactttgctgaaaatagagactaaaaagaagtatttttcaaagaataggaggccgtgccaccagctaataatatgtaaagcaagttacaaaggggaagcaaaggcttctgaattaagttgtggattcacagtcactctgcatgacttacagtgactgttcttaaaatgcttgtgctttttgttcttttctagaaatctcttgtcgaggggaaaggataagagattattaccaaaagcagcagggctatgctgcttgccaaacaaccaagaaggtgtcccgattagagtgcagaggtgggtgtgcaggagggcagtgctgtggaccgctgaggagcaagcggcggaaatactctttcgaatgcactgacggctcctcctttgtggacgaggttgagaaagtggtgaagtgcggctgtacgaggtgtgtgtcctaaacacactcccggcagctctgtctttggaaaaggttgtatacttcttgaccgtgtgggactaatgaatgcttcatagtggaaatatttgaaatatattgtaaaatacagaacagacttatttttattatgagaataaagactttttttctgcatttg
